US012606847B2

(12) United States Patent
Kelsic et al.

(10) Patent No.: US 12,606,847 B2
(45) Date of Patent: *Apr. 21, 2026

(54) ENGINEERED VIRAL CAPSID POLYPEPTIDES AND USES THEREOF

(71) Applicant: PRESIDENT AND FELLOWS OF HARVARD COLLEGE, Cambridge, MA (US)

(72) Inventors: Eric Kelsic, Cambridge, MA (US); Sam Sinai, Somerville, MA (US); George M. Church, Brookline, MA (US)

(73) Assignee: PRESIDENT AND FELLOWS OF HARVARD COLLEGE

( * ) Notice: Subject to any disclaimer, the term of this patent is extended or adjusted under 35 U.S.C. 154(b) by 772 days.

This patent is subject to a terminal disclaimer.

(21) Appl. No.: 17/774,315

(22) PCT Filed: Nov. 6, 2020

(86) PCT No.: PCT/US2020/059296
§ 371 (c)(1),
(2) Date: May 4, 2022

(87) PCT Pub. No.: WO2021/092300
PCT Pub. Date: May 14, 2021

(65) Prior Publication Data
US 2022/0396808 A1     Dec. 15, 2022

Related U.S. Application Data

(60) Provisional application No. 62/932,650, filed on Nov. 8, 2019.

(51) Int. Cl.
*C12N 15/86* (2006.01)

(52) U.S. Cl.
CPC .... *C12N 15/86* (2013.01); *C12N 2750/14122* (2013.01); *C12N 2750/14123* (2013.01); *C12N 2750/14142* (2013.01)

(58) Field of Classification Search
None
See application file for complete search history.

(56) References Cited

U.S. PATENT DOCUMENTS

| | | | |
|---|---|---|---|
| 6,156,303 A | 12/2000 | Russell et al. | |
| 2009/0215879 A1 | 8/2009 | Diprimio et al. | |
| 2013/0310443 A1* | 11/2013 | Srivastava | A61P 35/00 435/320.1 |
| 2014/0050701 A1 | 2/2014 | Zhong et al. | |
| 2014/0341852 A1 | 11/2014 | Srivastava et al. | |
| 2017/0096683 A1 | 4/2017 | Scaria et al. | |
| 2022/0396808 A1* | 12/2022 | Kelsic | C12N 15/86 |

FOREIGN PATENT DOCUMENTS

| | | | | | |
|---|---|---|---|---|---|
| WO | 2001068888 A2 | 9/2001 | | | |
| WO | 2002053703 A2 | 7/2002 | | | |
| WO | 2003052051 A2 | 6/2003 | | | |
| WO | 2004111248 A2 | 12/2004 | | | |
| WO | 2005005610 A2 | 1/2005 | | | |
| WO | WO-2005033321 A2 * | 4/2005 | ............ | A61K 48/00 |
| WO | 2008124724 A1 | 10/2008 | | | |
| WO | 2013170078 A1 | 11/2013 | | | |
| WO | 2013173512 A2 | 11/2013 | | | |
| WO | 2015/121501 | 2/2015 | | | |
| WO | WO-2015168666 A2 * | 11/2015 | ............... | A61P 9/00 |
| WO | 2017147477 A1 | 2/2017 | | | |
| WO | 2017106236 A1 | 6/2017 | | | |
| WO | 2019006046 A2 | 1/2019 | | | |

OTHER PUBLICATIONS

UniProt_202406 database accession No. A0A513ZUC6_9VIRU by La Bella et al. 2018 sequence alignment with instant SEQ ID No. 2.*
Tseng et al. (Frontiers in immunology.Jan. 30, 2014; 5: 9).*
SEQ ID No. 2 aligment with Geneseq db alignments in USPgPub2013310443 Nov. 2013 by Srivastava et al.*
SEQ 2 alignment with Geneseq db access No. BCH00068 by Scaria et al. in WO 2015/168666 Nov. 2015.*
Gao et al. "Clades of Adeno-associated viruses are widely disseminated in human tissues." Journal of virology 78.12: 6381-6388 (2004).
Gao. "Adeno-associated virus isolate hu. 63 capsid protein VP1 (cap gene, complete cds." Retrieved from NCBI Database, accession No. AY530624 (2004).
Aslanidi et al. "Optimization of the capsid of recombinant adeno-associated virus 2 (AAV2) vectors: the final threshold ?." PloS one 8.3 (2013): e59142.
De Silva et al. "Single residue AAV capsid mutation improves transduction of photoreceptors in the Abca4-/- mouse and bipolar cells in the rd1 mouse and human retina ex vivo." Gene Therapy 23(11): 767-774 (2016).
Perabo et al. "In vitro selection of viral vectors with modified tropism: the adeno-associated virus display." Molecular therapy 8.1 (2003): 151-157.
Wooley et al. "A directed evolution approach to select for novel Adeno-associated virus capsids on an HIV-1 producer T cell line." Journal of virological methods 250 (2017): 47-54.

(Continued)

*Primary Examiner* — Shanon A. Foley
(74) *Attorney, Agent, or Firm* — NIXON PEABODY LLP; David S. Resnick; Mark J. Fitzgerald

(57)     ABSTRACT

The technology described herein provides variant adeno-associated viral capsid polypeptides and viruses comprising the same. Further provided herein are methods for delivering a viral payload using viruses comprising variant capsid polypeptides described herein. Described herein are viral vectors comprising a variant sequence of the capsid gene, VP1. In particular, viral vectors with capsid polypeptide mutations that modify tropism of the viral particles relative to particles with wild-type capsid polypeptide are described.

21 Claims, 1 Drawing Sheet

Specification includes a Sequence Listing.

(56)           References Cited

OTHER PUBLICATIONS

Wu et al. "Mutational analysis of the adeno-associated virus type 2 (AAV2) capsid gene and construction of AAV2 vectors with altered tropism." Journal of Virology 74(18): 8635-8647 (2000).

Kanaan et al. "Rationally engineered AAV capsids improve transduction and volumetric spread in the CNS." Molecular Therapy-Nucleic Acids 8: 184-197 (2017).

Yu et al. "A muscle-targeting peptide displayed on AAV2 improves muscle tropism on systemic delivery." Gene therapy 16.8: 953-962 (2009).

Büning et al. "Capsid modifications for targeting and improving the efficacy of AAV vectors." Molecular Therapy—Methods & Clinical Development 12: 248-265 (2019).

* cited by examiner

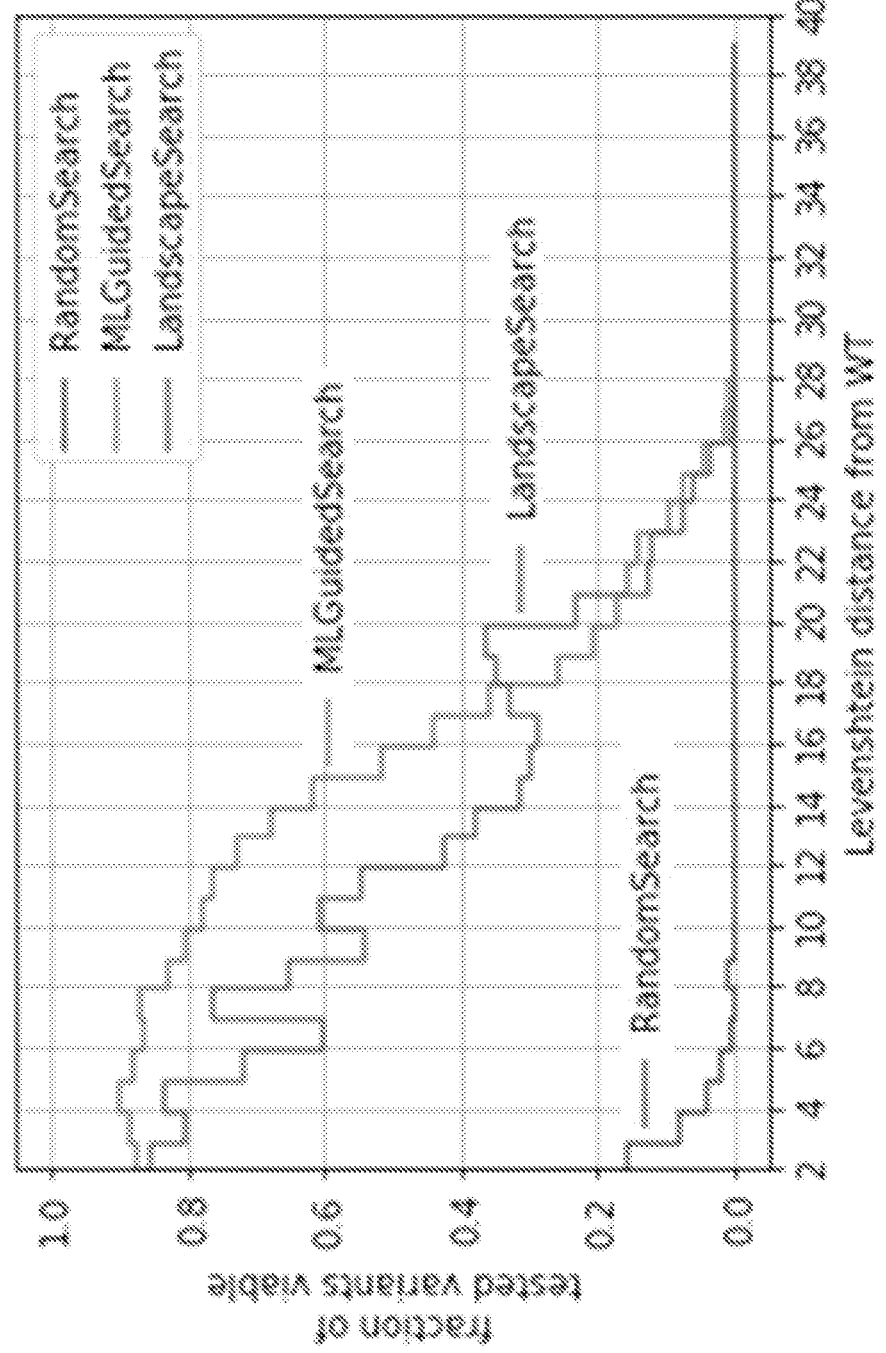

ENGINEERED VIRAL CAPSID POLYPEPTIDES AND USES THEREOF

CROSS-REFERENCE TO RELATED APPLICATIONS

This application is a 35 U.S.C. § 371 National Phase Entry Application of International Application No. PCT/US2020/059296 filed Nov. 6, 2020, which designates the U.S. and claims benefit under 35 U.S.C. § 119 (e) of U.S. Provisional Application No. 62/932,650 filed Nov. 8, 2019, the content of which is incorporated herein by reference in their entirety.

SEQUENCE LISTING

The instant application contains a Sequence Listing which has been submitted electronically in ASCII format and is hereby incorporated by reference in its entirety. Said ASCII copy, created on Nov. 5, 2019, is named 002806-096410PL01_SL.txt and is 93,516,692 bytes in size.

TECHNICAL FIELD OF THE INVENTION

This invention is related to engineering viral vectors.

BACKGROUND OF THE INVENTION

Adeno-associated virus (AAV) is an attractive agent for use as gene delivery vector. Its simple structure also makes it an attractive target for genetic improvement programs. Nonetheless, there is a continuing need in the art to improve delivery of DNA using AAV and other viral vectors.

SUMMARY OF THE INVENTION

Described herein are viral vectors comprising a variant sequence of the capsid gene, VP1. Such vectors provide, e.g., an improvement in the degree of tissue targeting, payload packaging, delivery efficiency, etc., attainable with such vectors. In particular, viral vectors with capsid polypeptide mutations that modify tropism of the viral particles relative to particles with wild-type capsid polypeptide are described.

Accordingly, one aspect provided herein is a viral capsid polypeptide bearing a mutation relative to SEQ ID NO: 2 (WT AAV2) in a region corresponding to amino acids 561-588.

In one embodiment of any aspect provided herein, the region corresponding to amino acids 561-588 comprises a sequence selected from SEQ ID NO: 4-211,872.

In one embodiment of any aspect provided herein, the capsid is an AAV capsid. In one embodiment of any aspect provided herein, the capsid is an AAV2 capsid.

In one embodiment of any aspect provided herein, the only variation relative to a wild-type AAV viral capsid is in the region corresponding to amino acids 561-588 of SEQ ID NO: 2.

Another aspect described herein provides an AAV VP1 capsid polypeptide bearing a mutation in the region corresponding to amino acids 561-588 of SEQ ID NO: 2.

In one embodiment of any aspect provided herein, the region corresponding to amino acids 561-588 of SEQ ID NO: 2 comprises a sequence selected from SEQ ID NO: 4-211,872.

In one embodiment of any aspect provided herein, the AAV VP1 polypeptide described herein is an AAV2 capsid polypeptide.

Another aspect described herein provides a viral capsid polypeptide comprising a sequence of SEQ ID NO: 2, wherein the region of amino acids 561-588 of SEQ ID NO: 2 comprises a variant sequence selected from SEQ ID NO: 4-211,872.

Another aspect described herein provides a variant viral capsid polypeptide of SEQ ID 2, wherein the region of amino acids 561-588 comprise a sequence of SEQ ID NO: 4-211,872.

Another aspect described herein provides an AAV2 capsid polypeptide comprising a sequence of SEQ ID NO: 2, wherein the region of amino acids 561-588 of SEQ ID NO: 2 comprises a variant sequence selected from SEQ ID NO: 4-211,872.

Another aspect described herein provides an engineered AAV vector having at least one viral capsid polypeptide comprising any of the capsid polypeptides described herein.

Another aspect described herein provides a nucleic acid encoding any of the capsid polypeptide described herein.

Another aspect described herein provides a viral particle comprising any of the capsid polypeptide described herein.

Another aspect described herein provides a method for delivering a payload, the method comprising contacting a cell with any of the engineered AAV vectors described herein, or any of the viral particles described herein.

In one embodiment of any aspect provided herein, the contacting is sufficient to allow for expression of the payload in the cell.

Another aspect described herein provides a method for administering a payload, the method comprising administering to a subject any of the engineered AAV vectors described herein, or any of the viral particles described herein.

In one embodiment of any aspect provided herein, the administering is sufficient to allow for expression of the payload in the cell.

In one embodiment of any aspect provided herein, the payload is selected from the group consisting of: a nucleic acid, a polypeptide, an inhibitory RNA, an antibody or antibody reagent, an oligonucleotide, and a miRNA.

In yet another aspect, provided herein is a cell comprising a variant capsid polypeptide described herein or a polynucleotide encoding same. For example, a cell comprising a viral particle, where the viral particle comprises a variant capsid polypeptide described herein.

In still another aspect provided herein is a composition, e.g., a pharmaceutical composition comprising a variant capsid polypeptide described herein or a polynucleotide encoding same.

BRIEF DESCRIPTION OF THE DRAWINGS

FIG. 1 is a plot showing the proportion of attempted variants that demonstrate viable packaging ability by two methods used here (ML guided search and Landscape search). We include as baseline the success of random sampling for comparison.

DETAILED DESCRIPTION OF THE INVENTION

Described herein are viral vectors containing amino acid mutations in the capsid protein, VP1. Such vectors provide improvements in various functions of the viral vector, e.g., improvement in the degree of tissue targeting (e.g., tropism), payload packaging, delivery efficiency, etc. relative to vectors with wild-type capsid polypeptide. Alternatively, a viral vector comprising a mutated VP1 sequence has a decreased function, e.g., reduced or broadened tropism, relative to vectors with wild-type capsid polypeptide. In one embodiment, a viral vector comprising a mutated VP1 polypeptide comprises an improvement or reduction in at least two functions of the viral vector.

Mutations can be combined together in a single viral nucleic acid or a single viral protein sequence for improved properties. The following describes mutations to viral capsid polypeptides that permit viral genome packaging, yet modify viral vector function, including but not limited to, tropism, either positively, negatively, or both when mutations are combined, relative to given tissues or cell types. Also described are methods of using mutated viral capsid polypeptides and viral vectors comprising them to introduce nucleic acids to desired tissue or cell types, e.g., with improved selectivity for those tissue or cell types. The following provides description of various mutations and considerations for their use to generate viral vectors with improved properties. Mutant capsid proteins and nucleic acids encoding them can be used, e.g., for further viral improvement, for virus preparation and manufacture, and for safety and efficacy studies.

Mutant Capsid Polypeptides

One aspect of the technology described herein provides a viral capsid polypeptide bearing a mutation relative to SEQ ID NO: 2 in a region that corresponds to amino acids 561-588 (SEQ ID NO: 3). SEQ ID NO: 2 is an amino acid sequence encoding wild-type AAV2 capsid protein.

```
                                             (SEQ ID NO: 2)
MAADGYLPDWLEDTLSEGIRQWWKLKPGPPPPKPAERHKDDSRGLV

LPGYKYLGPFNGLDKGEPVNEADAAALEHDKAYDRQLDSGDNPYLK

YNHADAEFQERLKEDTSFGGNLGRAVFQAKKRVLEPLGLVEEPVKTA

PGKKRPVEHSPVEPDSSSGTGKAGQQPARKRLNFGQTGDADSVPDPQ

PLGQPPAAPSGLGTNTMATGSGAPMADNNEGADGVGNSSGNWHCDS

TWMGDRVITTSTRTWALPTYNNHLYKQISSQSGASNDNHYFGYSTPW

GYFDFNRFHCHFSPRDWQRLINNNWGFRPKRLNFKLFNIQVKEVTQN

DGTTTIANNLTSTVQVFTDSEYQLPYVLGSAHQGCLPPFPADVFMVPQ

YGYLTLNNGSQAVGRSSFYCLEYFPSQMLRTGNNFTFSYTFEDVPFHS

SYAHSQSLDRLMNPLIDQYLYYLSRTNTPSGTTTQSRLQFSQAGASDI

RDQSRNWLPGPCYRQQRVSKTSADNNNSEYSWTGATKYHLNGRDSL

VNPGPAMASHKDDEEKFFPQSGVLIFGKQGSEKTNVDIEKVMITDEEE

IRTTNPVATEQYGSVSTNLQRGNRQAATADVNTQGVLPGMVWQDRD

VYLQGPIWAKIPHTDGHFHPSPLMGGFGLKHPPPQILIKNTPVPANPST

TFSAAKFASFITQYSTGQVSVEIEWELQKENSKRWNPEIQYTSNYNKS

VNVDFTVDTNGVYSEPRPIGTRYLTRNL
```

SEQ ID NO: 3 is an amino acid sequence encoding the amino acid region between amino acids 561-588 of SEQ ID NO: 2.

```
                                             (SEQ ID NO: 3)
       DEEEIRTTNPVATEQYGSVSTNLQRGNR
```

In one embodiment, the region corresponding to amino acids 561-588 comprises a sequence selected from SEQ ID NO: 4-211,872.

In one embodiment, the capsid is an AAV capsid. In one embodiment, the capsid is an AAV2 capsid.

Further provided herein is an AAV VP1 capsid polypeptide bearing a mutation in the region corresponding to amino acids 561-588 of SEQ ID NO: 2. In one embodiment, the region corresponding to amino acids 561-588 of SEQ ID NO: 2 comprises a sequence selected from SEQ ID NO: 4-4-211,872. In one embodiment of any aspect provided herein, the AAV VP1 polypeptide described herein is an AAV2 capsid polypeptide.

Further provided herein is a viral capsid polypeptide comprising a sequence of SEQ ID NO: 2, wherein the region of amino acids 561-588 comprises a sequence SEQ ID NO: 4-211,872.

Further provided herein is a variant of the viral capsid polypeptide of SEQ ID NO: 2, wherein the region of amino acids 561-588 comprises a sequence of SEQ ID NO: 4-211, 872.

Viruses are typically tropic for certain types of cells and or tissues in the natural host. In one embodiment, a mutant (i.e., variant) sequence of VP1 described herein alters tropism of the virus comprising the variant sequence. As used herein the term "alters tropism" refers to a mutation or set of mutations that changes the efficiency with which a viral vector delivers a nucleic acid to a given tissue or cell type, e.g., blood, brain, heart, kidney, liver, lung, or spleen. In other words, a viral vector comprising a variant viral capsid polypeptide described herein exhibits altered characteristics in comparison to a viral vector comprising the wild-type capsid polypeptide, e.g., a polypeptide of SEQ ID NO: 2, including but not limited to, altered cellular or tissue tropism, cellular or tissue transduction, and/or antigenic properties.

The tropism of a virus or viral vector is generally defined by the structure of its outer surface that interacts with receptors or other cell surface determinants on target cells. For AAV vectors, among others, viral vector tropism is determined primarily by viral capsid polypeptides, and as described herein, the tropism of such vectors can be changed by changing the amino acid sequence of the viral capsid polypeptide. An amino acid change that changes the efficiency of viral vector delivery of a nucleic acid to a target cell or tissue type by at least 10% relative to a reference vector, often, but not necessarily relative to a wild-type vector, is an altered tropism. To be clear, an altered tropism can be an increase/enrichment by at least 10% (1.1×) or a decrease/de-enrichment by at least 10% (0.9×).

The term "tropism" refers to the ability of a viral vector to infect one or more specified cell types, but can also encompass how the vector functions to transduce the cell in the one or more specified cell types. In other words, tropism refers to preferential entry of the viral vector into certain cell or tissue type(s) and/or preferential interaction with the cell surface that facilitates entry into certain cell or tissue types, optionally and preferably followed by expression (e.g., transcription and, optionally, translation) of a transgene carried by the viral vector/particle in the cell. As used herein, the term "tropism profile" refers to the pattern of transduction of one or more target cells, tissues and/or organs.

As used herein, the term "transduction" refers to the introduction, by a viral vector, of a genetic payload and expression of one or more genes encoded therein. Thus, transduction refers to entry of the vector into the cell and the transfer of genetic material contained within the vector into the cell to obtain expression from the vector genome. In some cases, but not all cases, transduction and tropism may correlate.

As used here, "systemic tropism" and "systemic transduction" (and equivalent terms) indicate that the viral vector exhibits tropism for or transduces, respectively, tissues throughout the body (e.g., brain, lung, skeletal muscle, heart, liver, kidney and/or pancreas).

Methods for measuring viral vector tropism are known in the art. For example, viral vector tropism can be determined by measuring the ability of viral vector to transduce a transgene in a cell of interest. This can be measured by the expression of a reporter protein and compared to a control viral vector, e.g., wild-type viral vector. Some exemplary reporter proteins include, but are not limited to, GFP, YFP, red cherry, β-galactosidase, or other reporter proteins known in the art.

In one embodiment, the mutation of the capsid polypeptide increases tropism, e.g., the virus comprising the mutated viral capsid polypeptide more efficiently delivers nucleic acid to the target cell type as compared a virus comprising a wild-type, or other reference, viral capsid polypeptide. In one embodiment, tropism is at least 1.1-fold (e.g., 10% greater than reference level, or 110% of the level reference level) more efficient as compared to a wild-type, or other reference, viral capsid polypeptide. In one embodiment, the delivery of a nucleic acid is at least 1.5-fold, at least 2-fold, at least 4-fold, at least 5-fold, at least 10-fold, or more, more efficient as compared to a virus comprising the wild-type viral capsid polypeptide. One of ordinary skill in the art can measure the delivery efficiency of a viral particle comprising any of the viral capsid polypeptides described herein, e.g., using PCR-based assays on an isolated targeted cell or tissue type (e.g., blood, heart, kidney, liver, lung, or spleen) to assess if the nucleic acid is delivered to and/or expressed in that targeted cell type. The expression of the nucleic acid delivered by a viral particle comprising either a viral capsid polypeptide as described herein or a wild-type, or other reference, viral capsid polyprotein can be compared to determine the change in expression as a measure of the efficiency of delivery.

In some embodiments of any one of the aspects, a viral vector comprising a variant viral capsid polypeptide as described herein exhibits increased tropism, as compared to a wild-type, or other reference, viral capsid polypeptide, for a cell or tissue selected from skeletal muscle, cardiac muscle, diaphragm muscle, pancreas (including (β-islet cells), spleen, the gastrointestinal tract (e.g., epithelium and/or smooth muscle), cells of the central nervous system, liver, lung, joint cells, and/or kidney. For example, a viral vector comprising a variant viral capsid polypeptide as described herein exhibits increased tropism for a tissue or cell type selected from blood, brain, heart, kidney, liver, lung, and spleen.

In one embodiment, the mutation of the capsid polypeptide decreases tropism, e.g., the virus comprising the mutated viral capsid polypeptide delivers nucleic acid to a broader range of target cell types as compared to a virus comprising the wild-type, or other reference, viral capsid polypeptide. In one embodiment, the tropism is decreased by at least 10%. In other embodiments, the tropism is decreased by at least 20%, at least 30%, at least 40%, at least 50%, at least 60%, at least 70%, at least 80%, at least 90%, at least 99%, or more as compared to a virus comprising the wild-type, or other reference, viral capsid polypeptide. One skilled in the art can assess tropism of a virus using standard techniques, e.g., measuring local expression of a virus following in vivo delivery.

In some embodiments of any one of the aspects, a viral vector comprising a variant viral capsid polypeptides described herein exhibits a decreased tropism, as compared to a wild-type, or other reference, viral capsid polypeptide, for a cell or tissue selected from skeletal muscle, cardiac muscle, diaphragm muscle, pancreas (including (β-islet cells), spleen, the gastrointestinal tract (e.g., epithelium and/or smooth muscle), cells of the central nervous system, liver, lung, joint cells, and/or kidney. For example, a viral vector comprising a variant viral capsid polypeptides described herein exhibits decreased tropism for a tissue or cell type selected from blood, brain, heart, kidney, liver, lung, and spleen.

Variant VP1 polypeptides have been identified and assessed for effects on viral DNA packaging and viral infectivity of particular tissues. In one embodiment, the viral packaging is increased by at least 10%. In other embodiments, the viral packaging is increased or altered by at least 20%, at least 30%, at least 40%, at least 50%, at least 60%, at least 70%, at least 80%, at least 90%, at least 99%, or more as compared to a virus comprising the wild-type, or other reference, viral capsid polypeptide.

In one embodiment, the viral packaging is decreased by at least 10%. Alterations in packaging include, but are not limited to alterations in the rate or efficiency of packaging, or, for example, alterations in the amount of vector sequence that can be packaged while retaining viral infectivity. In one embodiment, the viral infectivity is increased by at least 10% or more. In one embodiment, the viral infectivity is increased by 10%. In other embodiments, the viral infectivity is increased by 20%, 30%, 40%, 50%, or more as compared to a virus comprising the wild-type viral capsid polypeptide. In one embodiment, the viral infectivity is decreased by at least 10%. In other embodiments, the viral infectivity is decreased by at least 20%, at least 30%, at least 40%, at least 50%, at least 60%, at least 70%, at least 80%, at least 90%, at least 99%, or more as compared to a virus comprising the wild-type, or other reference, viral capsid polypeptide. A decreased in infectivity can be tolerated, e.g., where there are other beneficial changes provided by the mutation. Viral packaging and infectivity can be assessed by one skilled in the art using standard techniques, e.g., measuring the viral titer in a sample that has been contacted with an AAV virus or viral particle comprising any of the viral capsid polypeptides described herein.

Particular regions of AAV2 capsid protein tolerate amino acid alterations, e.g., deletion, insertion, or substitution better than others, and changes to certain regions that tolerate such change can have pronounced impact on viral vector tropism, among other functions. The region of the AAV2 capsid polypeptide of SEQ ID NO: 3, which is amino acids 561-588 of SEQ ID NO: 2, is identified herein as being tolerant of a variety of changes.

One aspect of the technology described herein is a nucleic acid, e.g., a polynucleotide encoding any of the viral capsid polypeptides described herein. One skilled in the art can alter the wild-type VP1 sequence (SEQ ID NO: 1), e.g., by introducing at least one base pair substitution, such that the altered sequence encodes a variant amino acid sequence. The nucleic acid sequence for each codon is known in the art and presented herein in Table 1. For example, to alter an amino acid from an isoleucine (which is translated by the nucleotide sequence AUU) to valine (which is translated by the nucleotide sequence GUU), one would change the first nucleotide from an A to G. In one embodiment, the nucleic acid sequence of SEQ ID NO: 1 is altered such that the region of amino acids 561-588 of the altered sequence encodes a sequence of SEQ ID NO: 4-211,872. Site-directed mutagenesis is known in the art and can be used to introduce a point mutation(s) (e.g., amino acid substitutions, insertions, or deletions) or other mutations or combinations thereof to a viral capsid polypeptide. Site-directed mutagenesis is further described in, e.g., Li B, et al. *Hum Gene Ther Methods*. 2015 December: 26(6):211-20, and Bachman, J. *Methods Enzymol*. 2013; 529:241-248, which are incorporated herein by reference in their entireties.

In one embodiment, the nucleotide sequence comprises at least 1 point mutation. In one embodiment, the nucleotide sequence comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84 or more point mutations.

In some embodiments, the nucleotide sequence comprises no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, no more than 28, no more than 29, no more than 30, no more than 31, no more than 32, no more than 33, no more than 34, no more than 35, no more than 36, no more than 37, no more than 38, no more than 39, no more than 40, no more than 41, no more than 42, no more than 43, no more than 44, no more than 45, no more than 46, no more than 47, no more than 48, no more than 49, no more than 50, no more than 51, no more than 52, no more than 53, no more than 54, no more than 55, no more than 56, no more than 57, no more than 58, no more than 59, no more than 60, no more than 61, no more than 62, no more than 63, no more than 64, no more than 65, no more than 66, no more than 67, no more than 68, no more than 69, no more than 70, no more than 71, no more than 72, no more than 73, no more than 74, no more than 75, no more than 76, no more than 77, no more than 78, no more than 79, no more than 80, no more than 81, no more than 82, no more than 83, or no more than 84 point mutations.

In one embodiment, the nucleotide sequence comprises at least 1 point mutation in the region encoding amino acids 561-588 of SEQ ID NO: 2. For example, the nucleotide sequence comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, or 84 point mutations in the region encoding amino acids 561-588 of SEQ ID NO: 2.

In some embodiments, the nucleotide sequence comprises no more than 1, no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, no more than 28, no more than 29, no more than 30, no more than 31, no more than 32, no more than 33, no more than 34, no more than 35, no more than 36, no more than 37, no more than 38, no more than 39, no more than 40, no more than 41, no more than 42, no more than 43, no more than 44, no more than 45, no more than 46, no more than 47, no more than 48, no more than 49, no more than 50, no more than 51, no more than 52, no more than 53, no more than 54, no more than 55, no more than 56, no more than 57, no more than 58, no more than 59, no more than 60, no more than 61, no more than 62, no more than 63, no more than 64, no more than 65, no more than 66, no more than 67, no more than 68, no more than 69, no more than 70, no more than 71, no more than 72, no more than 73, no more than 74, no more than 75, no more than 76, no more than 77, no more than 78, no more than 79, no more than 80, no more than 81, no more than 82, no more than 83, or no more than 84 point mutations in the region encoding amino acids 561-588 of SEQ ID NO: 2.

In one embodiment, the nucleic acid sequence is altered such that it encodes at least 1 variant amino acid. In one embodiment, the nucleic acid sequence is altered such that it encodes at least 2, 3, 4, 5, 6, 7, 8, 9, 10, 11, 12, 13, 14, 15, 16, 17, 18, 19, 20, 21, 22, 23, 24, 25, 26, 27, 28 or more variant amino acids. For clarity, it is noted that a variant amino acid means an amino acid that is different from the one encoded by a nucleic acid sequence encoding SEQ ID NO: 2.

In some embodiments, the nucleic acid sequence is altered such that it encodes no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, or no more than 28 variant amino acids.

In one embodiment, the nucleic acid sequence is altered such that it encodes at least 1 variant amino acid in the region corresponding to amino acids 561-588 of SEQ ID NO: 2. For Example, the nucleic acid sequence is altered such that it encodes at least 2, 3, 4, 5, 6, 7, 8, 9, 10, 11, 12, 13, 14, 15, 16, 17, 18, 19, 20, 21, 22, 23, 24, 25, 26, 27, 28 or more variant amino acids in the region corresponding to amino acids 561-588 of SEQ ID NO: 2.

In some embodiments, the nucleic acid sequence is altered such that it encodes no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, or no more than 28 variant amino acids in the region corresponding to amino acids 561-588 of SEQ ID NO: 2.

TABLE 1

| Nucleotide codons for amino acids | |
| --- | --- |
| AA | Codons |
| Ala | GCT, GCC, GCA, GCG |
| Arg | CGT, CGC, CGA, CGG, AGA, AGG |
| Asn | AAT, AAC |
| Asp | GAT, GAC |
| Cys | TGT, TGC |
| Gln | CAA, CAG |
| Glu | GAA, GAG |

TABLE 1-continued

Nucleotide codons for amino acids

| AA | Codons |
|---|---|
| Gly | GGT, GGC, GGA, GGG |
| His | CAT, CAC |
| Ile | ATT, TAC, ATA |
| Leu | TTA, TTG, CTT, CTA, CTG |
| Lys | AAA, AAG |
| Met | ATG |
| Phe | TTT, TTC |
| Pro | CCT, CCC, CCA, CCG |
| Ser | TCT, TCC, TCA, TCG, AGT, AGC |
| Thr | ACT, ACC, ACA, ACG |
| Trp | TGG |
| Tyr | TAT, TAC |
| Val | GTT, GTC, GTA, GTG |
| Start | ATG |
| Stop | TAA, TGA, TAG |

In some embodiments, a polynucleotide encoding a variant viral capsid polypeptide described herein is operably linked to a promoter sequence. For example, a promoter sequence that drives expression of the polynucleotide in a cell. In some embodiments, the polynucleotide further comprises a sequence that encodes a REP protein, e.g., an AAV rep protein. In some embodiments, the polynucleotide further comprises a sequence that encodes a CAP protein, e.g., an AAV CAP protein.

Another aspect of the technology described herein is a viral particle comprising any of the viral capsid polypeptides described herein. It is noted that a viral particle comprising a variant capsid polypeptides described herein can be replication-competent or replication-incompetent. Thus, in some embodiments, the viral particle comprising a variant capsid polypeptides described herein is replication-competent. As used herein, the term "replication-competent" refers to a virus or viral particle that is infectious, and is also capable of being replicated in an infected cell (i.e. in the presence of a helper virus or helper virus functions). In the case of AAV, replication competence generally requires the presence of functional AAV packaging genes.

In some other embodiments, the viral particle comprising a variant capsid polypeptides described herein is replication-incompetent or replication defective. As used herein, the terms "replication-incompetent" and "replication defective" refer to a virus or viral particle that cannot independently replicate and package its genome. For example, when a cell is infected with the virus or viral particle, the heterologous gene is expressed in the infected cells, however, the virus or the viral particle is not able to replicate further.

In some embodiments, the viral particle further comprises a polynucleotide encoding a transgene, e.g., a polynucleotide comprising a sequence that encodes a gene product such as a therapeutic gene product. In some embodiments, the polynucleotide is flanked on the 5' and 3' ends by functional AAV inverted terminal repeat (ITR) sequences. By "functional AAV ITR sequences" is meant that the ITR sequences function as intended for the rescue, replication and packaging of the AAV virion. Hence, AAV ITRs for use in the gene delivery vectors need not have a wild-type nucleotide sequence, and can be altered by the insertion, deletion or substitution of nucleotides or the AAV ITRs can be derived from any of several AAV serotypes, e.g. AAV1, AAV2, AAV3, AAV4, AAV5, AAV6, AAV7, AAV8, AAV9, and AAV10. In some embodiments, the viral particles have the wild type REP and CAP genes deleted in whole or part, but retain functional flanking ITR sequences.

One skilled in the art can make viral particles comprising a variant capsid polypeptide described herein using standard methods. For example, an AAV expression vector comprising a polynucleotide cassette can be introduced into a producer cell, followed by introduction of an AAV helper construct comprising a polynucleotide sequence encoding a variant capsid polypeptide described herein, and where the helper construct includes AAV coding regions capable of being expressed in the producer cell and which complement AAV helper functions absent in the AAV vector. This is followed by introduction of helper virus and/or additional vectors into the producer cell, wherein the helper virus and/or additional vectors provide accessory functions capable of supporting efficient rAAV virus production. The producer cells are then cultured to produce rAAV. Some exemplary methods for producing viral particles and amenable to the present invention are described, for example, in U.S. Pat. Nos. 5,436,146; 5,753,500, 6,040,183, 6,093,570 and 6,548,286, contents of each of which is incorporated herein by reference in their entireties.

In one example, viral particles comprising a variant polypeptide described herein can be produced by first generating a DNA library of AAV capsid variants. Libraries of AAV2 capsid gene sequence variants are cloned into a plasmid containing the AAV Inverted Terminal Repeat regions (ITRs). The final ITR plasmids contain, e.g., a cytomegalovirus (CMV) promoter upstream of the Cap gene. AAV virus libraries are produced from the DNA libraries. The capsid library plasmids, AAV pHelper plasmids, and plasmids containing the AAV2 Rep gene are co-transfected into HEK-293T cells using PEI. Capsids are purified using standard techniques for cell lysis (freeze-thaw or addition of 5 M NaCl), treatment with benzonase to remove unpackaged genomes, and purification and concentration by iodixanol ultra-centrifugation.

In preparing the viral particles, any host cells for producing recombinant viral particles can be employed, including, for example, mammalian cells, insect cells, plant cells, microorganisms and yeast. Host cells can also be packaging cells in which the AAV rep and cap genes are stably maintained in the host cell or producer cells in which the AAV vector genome is stably maintained and packaged. Exemplary packaging and producer cells include but are not limited to HeLa cell, COS cell, COS-1 cell, COS-7 cell, HEK293 cell, A549 cell, BHK cell, BSC-1 cell, BSC-40 cell, Vero cell, Sfc9 cell, Sf-21 cell, Tn-368 cell, BTI-Tn-5B1-4 (High-Five) cell, Saos cell, C2C12 cell, L cell, HT1080 cell, HepG2 cell, WEHI cell, 3T3 cell, 10T1/2 cell, MDCK cell, BMT-10 cell, WI38 cell, or primary fibroblast, hepatocyte or myoblast cell derived from mammals.

In vivo packaging ability of viral capsid variants was measured, e.g., using methods described herein above. The number of viruses that were packaged ("virus") compared to the number of input viral genomes ("plasmid") were determined. Measuring the frequency of capsid (or other library component) mutants before and after selection reveals which mutations are beneficial and which are deleterious based on the particular selection method.

Also provided herein is a cell comprising a variant viral capsid polypeptide described herein or a polynucleotide encoding a variant viral capsid polypeptide described herein. The cell can be prokaryotic cell or eukaryotic cell. For example, the cell can be a mammalian cell, insect cell, plant cell, bacterial cell or yeast cell. Some exemplary cells include, but are not limited to, alveolar cells, basophils, cardiac smooth muscle cells), cardiomyocyte, collecting duct intercalated cells, collecting duct principal cells, ectodermal cells, endocardial cells, endoderm cells, eosinophils, epithelial cells, hepatic stellate cells, interstitial kidney cells, intrahepatic lymphocytes, kidney distal tubule cells, kidney glomerulus parietal cells, kidney glomerulus podocytes, kidney proximal tubule brush border cells, loop of Henle thin segment cells, lung epithelial cells, lung smooth muscle cells, lymphocytes, monocytes, muscle cells, neutrophils, non-parenchymal cells, parenchymal cells, phagocytic Kupffer cells, platelets, red blood cells, sinusoidal endothelial cells, splenic endothelial cells, splenic fibroblasts, splenocytes, and thick ascending limb cells.

In some embodiments, the cell can be a cell used for producing a viral particle, e.g., a producer cell.

In some embodiments, the cell can be a cell which has been transduced, infected, transfected or transformed with a viral vector described herein. Typically, a cell is referred to as "transduced", "infected"; "transfected" or "transformed" dependent on the means used for administration, introduction or insertion of heterologous DNA (i.e., the viral vector) into the cell.

Also provided herein are pharmaceutical compositions comprising a variant capsid polypeptide described herein or a polynucleotide encoding same and one or more pharmaceutically acceptable diluent, carrier, or excipient. For example, the composition can comprise a viral particle comprising a variant capsid polypeptide described herein. In some embodiments, the composition can comprise a cell, wherein the cell comprises a variant capsid polypeptide described herein or a polynucleotide encoding same.

For example, the variant capsid polypeptide or a polynucleotide encoding same (as is or as encompassed in a viral particle or cell) can be combined with pharmaceutically-acceptable carriers, diluents and reagents useful in preparing a formulation that is generally safe, non-toxic, and desirable, and includes excipients that are acceptable for primate use. Such excipients can be solid, liquid, semisolid, or, in the case of an aerosol composition, gaseous. Examples of such carriers or diluents include, but are not limited to, water, saline, Ringer's solutions, dextrose solution, and 5% human serum albumin. Supplementary active compounds can also be incorporated into the formulations. Solutions or suspensions used for the formulations can include a sterile diluent such as water for injection, saline solution, fixed oils, polyethylene glycols, glycerine, propylene glycol or other synthetic solvents; antibacterial compounds such as benzyl alcohol or methyl parabens; antioxidants such as ascorbic acid or sodium bisulfite; chelating compounds such as ethylenediaminetetraacetic acid (EDTA); buffers such as acetates, citrates or phosphates; detergents such as Tween 20 to prevent aggregation; and compounds for the adjustment of tonicity such as sodium chloride or dextrose. The pH can be adjusted with acids or bases, such as hydrochloric acid or sodium hydroxide. In particular embodiments, the pharmaceutical compositions are sterile. For instances in which ocular cells are to be contacted in vivo, the subject polynucleotide cassettes or gene delivery vectors comprising the subject polynucleotide cassette can be treated as appropriate for delivery to the eye.

Pharmaceutical compositions can further include sterile aqueous solutions or dispersions and sterile powders for the extemporaneous preparation of sterile injectable solutions or dispersion. For intravenous administration, suitable carriers include physiological saline, bacteriostatic water, or phosphate buffered saline (PBS). In some cases, the composition is sterile and should be fluid to the extent that easy syringability exists. In certain embodiments, it is stable under the conditions of manufacture and storage and is preserved against the contaminating action of microorganisms such as bacteria and fungi. The carrier can be, e.g., a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the internal compositions can be brought about by including in the composition an agent which delays absorption, for example, aluminum monostearate and gelatin.

Corresponding Mutations

Mutations at corresponding locations in, for example homologous viral capsid polypeptides, would be expected to have similar effects on viral function. Corresponding locations can include, for example, a location relative to the full length capsid polypeptide (e.g., SEQ ID NO: 2), or for that matter, a location relative to a sub-domain or sub-region of the full length capsid polypeptide (e.g., SEQ ID NO: 3). In one aspect, a viral capsid polypeptide is provided herein that bears a mutation that corresponds to a mutation of the polypeptide of SEQ ID NO: 2, e.g., SEQ ID NO: 4-211,872, as described herein. In one embodiment, a homologous viral capsid polypeptide has at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or more sequence identity to wild-type AAV2 capsid protein (e.g., SEQ ID NO: 2). In another embodiment, the viral capsid polypeptides of AAV serotypes 1, and 3-13 are homologous to an AAV2 capsid polypeptide.

One aspect described herein is a viral capsid polypeptide comprising a region corresponding to the amino acid sequence of SEQ ID NO: 3, wherein the region corresponding to the amino acid sequence of SEQ ID NO: 3 comprises a mutation relative to SEQ ID NO: 3 that, e.g., alters the function of the virus comprising the viral capsid polypeptide, wherein the mutation is selected from SEQ ID NO: 4-211,872. In one embodiment, a homologous viral capsid polypeptide has a region with at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or more sequence identity to SEQ ID NO: 3.

As noted elsewhere herein, the identification of amino acid sites or regions of amino acid sequence in the AAV2 capsid polypeptide of SEQ ID NO: 2 that tolerate change in general, i.e., that permit functions of the viral vector can be used to guide changes in the capsid polypeptides of other AAV serotypes to similarly influence function or provide for modified properties. Thus, through use of sequence alignment, a mutation or set of mutations that provides a desired change in function for AAV2 capsid polypeptide of SEQ ID NO: 2 can be introduced to the corresponding location of the capsid polypeptide of another AAV serotype to similarly influence those properties in that serotype. It is contemplated that the introduction of changes identified herein in this amino acid 561-588 sub-region of the AAV2 capsid polypeptide to the corresponding region or sub-region of another AAV serotype capsid polypeptide will influence the function of that AAV serotype in a similar manner.

As used herein, "mutation" refers to any change in the amino acid sequence, e.g., a substitution, insertion, or deletion of at least one amino acid. Site-directed mutations in the nucleic acid sequence can be generated by one skilled in the art using techniques known in the art or described herein.

Mutations that are at equivalent positions in other homologous viruses can be made and used for improving, e.g., virus packaging and virus infectivity. Examples of other homologous viruses include any of AAV serotypes 1, and 3-12, as well as other natural isolates or synthetic sequences. Corresponding positions in homologous viruses can be inferred from sequence homology to AAV2. In one embodiment, the mutations described herein are introduced into the corresponding amino acid sequence of an AAV1, AAV3, AAV3B, AAV4, AAV5, AAV6, AAV7, AAV8, AAV9, AAV10, AAV11, AAV12, or AAV13 capsid polypeptide.

Methods for Delivering Nucleic Acid

Provided herein is a method of delivering a payload to a cell comprising contacting a cell with an AAV virus or viral particle comprising any of the viral capsid polypeptides described herein. In one embodiment, the contacting occurs in vitro. In one embodiment, the contacting occurs ex vivo.

The term "contacting" or "contact" as used herein in connection with contacting a cell with an AAV virus or viral particle includes subjecting the cell to an appropriate culture medium which comprises the AAV virus or viral particle. Where the cell is in vivo, "contacting" or "contact" includes administering the AAV virus or viral particle in a pharmaceutical composition to a subject via an appropriate administration route such that the virus or viral particle contacts the cell in vivo.

Further provided herein is a method of delivering a payload in vivo to a target cell, comprising administering an AAV virus or viral particle comprising any of the viral capsid polypeptides described herein to a subject. In one embodiment, in vivo is systemic delivery.

Exemplary target or host cells include blood cells (e.g., red blood cells, platelets, neutrophils, eosinophils, basophils, lymphocytes, or monocytes); heart cells (e.g., cardiomyocyte, endocardial cells, or cardiac smooth muscle cells); muscle cells; epithelial cells; endoderm cells; ectodermal cells; kidney cells (e.g., kidney glomerulus parietal cells, kidney glomerulus podocytes, kidney proximal tubule brush border cells, loop of Henle thin segment cells, thick ascending limb cells, kidney distal tubule cells, collecting duct principal cells, collecting duct intercalated cells, and interstitial kidney cells); liver cells (e.g., parenchymal cells, non-parenchymal cells, sinusoidal endothelial cells, phagocytic Kupffer cells, hepatic stellate cells, and intrahepatic lymphocytes); lung cells (e.g., lung epithelial cells, lung smooth muscle cells, and alveolar cells); and spleen cells (e.g., splenocytes, splenic endothelial cells and splenic fibroblasts).

In vivo delivery of the AAV virus or viral particle can be, for example, by injection, infusion, instillation, inhalation, or ingestion. "Injection" includes, without limitation, intravenous, intramuscular, intraarterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, intrasternal injection and infusion. The AAV virus or viral can be administered as a single bolus or multiple boluses, as a continuous infusion, or a combination thereof. In some embodiments, the AAV virus or viral particle can be administration into the blood stream of the subject.

The dose of AAV virions or viral particles required to achieve a particular "therapeutic effect," e.g., the units of dose in vector genomes/per kilogram of body weight (vg/kg), will vary based on several factors including, but not limited to: the route of AAV virus or viral particle administration, the level of gene expression required to achieve a therapeutic effect, the specific disease or disorder being treated, a host immune response to the AAV virus or viral particle, a host immune response to the gene expression product, and the stability of the gene product. One of skill in the art can readily determine a AAV virus or viral particle dose range to treat a patient having a particular disease or disorder based on the aforementioned factors, as well as other factors that are well known in the art. Generally speaking, by "therapeutic effect" is meant a level of expression of one or more transgenes in the AAV virus or viral particle sufficient to alter a component of a disease (or disorder) toward a desired outcome or clinical endpoint, such that a patient's disease or disorder shows clinical improvement, often reflected by the amelioration of a clinical sign or symptom relating to the disease or disorder. Exemplary doses for achieving therapeutic effects are AAV virus or viral particle titers of at least about $10^5$, $10^6$, $10^7$, $10^8$, $10^9$, $10^{10}$, $10^{11}$, $10^{12}$, $10^{13}$, $10^{14}$, $10^{15}$, $10^{16}$ transducing units or more. For example, from about $10^8$ to about $10^{13}$ transducing units. It is noted that more than one administration (e.g., two, three, four, or more administrations) can be employed to achieve desired (e.g. therapeutic) levels of gene expression.

Levenshtein Distance

The Levenshtein distance has been calculated for the variant capsid polypeptides described herein. As used herein, the "Levenshtein distance" refers to a string metric for measuring the difference between two sequences. For example, the Levenshtein distance between two sequences is the minimum number of single-base pair edits (i.e. insertions, deletions, or substitutions) required to change one sequence into the other. In one embodiment, the variant capsid polypeptide has a Levenshtein distance of 2, 3, 4, 5, 6, 7, 8, 9, 10, 11, 12, 13, 14, 15, 16, 17, 18, 19, 20, 21, 22, 23, 24, 25, 26, 27, 28 or more as compared to SEQ ID NO: 2 (wild-type VP1). The Levenshtein distance can be calculated by one skilled in the art, e.g., using the formula below:

the Levenshtein distance between two strings a, b (of length and |a| and |b| respectively) is given by lev$_{a,b}$ (|a|,|b|) where:

$$lev_{a,b}(i, j) = \begin{cases} \max(i, j) & \text{if } \min(i, j) = 0, \\ \min \begin{cases} lev_{a,b}(i-1, j) + 1 \\ lev_{a,b}(i, j-1) + 1 \\ lev_{a,b}(i-1, j-1) + 1_{(a_i \neq b_j)} \end{cases} & \text{otherwise.} \end{cases}$$

where 1(ai≠bi) is the indicator function equal to 0 when ai≠bi and equal to 1 otherwise, and leva, b(i,j) is the distance between the first i characters of a and the first j characters of b.

Note that the first element in the minimum corresponds to deletion (from a to b), the second to insertion and the third to match or mismatch, depending on whether the respective symbols are the same.

Table 2 denotes the SEQ ID NOs that correspond to a particular Levenshtein distance to the wild-type (e.g., SEQ ID NO: 2). The SEQ ID NOs boundaries are inclusive (e.g. start_SEQ ID NO: 4, and end_SEQ ID NO: 4696, means both SEQ ID NO: 4 and SEQ ID NO: 4696 are included in the range).

TABLE 2

| Levenshtein distance of sequences to the wild-type (SEQ ID NO: 2) | | |
| --- | --- | --- |
| Distance from Wild-type | Start SEQ ID NO | End SEQ ID NO |
| 0 | 2 | 3 |
| 2 | 4 | 4696 |
| 3 | 4697 | 4953 |
| 4 | 4954 | 5612 |
| 5 | 5613 | 14838 |
| 6 | 14839 | 27561 |
| 7 | 27562 | 40693 |
| 8 | 40694 | 54147 |
| 9 | 54148 | 68182 |
| 10 | 68183 | 83192 |
| 11 | 83193 | 100069 |
| 12 | 100070 | 120359 |
| 13 | 120360 | 140831 |
| 14 | 140832 | 158014 |
| 15 | 158015 | 171403 |
| 16 | 171404 | 181859 |
| 17 | 181860 | 189840 |
| 18 | 189841 | 196007 |
| 19 | 196008 | 200759 |
| 20 | 200760 | 204807 |
| 21 | 204808 | 207612 |
| 22 | 207613 | 209359 |
| 23 | 209360 | 210624 |
| 24 | 210625 | 211289 |
| 25 | 211290 | 211659 |
| 26 | 211660 | 211822 |
| 27 | 211823 | 211863 |
| 28 | 211864 | 211872 |

Some exemplary embodiments of the invention can be described by the following numbered embodiments:

Embodiment 1: A viral capsid polypeptide bearing a mutation relative to SEQ ID NO: 2 (WT AAV2) in a region corresponding to amino acids 561-588.

Embodiment 2: The viral capsid polypeptide of Embodiment 1, wherein the region corresponding to amino acids 561-588 comprises a sequence selected from SEQ ID NO: 4-211,872.

Embodiment 3: The viral capsid polypeptide of Embodiments 1 or 2, which is an AAV capsid polypeptide.

Embodiment 4: The viral capsid polypeptide of any of Embodiments 1-3, which is an AAV2 capsid polypeptide.

Embodiment 5: An AAV VP1 capsid polypeptide bearing a mutation in the region corresponding to amino acids 561-588 of SEQ ID NO: 2.

Embodiment 6: The AAV VP1 capsid polypeptide of Embodiment 5, wherein the region corresponding to amino acids 561-588 of SEQ ID NO: 2 comprises a sequence selected from SEQ ID NO: 4-211,872.

Embodiment 7: The AAV VP1 capsid polypeptide of Embodiments 5 or 6, which is an AAV2 capsid polypeptide.

Embodiment 8: A viral capsid polypeptide comprising a sequence of SEQ ID NO: 2, wherein the region of amino acids 561-588 of SEQ ID NO: 2 comprises a variant sequence selected from SEQ ID NO: 4-211,872.

Embodiment 9: A variant viral capsid polypeptide of SEQ ID 2, wherein the region of amino acids 561-588 comprises a sequence of SEQ ID NO: 4-211,872.

Embodiment 10: An AAV2 capsid polypeptide comprising a sequence of SEQ ID NO: 2, wherein the region of amino acids 561-588 of SEQ ID NO: 2 comprises a variant sequence selected from SEQ ID NO: 4-211,872.

Embodiment 11: An engineered AAV vector having at least one capsid polypeptide comprising any one of the capsid polypeptides of Embodiments 1-10.

Embodiment 12: A nucleic acid encoding the capsid polypeptide of any one of Embodiments 1-10.

Embodiment 13: A viral particle comprising a capsid polypeptide of any one of Embodiments 1-10.

Embodiment 14: A method for delivering a payload, the method comprising contacting a cell with any of the engineered AAV vectors of Embodiment 12, or viral particles of Embodiment 13.

Embodiment 15: The method of Embodiment 14, wherein the contacting is sufficient to allow for expression of the payload in the cell.

Embodiment 16: A method for administering a payload, the method comprising administering to a subject any of the engineered AAV vectors of Embodiment 12, or viral particles of Embodiment 13.

Embodiment 17: The method of Embodiment 16, wherein the administering is sufficient to allow for expression of the payload in the cell.

Embodiment 18: The method of any of Embodiments 14-17, wherein the payload is selected from the group consisting of: a nucleic acid, a polypeptide, an inhibitory RNA, an antibody or antibody reagent, an oligonucleotide, and a miRNA.

Definitions

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed technology, because the scope of the technology is limited only by the claims. Unless otherwise defined, all technical and scientific terms used herein have the same meaning as commonly understood by one of ordinary skill in the art to which this technology belongs. If there is an apparent discrepancy between the usage of a term in the art and its definition provided herein, the definition provided within the specification shall prevail.

Definitions of common terms in immunology and molecular biology can be found in The Merck Manual of Diagnosis and Therapy, 19th Edition, published by Merck Sharp & Dohme Corp., 2011 (ISBN 978-0-911910-19-3); Robert S. Porter et al. (eds.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), Taylor & Francis Limited, 2014 (ISBN 0815345305, 9780815345305); Lewin's Genes XI, published by Jones & Bartlett Publishers, 2014 (ISBN-1449659055); Michael Richard Green and Joseph Sambrook, Molecular Cloning: A Laboratory Manual, 4th ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.)

Elsevier, 2013 (ISBN 0124199542); Current Protocols in Molecular Biology (CPMB), Frederick M. Ausubel (ed.), John Wiley and Sons, 2014 (ISBN 047150338X, 9780471503385), Current Protocols in Protein Science (CPPS), John E. Coligan (ed.), John Wiley and Sons, Inc., 2005; and Current Protocols in Immunology (CPI) (John E. Coligan, ADA M Kruisbeek, David H Margulies, Ethan M Shevach, Warren Strobe, (eds.) John Wiley and Sons, Inc., 2003 (ISBN 0471142735, 9780471142737), the contents of which are all incorporated by reference herein in their entireties. As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of additional elements that do not materially affect the basic and novel or functional characteristic(s) of that embodiment of the technology.

The word "or" is intended to include "and" unless the context clearly indicates otherwise.

In some embodiments, the terms "a" and "an" and "the" and similar references used in the context of describing a particular embodiment of the invention (especially in the context of certain of the following claims) can be construed to cover both the singular and the plural. The recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g. "such as") provided with respect to certain embodiments herein is intended merely to better illuminate the invention and does not pose a limitation on the scope of the invention otherwise claimed. No language in the specification should be construed as indicating any non-claimed element essential to the practice of the invention.

The abbreviation, "e.g." is derived from the Latin Exempli gratia, and is used herein to indicate a non-limiting example. Thus, the abbreviation "e.g." is synonymous with the term "for example."

As used herein, the term "viral capsid polypeptide" refers to the proteinaceous shell or coat of a viral particle. At a minimum, a viral capsid polypeptide as described herein permits packaging or assembly of the capsid polypeptide into a viral particle that is competent for delivery of nucleic acid to the host cell. Capsids function to encapsidate, protect, transport, and release into a host cell a viral genome. Capsids are generally comprised of oligomeric structural subunits of a polypeptide of the viral capsid polypeptides. As used herein, the term "encapsidated" means enclosed within a viral capsid. As an example, the AAV genome comprises three overlapping sequences which encode capsid proteins, VP1, VP2 and VP3, which start from one promoter, p40. The AAV capsid is composed of a mixture of VP1, VP2, and VP3 totaling 60 monomers arranged in icosahedral symmetry in a ratio of 1:1:10.

As used herein, "packaging" refers to a series of intracellular events that result in the assembly and encapsidation of an AAV particle.

As used herein, "payload" refers to a nucleic acid which is encapsidated within a viral vector, e.g., an AAV vector. A payload nucleic acid can encode, e.g., a polypeptide, an inhibitory RNA, an antibody or antibody reagent, an oligonucleotide, or a miRNA.

The term "polypeptide" as used herein refers to a polymer of amino acids. The terms "protein" and "polypeptide" are used interchangeably herein. A peptide is a relatively short polypeptide, typically between about 2 and 60 amino acids in length. Polypeptides used herein typically contain amino acids such as the 20 L-amino acids that are most commonly found in proteins. However, other amino acids and/or amino acid analogs known in the art can be used. One or more of the amino acids in a polypeptide may be modified, for example, by the addition of a chemical entity such as a carbohydrate group, a phosphate group, a fatty acid group, a linker for conjugation, functionalization, etc. A polypeptide that has a nonpolypeptide moiety covalently or noncovalently associated therewith is still considered a "polypeptide." Exemplary modifications include glycosylation and palmitoylation. Polypeptides can be purified from natural sources, produced using recombinant DNA technology or synthesized through chemical means such as conventional solid phase peptide synthesis, etc. The term "polypeptide sequence" or "amino acid sequence" as used herein can refer to the polypeptide material itself and/or to the sequence information (i.e., the succession of letters or three letter codes used as abbreviations for amino acid names) that biochemically characterizes a polypeptide. A polypeptide sequence presented herein is presented in an N-terminal to C-terminal direction unless otherwise indicated.

A given amino acid can be replaced by a residue having similar physicochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity, e.g. ligand-mediated receptor activity and specificity of a native or reference polypeptide is retained.

Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions will entail exchanging a member of one of these classes for another class. Particular conservative substitutions include, for example; Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

In some embodiments, a polypeptide described herein (or a nucleic acid encoding such a polypeptide) can be a functional fragment of one of the amino acid sequences described herein. As used herein, a "functional fragment" is a fragment or segment of a peptide which retains at least 50% of the wild-type reference polypeptide's activity according to an assay known in the art or described below herein. For example, a functional fragment described herein would retain at least 50% of the VP1 capsid function. One skilled in the art can assess the function of VP1 using standard techniques, for example those described herein below. A functional fragment can comprise conservative substitutions of the sequences disclosed herein.

In some embodiments, a polypeptide described herein can be a variant of a polypeptide or molecule as described herein. In some embodiments, the variant is a conservatively modified variant. Conservative substitution variants can be obtained by mutations of native nucleotide sequences, for example. A "variant," as referred to herein, is a polypeptide substantially homologous to a native or reference polypeptide, e.g., SEQ ID NO: 2, but which has an amino acid sequence different from that of the native or reference polypeptide because of one or a plurality of deletions, insertions or substitutions. A variant capsid polypeptide as the term is used herein retains the capacity for assembly into a viral capsid. Variant polypeptide-encoding DNA sequences encompass sequences that comprise one or more additions, deletions, or substitutions of nucleotides when compared to a native or reference DNA sequence, e.g., SEQ ID NO: 1, but that encode a variant protein or fragment thereof that retains activity of the non-variant polypeptide. A wide variety of PCR-based site-specific mutagenesis approaches are known in the art and can be applied by the ordinarily skilled artisan.

A variant amino acid or DNA sequence can be at least 90%, at least 91%, at least 92%, at least 93%, at least 94%, at least 95%, at least 96%, at least 97%, at least 98%, at least 99%, or more, identical to a native or reference sequence. The degree of homology (percent identity) between a native and a mutant sequence can be determined, for example, by comparing the two sequences using computer programs commonly employed for this purpose, e.g., that are freely available on the world wide web (e.g. BLASTp or BLASTn with default settings). Alterations of the native amino acid sequence can be accomplished by any of a number of techniques known to one of skill in the art. Mutations can be introduced, for example, at particular loci by synthesizing oligonucleotides containing a mutant sequence, flanked by restriction sites permitting ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations are well established and include, for example, those disclosed by Walder et al. (Gene 42:133, 1986); Bauer et al. (Gene 37:73, 1985); Craik (BioTechniques, January 1985, 12-19); Smith et al. (Genetic Engineering: Principles and Methods, Plenum Press, 1981); and U.S. Pat. Nos. 4,518,584 and 4,737,462, which are herein incorporated by reference in their entireties. Any cysteine residue not involved in maintaining the proper conformation of a polypeptide also can be substituted, generally with serine, to improve the oxidative stability of the molecule and prevent aberrant crosslinking. Conversely, cysteine bond(s) can be added to a polypeptide to improve its stability or facilitate oligomerization.

As used herein, the term "DNA" is defined as deoxyribonucleic acid. The term "polynucleotide" is used herein interchangeably with "nucleic acid" to indicate a polymer of nucleosides. Typically, a polynucleotide is composed of nucleosides that are naturally found in DNA or RNA (e.g., adenosine, thymidine, guanosine, cytidine, uridine, deoxyadenosine, deoxythymidine, deoxyguanosine, and deoxycytidine) joined by phosphodiester bonds. However, the term encompasses molecules comprising nucleosides or nucleoside analogs containing chemically or biologically modified bases, modified backbones, etc., whether or not found in naturally occurring nucleic acids, and such molecules may be preferred for certain applications. Where this specification refers to a polynucleotide it is understood that both DNA, RNA, and in each case both single- and double-stranded forms (and complements of each single-stranded molecule) are provided. "Polynucleotide sequence" as used herein can refer to the polynucleotide material itself and/or to the sequence information (i.e. the succession of letters used as abbreviations for bases) that biochemically characterizes a specific nucleic acid. A polynucleotide sequence presented herein is presented in a 5' to 3' direction unless otherwise indicated.

As used herein, the term "viral vector" refers to a nucleic acid vector construct that includes at least one element of viral origin and has the capacity to be packaged into a viral particle. The viral vector can contain a nucleic acid (e.g., a payload) encoding a polypeptide as described herein in place of non-essential viral genes. The vector and/or particle may be utilized for the purpose of transferring nucleic acids into cells either in vitro or in vivo. Numerous forms of viral vectors are known in the art.

As used herein, an "AAV virus" or "AAV viral particle" refers to a viral particle composed of at least one AAV capsid protein such as VP1 (typically by all of the capsid proteins of a wild-type AAV) and an encapsidated polynucleotide rAAV vector. If the particle comprises a heterologous polynucleotide (i.e. a polynucleotide other than a wild-type AAV genome, such as a transgene to be delivered to a mammalian cell), it is typically referred to as a "recombinant AAV vector particle" or simply a "rAAV vector". Thus, production of a rAAV particle necessarily includes production of a rAAV vector, as such a vector is contained within a rAAV particle.

As used herein, the term "corresponding to," when used in reference to an amino acid or polynucleotide sequence means that a given amino acid or polynucleotide sequence in one polypeptide or polynucleotide molecule has structural properties, functional properties, or both that are similar relative to an amino acid or polynucleotide sequence in a similar location in another polypeptide or polynucleotide molecule. Homologues of a given polypeptide in different species "correspond to" each other, as do regions or domains of homologous polypeptides from different species. Similarly, capsid polypeptides of different serotypes of viral vectors, including but not limited to adeno-associated virus (AAV) vectors, "correspond to" each other, as do regions of such polypeptides, defined, for example by alignment of their amino acid sequences. While other alignment parameters can be used to define such regions, for the avoidance of doubt, alignment can be performed using BLAST® (Basic Local Alignment Search Tool) using default parameters of version BLAST+ 2.8.0 released Mar. 28, 2018.

As used herein, a "transgene" is a polynucleotide that is delivered to a cell by a vector.

A "gene" refers to a polynucleotide containing at least one open reading frame that is capable of encoding a particular gene product after being transcribed, and sometimes also translated. The term "gene" or "coding sequence" refers to a nucleotide sequence in vitro or in vivo that encodes a gene product. In some instances, the gene consists or consists essentially of coding sequence, that is, sequence that encodes the gene product. In other instances, the gene comprises additional, non-coding, sequence. For example, the gene may or may not include regions preceding and following the coding region, e.g. 5' untranslated (5' UTR) or "leader" sequences and 3' UTR or "trailer" sequences, as well as intervening sequences (introns) between individual coding segments (exons).

A "gene product" is a molecule resulting from expression of a particular gene. Gene products include, e.g., a polypeptide, an aptamer, an interfering RNA, an mRNA, and the like. In particular embodiments, a "gene product" is a polypeptide, peptide, protein or interfering RNA including short interfering RNA (siRNA), miRNA or small hairpin RNA (shRNA). In particular embodiments, a gene product is a therapeutic gene product, e.g., a therapeutic protein.

As used herein, a "therapeutic gene" refers to a gene that, when expressed, produces a therapeutic gene product that confers a beneficial effect on the cell or tissue in which it is present, or on a mammal in which the gene is expressed. Examples of beneficial effects include amelioration of a sign or symptom of a condition or disease, prevention or inhibition of a condition or disease, or conferral of a desired characteristic. Therapeutic genes include, but are not limited to, genes that correct a genetic deficiency in a cell or mammal.

All patents, patent applications, and publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

SEQUENCE LISTING (211872 sequences)

SEQ ID NO: 1 - DNA, 2208 bp, Adeno-associated virus - 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 2 - protein, 735 aa, Adeno-associated virus - 2 [sequence omitted]

SEQ ID NO: 3 - protein, 28 aa, Adeno-associated virus - 2
DEEEIRTTNPVATEQYGSVSTNLQRGNR

SEQ ID NO: 4 - protein, 28 aa, Artificial Sequence
  Description of Artificial Sequence: Synthetic peptide
DEEEIRTTNPVATEQYGSVSDNLQRSNR

SEQ ID NO: 5 - protein, 29 aa, Artificial Sequence
  Description of Artificial Sequence: Synthetic peptide
DEEEIRTTNPVATEQYGSVSTNLQLRVNR

SEQ ID NO: 6 - protein, 28 aa, Artificial Sequence
  Description of Artificial Sequence: Synthetic peptide
DEEEIRTTNPEATEQYGSVWTNLQRGNR

SEQ ID NO: 7 - protein, 29 aa, Artificial Sequence
  Description of Artificial Sequence: Synthetic peptide
DEEEIRTTNPVATEQYGSVSDTNLQRGNN

SEQ ID NO: 8 - protein, 28 aa, Artificial Sequence
  Description of Artificial Sequence: Synthetic peptide
DENEIRTTNPVAIEQYGSVSTNLQRGNR

SEQ ID NO: 9 - protein, 30 aa, Artificial Sequence
  Description of Artificial Sequence: Synthetic polypeptide
DEEEIRTTNPVATEQYGSVSDTNLQRGNAR

SEQ ID NO: 10 - protein, 28 aa, Artificial Sequence
  Description of Artificial Sequence: Synthetic peptide
DEEEIRTTNPVATEQYGSASTNLCRGNR

SEQ ID NO: 11 - protein, 29 aa, Artificial Sequence
  Description of Artificial Sequence: Synthetic peptide
DEEEIRTTNPVATEQYGSAVSMNLQRGNR

SEQ ID NO: 12 - protein, 29 aa, Artificial Sequence
  Description of Artificial Sequence: Synthetic peptide
DEEEIRTTNPVATEQYGSVSDTNLTRGNR

SEQ ID NO: 13 - protein, 30 aa, Artificial Sequence
  Description of Artificial Sequence: Synthetic polypeptide
DEEEIRTTNPVATEQYGSVSDTNLQRLGNR

SEQ ID NO: 14 - protein, 28 aa, Artificial Sequence
  Description of Artificial Sequence: Synthetic peptide
DEDEIRTTNPVATEQYGLVSTNLQRGNR

SEQ ID NO: 15 - protein, 28 aa, Artificial Sequence
  Description of Artificial Sequence: Synthetic peptide
DEEEIRTTNPEATWQYGSVSTNLQRGNR

SEQ ID NO: 16 - protein, 29 aa, Artificial Sequence
  Description of Artificial Sequence: Synthetic peptide
DEEEIRTTNPVATEQYGSVSDNLQHRGNR

SEQ ID NO: 17 - protein, 28 aa, Artificial Sequence
  Description of Artificial Sequence: Synthetic peptide
DEEEIRTTNPVATEAYGSMSTNLQRGNR

SEQ ID NO: 18 - protein, 30 aa, Artificial Sequence
  Description of Artificial Sequence: Synthetic polypeptide
DEEEIRTTNPVATEQYGSVSDTNLQWRGNR

SEQ ID NO: 19 - protein, 29 aa, Artificial Sequence
  Description of Artificial Sequence: Synthetic peptide
DEEEIRTTNPVATEQYGSVSSNLQRGDNR

SEQ ID NO: 20 - protein, 28 aa, Artificial Sequence
  Description of Artificial Sequence: Synthetic peptide
DEEEIRTTNPVATEQYGSVSSNLVRGNR

SEQ ID NO: 21 - protein, 28 aa, Artificial Sequence
  Description of Artificial Sequence: Synthetic peptide
DEMEIRTTNPVAGEQYGSVSTNLQRGNR

SEQ ID NO: 22 - protein, 29 aa, Artificial Sequence
  Description of Artificial Sequence: Synthetic peptide
DEEEIRTTNPVATEQYGSVSDNLQRAGNR

SEQ ID NO: 23 - protein, 29 aa, Artificial Sequence
  Description of Artificial Sequence: Synthetic peptide
DEEEIRTTNPVATEQYGSVSTNLQMGKNR

SEQ ID NO: 24 - protein, 28 aa, Artificial Sequence
  Description of Artificial Sequence: Synthetic peptide
DEEEIRTTNPEATEQYGVVSTNLQRGNR

SEQ ID NO: 25 - protein, 28 aa, Artificial Sequence
  Description of Artificial Sequence: Synthetic peptide
EEEEIRTTNPVATEQYGSVSTWLQRGNR

SEQ ID NO: 26 - protein, 28 aa, Artificial Sequence
  Description of Artificial Sequence: Synthetic peptide
DEEEIRTTNPVATEQYGSVSTNLQMGNE

SEQ ID NO: 27 - protein, 30 aa, Artificial Sequence
  Description of Artificial Sequence: Synthetic polypeptide
DEEEIRTTNPVATEQYGSVSDTNLIQRGNR

SEQ ID NO: 28 - protein, 30 aa, Artificial Sequence
  Description of Artificial Sequence: Synthetic polypeptide
DEEEIRTTNPVATEQYGSVSDTNLQRVGNR

SEQ ID NO: 29 - protein, 28 aa, Artificial Sequence
  Description of Artificial Sequence: Synthetic peptide
DEEEIRTTNPVATEAYGSGSTNLQRGNR

SEQ ID NO: 30 - protein, 28 aa, Artificial Sequence
  Description of Artificial Sequence: Synthetic peptide
DEMEIRCTNPVATEQYGSVSTNLQRGNR

SEQ ID NO: 31 - protein, 29 aa, Artificial Sequence
  Description of Artificial Sequence: Synthetic peptide
DEEEIRTTNPVATEQYGSVSDINLQRGNR

SEQ ID NO: 32 - protein, 29 aa, Artificial Sequence
  Description of Artificial Sequence: Synthetic peptide
DEEEIRTTNPVATEQYGSVSDNLQRGCNR

SEQ ID NO: 33 - protein, 28 aa, Artificial Sequence
  Description of Artificial Sequence: Synthetic peptide
DELEIWTTNPVATEQYGSVSTNLQRGNR

SEQ ID NO: 34 - protein, 29 aa, Artificial Sequence
  Description of Artificial Sequence: Synthetic peptide
DEEEIRTTNPVATEQYGSAVQTNLQRGNR

SEQ ID NO: 35 - protein, 28 aa, Artificial Sequence
  Description of Artificial Sequence: Synthetic peptide
DEDEIRTTNPVATEQYGSVSMNLQRGNR

SEQ ID NO: 36 - protein, 28 aa, Artificial Sequence
  Description of Artificial Sequence: Synthetic peptide
DEEEIRTTNPVATEQYGSVSTNLQMVNR

SEQ ID NO: 37 - protein, 29 aa, Artificial Sequence
  Description of Artificial Sequence: Synthetic peptide
DEEEIRTTNPVATEQYGSVSTTLQRGNMR

SEQ ID NO: 38 - protein, 28 aa, Artificial Sequence
  Description of Artificial Sequence: Synthetic peptide
DEEEIRTTNPVATEQYGSVSTTLQRGNE

SEQ ID NO: 39 - protein, 28 aa, Artificial Sequence
  Description of Artificial Sequence: Synthetic peptide
DEEEIRTTNPVATEQYGSVSTTLQRGMR

SEQ ID NO: 40 - protein, 29 aa, Artificial Sequence
  Description of Artificial Sequence: Synthetic peptide
EEEEIRTTNPVATEQYGSVSTNLVQRGNR

SEQ ID NO: 41 - protein, 29 aa, Artificial Sequence
  Description of Artificial Sequence: Synthetic peptide
DEEEIRTTNPVATEQYGSVSTGILQRGNR

SEQ ID NO: 42 - protein, 29 aa, Artificial Sequence
  Description of Artificial Sequence: Synthetic peptide
EEEEIRTTNPVATEQYGSVSTNLSQRGNR

SEQ ID NO: 43 - protein, 29 aa, Artificial Sequence
  Description of Artificial Sequence: Synthetic peptide
DEEEIRTTNPVATEQYGSVSDNLQRGNAR

SEQ ID NO: 44 - protein, 29 aa, Artificial Sequence
  Description of Artificial Sequence: Synthetic peptide
DEEEIRTTNPVATEQYGSVSSNLQRTGNR

SEQ ID NO: 45 - protein, 29 aa, Artificial Sequence
  Description of Artificial Sequence: Synthetic peptide
DEEEIRTTNPVATEQYGSVSDNLQRGNER

SEQ ID NO: 46 - protein, 28 aa, Artificial Sequence
  Description of Artificial Sequence: Synthetic peptide
AEEEMRTTNPVATEQYGSVSTNLQRGNR

SEQ ID NO: 47 - protein, 29 aa, Artificial Sequence
  Description of Artificial Sequence: Synthetic peptide
DELEIRTTNPVATEQYGSVSTNLQRTGNR

SEQ ID NO: 48 - protein, 29 aa, Artificial Sequence
  Description of Artificial Sequence: Synthetic peptide
EEEEIRTTNPVATEQYGSVSTNLQRMGNR

SEQ ID NO: 49 - protein, 28 aa, Artificial Sequence
  Description of Artificial Sequence: Synthetic peptide
EEEEIRTTNPVATEQYGSVSTNLQRGNW

SEQ ID NO: 50 - protein, 28 aa, Artificial Sequence
  Description of Artificial Sequence: Synthetic peptide
DEEEIRTTNPVATDQYGYVSTNLQRGNR

SEQ ID NO: 51 - protein, 28 aa, Artificial Sequence
  Description of Artificial Sequence: Synthetic peptide
DEEEIRTTNPVATEQYGSVSSNLQRPNR

SEQ ID NO: 52 - protein, 30 aa, Artificial Sequence
  Description of Artificial Sequence: Synthetic polypeptide
DEEEIRTTNPVATEQYGSVSTGNILQRGNR

SEQ ID NO: 53 - protein, 28 aa, Artificial Sequence
  Description of Artificial Sequence: Synthetic peptide
DEEEIRTTNPVATEQYGSVSTTLQGGNR

SEQ ID NO: 54 - protein, 29 aa, Artificial Sequence
  Description of Artificial Sequence: Synthetic peptide
DEEEIRTTNPVATEQYGSAVSCNLQRGNR

SEQ ID NO: 55 - protein, 28 aa, Artificial Sequence
  Description of Artificial Sequence: Synthetic peptide
DEMEIRTTNPVATEQYGSVCTNLQRGNR

SEQ ID NO: 56 - protein, 28 aa, Artificial Sequence
  Description of Artificial Sequence: Synthetic peptide
DEEEIRTTNPEATEQYGSVVTNLQRGNR

SEQ ID NO: 57 - protein, 29 aa, Artificial Sequence
  Description of Artificial Sequence: Synthetic peptide
DEEEIRTTNPVATEQYGSVSTTLQRGNRS

SEQ ID NO: 58 - protein, 29 aa, Artificial Sequence
  Description of Artificial Sequence: Synthetic peptide
DEEEIRTTNPVATEQYGSVSDNLQRGNVR

SEQ ID NO: 59 - protein, 28 aa, Artificial Sequence
  Description of Artificial Sequence: Synthetic peptide
EEEEIRTTNPVATEQYGSVSTTLQRGNR

SEQ ID NO: 60 - protein, 29 aa, Artificial Sequence
  Description of Artificial Sequence: Synthetic peptide
DEEEIRTTNPVATEQYGSVSTNLQQGNHR

SEQ ID NO: 61 - protein, 29 aa, Artificial Sequence
  Description of Artificial Sequence: Synthetic peptide
DEEEIRTTNPVATEQYGSVSDNLQRGLNR

SEQ ID NO: 62 - protein, 28 aa, Artificial Sequence
  Description of Artificial Sequence: Synthetic peptide
DEEEIRTTNPVATEQYGSVSDNLQRGNA

SEQ ID NO: 63 - protein, 29 aa, Artificial Sequence
  Description of Artificial Sequence: Synthetic peptide
DEEEIRTTNPVATEQYGSVSDNLQRGNTR

SEQ ID NO: 64 - protein, 29 aa, Artificial Sequence
  Description of Artificial Sequence: Synthetic peptide
DEEEIRTTNPVATEQYGSVSDTNLWRGNR

SEQ ID NO: 65 - protein, 29 aa, Artificial Sequence
  Description of Artificial Sequence: Synthetic peptide
DEEEIRTTNPVATEQYGSVSTTLTQRGNR

SEQ ID NO: 66 - protein, 30 aa, Artificial Sequence
  Description of Artificial Sequence: Synthetic polypeptide
DEEEIRTTNPVATEQYGSVSITMNLQRGNR

SEQ ID NO: 67 - protein, 30 aa, Artificial Sequence
  Description of Artificial Sequence: Synthetic polypeptide
DEEEIRTTNPVATEQYGSVSTNLQLRGVNR

SEQ ID NO: 68 - protein, 28 aa, Artificial Sequence
  Description of Artificial Sequence: Synthetic peptide
DEEEIRTTNPVATEQYGSVSTNLQQGNA

SEQ ID NO: 69 - protein, 29 aa, Artificial Sequence
  Description of Artificial Sequence: Synthetic peptide
DEEEIRTTNPVATEQYGSVSTNLQMGNMR

SEQ ID NO: 70 - protein, 28 aa, Artificial Sequence
  Description of Artificial Sequence: Synthetic peptide
DEEEIRTTNPVATEQYGSASTHLQRGNR

SEQ ID NO: 71 - protein, 29 aa, Artificial Sequence
  Description of Artificial Sequence: Synthetic peptide
DEEEIRTTNPVATEQYGSVSTNLQQGNSR

SEQ ID NO: 72 - protein, 29 aa, Artificial Sequence
  Description of Artificial Sequence: Synthetic peptide
DEEEIRTTNPVATEQYGSVSDNLQRGNSR

SEQ ID NO: 73 - protein, 28 aa, Artificial Sequence
  Description of Artificial Sequence: Synthetic peptide
DEEEIRTTNPFASEQYGSVSTNLQRGNR

SEQ ID NO: 74 - protein, 28 aa, Artificial Sequence
  Description of Artificial Sequence: Synthetic peptide
DEEEIRTTNPVATEQYGSVSTGLDRGNR

SEQ ID NO: 75 - protein, 29 aa, Artificial Sequence
  Description of Artificial Sequence: Synthetic peptide
DEEEIRTTNPVATEQYGSVSSNLQRGNNR

SEQ ID NO: 76 - protein, 30 aa, Artificial Sequence
  Description of Artificial Sequence: Synthetic polypeptide
DEEEIRTTNPVATEQYGSVSTGNLQFRGNR

SEQ ID NO: 77 - protein, 29 aa, Artificial Sequence
  Description of Artificial Sequence: Synthetic peptide
DEEEIRTTNPVATEQYGSVSLTNLQRPNR

SEQ ID NO: 78 - protein, 29 aa, Artificial Sequence
  Description of Artificial Sequence: Synthetic peptide
DEEEIRTTNPVATEQYGSVSDNLQRGNRF

SEQ ID NO: 79 - protein, 30 aa, Artificial Sequence
  Description of Artificial Sequence: Synthetic polypeptide
DEEEIRTTNPVATEQYGSVSTNLQLRGNRT

SEQ ID NO: 80 - protein, 29 aa, Artificial Sequence
  Description of Artificial Sequence: Synthetic peptide
DEEEIRTTNPVATEQYGSVSTNLQQGNRY

SEQ ID NO: 81 - protein, 28 aa, Artificial Sequence
  Description of Artificial Sequence: Synthetic peptide
DEEEIRTTNPVATEQYGSVSDNLQAGNR

SEQ ID NO: 82 - protein, 28 aa, Artificial Sequence
  Description of Artificial Sequence: Synthetic peptide
DEEEIRTTNPVATEQYGSVSTNLQPSNR

SEQ ID NO: 83 - protein, 30 aa, Artificial Sequence
  Description of Artificial Sequence: Synthetic polypeptide
DEEEIRTTNPVATEQYGSVSDTNLDQRGNR

SEQ ID NO: 84 - protein, 28 aa, Artificial Sequence
  Description of Artificial Sequence: Synthetic peptide
FEEEIRTTNPVATEQYGEVSTNLQRGNR

SEQ ID NO: 85 - protein, 30 aa, Artificial Sequence
  Description of Artificial Sequence: Synthetic polypeptide
DEEEIRTTNPVATEQYGSVSLTPNLQRGNR

SEQ ID NO: 86 - protein, 30 aa, Artificial Sequence
  Description of Artificial Sequence: Synthetic polypeptide
DEEEIRTTNPVATEQYGSAVSTTNLQRGNR

SEQ ID NO: 87 - protein, 29 aa, Artificial Sequence
  Description of Artificial Sequence: Synthetic peptide
DEEEIRTTNPVATEQYGSVSNTNLQRGFR

SEQ ID NO: 88 - protein, 28 aa, Artificial Sequence
  Description of Artificial Sequence: Synthetic peptide
FEEEIRTTNPVATEIYGSVSTNLQRGNR

SEQ ID NO: 89 - protein, 28 aa, Artificial Sequence
  Description of Artificial Sequence: Synthetic peptide
DEEEIRTTNPVATEQYGSVSTGLQVGNR

SEQ ID NO: 90 - protein, 28 aa, Artificial Sequence
  Description of Artificial Sequence: Synthetic peptide
FEEEIRTTNPVADEQYGSVSTNLQRGNR

SEQ ID NO: 91 - protein, 28 aa, Artificial Sequence
  Description of Artificial Sequence: Synthetic peptide
FEEEIRTTNPVACEQYGSVSTNLQRGNR

SEQ ID NO: 92 - protein, 28 aa, Artificial Sequence
  Description of Artificial Sequence: Synthetic peptide
DEDEIRTTNPVATEQYGSVATNLQRGNR

SEQ ID NO: 93 - protein, 28 aa, Artificial Sequence
  Description of Artificial Sequence: Synthetic peptide
DEEEIRTTNPVATEQYGSVSTNLQMPNR

SEQ ID NO: 94 - protein, 28 aa, Artificial Sequence
  Description of Artificial Sequence: Synthetic peptide
DEMEIRTTNPVATEQYGYVSTNLQRGNR

SEQ ID NO: 95 - protein, 29 aa, Artificial Sequence
  Description of Artificial Sequence: Synthetic peptide
DEMEIRTTNPVATEQYGSVSTNLQQRGNR

SEQ ID NO: 96 - protein, 28 aa, Artificial Sequence
  Description of Artificial Sequence: Synthetic peptide
FEEEIATTNPVATEQYGSVSTNLQRGNR

SEQ ID NO: 97 - protein, 28 aa, Artificial Sequence
  Description of Artificial Sequence: Synthetic peptide
DEMELRTTNPVATEQYGSVSTNLQRGNR

SEQ ID NO: 98 - protein, 29 aa, Artificial Sequence
  Description of Artificial Sequence: Synthetic peptide
DEEEIRTTNPVATEQYGSVSTNLQPGNIR

SEQ ID NO: 99 - protein, 29 aa, Artificial Sequence
  Description of Artificial Sequence: Synthetic peptide
DEEEIRTTNPVATEQYGSVSTGLQRMGNR

SEQ ID NO: 100 - protein, 29 aa, Artificial Sequence
  Description of Artificial Sequence: Synthetic peptide
DEEEIRTTNPVATEQYGSAVSTNLQRGNW

SEQ ID NO: 101 - protein, 28 aa, Artificial Sequence
  Description of Artificial Sequence: Synthetic peptide
DEMEIRTTNPVATEQYGCVSTNLQRGNR

SEQ ID NO: 102 - protein, 29 aa, Artificial Sequence
  Description of Artificial Sequence: Synthetic peptide
DEEEIRTTNPVATEQYGSVSTNLQPGNMR

SEQ ID NO: 103 - protein, 28 aa, Artificial Sequence
  Description of Artificial Sequence: Synthetic peptide
DEEEIRTTNPVATEQYGSASTNMQRGNR

SEQ ID NO: 104 - protein, 29 aa, Artificial Sequence
  Description of Artificial Sequence: Synthetic peptide
DEEEIRTTNPVATEQYGSVSTGLQRLGNR

SEQ ID NO: 105 - protein, 30 aa, Artificial Sequence
  Description of Artificial Sequence: Synthetic polypeptide
DEEEIRTTNPVATEQYGSAVSTNLQRGENR

SEQ ID NO: 106 - protein, 29 aa, Artificial Sequence
  Description of Artificial Sequence: Synthetic peptide
DEEEIRTTNPVATEQYGSAVSTNLVRGNR

SEQ ID NO: 107 - protein, 29 aa, Artificial Sequence
  Description of Artificial Sequence: Synthetic peptide
DEEEIRTTNPVATEQYGSVSTGLQRGVNR

SEQ ID NO: 108 - protein, 29 aa, Artificial Sequence
  Description of Artificial Sequence: Synthetic peptide
DEEEIRTTNPVATEQYGSVSTNLQMRGFR

SEQ ID NO: 109 - protein, 30 aa, Artificial Sequence
  Description of Artificial Sequence: Synthetic polypeptide
DEEEIRTTNPVATEQYGSVSTTNYLQRGNR

SEQ ID NO: 110 - protein, 30 aa, Artificial Sequence
  Description of Artificial Sequence: Synthetic polypeptide
DEEEIRTTNPVATEQYGSVSTNLQNRMGNR

SEQ ID NO: 111 - protein, 30 aa, Artificial Sequence
  Description of Artificial Sequence: Synthetic polypeptide
DEEEIRTTNPVATEQYGSVSTNLQNRGDNR

SEQ ID NO: 112 - protein, 29 aa, Artificial Sequence
  Description of Artificial Sequence: Synthetic peptide
DEEEIRTTNPVATEQYGSVSTNLQNPGNR

SEQ ID NO: 113 - protein, 30 aa, Artificial Sequence
  Description of Artificial Sequence: Synthetic polypeptide
DEEEIRTTNPVATEQYGSVSTNLQNRPGNR

SEQ ID NO: 114 - protein, 29 aa, Artificial Sequence
  Description of Artificial Sequence: Synthetic peptide
DEEEIRTTNPVATEQYGSVSSNYLQRGNR

SEQ ID NO: 115 - protein, 30 aa, Artificial Sequence
  Description of Artificial Sequence: Synthetic polypeptide
DEEEIRTTNPVATEQYGSVSTTNLQRSGNR

SEQ ID NO: 116 - protein, 30 aa, Artificial Sequence
  Description of Artificial Sequence: Synthetic polypeptide
DEEEIRTTNPVATEQYGSVSTTNLQRGNRT

SEQ ID NO: 117 - protein, 28 aa, Artificial Sequence
  Description of Artificial Sequence: Synthetic peptide
DEEEIRTTNPEATMQYGSVSTNLQRGNR

SEQ ID NO: 118 - protein, 29 aa, Artificial Sequence
  Description of Artificial Sequence: Synthetic peptide
DEEEIRTTNPVATEQYGSVSTNLQNGNRV

SEQ ID NO: 119 - protein, 30 aa, Artificial Sequence
  Description of Artificial Sequence: Synthetic polypeptide
DEEEIRTTNPVATEQYGSVSTNLQMRGNIR

SEQ ID NO: 120 - protein, 28 aa, Artificial Sequence
  Description of Artificial Sequence: Synthetic peptide
DEMEIRTTNPVATEQYGSVSTNPQRGNR

SEQ ID NO: 121 - protein, 28 aa, Artificial Sequence
  Description of Artificial Sequence: Synthetic peptide
DEDEIRTTNPVATEQYGSVQTNLQRGNR

SEQ ID NO: 122 - protein, 30 aa, Artificial Sequence
  Description of Artificial Sequence: Synthetic polypeptide
DEEEIRTTNPVATEQYGSAVYSTNLQRGNR

SEQ ID NO: 123 - protein, 30 aa, Artificial Sequence
  Description of Artificial Sequence: Synthetic polypeptide
DEEEIRTTNPVATEQYGSVSTTNLQRGNDR

SEQ ID NO: 124 - protein, 29 aa, Artificial Sequence
  Description of Artificial Sequence: Synthetic peptide
DEEEIRTTNPVATEQYGSVSTTNLQRGNA

SEQ ID NO: 125 - protein, 28 aa, Artificial Sequence
  Description of Artificial Sequence: Synthetic peptide
FEEEIRTTNPVATEQYGSISTNLQRGNR

SEQ ID NO: 126 - protein, 29 aa, Artificial Sequence
  Description of Artificial Sequence: Synthetic peptide
DEEEIRTTNPVATEQYGSVSTNLQMRGIR

SEQ ID NO: 127 - protein, 28 aa, Artificial Sequence
  Description of Artificial Sequence: Synthetic peptide
DEEEIRTTNPVATEQYGSASYNLQRGNR

SEQ ID NO: 128 - protein, 29 aa, Artificial Sequence
  Description of Artificial Sequence: Synthetic peptide
DEEEIRTTNPVATEQYGSASVTNLQRGNR

SEQ ID NO: 129 - protein, 29 aa, Artificial Sequence
  Description of Artificial Sequence: Synthetic peptide
DEEEIRTTNPVATEQYGSVSTNLQNRTNR

SEQ ID NO: 130 - protein, 29 aa, Artificial Sequence
  Description of Artificial Sequence: Synthetic peptide
DEEEIRTTNPVATEQYGSCCSTNLQRGNR

SEQ ID NO: 131 - protein, 28 aa, Artificial Sequence
  Description of Artificial Sequence: Synthetic peptide
DEEEIRTTNPVATEQYGSVSDNLCRGNR

SEQ ID NO: 132 - protein, 30 aa, Artificial Sequence
  Description of Artificial Sequence: Synthetic polypeptide
DEEEIRTTNPVATEQYGSVSTTNLQRGNRG

SEQ ID NO: 133 - protein, 29 aa, Artificial Sequence
  Description of Artificial Sequence: Synthetic peptide
DEMEIRTTNPVATEQYGSVSTCNLQRGNR

SEQ ID NO: 134 - protein, 29 aa, Artificial Sequence
  Description of Artificial Sequence: Synthetic peptide
DEEEIATTNPVATEQYNGSVSTNLQRGNR

SEQ ID NO: 135 - protein, 29 aa, Artificial Sequence
  Description of Artificial Sequence: Synthetic peptide
DEEEIRTTNPVATEQYGSVSTNLQPGSNR

SEQ ID NO: 136 - protein, 29 aa, Artificial Sequence
  Description of Artificial Sequence: Synthetic peptide
DEEEIRTTNPVATEQYGSVSTNLQPRGNM

SEQ ID NO: 137 - protein, 28 aa, Artificial Sequence
  Description of Artificial Sequence: Synthetic peptide
DEEEIRTTNPVATEQYGSASTNLQRGNF

SEQ ID NO: 138 - protein, 29 aa, Artificial Sequence
  Description of Artificial Sequence: Synthetic peptide
DEEEIRTTNPVATEQYGSASTNLQRCGNR

SEQ ID NO: 139 - protein, 30 aa, Artificial Sequence
  Description of Artificial Sequence: Synthetic polypeptide
DEEEIRTTNPVATEQYGSAVSTNLLQRGNR

SEQ ID NO: 140 - protein, 29 aa, Artificial Sequence
  Description of Artificial Sequence: Synthetic peptide
DEEEIRTTNPVATEQYGSVSTNLQNFGNR

SEQ ID NO: 141 - protein, 28 aa, Artificial Sequence
  Description of Artificial Sequence: Synthetic peptide
DEEEIRTTNPVATEQYGSVSTNLQMGWR

SEQ ID NO: 142 - protein, 30 aa, Artificial Sequence
  Description of Artificial Sequence: Synthetic polypeptide
DEEEIRTTNPVATEQYGSAVSTNCLQRGNR

SEQ ID NO: 143 - protein, 29 aa, Artificial Sequence
  Description of Artificial Sequence: Synthetic peptide
DEEEIRTTNPVATEQYGSVSTGLQMRGNR

SEQ ID NO: 144 - protein, 30 aa, Artificial Sequence
  Description of Artificial Sequence: Synthetic polypeptide
DEEEIRTTNPVATEQYGSVSTNLQPRGNRL

SEQ ID NO: 145 - protein, 28 aa, Artificial Sequence
  Description of Artificial Sequence: Synthetic peptide
DEEEIRTTNPVATEQYGSVSTNLQNDNR

SEQ ID NO: 146 - protein, 29 aa, Artificial Sequence
  Description of Artificial Sequence: Synthetic peptide
DEEEIRTTNPVATEQYGSVSTTNLERGNR

SEQ ID NO: 147 - protein, 30 aa, Artificial Sequence
  Description of Artificial Sequence: Synthetic polypeptide
DEEEIRTTNPVATEQYGSVSTNLQPRGNRS

SEQ ID NO: 148 - protein, 29 aa, Artificial Sequence
  Description of Artificial Sequence: Synthetic peptide
DEEEIRTTNPVATEQYGSVSTNLQPYGNR

SEQ ID NO: 149 - protein, 29 aa, Artificial Sequence
  Description of Artificial Sequence: Synthetic peptide
DEEEIRTTNPVATEQYGSVSDTLLQRGNR

SEQ ID NO: 150 - protein, 28 aa, Artificial Sequence
  Description of Artificial Sequence: Synthetic peptide
FEEEIRTTNPVATEQYGSVSDNLQRGNR

SEQ ID NO: 151 - protein, 30 aa, Artificial Sequence
  Description of Artificial Sequence: Synthetic polypeptide
DEEEIRTTNPVATEQYGSVSDTNALQRGNR

SEQ ID NO: 152 - protein, 28 aa, Artificial Sequence
  Description of Artificial Sequence: Synthetic peptide
DEECIRTTNPVATEQGGSVSTNLQRGNR

SEQ ID NO: 153 - protein, 29 aa, Artificial Sequence
  Description of Artificial Sequence: Synthetic peptide
DEEEIRTTNPVATEQYGSVSTTNDQRGNR

SEQ ID NO: 154 - protein, 29 aa, Artificial Sequence
  Description of Artificial Sequence: Synthetic peptide
DEEEIRTTNPVATEQYGSVSTNLQQEGNR

SEQ ID NO: 155 - protein, 29 aa, Artificial Sequence
  Description of Artificial Sequence: Synthetic peptide
DEEEIRTTNPVATEQYGSVSTNLQMGNSR

SEQ ID NO: 156 - protein, 28 aa, Artificial Sequence
  Description of Artificial Sequence: Synthetic peptide
EEEEIRTTNPVATEQYGSVTTNLQRGNR

SEQ ID NO: 157 - protein, 29 aa, Artificial Sequence
  Description of Artificial Sequence: Synthetic peptide
DEEEIRTTNPVATEQYGSVSDTNHQRGNR

SEQ ID NO: 158 - protein, 30 aa, Artificial Sequence
  Description of Artificial Sequence: Synthetic polypeptide
DEEEIRTTNPVATEQYGSVSTTNILQRGNR

SEQ ID NO: 159 - protein, 29 aa, Artificial Sequence
  Description of Artificial Sequence: Synthetic peptide
DEEEIRTTNPVATEQYGSVSTNLQPGNSR

SEQ ID NO: 160 - protein, 28 aa, Artificial Sequence
  Description of Artificial Sequence: Synthetic peptide
DEMEIRTTNPVATEQYGSVSTNAQRGNR

SEQ ID NO: 161 - protein, 28 aa, Artificial Sequence
  Description of Artificial Sequence: Synthetic peptide
EEKEIRTTNPVATEQYGSVSTNLQRGNR

SEQ ID NO: 162 - protein, 29 aa, Artificial Sequence
  Description of Artificial Sequence: Synthetic peptide
DEEEIRTTNPVATEQYGSASTNLTQRGNR

SEQ ID NO: 163 - protein, 29 aa, Artificial Sequence
  Description of Artificial Sequence: Synthetic peptide
DEEEIRTTNPVATEQYGSASTNLQRTGNR

SEQ ID NO: 164 - protein, 28 aa, Artificial Sequence
  Description of Artificial Sequence: Synthetic peptide
DEEEIRTTNPVATEQYGSVSTNLQNGNF

SEQ ID NO: 165 - protein, 28 aa, Artificial Sequence
  Description of Artificial Sequence: Synthetic peptide
DEEEIRTTNPVATEQYGSASTNLQRMNR

SEQ ID NO: 166 - protein, 29 aa, Artificial Sequence
  Description of Artificial Sequence: Synthetic peptide
DEEEIRTTNPVATEQYGSVSSTDLQRGNR

SEQ ID NO: 167 - protein, 29 aa, Artificial Sequence
  Description of Artificial Sequence: Synthetic peptide
DEEEIRTTNPVATEQYGSAVSTNLQFGNR

SEQ ID NO: 168 - protein, 29 aa, Artificial Sequence
  Description of Artificial Sequence: Synthetic peptide
DEEEIRTTNPVATEQYGSVSTNLQPKGNR

SEQ ID NO: 169 - protein, 28 aa, Artificial Sequence
  Description of Artificial Sequence: Synthetic peptide
DEEEIRTTNPVATEQYGSVSTNLQPKNR

SEQ ID NO: 170 - protein, 29 aa, Artificial Sequence
  Description of Artificial Sequence: Synthetic peptide
DEEEIRTTNPVATEQYGSASTNLQRGNVR

SEQ ID NO: 171 - protein, 28 aa, Artificial Sequence
  Description of Artificial Sequence: Synthetic peptide
EEYEIRTTNPVATEQYGSVSTNLQRGNR

SEQ ID NO: 172 - protein, 29 aa, Artificial Sequence
  Description of Artificial Sequence: Synthetic peptide
DEEEIRTTNPVATEQYGSVSTGLQRGFNR

SEQ ID NO: 173 - protein, 30 aa, Artificial Sequence
  Description of Artificial Sequence: Synthetic polypeptide
DEEEIRTTNPVATEQYGSAVSTNLQCRGNR

SEQ ID NO: 174 - protein, 29 aa, Artificial Sequence
  Description of Artificial Sequence: Synthetic peptide
DEEEIRTTNPVATEQYGSVSDNLFQRGNR

SEQ ID NO: 175 - protein, 30 aa, Artificial Sequence
  Description of Artificial Sequence: Synthetic polypeptide
DEEEIRTTNPVATEQYGSVSCTTNLQRGNR

SEQ ID NO: 176 - protein, 29 aa, Artificial Sequence
  Description of Artificial Sequence: Synthetic peptide
DEEEIRTTNPVATEQYGSVSTGLQRGNAR

SEQ ID NO: 177 - protein, 30 aa, Artificial Sequence
  Description of Artificial Sequence: Synthetic polypeptide
DEEEIRTTNPVATEQYGSVSTNLQMRGTNR

SEQ ID NO: 178 - protein, 28 aa, Artificial Sequence
  Description of Artificial Sequence: Synthetic peptide
DEEEIRTTNPVATEQYGSASTNLQRGNH

SEQ ID NO: 179 - protein, 29 aa, Artificial Sequence
  Description of Artificial Sequence: Synthetic peptide
DEEEIRTTNPVATEQYGSVSTNLQPQGNR

SEQ ID NO: 180 - protein, 28 aa, Artificial Sequence
  Description of Artificial Sequence: Synthetic peptide
DEEEIRTTNPVATEQYGSVSDNLHRGNR

SEQ ID NO: 181 - protein, 28 aa, Artificial Sequence
  Description of Artificial Sequence: Synthetic peptide
DEEEIRTTNPVATEQYGSVSTGLQRGGR

SEQ ID NO: 182 - protein, 29 aa, Artificial Sequence
  Description of Artificial Sequence: Synthetic peptide
DEEEIRTTNPVATEQYGSVSTNLQPRGCR

SEQ ID NO: 183 - protein, 29 aa, Artificial Sequence
  Description of Artificial Sequence: Synthetic peptide
DEEEIRTTNPVATEQYGSAVSTNLLRGNR

SEQ ID NO: 184 - protein, 29 aa, Artificial Sequence
  Description of Artificial Sequence: Synthetic peptide
DEEEIRTTNPVATEQYGSVSTTNLQTGNR

SEQ ID NO: 185 - protein, 29 aa, Artificial Sequence
  Description of Artificial Sequence: Synthetic peptide
DEEEIRTTNPVATEQYGSVSDNNLQRGNR

SEQ ID NO: 186 - protein, 29 aa, Artificial Sequence
  Description of Artificial Sequence: Synthetic peptide
DEEEIRTTNPFATEQYGSVSTMNLQRGNR

SEQ ID NO: 187 - protein, 28 aa, Artificial Sequence
  Description of Artificial Sequence: Synthetic peptide
EEEEIRTTNPVATEQYGSVSTNLQRGAR

SEQ ID NO: 188 - protein, 30 aa, Artificial Sequence
  Description of Artificial Sequence: Synthetic polypeptide
DEEEIRTTNPVATEQYGSVSTNLQRGENDR

SEQ ID NO: 189 - protein, 28 aa, Artificial Sequence
  Description of Artificial Sequence: Synthetic peptide
DEEEIRTTNPVATEQYGSVSTNLQRGEM

SEQ ID NO: 190 - protein, 29 aa, Artificial Sequence
  Description of Artificial Sequence: Synthetic peptide
DEEEIRTTNPVATEQYGSVSTNLQRGEKR

SEQ ID NO: 191 - protein, 28 aa, Artificial Sequence
  Description of Artificial Sequence: Synthetic peptide
DEEEIRTTNPVATEQYGSVSTNLQRGED

SEQ ID NO: 192 - protein, 29 aa, Artificial Sequence
  Description of Artificial Sequence: Synthetic peptide
DEEEIRTTNPVATEQYGSVSTQNLQRGFR

SEQ ID NO: 193 - protein, 30 aa, Artificial Sequence
  Description of Artificial Sequence: Synthetic polypeptide
DEEEIRTTNPVATEQYGSVSTQNLQRNGNR

SEQ ID NO: 194 - protein, 28 aa, Artificial Sequence
  Description of Artificial Sequence: Synthetic peptide
DEEEIRTTNPVASEQYGSVSANLQRGNR

SEQ ID NO: 195 - protein, 28 aa, Artificial Sequence
  Description of Artificial Sequence: Synthetic peptide
DEEEIRTTNPVATEQYGSVSTNLQRGEA

SEQ ID NO: 196 - protein, 28 aa, Artificial Sequence
  Description of Artificial Sequence: Synthetic peptide
DEEEIRTTNPVATEQYGSVATNLVRGNR

SEQ ID NO: 197 - protein, 29 aa, Artificial Sequence
  Description of Artificial Sequence: Synthetic peptide
DEEEIRTTNPVATEQYGSVSTNLQRGDRE

SEQ ID NO: 198 - protein, 29 aa, Artificial Sequence
  Description of Artificial Sequence: Synthetic peptide
DEDEIRTTNPVATEQYGCSVSTNLQRGNR

SEQ ID NO: 199 - protein, 28 aa, Artificial Sequence
  Description of Artificial Sequence: Synthetic peptide
DENEIRTTNPVATWQYGSVSTNLQRGNR

SEQ ID NO: 200 - protein, 29 aa, Artificial Sequence
  Description of Artificial Sequence: Synthetic peptide
DEEEIRTTNPVASEQYGSVSDTNLQRGNR

SEQ ID NO: 201 - protein, 29 aa, Artificial Sequence
  Description of Artificial Sequence: Synthetic peptide
DEEEIRTTNPVATEQYGSVSTNLQRGDNI

SEQ ID NO: 202 - protein, 28 aa, Artificial Sequence
  Description of Artificial Sequence: Synthetic peptide
DEEEIRATNPVATLQYGSVSTNLQRGNR

SEQ ID NO: 203 - protein, 29 aa, Artificial Sequence
  Description of Artificial Sequence: Synthetic peptide
DEEEIRTTNPVATEQYGSVSTQNLQGGNR

SEQ ID NO: 204 - protein, 28 aa, Artificial Sequence
  Description of Artificial Sequence: Synthetic peptide
DEEEIRTTNPVAQEQYGSVSTVLQRGNR

SEQ ID NO: 205 - protein, 30 aa, Artificial Sequence
  Description of Artificial Sequence: Synthetic polypeptide
DEEEIRTTNPVATEQYGSVSTNLQRGENRK

SEQ ID NO: 206 - protein, 30 aa, Artificial Sequence
  Description of Artificial Sequence: Synthetic polypeptide
DEEEIRTTNPVATEQYGSVSTNLQRGENRL

SEQ ID NO: 207 - protein, 29 aa, Artificial Sequence
  Description of Artificial Sequence: Synthetic peptide
DEEEIRTTNPVAPEQYGSVSTNLQERGNR

SEQ ID NO: 208 - protein, 30 aa, Artificial Sequence
  Description of Artificial Sequence: Synthetic polypeptide
DEEEIRTTNPVATEQYGSVSTNLQRGGNQR

SEQ ID NO: 209 - protein, 29 aa, Artificial Sequence
  Description of Artificial Sequence: Synthetic peptide
DEEEIRTTNPVATEQYGSVSTNLQRGGNI

SEQ ID NO: 210 - protein, 28 aa, Artificial Sequence
  Description of Artificial Sequence: Synthetic peptide
DEEEIRTTNPVATEQYGSVSTNLQRGGG

SEQ ID NO: 211 - protein, 28 aa, Artificial Sequence
  Description of Artificial Sequence: Synthetic peptide
DEEEIRTTNPVATEQYGSVSTNLQRGGF

SEQ ID NO: 212 - protein, 29 aa, Artificial Sequence
  Description of Artificial Sequence: Synthetic peptide
DEEEIRTTNPVATEQYGSVSTNLQRGFVR

SEQ ID NO: 213 - protein, 28 aa, Artificial Sequence
  Description of Artificial Sequence: Synthetic peptide
DEEEIRTTNPVAPEQYGSVSTNLQRGNA

SEQ ID NO: 214 - protein, 29 aa, Artificial Sequence
  Description of Artificial Sequence: Synthetic peptide
DEEEIRTTNPVATEQYGSVSTNLQRGDLR

SEQ ID NO: 215 - protein, 29 aa, Artificial Sequence
  Description of Artificial Sequence: Synthetic peptide
DEEEIRTTNPVATEQYGSVSTQNLQAGNR

SEQ ID NO: 216 - protein, 30 aa, Artificial Sequence
  Description of Artificial Sequence: Synthetic polypeptide
DEEEIRTTNPVATEQYGSVSTNLQRGFNIR

SEQ ID NO: 217 - protein, 29 aa, Artificial Sequence
  Description of Artificial Sequence: Synthetic peptide
DEEEIRTTNPVATEQYGSVSTNLQRGFNA

SEQ ID NO: 218 - protein, 29 aa, Artificial Sequence
  Description of Artificial Sequence: Synthetic peptide
DEEEIRTTNPVATEQYGSVSTQNLQDGNR

SEQ ID NO: 219 - protein, 28 aa, Artificial Sequence
  Description of Artificial Sequence: Synthetic peptide
DEEEIRTTNPVATEQYGSVSTNLQRGFM

SEQ ID NO: 220 - protein, 29 aa, Artificial Sequence
  Description of Artificial Sequence: Synthetic peptide
DEEEIRTTNPVATEQYGSVSTNLQRGFGR

SEQ ID NO: 221 - protein, 29 aa, Artificial Sequence
  Description of Artificial Sequence: Synthetic peptide
DEEEIRTTNPVATEQYGSVSTNLQRGERK

SEQ ID NO: 222 - protein, 29 aa, Artificial Sequence
  Description of Artificial Sequence: Synthetic peptide
DEEEIRTTNPVATEQYGSVSTQNLQFGNR

SEQ ID NO: 223 - protein, 29 aa, Artificial Sequence
  Description of Artificial Sequence: Synthetic peptide
DEEEIRTTNPVAQEQYGSVSTNLQRDGNR

SEQ ID NO: 224 - protein, 29 aa, Artificial Sequence
  Description of Artificial Sequence: Synthetic peptide
DEEEIRTTNPVATEQYGSVSTQNLMRGNR

SEQ ID NO: 225 - protein, 29 aa, Artificial Sequence
  Description of Artificial Sequence: Synthetic peptide
DEEEIRTTNPVATEQYGSVSTNLQRGDER

SEQ ID NO: 226 - protein, 28 aa, Artificial Sequence
  Description of Artificial Sequence: Synthetic peptide
DEEEIRTTNPVATEQYGSVSTNLQRGCN

SEQ ID NO: 227 - protein, 29 aa, Artificial Sequence
  Description of Artificial Sequence: Synthetic peptide
DEEEIRTTNPVATEQYGSVSTNLQRFNSR

SEQ ID NO: 228 - protein, 29 aa, Artificial Sequence
  Description of Artificial Sequence: Synthetic peptide
DEEEIRTTNPVATEQYGSVSTNLQRFNRW

SEQ ID NO: 229 - protein, 29 aa, Artificial Sequence
  Description of Artificial Sequence: Synthetic peptide
DEEEIRTTNPVATEQYGSVSTNLQRFNRD

SEQ ID NO: 230 - protein, 28 aa, Artificial Sequence
  Description of Artificial Sequence: Synthetic peptide
DEEEIRTTNPVASEQYGSVSTNLQLGNR

SEQ ID NO: 231 - protein, 29 aa, Artificial Sequence
  Description of Artificial Sequence: Synthetic peptide
DEEEIRTTNPVATEQYGSVSTRNLDRGNR

SEQ ID NO: 232 - protein, 29 aa, Artificial Sequence
  Description of Artificial Sequence: Synthetic peptide
DEEEIRTTNPVATEQYGSVSTNLQRFNLR

SEQ ID NO: 233 - protein, 29 aa, Artificial Sequence
  Description of Artificial Sequence: Synthetic peptide
DEEEIRTTNPVATEQYGSVSTRNLQRGNI

SEQ ID NO: 234 - protein, 29 aa, Artificial Sequence
  Description of Artificial Sequence: Synthetic peptide
DEEEIRTTNPVASEQYGSVSTNLQRMGNR

SEQ ID NO: 235 - protein, 29 aa, Artificial Sequence
  Description of Artificial Sequence: Synthetic peptide
DEEEIRTTNPFATEQYGSVSTNLVQRGNR

SEQ ID NO: 236 - protein, 29 aa, Artificial Sequence
  Description of Artificial Sequence: Synthetic peptide
DEEEIRTTNPVATEQYGSVSTNLQRFNIR

SEQ ID NO: 237 - protein, 29 aa, Artificial Sequence
  Description of Artificial Sequence: Synthetic peptide
DEEEIRTTNPVATEQYGSVSTNLQRFGVR

SEQ ID NO: 238 - protein, 29 aa, Artificial Sequence
  Description of Artificial Sequence: Synthetic peptide
DEEEIRTTNPFATEQYGSVSTNLQVRGNR

SEQ ID NO: 239 - protein, 29 aa, Artificial Sequence
  Description of Artificial Sequence: Synthetic peptide
DEEEIRTTNPVATEQYGSVSTNLQRFGNN

SEQ ID NO: 240 - protein, 29 aa, Artificial Sequence
  Description of Artificial Sequence: Synthetic peptide
DEEEIRTTNPVATEQYGSVSTNLQRFGGR

SEQ ID NO: 241 - protein, 28 aa, Artificial Sequence
  Description of Artificial Sequence: Synthetic peptide
DEEEIRTTNPFATEQYGSVSTNLQVGNR

SEQ ID NO: 242 - protein, 28 aa, Artificial Sequence
  Description of Artificial Sequence: Synthetic peptide
DEEEIRTTNPVATEQYGSVSTNLQRFNY

SEQ ID NO: 243 - protein, 29 aa, Artificial Sequence
  Description of Artificial Sequence: Synthetic peptide
DEEEIRTTNPVATEQYGSVSTNLQRFQNR

SEQ ID NO: 244 - protein, 29 aa, Artificial Sequence
  Description of Artificial Sequence: Synthetic peptide
DEEEIRTTNPVATEQYGSCSTDNLQRGNR

SEQ ID NO: 245 - protein, 29 aa, Artificial Sequence
  Description of Artificial Sequence: Synthetic peptide
DEEEIRTTNPVATEQYGSVSTNLQRFSNR

SEQ ID NO: 246 - protein, 28 aa, Artificial Sequence
  Description of Artificial Sequence: Synthetic peptide
DEEEIRTTNPVATEQYGSVSTNLQRGAP

SEQ ID NO: 247 - protein, 29 aa, Artificial Sequence
  Description of Artificial Sequence: Synthetic peptide
DEEEIRTTNPVATEQYGSVSTQNMQRGNR

SEQ ID NO: 248 - protein, 29 aa, Artificial Sequence
  Description of Artificial Sequence: Synthetic peptide
DEEEIRTTNPVATEQYGSVSSTNHQRGNR

SEQ ID NO: 249 - protein, 30 aa, Artificial Sequence
  Description of Artificial Sequence: Synthetic polypeptide
DEEEIRTTNPVATEQYGSVSTNLQRGANRS

SEQ ID NO: 250 - protein, 29 aa, Artificial Sequence
  Description of Artificial Sequence: Synthetic peptide
DEEEIRTTNPVATEQYGSVSTNLQRGAMR

SEQ ID NO: 251 - protein, 29 aa, Artificial Sequence
  Description of Artificial Sequence: Synthetic peptide
DEEEIRTTNPVATEQYGSVSENLCQRGNR

SEQ ID NO: 252 - protein, 28 aa, Artificial Sequence
  Description of Artificial Sequence: Synthetic peptide
DVEEIRTTNPVATEQYGSVSTGLQRGNR

SEQ ID NO: 253 - protein, 28 aa, Artificial Sequence
  Description of Artificial Sequence: Synthetic peptide
DEEEIRTTNPVASEQYGSVSTNLLRGNR

SEQ ID NO: 254 - protein, 28 aa, Artificial Sequence
  Description of Artificial Sequence: Synthetic peptide
DEEEIRTTNPFATEQYGSVSTNWQRGNR

SEQ ID NO: 255 - protein, 28 aa, Artificial Sequence
  Description of Artificial Sequence: Synthetic peptide
DVEEIRTTNPVATEQYGSVSTNVQRGNR

SEQ ID NO: 256 - protein, 28 aa, Artificial Sequence
  Description of Artificial Sequence: Synthetic peptide
DEEEIRTTNPVASEQYGSVSTNLQHGNR

SEQ ID NO: 257 - protein, 28 aa, Artificial Sequence
  Description of Artificial Sequence: Synthetic peptide
DEEEIRTTNPVATEQYGSVATNQQRGNR

SEQ ID NO: 258 - protein, 28 aa, Artificial Sequence
  Description of Artificial Sequence: Synthetic peptide
CEEEIRTTNPVATEQYGSKSTNLQRGNR

SEQ ID NO: 259 - protein, 28 aa, Artificial Sequence
  Description of Artificial Sequence: Synthetic peptide
DEEEIRTTNPVATEQYGSVSTNLQRGAH

SEQ ID NO: 260 - protein, 28 aa, Artificial Sequence
  Description of Artificial Sequence: Synthetic peptide
EDEEIRTTNPVATEQYGSVSTNLQRGNR

SEQ ID NO: 261 - protein, 29 aa, Artificial Sequence
  Description of Artificial Sequence: Synthetic peptide
DEEEIRTTNPVATEQYGSVSTNLQRGAGR

SEQ ID NO: 262 - protein, 28 aa, Artificial Sequence
  Description of Artificial Sequence: Synthetic peptide
DVEEIRTTNPVATEQYGSVSTNLQRGNN

SEQ ID NO: 263 - protein, 30 aa, Artificial Sequence
  Description of Artificial Sequence: Synthetic polypeptide
DEEEIRTTNPVATEQYGSVSTNLQRGGNRA

SEQ ID NO: 264 - protein, 29 aa, Artificial Sequence
  Description of Artificial Sequence: Synthetic peptide
DEEEIRTTNPVATEQYGSVSTNLQRGGNY

SEQ ID NO: 265 - protein, 28 aa, Artificial Sequence
  Description of Artificial Sequence: Synthetic peptide
DEEEIRTTNPVATEQYGSVATNLQRVNR

SEQ ID NO: 266 - protein, 29 aa, Artificial Sequence
  Description of Artificial Sequence: Synthetic peptide
DEEEIRTTNPVATEQYGSVSTNLQRGMLR

SEQ ID NO: 267 - protein, 28 aa, Artificial Sequence
  Description of Artificial Sequence: Synthetic peptide
DTEEIRTTNPVATEQYGSVSENLQRGNR

SEQ ID NO: 268 - protein, 29 aa, Artificial Sequence
  Description of Artificial Sequence: Synthetic peptide
DTEEIRTTNPVATEQYGSVSTANLQRGNR

SEQ ID NO: 269 - protein, 28 aa, Artificial Sequence
  Description of Artificial Sequence: Synthetic peptide
DTEEIRTTNPVATEQYGSVSTDLQRGNR

SEQ ID NO: 270 - protein, 29 aa, Artificial Sequence
  Description of Artificial Sequence: Synthetic peptide
DTEEIRTTNPVATEQYGSVSTENLQRGNR

SEQ ID NO: 271 - protein, 29 aa, Artificial Sequence
  Description of Artificial Sequence: Synthetic peptide
DTEEIRTTNPVATEQYGSVSTNLDQRGNR

SEQ ID NO: 272 - protein, 28 aa, Artificial Sequence
  Description of Artificial Sequence: Synthetic peptide
DTEEIRTTNPVATEQYGSVSTNLERGNR

SEQ ID NO: 273 - protein, 28 aa, Artificial Sequence
  Description of Artificial Sequence: Synthetic peptide
DTEEIRTTNPVATEQYGSVSTNLQMGNR

SEQ ID NO: 274 - protein, 29 aa, Artificial Sequence
  Description of Artificial Sequence: Synthetic peptide
DTEEIRTTNPVATEQYGSVSTNLQREGNR

SEQ ID NO: 275 - protein, 29 aa, Artificial Sequence
  Description of Artificial Sequence: Synthetic peptide
DTEEIRTTNPVATEQYGSVSTNLQRGDNR

SEQ ID NO: 276 - protein, 29 aa, Artificial Sequence
  Description of Artificial Sequence: Synthetic peptide
DTEEIRTTNPVATEQYGSVSTNLQRGNRA

SEQ ID NO: 277 - protein, 29 aa, Artificial Sequence
  Description of Artificial Sequence: Synthetic peptide
DEEEIRTTNPVATEQYGSVSSTNLLRGNR

SEQ ID NO: 278 - protein, 29 aa, Artificial Sequence
  Description of Artificial Sequence: Synthetic peptide
DTEEIRTTNPVATEQYGSVSTNLQRGVNR

SEQ ID NO: 279 - protein, 29 aa, Artificial Sequence
  Description of Artificial Sequence: Synthetic peptide
DTEEIRTTNPVATEQYGSVSTNLQRPGNR

SEQ ID NO: 280 - protein, 28 aa, Artificial Sequence
  Description of Artificial Sequence: Synthetic peptide
DEEEIRTTNPVATEQYGSVSTNLQRGMI

SEQ ID NO: 281 - protein, 29 aa, Artificial Sequence
  Description of Artificial Sequence: Synthetic peptide
DEEEIRTTNPVATEQYGSVSTFLQRIGNR

SEQ ID NO: 282 - protein, 29 aa, Artificial Sequence
  Description of Artificial Sequence: Synthetic peptide
DEEEIRTTNPVATEQYGSVSTNLQRGMNA

SEQ ID NO: 283 - protein, 30 aa, Artificial Sequence
  Description of Artificial Sequence: Synthetic polypeptide
DEEEIRTTNPVATEQYGSVSTNLQRGMNPR

SEQ ID NO: 284 - protein, 29 aa, Artificial Sequence
  Description of Artificial Sequence: Synthetic peptide
DEEEIRTTNPVATEQYGSVSTFLQRGPNR

SEQ ID NO: 285 - protein, 28 aa, Artificial Sequence
  Description of Artificial Sequence: Synthetic peptide
DEEEIRTTNPVATEQYGSVSGNFQRGNR

SEQ ID NO: 286 - protein, 29 aa, Artificial Sequence
  Description of Artificial Sequence: Synthetic peptide
DEEEIRTTNPVAIEQYGSVSTVNLQRGNR

SEQ ID NO: 287 - protein, 29 aa, Artificial Sequence
  Description of Artificial Sequence: Synthetic peptide
DEEEIRTTNPVALEQYGSVSTDNLQRGNR

SEQ ID NO: 288 - protein, 28 aa, Artificial Sequence
  Description of Artificial Sequence: Synthetic peptide
DEEEIRTTNPVALEQYGSVSTNLQMGNR

SEQ ID NO: 289 - protein, 28 aa, Artificial Sequence
  Description of Artificial Sequence: Synthetic peptide
DEPEIRTTNPVATEQYGSVSTNLQCGNR

SEQ ID NO: 290 - protein, 29 aa, Artificial Sequence
  Description of Artificial Sequence: Synthetic peptide
DEEEIRTTNPVATEQYGSVSTNLQRGNAG

SEQ ID NO: 291 - protein, 29 aa, Artificial Sequence
  Description of Artificial Sequence: Synthetic peptide
DEPEIRTTNPVATEQYGSVSTDNLQRGNR

SEQ ID NO: 292 - protein, 29 aa, Artificial Sequence
  Description of Artificial Sequence: Synthetic peptide
DEEEIRTTNPVATEQYGSVSTNLQRGMHR

SEQ ID NO: 293 - protein, 30 aa, Artificial Sequence
  Description of Artificial Sequence: Synthetic polypeptide
DEEEIRTTNPVATEQYGSVSTQNFLQRGNR

SEQ ID NO: 294 - protein, 28 aa, Artificial Sequence
  Description of Artificial Sequence: Synthetic peptide
DEEEIRTTNPVATEQYGSVSTFLQRGDR

SEQ ID NO: 295 - protein, 28 aa, Artificial Sequence
  Description of Artificial Sequence: Synthetic peptide
DEEEIRTTNPVATEQYGSVSTFLQRGGR

SEQ ID NO: 296 - protein, 29 aa, Artificial Sequence
  Description of Artificial Sequence: Synthetic peptide
DEEEIRTTNPVALEQYGSVSTNLQRQGNR

SEQ ID NO: 297 - protein, 28 aa, Artificial Sequence
  Description of Artificial Sequence: Synthetic peptide
DEEEIRTTNPVALEQYGSVSTNLQWGNR

SEQ ID NO: 298 - protein, 28 aa, Artificial Sequence
  Description of Artificial Sequence: Synthetic peptide
DEEEIRTTNPVAMEQYGEVSTNLQRGNR

SEQ ID NO: 299 - protein, 29 aa, Artificial Sequence
  Description of Artificial Sequence: Synthetic peptide
DEEEIRTTNPVATEQYGSVSTFLQRGNRQ

SEQ ID NO: 300 - protein, 29 aa, Artificial Sequence
  Description of Artificial Sequence: Synthetic peptide
DEEEIRTTNPVATEQYGSVSTNLQRGMQR

SEQ ID NO: 301 - protein, 28 aa, Artificial Sequence
  Description of Artificial Sequence: Synthetic peptide
DEEEIRTTNPVATEQYGSVSTFLQRANR

SEQ ID NO: 302 - protein, 28 aa, Artificial Sequence
  Description of Artificial Sequence: Synthetic peptide
DEEEIRTTNPVATEQYGSVATNLQIGNR

SEQ ID NO: 303 - protein, 29 aa, Artificial Sequence
  Description of Artificial Sequence: Synthetic peptide
DEEEIRTTNPVATEQYGSVSTNLQRGMER

SEQ ID NO: 304 - protein, 29 aa, Artificial Sequence
  Description of Artificial Sequence: Synthetic peptide
DEEEIRTTNPVATEQYGSVSTNLQRGMDR

SEQ ID NO: 305 - protein, 28 aa, Artificial Sequence
  Description of Artificial Sequence: Synthetic peptide
DEEEIRTTNPVANEQYGSVSTNLQLGNR

SEQ ID NO: 306 - protein, 28 aa, Artificial Sequence
  Description of Artificial Sequence: Synthetic peptide
DEEEIRTTNPVANEQYGSVSTNLQQGNR

SEQ ID NO: 307 - protein, 28 aa, Artificial Sequence
  Description of Artificial Sequence: Synthetic peptide
DEEEIRTTNPVATEQYGSVATNLQRGNT

SEQ ID NO: 308 - protein, 28 aa, Artificial Sequence
  Description of Artificial Sequence: Synthetic peptide
DEEEIRTTNPVANEQYGSVSTNLQRGDR

SEQ ID NO: 309 - protein, 28 aa, Artificial Sequence
  Description of Artificial Sequence: Synthetic peptide
DEEEIRTTNPVATEQYGSVSENLNRGNR

SEQ ID NO: 310 - protein, 28 aa, Artificial Sequence
  Description of Artificial Sequence: Synthetic peptide
DEEEIRTTNPVATEQYGSVSTNLQRGHV

SEQ ID NO: 311 - protein, 29 aa, Artificial Sequence
  Description of Artificial Sequence: Synthetic peptide
DEEEIRTTNPVANEQYGSVSTNLQRGNRD

SEQ ID NO: 312 - protein, 29 aa, Artificial Sequence
  Description of Artificial Sequence: Synthetic peptide
DEEEIRTTNPVANEQYGSVSTGNLQRGNR

SEQ ID NO: 313 - protein, 29 aa, Artificial Sequence
  Description of Artificial Sequence: Synthetic peptide
DEEEIRTTNPVATEQYGSVATNLQRNGNR

SEQ ID NO: 314 - protein, 28 aa, Artificial Sequence
  Description of Artificial Sequence: Synthetic peptide
DEEEIRTTNPVANEQYGSVSTNSQRGNR

SEQ ID NO: 315 - protein, 30 aa, Artificial Sequence
  Description of Artificial Sequence: Synthetic polypeptide
DEEEIRTTNPVATEQYGSVSTNLQRGHNRL

SEQ ID NO: 316 - protein, 29 aa, Artificial Sequence
  Description of Artificial Sequence: Synthetic peptide
DEEEIRTTNPVATEQYGSVSTQNLGRGNR

SEQ ID NO: 317 - protein, 28 aa, Artificial Sequence
  Description of Artificial Sequence: Synthetic peptide
DENELRTTNPVATEQYGSVSTNLQRGNR

SEQ ID NO: 318 - protein, 29 aa, Artificial Sequence
  Description of Artificial Sequence: Synthetic peptide
DEEEIRTTNPVATEQYGSVSTNLQRGGYR

SEQ ID NO: 319 - protein, 29 aa, Artificial Sequence
  Description of Artificial Sequence: Synthetic peptide
DEEEIRTTNPVATEQYGSVSTNLQRGGSR

SEQ ID NO: 320 - protein, 29 aa, Artificial Sequence
  Description of Artificial Sequence: Synthetic peptide
DEEEIRTTNPVATEQYGSVSTNLQRGGRP

SEQ ID NO: 321 - protein, 28 aa, Artificial Sequence
  Description of Artificial Sequence: Synthetic peptide
DEEEIRTTNPVANEQYGSVSTNLQSGNR

SEQ ID NO: 322 - protein, 30 aa, Artificial Sequence
  Description of Artificial Sequence: Synthetic polypeptide
DEEEIRTTNPVATEQYGSVSTFNLQFRGNR

SEQ ID NO: 323 - protein, 29 aa, Artificial Sequence
  Description of Artificial Sequence: Synthetic peptide
DEEEIRTTNPVATEQYGSVATNLQRGNER

SEQ ID NO: 324 - protein, 30 aa, Artificial Sequence
  Description of Artificial Sequence: Synthetic polypeptide
DEEEIRTTNPVATEQYGSVSTNLQRGINRE

SEQ ID NO: 325 - protein, 30 aa, Artificial Sequence
  Description of Artificial Sequence: Synthetic polypeptide
DEEEIRTTNPVATEQYGSVSTNLQRGLNTR

SEQ ID NO: 326 - protein, 30 aa, Artificial Sequence
  Description of Artificial Sequence: Synthetic polypeptide
DEEEIRTTNPVATEQYGSVSTNLQRGLNRC

SEQ ID NO: 327 - protein, 30 aa, Artificial Sequence
  Description of Artificial Sequence: Synthetic polypeptide
DEEEIRTTNPVATEQYGSVSTNLQRGLNMR

SEQ ID NO: 328 - protein, 29 aa, Artificial Sequence
  Description of Artificial Sequence: Synthetic peptide
DEEEIRTTNPVATEQYGSVSTNLQRGLMR

SEQ ID NO: 329 - protein, 29 aa, Artificial Sequence
  Description of Artificial Sequence: Synthetic peptide
DEEEIRTTNPVATEQYGSVSTQNLDRGNR

SEQ ID NO: 330 - protein, 28 aa, Artificial Sequence
  Description of Artificial Sequence: Synthetic peptide
DEEEIRTTNPVATEQYGSVSTNLQRGKP

SEQ ID NO: 331 - protein, 29 aa, Artificial Sequence
  Description of Artificial Sequence: Synthetic peptide
DEEEIRTTNPVATEQYGSVSTNLQRGKER

SEQ ID NO: 332 - protein, 29 aa, Artificial Sequence
  Description of Artificial Sequence: Synthetic peptide
DEEEIRTTNPVATEQYGSVATNLQRGMNR

SEQ ID NO: 333 - protein, 28 aa, Artificial Sequence
  Description of Artificial Sequence: Synthetic peptide
DEEEIRTTNPVATEQYGSVSTNLQRGKC

SEQ ID NO: 334 - protein, 29 aa, Artificial Sequence
  Description of Artificial Sequence: Synthetic peptide
DEEEIRTTNPVAMEQYGSVSTNLPQRGNR

SEQ ID NO: 335 - protein, 28 aa, Artificial Sequence
  Description of Artificial Sequence: Synthetic peptide
DEEEIRTTNPVAMEQYGSVSTNLQRGNM

SEQ ID NO: 336 - protein, 28 aa, Artificial Sequence
  Description of Artificial Sequence: Synthetic peptide
DEEEIRTTNPVATEQYGSVSTNLQRGIT

SEQ ID NO: 337 - protein, 30 aa, Artificial Sequence
  Description of Artificial Sequence: Synthetic polypeptide
DEEEIRTTNPVATEQYGSVSTNLQRGINTR

SEQ ID NO: 338 - protein, 28 aa, Artificial Sequence
  Description of Artificial Sequence: Synthetic peptide
DEEEIRTTNPVANECYGSVSTNLQRGNR

SEQ ID NO: 339 - protein, 28 aa, Artificial Sequence
  Description of Artificial Sequence: Synthetic peptide
DEEEIRTTNPVANEQYGSVATNLQRGNR

SEQ ID NO: 340 - protein, 29 aa, Artificial Sequence
  Description of Artificial Sequence: Synthetic peptide
DEEEIRTTNPVANEQYGSVGSTNLQRGNR

SEQ ID NO: 341 - protein, 29 aa, Artificial Sequence
  Description of Artificial Sequence: Synthetic peptide
DEEEIRTTNPVAMEQYGSVSTNGLQRGNR

SEQ ID NO: 342 - protein, 28 aa, Artificial Sequence
  Description of Artificial Sequence: Synthetic peptide
DEEEIRTTNPVATEQYGSVSTSEQRGNR

SEQ ID NO: 343 - protein, 30 aa, Artificial Sequence
  Description of Artificial Sequence: Synthetic polypeptide
DEEEIRTTNPVATEQYGSVSTNLQRFGENR

SEQ ID NO: 344 - protein, 28 aa, Artificial Sequence
  Description of Artificial Sequence: Synthetic peptide
DENEIRTTNPVATEQYGSVSTTLQRGNR

SEQ ID NO: 345 - protein, 29 aa, Artificial Sequence
  Description of Artificial Sequence: Synthetic peptide
DEEEIRTTNPVATEQYGSVSTNLQRDGIR

SEQ ID NO: 346 - protein, 28 aa, Artificial Sequence
  Description of Artificial Sequence: Synthetic peptide
DEEEIRTTNPVATEQYGSVSTNLQRDER

SEQ ID NO: 347 - protein, 29 aa, Artificial Sequence
  Description of Artificial Sequence: Synthetic peptide
DEEEIRTTNPVATEQYGSVSTNLQRDANR

SEQ ID NO: 348 - protein, 29 aa, Artificial Sequence
  Description of Artificial Sequence: Synthetic peptide
DEEEIRTTNPVATEQYGSVSTNLQRCNDR

SEQ ID NO: 349 - protein, 29 aa, Artificial Sequence
  Description of Artificial Sequence: Synthetic peptide
DEEEIRTTNPVATEQYGSVSTNLQRCLNR

SEQ ID NO: 350 - protein, 29 aa, Artificial Sequence
  Description of Artificial Sequence: Synthetic peptide
DEEEIRTTNPVATEQYGSVSEENLQRGNR

SEQ ID NO: 351 - protein, 29 aa, Artificial Sequence
  Description of Artificial Sequence: Synthetic peptide
DEEEIRTTNPVATEQYGSVSTNLQRCGQR

SEQ ID NO: 352 - protein, 29 aa, Artificial Sequence
  Description of Artificial Sequence: Synthetic peptide
DEEEIRTTNPVATEQYGSVSLTNLQRGFR

SEQ ID NO: 353 - protein, 29 aa, Artificial Sequence
  Description of Artificial Sequence: Synthetic peptide
DEEEIRTTNPVATEQYGSVSLTNLQRGNI

SEQ ID NO: 354 - protein, 29 aa, Artificial Sequence
  Description of Artificial Sequence: Synthetic peptide
DEEEIRTTNPVATEQYGSVSTFQLQRGNR

SEQ ID NO: 355 - protein, 29 aa, Artificial Sequence
  Description of Artificial Sequence: Synthetic peptide
DEEEIRTTNPVATEQYGSVSTNLQRCGNL

SEQ ID NO: 356 - protein, 28 aa, Artificial Sequence
  Description of Artificial Sequence: Synthetic peptide
DENEIRTTNPVATEQYGSISTNLQRGNR

SEQ ID NO: 357 - protein, 29 aa, Artificial Sequence
  Description of Artificial Sequence: Synthetic peptide
DEEEIRTTNPVATEQYGSVSTNLQRCGLR

SEQ ID NO: 358 - protein, 28 aa, Artificial Sequence
  Description of Artificial Sequence: Synthetic peptide
DEEEIRTTNPVATEQYGSVSTNLQRCER

SEQ ID NO: 359 - protein, 28 aa, Artificial Sequence
  Description of Artificial Sequence: Synthetic peptide
DEEEIRTTNPVATEQYGSVSTFTQRGNR

SEQ ID NO: 360 - protein, 28 aa, Artificial Sequence
  Description of Artificial Sequence: Synthetic peptide
DEEEIRTTNPVATDQYGLVSTNLQRGNR

SEQ ID NO: 361 - protein, 29 aa, Artificial Sequence
  Description of Artificial Sequence: Synthetic peptide
DENEIRTTNPVATEQYGSVLSTNLQRGNR

SEQ ID NO: 362 - protein, 30 aa, Artificial Sequence
  Description of Artificial Sequence: Synthetic polypeptide
DEEEIRTTNPVATEQYGSVSITNLQERGNR

SEQ ID NO: 363 - protein, 30 aa, Artificial Sequence
  Description of Artificial Sequence: Synthetic polypeptide
DEEEIRTTNPVATEQYGSVSTNLQRDGNRG

SEQ ID NO: 364 - protein, 28 aa, Artificial Sequence
  Description of Artificial Sequence: Synthetic peptide
DENEIRTTNPVATEQYGSVSPNLQRGNR

SEQ ID NO: 365 - protein, 29 aa, Artificial Sequence
  Description of Artificial Sequence: Synthetic peptide
DEEEIRTTNPVATEQYGSVSTNLQRDNFR

SEQ ID NO: 366 - protein, 28 aa, Artificial Sequence
  Description of Artificial Sequence: Synthetic peptide
DEEEIRCTNPDATEQYGSVSTNLQRGNR

SEQ ID NO: 367 - protein, 29 aa, Artificial Sequence
  Description of Artificial Sequence: Synthetic peptide
DEEEIRTTNPFATEQYGSVSSTNLQRGNR

SEQ ID NO: 368 - protein, 30 aa, Artificial Sequence
  Description of Artificial Sequence: Synthetic polypeptide
DEEEIRTTNPVATEQYGSVSTSNLQRGGNR

SEQ ID NO: 369 - protein, 30 aa, Artificial Sequence
  Description of Artificial Sequence: Synthetic polypeptide
DEEEIRTTNPVATEQYGSVSTSNLQRGNLR

SEQ ID NO: 370 - protein, 30 aa, Artificial Sequence
  Description of Artificial Sequence: Synthetic polypeptide
DEEEIRTTNPVATEQYGSVSTSNLQRGQNR

SEQ ID NO: 371 - protein, 29 aa, Artificial Sequence
  Description of Artificial Sequence: Synthetic peptide
DEEEIRTTNPVATEQYGSVSTNLQRAYNR

SEQ ID NO: 372 - protein, 29 aa, Artificial Sequence
  Description of Artificial Sequence: Synthetic peptide
DEEEIRTTNPVATEQYGSVSTSNLQRTNR

SEQ ID NO: 373 - protein, 30 aa, Artificial Sequence
  Description of Artificial Sequence: Synthetic polypeptide
DEEEIRTTNPVATEQYGSVSTNLQRDGNVR

SEQ ID NO: 374 - protein, 29 aa, Artificial Sequence
  Description of Artificial Sequence: Synthetic peptide
EEEEIRTTNPVATEQYGSVCSTNLQRGNR

SEQ ID NO: 375 - protein, 30 aa, Artificial Sequence
  Description of Artificial Sequence: Synthetic polypeptide
DEEEIRTTNPVATEQYGSVSTNLQRDGNRT

SEQ ID NO: 376 - protein, 28 aa, Artificial Sequence
  Description of Artificial Sequence: Synthetic peptide
DEEEIRTTNPVATDNYGSVSTNLQRGNR

SEQ ID NO: 377 - protein, 29 aa, Artificial Sequence
  Description of Artificial Sequence: Synthetic peptide
DEEEIRTTNPVATEQYGSVSTSNNQRGNR

SEQ ID NO: 378 - protein, 29 aa, Artificial Sequence
  Description of Artificial Sequence: Synthetic peptide
DEEEIRTTNPVATEQYGSVSSTMLQRGNR

SEQ ID NO: 379 - protein, 30 aa, Artificial Sequence
  Description of Artificial Sequence: Synthetic polypeptide
DEEEIRTTNPVATEQYGSVSTNLQRDGNRN

SEQ ID NO: 380 - protein, 29 aa, Artificial Sequence
  Description of Artificial Sequence: Synthetic peptide
DEEEIRTTNPVATEQYGSVCETNLQRGNR

SEQ ID NO: 381 - protein, 28 aa, Artificial Sequence
  Description of Artificial Sequence: Synthetic peptide
DEEEIRTTNPVATEQYGSVSTNLQRANA

SEQ ID NO: 382 - protein, 29 aa, Artificial Sequence
  Description of Artificial Sequence: Synthetic peptide
DEEEIRTTNPVATEQYGSVSGNLEQRGNR

SEQ ID NO: 383 - protein, 28 aa, Artificial Sequence
  Description of Artificial Sequence: Synthetic peptide
DENEIRTTNPVATEQYGHVSTNLQRGNR

SEQ ID NO: 384 - protein, 30 aa, Artificial Sequence
  Description of Artificial Sequence: Synthetic polypeptide
DEEEIRTTNPVATEQYGSVSTNLQQRGENR

SEQ ID NO: 385 - protein, 28 aa, Artificial Sequence
  Description of Artificial Sequence: Synthetic peptide
DEEEIRTTNPVATDQYGSVSTNYQRGNR

SEQ ID NO: 386 - protein, 30 aa, Artificial Sequence
  Description of Artificial Sequence: Synthetic polypeptide
DEEEIRTTNPVATEQYGSVSTNLQQRGDNR

SEQ ID NO: 387 - protein, 28 aa, Artificial Sequence
  Description of Artificial Sequence: Synthetic peptide
DEEEIRTTNPVATEQYGSVSGNLERGNR

SEQ ID NO: 388 - protein, 30 aa, Artificial Sequence
  Description of Artificial Sequence: Synthetic polypeptide
DEEEIRTTNPVATEQYGSVSTNLQQRDGNR

SEQ ID NO: 389 - protein, 29 aa, Artificial Sequence
  Description of Artificial Sequence: Synthetic peptide
DEEEIRTTNPVATEQYGSVSTNLQQQGNR

SEQ ID NO: 390 - protein, 29 aa, Artificial Sequence
  Description of Artificial Sequence: Synthetic peptide
EEEEIRTTNPVATEQYGSVSTNLPQRGNR

SEQ ID NO: 391 - protein, 28 aa, Artificial Sequence
  Description of Artificial Sequence: Synthetic peptide
DEEEIRTTNPVATDQYGSVSTNLSRGNR

SEQ ID NO: 392 - protein, 30 aa, Artificial Sequence
  Description of Artificial Sequence: Synthetic polypeptide
DEEEIRTTNPVATEQYGSVSDTSNLQRGNR

SEQ ID NO: 393 - protein, 30 aa, Artificial Sequence
  Description of Artificial Sequence: Synthetic polypeptide
DEEEIRTTNPVATEQYGSVSTNLQQMRGNR

SEQ ID NO: 394 - protein, 28 aa, Artificial Sequence
  Description of Artificial Sequence: Synthetic peptide
DEEEIRTTNPVATEQYGSVSTNLQQMNR

SEQ ID NO: 395 - protein, 29 aa, Artificial Sequence
  Description of Artificial Sequence: Synthetic peptide
DEEEIRTTNPFATEQYGSAVSTNLQRGNR

SEQ ID NO: 396 - protein, 28 aa, Artificial Sequence
  Description of Artificial Sequence: Synthetic peptide
DEEEIRTTNPVATEQYGSVSTNLQQLNR

SEQ ID NO: 397 - protein, 29 aa, Artificial Sequence
  Description of Artificial Sequence: Synthetic peptide
DEEEIRTTNPFATEQYGFSVSTNLQRGNR

SEQ ID NO: 398 - protein, 29 aa, Artificial Sequence
  Description of Artificial Sequence: Synthetic peptide
DEEEIRTTNPVATEQYGSVSDTNYQRGNR

SEQ ID NO: 399 - protein, 29 aa, Artificial Sequence
  Description of Artificial Sequence: Synthetic peptide
EEEEIRTTNPVATEQYGSVSTNLQNRGNR

SEQ ID NO: 400 - protein, 29 aa, Artificial Sequence
  Description of Artificial Sequence: Synthetic peptide
EEEEIRTTNPVATEQYGSVSTNLQCRGNR

SEQ ID NO: 401 - protein, 29 aa, Artificial Sequence
  Description of Artificial Sequence: Synthetic peptide
DEEEIRTTNPVATEQYGSVSTNLQRDNPR

SEQ ID NO: 402 - protein, 30 aa, Artificial Sequence
  Description of Artificial Sequence: Synthetic polypeptide
DEEEIRTTNPVATEQYGSVSTNLQQRGLNR

SEQ ID NO: 403 - protein, 30 aa, Artificial Sequence
  Description of Artificial Sequence: Synthetic polypeptide
DEEEIRTTNPVATEQYGSVSTNLQQRGNQR

SEQ ID NO: 404 - protein, 29 aa, Artificial Sequence
  Description of Artificial Sequence: Synthetic peptide
DEEEIRTTNPVATEQYGSVSTNLQRAHNR

SEQ ID NO: 405 - protein, 29 aa, Artificial Sequence
  Description of Artificial Sequence: Synthetic peptide
DENEIRTTNPVATEQYGESVSTNLQRGNR

SEQ ID NO: 406 - protein, 29 aa, Artificial Sequence
  Description of Artificial Sequence: Synthetic peptide
AEEEIRTTNPVATEQYGSVSTCNLQRGNR

SEQ ID NO: 407 - protein, 28 aa, Artificial Sequence
  Description of Artificial Sequence: Synthetic peptide
DEEEIRTTNPVATEQYGSVSTFWQRGNR

SEQ ID NO: 408 - protein, 28 aa, Artificial Sequence
  Description of Artificial Sequence: Synthetic peptide
DEEEIRTTNPVATEQYGSVSTNLQQRNR

SEQ ID NO: 409 - protein, 29 aa, Artificial Sequence
  Description of Artificial Sequence: Synthetic peptide
DEEEIRTTNPVATEQYGSVSTNLQQRNNR

SEQ ID NO: 410 - protein, 29 aa, Artificial Sequence
  Description of Artificial Sequence: Synthetic peptide
DEEEIRTTNPVATEQYGSVSTNLQQRGQR

SEQ ID NO: 411 - protein, 30 aa, Artificial Sequence
  Description of Artificial Sequence: Synthetic polypeptide
DEEEIRTTNPVATEQYGSVSTNLQQRGNMR

SEQ ID NO: 412 - protein, 28 aa, Artificial Sequence
  Description of Artificial Sequence: Synthetic peptide
EEEEIRTTNPVATEQYGSVSSNLQRGNR

SEQ ID NO: 413 - protein, 29 aa, Artificial Sequence
  Description of Artificial Sequence: Synthetic peptide
EEEEIRTTNPVATEQYGSVSTDNLQRGNR

SEQ ID NO: 414 - protein, 29 aa, Artificial Sequence
  Description of Artificial Sequence: Synthetic peptide
DEEEIRTTNPVATDQYGSVSTNLQRGDNR

SEQ ID NO: 415 - protein, 29 aa, Artificial Sequence
  Description of Artificial Sequence: Synthetic peptide
DEEEIRTTNPVATDQYGSVSTNLQRGNAR

SEQ ID NO: 416 - protein, 28 aa, Artificial Sequence
  Description of Artificial Sequence: Synthetic peptide
DENEIRTTNPVATEQMGSVSTNLQRGNR

SEQ ID NO: 417 - protein, 29 aa, Artificial Sequence
  Description of Artificial Sequence: Synthetic peptide
DEEEIRTTNPVATDQYGSVSTNLQRGNNR

SEQ ID NO: 418 - protein, 28 aa, Artificial Sequence
  Description of Artificial Sequence: Synthetic peptide
DEEEIRTTNPVATDQYGSVSTNLQRGPR

SEQ ID NO: 419 - protein, 28 aa, Artificial Sequence
  Description of Artificial Sequence: Synthetic peptide
DEEEIRTTNPVATDQYGSVSTNLQRGTR

SEQ ID NO: 420 - protein, 28 aa, Artificial Sequence
  Description of Artificial Sequence: Synthetic peptide
DEEEIRTTNPVATDQYGSVSTNLFRGNR

SEQ ID NO: 421 - protein, 28 aa, Artificial Sequence
  Description of Artificial Sequence: Synthetic peptide
EEEEIRTTNPVATEQYGSVSTNLQRGIR

SEQ ID NO: 422 - protein, 29 aa, Artificial Sequence
  Description of Artificial Sequence: Synthetic peptide
DEEEIRTTNPVATCQYGSVSTNLQRGNSR

SEQ ID NO: 423 - protein, 28 aa, Artificial Sequence
  Description of Artificial Sequence: Synthetic peptide
DEEEIRTTNPVATEQYGSVSTNLQRDNQ

SEQ ID NO: 424 - protein, 28 aa, Artificial Sequence
  Description of Artificial Sequence: Synthetic peptide
DEEEIRTTNPVATAQYGSVSTNLQWGNR

SEQ ID NO: 425 - protein, 28 aa, Artificial Sequence
  Description of Artificial Sequence: Synthetic peptide
DEEEIRTTNPVATEQYGSVSTSLQKGNR

SEQ ID NO: 426 - protein, 29 aa, Artificial Sequence
  Description of Artificial Sequence: Synthetic peptide
DEEEIRTTNPVATEQYGSVSTSLQRDGNR

SEQ ID NO: 427 - protein, 29 aa, Artificial Sequence
  Description of Artificial Sequence: Synthetic peptide
DENEIRTTNPVATEQYGSVSTNLQQRGNR

SEQ ID NO: 428 - protein, 28 aa, Artificial Sequence
  Description of Artificial Sequence: Synthetic peptide
EEEEIRTTNPVATEQFGSVSTNLQRGNR

SEQ ID NO: 429 - protein, 28 aa, Artificial Sequence
  Description of Artificial Sequence: Synthetic peptide
DEEEIRTTNPFATEQYGSVSTNLQRGNH

SEQ ID NO: 430 - protein, 28 aa, Artificial Sequence
  Description of Artificial Sequence: Synthetic peptide
DEEEIRTTNPVATCPYGSVSTNLQRGNR

SEQ ID NO: 431 - protein, 28 aa, Artificial Sequence
  Description of Artificial Sequence: Synthetic peptide
DEEEIRTTNPVATEQYGSVSTNLQRENP

SEQ ID NO: 432 - protein, 28 aa, Artificial Sequence
  Description of Artificial Sequence: Synthetic peptide
DEEEIRTTNPVATEQYGSVSTSLQRGNK

SEQ ID NO: 433 - protein, 28 aa, Artificial Sequence
  Description of Artificial Sequence: Synthetic peptide
DEEEIRTTNPFATEQYGSVSTNLQRDNR

SEQ ID NO: 434 - protein, 29 aa, Artificial Sequence
  Description of Artificial Sequence: Synthetic peptide
DEEEIRTTNPVATEQYGSVSTSLQRGSNR

SEQ ID NO: 435 - protein, 29 aa, Artificial Sequence
  Description of Artificial Sequence: Synthetic peptide
CEEEIRTTNPVATEQYGSVSTNLQRGHNR

SEQ ID NO: 436 - protein, 29 aa, Artificial Sequence
  Description of Artificial Sequence: Synthetic peptide
CEEEIRTTNPVATEQYGSVSTNLQRGNRT

SEQ ID NO: 437 - protein, 28 aa, Artificial Sequence
  Description of Artificial Sequence: Synthetic peptide
CEEEIRTTNPVATEQYGSVSTNLQRGNY

SEQ ID NO: 438 - protein, 28 aa, Artificial Sequence
  Description of Artificial Sequence: Synthetic peptide
CEEEIRTTNPVATEQYGSVSTNLQRLNR

SEQ ID NO: 439 - protein, 28 aa, Artificial Sequence
  Description of Artificial Sequence: Synthetic peptide
EEEEIRATNPVATEQYGSVSTNLQRGNR

SEQ ID NO: 440 - protein, 29 aa, Artificial Sequence
  Description of Artificial Sequence: Synthetic peptide
DEEEIRTTNPVATAQYGSVSTNLQRGNRL

SEQ ID NO: 441 - protein, 29 aa, Artificial Sequence
  Description of Artificial Sequence: Synthetic peptide
DEEEIRTTNPVATAQYGSVSTNLQRGNER

SEQ ID NO: 442 - protein, 28 aa, Artificial Sequence
  Description of Artificial Sequence: Synthetic peptide
DEEEIRTTNPVATAQYGSVSTNLQRGGR

SEQ ID NO: 443 - protein, 29 aa, Artificial Sequence
  Description of Artificial Sequence: Synthetic peptide
DEEEIRTTNPVATEQYGSVSTNLQREWNR

SEQ ID NO: 444 - protein, 28 aa, Artificial Sequence
  Description of Artificial Sequence: Synthetic peptide
DEEEIRTTNPVATAQYGSISTNLQRGNR

SEQ ID NO: 445 - protein, 28 aa, Artificial Sequence
  Description of Artificial Sequence: Synthetic peptide
DEEEIRTTNPVATEQYGSVSTNLQREVR

SEQ ID NO: 446 - protein, 28 aa, Artificial Sequence
  Description of Artificial Sequence: Synthetic peptide
DEEEIRTTNPFATEQYGSVSTNLQRINR

SEQ ID NO: 447 - protein, 28 aa, Artificial Sequence
  Description of Artificial Sequence: Synthetic peptide
DEEEIRTTNPFATEQYGSVSTNLQRGPR

SEQ ID NO: 448 - protein, 29 aa, Artificial Sequence
  Description of Artificial Sequence: Synthetic peptide
DEEEIRTTNPFATEQYGSVSTNLQRGPNR

SEQ ID NO: 449 - protein, 28 aa, Artificial Sequence
  Description of Artificial Sequence: Synthetic peptide
EEEEICTTNPVATEQYGSVSTNLQRGNR

SEQ ID NO: 450 - protein, 30 aa, Artificial Sequence
  Description of Artificial Sequence: Synthetic polypeptide
DEEEIRTTNPVATEQYGSVSTFNLQRGENR

SEQ ID NO: 451 - protein, 29 aa, Artificial Sequence
  Description of Artificial Sequence: Synthetic peptide
DEEEIRTTNPVATEQYGSVSTNLQRENSR

SEQ ID NO: 452 - protein, 29 aa, Artificial Sequence
  Description of Artificial Sequence: Synthetic peptide
DEEEIRTTNPVATEQYGSVSTNLQRENRD

SEQ ID NO: 453 - protein, 29 aa, Artificial Sequence
  Description of Artificial Sequence: Synthetic peptide
DENEIRTTNPVATEQYGSVSTNLQRSGNR

SEQ ID NO: 454 - protein, 28 aa, Artificial Sequence
  Description of Artificial Sequence: Synthetic peptide
DENEIRTTNPVATEQYGSVSTNLQRGNY

SEQ ID NO: 455 - protein, 28 aa, Artificial Sequence
  Description of Artificial Sequence: Synthetic peptide
DENEIRTTNPVATEQYGSVSTNLQRGNK

SEQ ID NO: 456 - protein, 29 aa, Artificial Sequence
  Description of Artificial Sequence: Synthetic peptide
DENEIRTTNPVATEQYGSVSTNLQRGANR

SEQ ID NO: 457 - protein, 29 aa, Artificial Sequence
  Description of Artificial Sequence: Synthetic peptide
DEEEIRTTNPVATAQYGSVSTMNLQRGNR

SEQ ID NO: 458 - protein, 28 aa, Artificial Sequence
  Description of Artificial Sequence: Synthetic peptide
DEEEIRTTNPVATAQYGSVSTNLQIGNR

SEQ ID NO: 459 - protein, 28 aa, Artificial Sequence
  Description of Artificial Sequence: Synthetic peptide
DEEEIRTTNPFATEQYGSVSTNLQRGNY

SEQ ID NO: 460 - protein, 30 aa, Artificial Sequence
  Description of Artificial Sequence: Synthetic polypeptide
DEEEIRTTNPVATEQYGSVSTFNLQRGNQR

SEQ ID NO: 461 - protein, 29 aa, Artificial Sequence
  Description of Artificial Sequence: Synthetic peptide
AEEEIRTTNPVATEQYGSVSTFNLQRGNR

SEQ ID NO: 462 - protein, 29 aa, Artificial Sequence
  Description of Artificial Sequence: Synthetic peptide
CEEEIRTTNPVATEQYGSVSTNLQRTGNR

SEQ ID NO: 463 - protein, 29 aa, Artificial Sequence
  Description of Artificial Sequence: Synthetic peptide
DEEEIRTTNPVATEQYGSVSTSLQRSGNR

SEQ ID NO: 464 - protein, 28 aa, Artificial Sequence
  Description of Artificial Sequence: Synthetic peptide
DEEEIRTTNPVATEQYGSVSTSLQWGNR

SEQ ID NO: 465 - protein, 30 aa, Artificial Sequence
  Description of Artificial Sequence: Synthetic polypeptide
DEEEIRTTNPVATEQYGSVSTNLQREGNLR

SEQ ID NO: 466 - protein, 29 aa, Artificial Sequence
  Description of Artificial Sequence: Synthetic peptide
DEEEIRTTNPVATEQYGSVSTSNAQRGNR

SEQ ID NO: 467 - protein, 28 aa, Artificial Sequence
  Description of Artificial Sequence: Synthetic peptide
DEEEIRTTNPFATEQYGSVSTNCQRGNR

SEQ ID NO: 468 - protein, 29 aa, Artificial Sequence
  Description of Artificial Sequence: Synthetic peptide
DEEEIRTTNPVATEQYGSVSTFNLQRQNR

SEQ ID NO: 469 - protein, 30 aa, Artificial Sequence
  Description of Artificial Sequence: Synthetic polypeptide
DEEEIRTTNPVATEQYGSVSTNLQREGKNR

SEQ ID NO: 470 - protein, 30 aa, Artificial Sequence
  Description of Artificial Sequence: Synthetic polypeptide
DEEEIRTTNPVATEQYGSVSTNLQREGNTR

SEQ ID NO: 471 - protein, 29 aa, Artificial Sequence
  Description of Artificial Sequence: Synthetic peptide
DEEEIRTTNPVATEQYGSVSTNLQREGER

SEQ ID NO: 472 - protein, 29 aa, Artificial Sequence
  Description of Artificial Sequence: Synthetic peptide
DEEEIRTTNPFATEQYGSVSTLNLQRGNR

SEQ ID NO: 473 - protein, 29 aa, Artificial Sequence
  Description of Artificial Sequence: Synthetic peptide
DEEEIRTTNPVATEQYGSVSTNLQRDYNR

SEQ ID NO: 474 - protein, 29 aa, Artificial Sequence
  Description of Artificial Sequence: Synthetic peptide
DEEEIRTTNPFATEQYGSVSTGNLQRGNR

SEQ ID NO: 475 - protein, 29 aa, Artificial Sequence
  Description of Artificial Sequence: Synthetic peptide
DEEEIRTTNPVATCQYGSVSTNLQRGNAR

SEQ ID NO: 476 - protein, 29 aa, Artificial Sequence
  Description of Artificial Sequence: Synthetic peptide
DEEEIRTTNPVATEQYGSVSTNLQRDTNR

SEQ ID NO: 477 - protein, 29 aa, Artificial Sequence
  Description of Artificial Sequence: Synthetic peptide
DEEEIRTTNPVATCQYGSVSTNLQRGNDR

SEQ ID NO: 478 - protein, 29 aa, Artificial Sequence
  Description of Artificial Sequence: Synthetic peptide
DEEEIRTTNPVATEQYGSVSTNLQRDNVR

SEQ ID NO: 479 - protein, 29 aa, Artificial Sequence
  Description of Artificial Sequence: Synthetic peptide
DEEEIRTTNPVATCQYGSVSTNLQRGLNR

SEQ ID NO: 480 - protein, 28 aa, Artificial Sequence
  Description of Artificial Sequence: Synthetic peptide
DEEEIRTTNPFATEQYGSVSTDLQRGNR

SEQ ID NO: 481 - protein, 28 aa, Artificial Sequence
  Description of Artificial Sequence: Synthetic peptide
DEEEIRTTNPVATEQYGSVSTSLQRQNR

SEQ ID NO: 482 - protein, 29 aa, Artificial Sequence
  Description of Artificial Sequence: Synthetic peptide
DEEEIRTTNPVATEQYGSVSTNLQREGNW

SEQ ID NO: 483 - protein, 29 aa, Artificial Sequence
  Description of Artificial Sequence: Synthetic peptide
DEEEIRTTNPVATEQYGSVSTNLQREHNR

SEQ ID NO: 484 - protein, 30 aa, Artificial Sequence
  Description of Artificial Sequence: Synthetic polypeptide
DEEEIRTTNPVATEQYGSVSTNLQREGSNR

SEQ ID NO: 485 - protein, 28 aa, Artificial Sequence
  Description of Artificial Sequence: Synthetic peptide
DENEIRTTNPVATEQYGSVSTNLQIGNR

SEQ ID NO: 486 - protein, 28 aa, Artificial Sequence
  Description of Artificial Sequence: Synthetic peptide
DENEIRTTNPVATEQYGSVSTNLQHGNR

SEQ ID NO: 487 - protein, 28 aa, Artificial Sequence
  Description of Artificial Sequence: Synthetic peptide
DEEEIRTTNPVATEQYGSVSTSLQRGTR

SEQ ID NO: 488 - protein, 30 aa, Artificial Sequence
  Description of Artificial Sequence: Synthetic polypeptide
DEEEIRTTNPVATEQYGSVSTFNLQRGNRT

SEQ ID NO: 489 - protein, 29 aa, Artificial Sequence
  Description of Artificial Sequence: Synthetic peptide
DEEEIRTTNPVATEQYGSVSTFNLQRGNT

SEQ ID NO: 490 - protein, 28 aa, Artificial Sequence
  Description of Artificial Sequence: Synthetic peptide
DENEIRTTNPVATEQYGSVSTNLARGNR

SEQ ID NO: 491 - protein, 29 aa, Artificial Sequence
  Description of Artificial Sequence: Synthetic peptide
DEEEIRTTNPVATEQYGSVSTFNLQRLNR

SEQ ID NO: 492 - protein, 29 aa, Artificial Sequence
  Description of Artificial Sequence: Synthetic peptide
EEEEIRTTNPVATEQYGSIVSTNLQRGNR

SEQ ID NO: 493 - protein, 29 aa, Artificial Sequence
  Description of Artificial Sequence: Synthetic peptide
DENEIRTTNPVATEQYGSVSTNLQERGNR

SEQ ID NO: 494 - protein, 29 aa, Artificial Sequence
  Description of Artificial Sequence: Synthetic peptide
DEEEIRTTNPVATEQYGSVSTSLQRGVNR

SEQ ID NO: 495 - protein, 28 aa, Artificial Sequence
  Description of Artificial Sequence: Synthetic peptide
DENEIRTTNPVATEQYGSVSTNLQCGNR

SEQ ID NO: 496 - protein, 29 aa, Artificial Sequence
  Description of Artificial Sequence: Synthetic peptide
DENEIRTTNPVATEQYGSVSTNLNQRGNR

SEQ ID NO: 497 - protein, 28 aa, Artificial Sequence
  Description of Artificial Sequence: Synthetic peptide
DENEIRTTNPVATEQYGSVSTNLIRGNR

SEQ ID NO: 498 - protein, 28 aa, Artificial Sequence
  Description of Artificial Sequence: Synthetic peptide
DENEIRTTNPVATEQYGSVSTNLDRGNR

SEQ ID NO: 499 - protein, 28 aa, Artificial Sequence
  Description of Artificial Sequence: Synthetic peptide
DEEEIRTTNPFATEQYGSVSTNLFRGNR

SEQ ID NO: 500 - protein, 29 aa, Artificial Sequence
  Description of Artificial Sequence: Synthetic peptide
DELEIRTTNPVATEQYGSVSTNLQRGNER

SEQ ID NO: 501 - protein, 30 aa, Artificial Sequence
  Description of Artificial Sequence: Synthetic polypeptide
DEEEIRTTNPVATEQYGSVSTGNLQRGMNR

SEQ ID NO: 502 - protein, 29 aa, Artificial Sequence
  Description of Artificial Sequence: Synthetic peptide
DELEIRTTNPVATEQYGSVSTNLQRGNAR

SEQ ID NO: 503 - protein, 30 aa, Artificial Sequence
  Description of Artificial Sequence: Synthetic polypeptide
DEEEIRTTNPVATEQYGSVSTYNLQRGNRN

SEQ ID NO: 504 - protein, 29 aa, Artificial Sequence
  Description of Artificial Sequence: Synthetic peptide
MEEEIRTTNPVATEQYGSYVSTNLQRGNR

SEQ ID NO: 505 - protein, 29 aa, Artificial Sequence
  Description of Artificial Sequence: Synthetic peptide
DEEEIRTTNPVATEQYGSVSQTNLQGGNR

SEQ ID NO: 506 - protein, 29 aa, Artificial Sequence
  Description of Artificial Sequence: Synthetic peptide
DEEEIRTTNPVATEQYGSVCTNLAQRGNR

SEQ ID NO: 507 - protein, 28 aa, Artificial Sequence
  Description of Artificial Sequence: Synthetic peptide
MEEEIRTTNPVATEWYGSVSTNLQRGNR

SEQ ID NO: 508 - protein, 30 aa, Artificial Sequence
  Description of Artificial Sequence: Synthetic polypeptide
DEEEIRTTNPVATEQYGQSVVSTNLQRGNR

SEQ ID NO: 509 - protein, 30 aa, Artificial Sequence
  Description of Artificial Sequence: Synthetic polypeptide
DEEEIRTTNPVATEQYGSVSQTNLDQRGNR

SEQ ID NO: 510 - protein, 29 aa, Artificial Sequence
  Description of Artificial Sequence: Synthetic peptide
DEEEIRTTNPVATEQYGSVSQTNLARGNR

SEQ ID NO: 511 - protein, 29 aa, Artificial Sequence
  Description of Artificial Sequence: Synthetic peptide
DEEEIRTTNPVATEQYGQSVSTNVQRGNR

SEQ ID NO: 512 - protein, 29 aa, Artificial Sequence
  Description of Artificial Sequence: Synthetic peptide
DEEEIRTTNPVATEQYGSVSMNLQRYGNR

SEQ ID NO: 513 - protein, 28 aa, Artificial Sequence
  Description of Artificial Sequence: Synthetic peptide
DEEEIRTTNPVATEQYGSVSINLQRMNR

SEQ ID NO: 514 - protein, 29 aa, Artificial Sequence
  Description of Artificial Sequence: Synthetic peptide
DEAEIRTTNPVATEQYGSVSATNLQRGNR

SEQ ID NO: 515 - protein, 28 aa, Artificial Sequence
  Description of Artificial Sequence: Synthetic peptide
DEDEIRTTNPVATEQYGSVVTNLQRGNR

SEQ ID NO: 516 - protein, 28 aa, Artificial Sequence
  Description of Artificial Sequence: Synthetic peptide
DEEEIRTTNPVATEQYGSVSINLQRGQR

SEQ ID NO: 517 - protein, 28 aa, Artificial Sequence
  Description of Artificial Sequence: Synthetic peptide
DEEEIRTTNPVATEQYGSVSINLQRGNV

SEQ ID NO: 518 - protein, 29 aa, Artificial Sequence
  Description of Artificial Sequence: Synthetic peptide
DEEEIRTTNPVATEQYGSVSTNLQDAGNR

SEQ ID NO: 519 - protein, 28 aa, Artificial Sequence
  Description of Artificial Sequence: Synthetic peptide
DEFEIVTTNPVATEQYGSVSTNLQRGNR

SEQ ID NO: 520 - protein, 29 aa, Artificial Sequence
  Description of Artificial Sequence: Synthetic peptide
DEEEIRTTNPVATEQYGSVSTMFLQRGNR

SEQ ID NO: 521 - protein, 29 aa, Artificial Sequence
  Description of Artificial Sequence: Synthetic peptide
DEFEIRTTNPVATEQYGSVSTNNLQRGNR

SEQ ID NO: 522 - protein, 30 aa, Artificial Sequence
  Description of Artificial Sequence: Synthetic polypeptide
DEEEIRTTNPVATEQYGSVSTYNLQRGNNR

SEQ ID NO: 523 - protein, 29 aa, Artificial Sequence
  Description of Artificial Sequence: Synthetic peptide
DEFEIRTTNPVATEQYGSVSTNLQRGNVR

SEQ ID NO: 524 - protein, 29 aa, Artificial Sequence
  Description of Artificial Sequence: Synthetic peptide
DEEEIRTTNPVATEQYGSVSTYNLQRGNL

SEQ ID NO: 525 - protein, 29 aa, Artificial Sequence
  Description of Artificial Sequence: Synthetic peptide
DEEEIRTTNPVATEQYGSVSTYNLQQGNR

SEQ ID NO: 526 - protein, 28 aa, Artificial Sequence
  Description of Artificial Sequence: Synthetic peptide
MEEEIRTTNPVATEQYGSVSTNLQRLNR

SEQ ID NO: 527 - protein, 29 aa, Artificial Sequence
  Description of Artificial Sequence: Synthetic peptide
MEEEIRTTNPVATEQYGSVSTNLQVRGNR

SEQ ID NO: 528 - protein, 28 aa, Artificial Sequence
  Description of Artificial Sequence: Synthetic peptide
MEEEIRTTNPVATEQYGSVSTNQQRGNR

SEQ ID NO: 529 - protein, 29 aa, Artificial Sequence
  Description of Artificial Sequence: Synthetic peptide
DEEEIRTTNPVATEQYGSVSCNFLQRGNR

SEQ ID NO: 530 - protein, 28 aa, Artificial Sequence
  Description of Artificial Sequence: Synthetic peptide
DEEEIRETNPVATEQYGSVSTNLQRGNL

SEQ ID NO: 531 - protein, 29 aa, Artificial Sequence
  Description of Artificial Sequence: Synthetic peptide
DEEEIRTTNPVATEQYGSVCTNALQRGNR

SEQ ID NO: 532 - protein, 28 aa, Artificial Sequence
  Description of Artificial Sequence: Synthetic peptide
DEEEIRTTNPVATEQYGSVSTNLQDGNG

SEQ ID NO: 533 - protein, 28 aa, Artificial Sequence
  Description of Artificial Sequence: Synthetic peptide
DEEEIRTTNPVATEQYGQVQTNLQRGNR

SEQ ID NO: 534 - protein, 28 aa, Artificial Sequence
  Description of Artificial Sequence: Synthetic peptide
DEEEIRTTNPVATEQYGSVSMNLQRSNR

SEQ ID NO: 535 - protein, 28 aa, Artificial Sequence
  Description of Artificial Sequence: Synthetic peptide
DEEEIRGTNPLATEQYGSVSTNLQRGNR

SEQ ID NO: 536 - protein, 28 aa, Artificial Sequence
  Description of Artificial Sequence: Synthetic peptide
DEEEIRTTNPVATEQYGQVGTNLQRGNR

SEQ ID NO: 537 - protein, 28 aa, Artificial Sequence
  Description of Artificial Sequence: Synthetic peptide
MEEEIRTTNPVATEQYGSVSTWLQRGNR

SEQ ID NO: 538 - protein, 29 aa, Artificial Sequence
  Description of Artificial Sequence: Synthetic peptide
DEEEIRTTNPVATEQYGSVSTNLQDGNFR

SEQ ID NO: 539 - protein, 29 aa, Artificial Sequence
  Description of Artificial Sequence: Synthetic peptide
DEEEIRTTNPVATEQYGSVSTNLQDGNER

SEQ ID NO: 540 - protein, 29 aa, Artificial Sequence
  Description of Artificial Sequence: Synthetic peptide
DEEEIRTTNPVATEQYGSVSTYNLQKGNR

SEQ ID NO: 541 - protein, 28 aa, Artificial Sequence
  Description of Artificial Sequence: Synthetic peptide
DEEEIRTTNPVATEQYGSVSTNLQDGIR

SEQ ID NO: 542 - protein, 28 aa, Artificial Sequence
  Description of Artificial Sequence: Synthetic peptide
DEDEIRTTNPVATEQYGSVSTYLQRGNR

SEQ ID NO: 543 - protein, 29 aa, Artificial Sequence
  Description of Artificial Sequence: Synthetic peptide
DEEEIRTTNPVATEQYGSVSQTNLQMGNR

SEQ ID NO: 544 - protein, 29 aa, Artificial Sequence
  Description of Artificial Sequence: Synthetic peptide
DEEEIRTTNPVATEQYGSVSINLVQRGNR

SEQ ID NO: 545 - protein, 28 aa, Artificial Sequence
  Description of Artificial Sequence: Synthetic peptide
DEEEIRTTNPVATEQYGSVCTNDQRGNR

SEQ ID NO: 546 - protein, 29 aa, Artificial Sequence
  Description of Artificial Sequence: Synthetic peptide
MEEEIRTTNPVATEQYGSVSTNLQRGNSR

SEQ ID NO: 547 - protein, 28 aa, Artificial Sequence
  Description of Artificial Sequence: Synthetic peptide
DEEEIRTTNPVATEQYGSVSMNLQVGNR

SEQ ID NO: 548 - protein, 29 aa, Artificial Sequence
  Description of Artificial Sequence: Synthetic peptide
DEEEIRTTNPVATEQYGSVSTNLQCRLNR

SEQ ID NO: 549 - protein, 28 aa, Artificial Sequence
  Description of Artificial Sequence: Synthetic peptide
DEEEIRTTNPVATEQYGSVSINLQAGNR

SEQ ID NO: 550 - protein, 29 aa, Artificial Sequence
  Description of Artificial Sequence: Synthetic peptide
DEEEIRTTNPVATEQYGSVSINLPQRGNR

SEQ ID NO: 551 - protein, 29 aa, Artificial Sequence
  Description of Artificial Sequence: Synthetic peptide
DEEEIRTTNPVATEQYGSVSQTNEQRGNR

SEQ ID NO: 552 - protein, 30 aa, Artificial Sequence
  Description of Artificial Sequence: Synthetic polypeptide
DEEEIRTTNPVATEQYGSVSTNLQARMGNR

SEQ ID NO: 553 - protein, 30 aa, Artificial Sequence
  Description of Artificial Sequence: Synthetic polypeptide
DEEEIRTTNPVATEQYGSVSTNLQARGNNR

SEQ ID NO: 554 - protein, 29 aa, Artificial Sequence
  Description of Artificial Sequence: Synthetic peptide
DEEEIRTTNPVATEQYGSVSTNLQARGNE

SEQ ID NO: 555 - protein, 29 aa, Artificial Sequence
  Description of Artificial Sequence: Synthetic peptide
DEEEIRTTNPVATEQYGSVSTNLQARGNC

SEQ ID NO: 556 - protein, 30 aa, Artificial Sequence
  Description of Artificial Sequence: Synthetic polypeptide
DEEEIRTTNPVATEQYGSVSTNLQARGGNR

SEQ ID NO: 557 - protein, 28 aa, Artificial Sequence
  Description of Artificial Sequence: Synthetic peptide
DEEYIRTTNPVATEQYGSVSTNLQRGNM

SEQ ID NO: 558 - protein, 29 aa, Artificial Sequence
  Description of Artificial Sequence: Synthetic peptide
DEEYIRTTNPVATEQYGSVSTNLQREGNR

SEQ ID NO: 559 - protein, 28 aa, Artificial Sequence
  Description of Artificial Sequence: Synthetic peptide
DEEYIRTTNPVATEQYGSVSTNLQIGNR

SEQ ID NO: 560 - protein, 28 aa, Artificial Sequence
  Description of Artificial Sequence: Synthetic peptide
DEEYIRTTNPVATEQYGSVSDNLQRGNR

SEQ ID NO: 561 - protein, 28 aa, Artificial Sequence
  Description of Artificial Sequence: Synthetic peptide
DEEEIRTTNPVATEQYGSVCTNLQRANR

SEQ ID NO: 562 - protein, 28 aa, Artificial Sequence
  Description of Artificial Sequence: Synthetic peptide
DEEWIRTTNPVATEQYGSVSTNLQRGNF

SEQ ID NO: 563 - protein, 28 aa, Artificial Sequence
  Description of Artificial Sequence: Synthetic peptide
DEEWIRTTNPVATEQYGSVSTNLQRGNC

SEQ ID NO: 564 - protein, 29 aa, Artificial Sequence
  Description of Artificial Sequence: Synthetic peptide
DEEVIRTTNPVSATEQYGSVSTNLQRGNR

SEQ ID NO: 565 - protein, 30 aa, Artificial Sequence
  Description of Artificial Sequence: Synthetic polypeptide
DEEEIRTTNPVATEQYGQSVSGTNLQRGNR

SEQ ID NO: 566 - protein, 29 aa, Artificial Sequence
  Description of Artificial Sequence: Synthetic peptide
DEEEIRTTNPVATEQYGSVCTNLQRPGNR

SEQ ID NO: 567 - protein, 28 aa, Artificial Sequence
  Description of Artificial Sequence: Synthetic peptide
DEEEIRTTNPVATEQYGSVSTNLQAGTR

SEQ ID NO: 568 - protein, 30 aa, Artificial Sequence
  Description of Artificial Sequence: Synthetic polypeptide
DEEEIRTTNPVATEQYGQSVSTNLMQRGNR

SEQ ID NO: 569 - protein, 29 aa, Artificial Sequence
  Description of Artificial Sequence: Synthetic peptide
DEFEIRTTNPVATEQYGSVSTNLQRGGNR

SEQ ID NO: 570 - protein, 29 aa, Artificial Sequence
  Description of Artificial Sequence: Synthetic peptide
DEEEIRTTNPVATEQYGSVSTNLQAVGNR

SEQ ID NO: 571 - protein, 30 aa, Artificial Sequence
  Description of Artificial Sequence: Synthetic polypeptide
DEEEIRTTNPVATEQYGQSVSTNLQREGNR

SEQ ID NO: 572 - protein, 29 aa, Artificial Sequence
  Description of Artificial Sequence: Synthetic peptide
DEFEIRTTNPVATEQYGSVSTNLQCRGNR

SEQ ID NO: 573 - protein, 30 aa, Artificial Sequence
  Description of Artificial Sequence: Synthetic polypeptide
DEEEIRTTNPVATEQYGSVSTNLQCRFGNR

SEQ ID NO: 574 - protein, 28 aa, Artificial Sequence
  Description of Artificial Sequence: Synthetic peptide
DEFEIRTTNPVATEQYGQVSTNLQRGNR

SEQ ID NO: 575 - protein, 30 aa, Artificial Sequence
  Description of Artificial Sequence: Synthetic polypeptide
DEEEIRTTNPVATEQYGQSVSTNLQRMGNR

SEQ ID NO: 576 - protein, 29 aa, Artificial Sequence
  Description of Artificial Sequence: Synthetic peptide
DEEEIRTTNPVATEQYGQSVSTNLQRGNY

SEQ ID NO: 577 - protein, 28 aa, Artificial Sequence
  Description of Artificial Sequence: Synthetic peptide
DEFEIRTTNPVATEDYGSVSTNLQRGNR

SEQ ID NO: 578 - protein, 28 aa, Artificial Sequence
  Description of Artificial Sequence: Synthetic peptide
DEFEIRATNPVATEQYGSVSTNLQRGNR

SEQ ID NO: 579 - protein, 29 aa, Artificial Sequence
  Description of Artificial Sequence: Synthetic peptide
DEEEIRTTNPVATEQYGSVSCINLQRGNR

SEQ ID NO: 580 - protein, 29 aa, Artificial Sequence
  Description of Artificial Sequence: Synthetic peptide
DEEEIRTTNPVATEQYGQSVSTNLQRGNV

SEQ ID NO: 581 - protein, 30 aa, Artificial Sequence
  Description of Artificial Sequence: Synthetic polypeptide
DEEEIRTTNPVATEQYGQSVSTNLQRGNRG

SEQ ID NO: 582 - protein, 30 aa, Artificial Sequence
  Description of Artificial Sequence: Synthetic polypeptide
DEEEIRTTNPVATEQYGSVSTNLQCRAGNR

SEQ ID NO: 583 - protein, 28 aa, Artificial Sequence
  Description of Artificial Sequence: Synthetic peptide
DEEEIRTTNPVATEQYGSVSTNLQCGTR

SEQ ID NO: 584 - protein, 30 aa, Artificial Sequence
  Description of Artificial Sequence: Synthetic polypeptide
DEEEIRTTNPVATEQYGSVSTYNMLQRGNR

SEQ ID NO: 585 - protein, 29 aa, Artificial Sequence
  Description of Artificial Sequence: Synthetic peptide
DEEEIRTTNPVATEQYGSVSTNLQCGNRM

SEQ ID NO: 586 - protein, 30 aa, Artificial Sequence
  Description of Artificial Sequence: Synthetic polypeptide
DEEEIRTTNPVATEQYGQSVSTNLQRGNDR

SEQ ID NO: 587 - protein, 29 aa, Artificial Sequence
  Description of Artificial Sequence: Synthetic peptide
DEEEIRTTNPVATEQYGQSVSTNLQRGMR

SEQ ID NO: 588 - protein, 30 aa, Artificial Sequence
  Description of Artificial Sequence: Synthetic polypeptide
DEEEIRTTNPVATEQYGQSVSTNLQRGGNR

SEQ ID NO: 589 - protein, 29 aa, Artificial Sequence
  Description of Artificial Sequence: Synthetic peptide
DEEEIRTTNPVATEQYGSVSINLQGRGNR

SEQ ID NO: 590 - protein, 28 aa, Artificial Sequence
  Description of Artificial Sequence: Synthetic peptide
DEEEIRTTNPVATEQYGSVSTNLQCGNP

SEQ ID NO: 591 - protein, 29 aa, Artificial Sequence
  Description of Artificial Sequence: Synthetic peptide
DEEEIRTTNPVATEQYGSVSTNLQCGNGR

SEQ ID NO: 592 - protein, 29 aa, Artificial Sequence
  Description of Artificial Sequence: Synthetic peptide
MEEEIRTTNPVATEQYGSVSTNLQNRGNR

SEQ ID NO: 593 - protein, 30 aa, Artificial Sequence
  Description of Artificial Sequence: Synthetic polypeptide
DEGEEIIRTTNPVATEQYGSVSTNLQRGNR

SEQ ID NO: 594 - protein, 29 aa, Artificial Sequence
  Description of Artificial Sequence: Synthetic peptide
DEGEEIRTTNPVATEQYGSVSTNLQDGNR

SEQ ID NO: 595 - protein, 29 aa, Artificial Sequence
  Description of Artificial Sequence: Synthetic peptide
DEEEIRTTNPVATEQYGSVSTWNLQRGNL

SEQ ID NO: 596 - protein, 30 aa, Artificial Sequence
  Description of Artificial Sequence: Synthetic polypeptide
DEEEIRTTNPVATEQYGSVSRTQNLQRGNR

SEQ ID NO: 597 - protein, 29 aa, Artificial Sequence
  Description of Artificial Sequence: Synthetic peptide
DEEEIRTTNPVATEQYGSVSTWNLQRGNN

SEQ ID NO: 598 - protein, 30 aa, Artificial Sequence
  Description of Artificial Sequence: Synthetic polypeptide
DEEEIRTTNPVATEQYGSVSRTNLQERGNR

SEQ ID NO: 599 - protein, 28 aa, Artificial Sequence
  Description of Artificial Sequence: Synthetic peptide
DEEEIRTTNPVATEQYGSVSRDLQRGNR

SEQ ID NO: 600 - protein, 28 aa, Artificial Sequence
  Description of Artificial Sequence: Synthetic peptide
DEEEIRTTNPVATEQYGSVSTNLQEGDR

SEQ ID NO: 601 - protein, 30 aa, Artificial Sequence
  Description of Artificial Sequence: Synthetic polypeptide
DEEEIRTTNPVATEQYGSVSTWNLQRGNVR

SEQ ID NO: 602 - protein, 29 aa, Artificial Sequence
  Description of Artificial Sequence: Synthetic peptide
DEEEIRTTNPVATEQYGSVCSTNWQRGNR

SEQ ID NO: 603 - protein, 29 aa, Artificial Sequence
  Description of Artificial Sequence: Synthetic peptide
DEEEIRTTNPVATEQYGSVCSTNYQRGNR

SEQ ID NO: 604 - protein, 28 aa, Artificial Sequence
  Description of Artificial Sequence: Synthetic peptide
DEGEIRTTNPVATEQMGSVSTNLQRGNR

SEQ ID NO: 605 - protein, 29 aa, Artificial Sequence
  Description of Artificial Sequence: Synthetic peptide
DEEEIRTTNPVATEQYGSVSTLSLQRGNR

SEQ ID NO: 606 - protein, 29 aa, Artificial Sequence
  Description of Artificial Sequence: Synthetic peptide
DEEEIRTTNPVATEQYGSVCSTPLQRGNR

SEQ ID NO: 607 - protein, 28 aa, Artificial Sequence
  Description of Artificial Sequence: Synthetic peptide
MEEEIRTTNPVADEQYGSVSTNLQRGNR

SEQ ID NO: 608 - protein, 28 aa, Artificial Sequence
  Description of Artificial Sequence: Synthetic peptide
DEEEIRTTNPVATEQYGQVSTNLQRQNR

SEQ ID NO: 609 - protein, 30 aa, Artificial Sequence
  Description of Artificial Sequence: Synthetic polypeptide
DEEEIRTTNPVATEQYGSVSCTCNLQRGNR

SEQ ID NO: 610 - protein, 29 aa, Artificial Sequence
  Description of Artificial Sequence: Synthetic peptide
DEEEIRTTNPVATEQYGQVSTNLQRGNSR

SEQ ID NO: 611 - protein, 28 aa, Artificial Sequence
  Description of Artificial Sequence: Synthetic peptide
DEEEIRTTNPVATEQYGSVSCSLQRGNR

SEQ ID NO: 612 - protein, 29 aa, Artificial Sequence
  Description of Artificial Sequence: Synthetic peptide
DEEEIRTTNPVATEQYGSVSMNLQRGNPR

SEQ ID NO: 613 - protein, 28 aa, Artificial Sequence
  Description of Artificial Sequence: Synthetic peptide
DEEEIRTTNPVATEQYGSVSTMCQRGNR

SEQ ID NO: 614 - protein, 29 aa, Artificial Sequence
  Description of Artificial Sequence: Synthetic peptide
DEEEIRTTNPVATEQYGSVSTWNLQRGNH

SEQ ID NO: 615 - protein, 28 aa, Artificial Sequence
  Description of Artificial Sequence: Synthetic peptide
MEEEIRTTNPVATEIYGSVSTNLQRGNR

SEQ ID NO: 616 - protein, 29 aa, Artificial Sequence
  Description of Artificial Sequence: Synthetic peptide
DEEEIRTTNPVATEQYGSVCSTNTQRGNR

SEQ ID NO: 617 - protein, 29 aa, Artificial Sequence
  Description of Artificial Sequence: Synthetic peptide
DEEEIRTTNPVATEQYGSVSTNLQEGNLR

SEQ ID NO: 618 - protein, 30 aa, Artificial Sequence
  Description of Artificial Sequence: Synthetic polypeptide
DEEEIRTTNPVATEQYGSVSTNLQERGQNR

SEQ ID NO: 619 - protein, 29 aa, Artificial Sequence
  Description of Artificial Sequence: Synthetic peptide
DEEEIRCTNPVATEQYGSVSVTNLQRGNR

SEQ ID NO: 620 - protein, 30 aa, Artificial Sequence
  Description of Artificial Sequence: Synthetic polypeptide
DEEEIRTTNPVATEQYGSVSTNLQERGNVR

SEQ ID NO: 621 - protein, 30 aa, Artificial Sequence
  Description of Artificial Sequence: Synthetic polypeptide
DEEEIRTTNPVATEQYGSVSTNLQERGNRG

SEQ ID NO: 622 - protein, 29 aa, Artificial Sequence
  Description of Artificial Sequence: Synthetic peptide
DEEEIRTTNPVATEQYGSVSTNLQERGNP

SEQ ID NO: 623 - protein, 28 aa, Artificial Sequence
  Description of Artificial Sequence: Synthetic peptide
DEEEIRTTNPDATEQYGSVSHNLQRGNR

SEQ ID NO: 624 - protein, 28 aa, Artificial Sequence
  Description of Artificial Sequence: Synthetic peptide
DEGEIRTTNPVATEQYGSVITNLQRGNR

SEQ ID NO: 625 - protein, 30 aa, Artificial Sequence
  Description of Artificial Sequence: Synthetic polypeptide
DEEEIRTTNPVATEQYGSVSTNLQERGNMR

SEQ ID NO: 626 - protein, 29 aa, Artificial Sequence
  Description of Artificial Sequence: Synthetic peptide
DEEEIRTTNPVATEQYGSVSTNLQERGMR

SEQ ID NO: 627 - protein, 28 aa, Artificial Sequence
  Description of Artificial Sequence: Synthetic peptide
DEGEIRTTNPVATEQYGSVCTNLQRGNR

SEQ ID NO: 628 - protein, 29 aa, Artificial Sequence
  Description of Artificial Sequence: Synthetic peptide
DEEEIRCTNPVATEQYGSYVSTNLQRGNR

SEQ ID NO: 629 - protein, 30 aa, Artificial Sequence
  Description of Artificial Sequence: Synthetic polypeptide
DEEEIRTTNPVATEQYGSVSTLNYLQRGNR

SEQ ID NO: 630 - protein, 28 aa, Artificial Sequence
  Description of Artificial Sequence: Synthetic peptide
DEEEIRTTNPVATEQYGSVSTNLQEHNR

SEQ ID NO: 631 - protein, 29 aa, Artificial Sequence
  Description of Artificial Sequence: Synthetic peptide
DEEEIRTTNPVATEQYGSVSTLPLQRGNR

SEQ ID NO: 632 - protein, 29 aa, Artificial Sequence
  Description of Artificial Sequence: Synthetic peptide
DEEEIRTTNPVATEQYGSVSTNLQEGNTR

SEQ ID NO: 633 - protein, 28 aa, Artificial Sequence
  Description of Artificial Sequence: Synthetic peptide
MEEEIKTTNPVATEQYGSVSTNLQRGNR

SEQ ID NO: 634 - protein, 28 aa, Artificial Sequence
  Description of Artificial Sequence: Synthetic peptide
DEEEIRTTNPDATEQYGSISTNLQRGNR

SEQ ID NO: 635 - protein, 28 aa, Artificial Sequence
  Description of Artificial Sequence: Synthetic peptide
DEEEIRTTNPDATEQWGSVSTNLQRGNR

SEQ ID NO: 636 - protein, 28 aa, Artificial Sequence
  Description of Artificial Sequence: Synthetic peptide
DEEEIRTTNPVATEQYGSVSTNLQEGNM

SEQ ID NO: 637 - protein, 29 aa, Artificial Sequence
  Description of Artificial Sequence: Synthetic peptide
DEEEIRTTNPVATEAYGSVSTVNLQRGNR

SEQ ID NO: 638 - protein, 28 aa, Artificial Sequence
  Description of Artificial Sequence: Synthetic peptide
MEEEIRTTNPVATEMYGSVSTNLQRGNR

SEQ ID NO: 639 - protein, 28 aa, Artificial Sequence
  Description of Artificial Sequence: Synthetic peptide
DEEEIRTTNPVATEQYGQVSTNLQRGNP

SEQ ID NO: 640 - protein, 28 aa, Artificial Sequence
  Description of Artificial Sequence: Synthetic peptide
DEEEIRTTNPVATEQYGQVSTNLQRGNF

SEQ ID NO: 641 - protein, 28 aa, Artificial Sequence
  Description of Artificial Sequence: Synthetic peptide
DEEEIRTTNPVATEQYGSVSCNLQRGNQ

SEQ ID NO: 642 - protein, 29 aa, Artificial Sequence
  Description of Artificial Sequence: Synthetic peptide
DEEEIRTTNPVATEQYGSVSCNLQRGNLR

SEQ ID NO: 643 - protein, 29 aa, Artificial Sequence
  Description of Artificial Sequence: Synthetic peptide
DEEEIRTTNPVATEQYGSVSQTNLQSGNR

SEQ ID NO: 644 - protein, 29 aa, Artificial Sequence
  Description of Artificial Sequence: Synthetic peptide
DEEEIRTTNPVATEQYGSVSTNLQDRGDR

SEQ ID NO: 645 - protein, 29 aa, Artificial Sequence
  Description of Artificial Sequence: Synthetic peptide
DEEEIRTTNPVATEQYGSVSCNLQRGNDR

SEQ ID NO: 646 - protein, 28 aa, Artificial Sequence
  Description of Artificial Sequence: Synthetic peptide
MEEEIRTTNPVATEQYGSVSQNLQRGNR

SEQ ID NO: 647 - protein, 28 aa, Artificial Sequence
  Description of Artificial Sequence: Synthetic peptide
DEEEIRTTNPVATEQYGSVSCNLQLGNR

SEQ ID NO: 648 - protein, 29 aa, Artificial Sequence
  Description of Artificial Sequence: Synthetic peptide
DEEEIRTTNPVATEQYGSVSQTNLQRTNR

SEQ ID NO: 649 - protein, 29 aa, Artificial Sequence
  Description of Artificial Sequence: Synthetic peptide
MEEEIRTTNPVATEQYGSVSQTNLQRGNR

SEQ ID NO: 650 - protein, 30 aa, Artificial Sequence
  Description of Artificial Sequence: Synthetic polypeptide
DEEEIRTTNPVATEQYGSVSQTNLQRGNRL

SEQ ID NO: 651 - protein, 28 aa, Artificial Sequence
  Description of Artificial Sequence: Synthetic peptide
DEEEIRTTNPVATEQYGSVSCNLQAGNR

SEQ ID NO: 652 - protein, 30 aa, Artificial Sequence
  Description of Artificial Sequence: Synthetic polypeptide
DEEEIRTTNPVATEQYGSVSQTNLQRGNMR

SEQ ID NO: 653 - protein, 30 aa, Artificial Sequence
  Description of Artificial Sequence: Synthetic polypeptide
DEEEIRTTNPVATEQYGSVSQTNLQRGNER

SEQ ID NO: 654 - protein, 28 aa, Artificial Sequence
  Description of Artificial Sequence: Synthetic peptide
DEEEIRTTNPCSTEQYGSVSTNLQRGNR

SEQ ID NO: 655 - protein, 30 aa, Artificial Sequence
  Description of Artificial Sequence: Synthetic polypeptide
DEEEIRTTNPVATEQYGSVSQTNLQRGGNR

SEQ ID NO: 656 - protein, 28 aa, Artificial Sequence
  Description of Artificial Sequence: Synthetic peptide
MEEEIRTTNPVATEQYGSVSTELQRGNR

SEQ ID NO: 657 - protein, 28 aa, Artificial Sequence
  Description of Artificial Sequence: Synthetic peptide
MEEEIRTTNPVATEQYGSVSTFLQRGNR

SEQ ID NO: 658 - protein, 29 aa, Artificial Sequence
  Description of Artificial Sequence: Synthetic peptide
DEEEIRTTNPVATEQYGSVSTNLQDGNRN

SEQ ID NO: 659 - protein, 28 aa, Artificial Sequence
  Description of Artificial Sequence: Synthetic peptide
MEEEIRTTNPVATEQYGSVSTNLPRGNR

SEQ ID NO: 660 - protein, 28 aa, Artificial Sequence
  Description of Artificial Sequence: Synthetic peptide
DEEEIRTTNPVATEQYGSVSCNLQRNNR

SEQ ID NO: 661 - protein, 29 aa, Artificial Sequence
  Description of Artificial Sequence: Synthetic peptide
DEEEIRTTNPVATEQYGSVSTNLQDRGLR

SEQ ID NO: 662 - protein, 30 aa, Artificial Sequence
  Description of Artificial Sequence: Synthetic polypeptide
DEEEIRTTNPVATEQYGSVSTNLQDRGMNR

SEQ ID NO: 663 - protein, 29 aa, Artificial Sequence
  Description of Artificial Sequence: Synthetic peptide
DEEEIRTTNPVATEQYGSVSTNLQDRGNF

SEQ ID NO: 664 - protein, 28 aa, Artificial Sequence
  Description of Artificial Sequence: Synthetic peptide
DEEEIRTTNPVATEQYGQVSTNLQRGIR

SEQ ID NO: 665 - protein, 28 aa, Artificial Sequence
  Description of Artificial Sequence: Synthetic peptide
DEEEIRTTNPVATEQYGQVSTNLQQGNR

SEQ ID NO: 666 - protein, 29 aa, Artificial Sequence
  Description of Artificial Sequence: Synthetic peptide
DEEEIRTTNPVATEQYGSVSMNLQRGNRN

SEQ ID NO: 667 - protein, 29 aa, Artificial Sequence
  Description of Artificial Sequence: Synthetic peptide
DEDEIRTTNPVATEQYGSVSTVNLQRGNR

SEQ ID NO: 668 - protein, 28 aa, Artificial Sequence
  Description of Artificial Sequence: Synthetic peptide
MEEEIRTTNPVATEQYGDVSTNLQRGNR

SEQ ID NO: 669 - protein, 29 aa, Artificial Sequence
  Description of Artificial Sequence: Synthetic peptide
DEEEIRTTNPVATEQYGQVSTNLNQRGNR

SEQ ID NO: 670 - protein, 29 aa, Artificial Sequence
  Description of Artificial Sequence: Synthetic peptide
DEEEIRTTNPVATEQYGSVSMNLQRGYNR

SEQ ID NO: 671 - protein, 28 aa, Artificial Sequence
  Description of Artificial Sequence: Synthetic peptide
DEEEIRTTNPVATEQYGSVSTYLQIGNR

SEQ ID NO: 672 - protein, 29 aa, Artificial Sequence
  Description of Artificial Sequence: Synthetic peptide
DEEEIRTTNPVATEQYGSVSQTNPQRGNR

SEQ ID NO: 673 - protein, 29 aa, Artificial Sequence
  Description of Artificial Sequence: Synthetic peptide
DEEEIRTTNPVATEQYGCVSTGNLQRGNR

SEQ ID NO: 674 - protein, 29 aa, Artificial Sequence
  Description of Artificial Sequence: Synthetic peptide
DEEEIRTTNPVATEQYGSVSMNLQRNGNR

SEQ ID NO: 675 - protein, 29 aa, Artificial Sequence
  Description of Artificial Sequence: Synthetic peptide
DEEEIRTTNPVATEQYGSVSTYLQRGNIR

SEQ ID NO: 676 - protein, 28 aa, Artificial Sequence
  Description of Artificial Sequence: Synthetic peptide
DEEEIRTTNPVATEQYGSVSTYLQRLNR

SEQ ID NO: 677 - protein, 30 aa, Artificial Sequence
  Description of Artificial Sequence: Synthetic polypeptide
DEEEIRTTNPVATEQYGSVSTNLQDRGQNR

SEQ ID NO: 678 - protein, 30 aa, Artificial Sequence
  Description of Artificial Sequence: Synthetic polypeptide
DEEEIRTTNPVATEQYGSVCSTYNLQRGNR

SEQ ID NO: 679 - protein, 29 aa, Artificial Sequence
  Description of Artificial Sequence: Synthetic peptide
DEEEIRTTNPVATEQYGSVSTYLSQRGNR

SEQ ID NO: 680 - protein, 30 aa, Artificial Sequence
  Description of Artificial Sequence: Synthetic polypeptide
DEEEIRTTNPVATEQYGSVSTNLQDRGPNR

SEQ ID NO: 681 - protein, 28 aa, Artificial Sequence
  Description of Artificial Sequence: Synthetic peptide
MEEEIRTTNPVATEQYGSVPTNLQRGNR

SEQ ID NO: 682 - protein, 28 aa, Artificial Sequence
  Description of Artificial Sequence: Synthetic peptide
DEEEIRTTNPVATEQYGSVSCNPQRGNR

SEQ ID NO: 683 - protein, 30 aa, Artificial Sequence
  Description of Artificial Sequence: Synthetic polypeptide
DEEEIRTTNPVATEQYGSVCSVTNLQRGNR

SEQ ID NO: 684 - protein, 28 aa, Artificial Sequence
  Description of Artificial Sequence: Synthetic peptide
DEEEIRTTNPVATEQYGQVSTNLIRGNR

SEQ ID NO: 685 - protein, 29 aa, Artificial Sequence
  Description of Artificial Sequence: Synthetic peptide
DEEEIRTTNPVATEQYGSVCTNLQRQGNR

SEQ ID NO: 686 - protein, 29 aa, Artificial Sequence
  Description of Artificial Sequence: Synthetic peptide
DEEEIRTTNPVATEQYGSVSTNLQAGNNR

SEQ ID NO: 687 - protein, 29 aa, Artificial Sequence
  Description of Artificial Sequence: Synthetic peptide
DEEVIRTTNPVATEQYGSVSTQNLQRGNR

SEQ ID NO: 688 - protein, 29 aa, Artificial Sequence
  Description of Artificial Sequence: Synthetic peptide
DEEEIRTTNPVATEQYGCSVSTNLQWGNR

SEQ ID NO: 689 - protein, 29 aa, Artificial Sequence
  Description of Artificial Sequence: Synthetic peptide
DEEEIRTTNPVATEQYGCSVSTNLQSGNR

SEQ ID NO: 690 - protein, 29 aa, Artificial Sequence
  Description of Artificial Sequence: Synthetic peptide
DEEEIRTTNPVATEQYGCSVSTNLQRINR

SEQ ID NO: 691 - protein, 30 aa, Artificial Sequence
  Description of Artificial Sequence: Synthetic polypeptide
DEEEIRTTNPVATEQYGCSVSTNLQRGNSR

SEQ ID NO: 692 - protein, 29 aa, Artificial Sequence
  Description of Artificial Sequence: Synthetic peptide
DEEEIRTTNPVATEQYGCSVSTNLQRGNP

SEQ ID NO: 693 - protein, 30 aa, Artificial Sequence
  Description of Artificial Sequence: Synthetic polypeptide
DEEEIRTTNPVATEQYGCSVSTNLQRGNIR

SEQ ID NO: 694 - protein, 29 aa, Artificial Sequence
  Description of Artificial Sequence: Synthetic peptide
DEETIRTTNPVATEQYGSVSTNLQRGNVR

SEQ ID NO: 695 - protein, 29 aa, Artificial Sequence
  Description of Artificial Sequence: Synthetic peptide
DEEEIRTTNPVATEQYGCSVSTNLQRGNG

SEQ ID NO: 696 - protein, 28 aa, Artificial Sequence
  Description of Artificial Sequence: Synthetic peptide
DEETIRTTNPVATEQYGSVSTNLQRGNV

SEQ ID NO: 697 - protein, 29 aa, Artificial Sequence
  Description of Artificial Sequence: Synthetic peptide
DEEEIRTTNPVATEQYGCSVSTNLQRGNE

SEQ ID NO: 698 - protein, 28 aa, Artificial Sequence
  Description of Artificial Sequence: Synthetic peptide
DEETIRTTNPVATEQYGSVSTNLQRGNA

SEQ ID NO: 699 - protein, 29 aa, Artificial Sequence
  Description of Artificial Sequence: Synthetic peptide
DEETIRTTNPVATEQYGSVSTNLQMRGNR

SEQ ID NO: 700 - protein, 29 aa, Artificial Sequence
  Description of Artificial Sequence: Synthetic peptide
DEEEIRTTNPVATEQYGCSVSTNLQRGNA

SEQ ID NO: 701 - protein, 29 aa, Artificial Sequence
  Description of Artificial Sequence: Synthetic peptide
DEEEIRTTNPVATEQYGCSVSTNLQHGNR

SEQ ID NO: 702 - protein, 30 aa, Artificial Sequence
  Description of Artificial Sequence: Synthetic polypeptide
DEEEIRTTNPVATEQYGCSVSTNLQDRGNR

SEQ ID NO: 703 - protein, 30 aa, Artificial Sequence
  Description of Artificial Sequence: Synthetic polypeptide
DEEEIRTTNPVATEQYGCSVSTNLGQRGNR

SEQ ID NO: 704 - protein, 30 aa, Artificial Sequence
  Description of Artificial Sequence: Synthetic polypeptide
DEEEIRTTNPVATEQYGCSVSTNLAQRGNR

SEQ ID NO: 705 - protein, 30 aa, Artificial Sequence
  Description of Artificial Sequence: Synthetic polypeptide
DEEEIRTTNPVATEQYGCSVSTNILQRGNR

SEQ ID NO: 706 - protein, 28 aa, Artificial Sequence
  Description of Artificial Sequence: Synthetic peptide
DEETIRTTNPVATEQYGSVSTNLQLGNR

SEQ ID NO: 707 - protein, 28 aa, Artificial Sequence
  Description of Artificial Sequence: Synthetic peptide
DEETIRTTNPVATEQYGSVSTNLQRGNW

SEQ ID NO: 708 - protein, 29 aa, Artificial Sequence
  Description of Artificial Sequence: Synthetic peptide
DEEEIRTTNPVATEQYGSVSATNLDRGNR

SEQ ID NO: 709 - protein, 29 aa, Artificial Sequence
  Description of Artificial Sequence: Synthetic peptide
DEETIRTTNPVATEQYGSVSTNLQRGSNR

SEQ ID NO: 710 - protein, 29 aa, Artificial Sequence
  Description of Artificial Sequence: Synthetic peptide
DEETIRTTNPVATEQYGSVSTNLQVRGNR

SEQ ID NO: 711 - protein, 28 aa, Artificial Sequence
  Description of Artificial Sequence: Synthetic peptide
DEEEIRTTNPVATEQYGSVDHNLQRGNR

SEQ ID NO: 712 - protein, 29 aa, Artificial Sequence
  Description of Artificial Sequence: Synthetic peptide
DEEEIRTTNPVATEQYGSVDLTNLQRGNR

SEQ ID NO: 713 - protein, 29 aa, Artificial Sequence
  Description of Artificial Sequence: Synthetic peptide
DEEEIRGTNPVATEQYGSVSTNLQCRGNR

SEQ ID NO: 714 - protein, 28 aa, Artificial Sequence
  Description of Artificial Sequence: Synthetic peptide
DEEEIRGTNPVATEQYGSVSTNLQEGNR

SEQ ID NO: 715 - protein, 28 aa, Artificial Sequence
  Description of Artificial Sequence: Synthetic peptide
DEEEIRGTNPVATEQYGSVSTNLQQGNR

SEQ ID NO: 716 - protein, 30 aa, Artificial Sequence
  Description of Artificial Sequence: Synthetic polypeptide
DEEEIRTTNPVATEQYGSVSATNLQRGFNR

SEQ ID NO: 717 - protein, 30 aa, Artificial Sequence
  Description of Artificial Sequence: Synthetic polypeptide
DEEEIRTTNPVATEQYGSVSMTNLDQRGNR

SEQ ID NO: 718 - protein, 30 aa, Artificial Sequence
  Description of Artificial Sequence: Synthetic polypeptide
DEEEIRTTNPVATEQYGSVDSFTNLQRGNR

SEQ ID NO: 719 - protein, 28 aa, Artificial Sequence
  Description of Artificial Sequence: Synthetic peptide
DEEEIRGTNPVATEQYGSVSTNLQRGDR

SEQ ID NO: 720 - protein, 28 aa, Artificial Sequence
  Description of Artificial Sequence: Synthetic peptide
DEEEIRGTNPVATEQYGSVSTNLQRGNN

SEQ ID NO: 721 - protein, 30 aa, Artificial Sequence
  Description of Artificial Sequence: Synthetic polypeptide
DEEEIRTTNPVATEQYGCSVSTVNLQRGNR

SEQ ID NO: 722 - protein, 30 aa, Artificial Sequence
  Description of Artificial Sequence: Synthetic polypeptide
DEEEIRTTNPVATEQYGSVSATNLQDRGNR

SEQ ID NO: 723 - protein, 29 aa, Artificial Sequence
  Description of Artificial Sequence: Synthetic peptide
DEEEIRGTNPVATEQYGSVSTNLQRGNRN

SEQ ID NO: 724 - protein, 30 aa, Artificial Sequence
  Description of Artificial Sequence: Synthetic polypeptide
DEEEIRTTNPVATEQYGCSVSTTNLQRGNR

SEQ ID NO: 725 - protein, 28 aa, Artificial Sequence
  Description of Artificial Sequence: Synthetic peptide
DEEEIRGTNPVATEQYGSVSTPLQRGNR

SEQ ID NO: 726 - protein, 28 aa, Artificial Sequence
  Description of Artificial Sequence: Synthetic peptide
TEEEIRTTNPVATENYGSVSTNLQRGNR

SEQ ID NO: 727 - protein, 30 aa, Artificial Sequence
  Description of Artificial Sequence: Synthetic polypeptide
DEEEIRTTNPVATEQYGCSVSTPNLQRGNR

SEQ ID NO: 728 - protein, 30 aa, Artificial Sequence
  Description of Artificial Sequence: Synthetic polypeptide
DEEEIRTTNPVATEQYGSVSHTNLQRGNYR

SEQ ID NO: 729 - protein, 30 aa, Artificial Sequence
  Description of Artificial Sequence: Synthetic polypeptide
DEEEIRTTNPVATEQYGCSVSTNPLQRGNR

SEQ ID NO: 730 - protein, 29 aa, Artificial Sequence
  Description of Artificial Sequence: Synthetic peptide
DEETIRTTNPVATEQYGSVSTNLQRQGNR

SEQ ID NO: 731 - protein, 30 aa, Artificial Sequence
  Description of Artificial Sequence: Synthetic polypeptide
DEEEIRTTNPVATEQYGSVSHTNLQRGNCR

SEQ ID NO: 732 - protein, 30 aa, Artificial Sequence
  Description of Artificial Sequence: Synthetic polypeptide
DEEEIRTTNPVATEQYGCSVSTNCLQRGNR

SEQ ID NO: 733 - protein, 30 aa, Artificial Sequence
  Description of Artificial Sequence: Synthetic polypeptide
DEEEIRTTNPVATEQYGSVSHTNLQRGNAR

SEQ ID NO: 734 - protein, 28 aa, Artificial Sequence
  Description of Artificial Sequence: Synthetic peptide
DEEEIRTTNPVATEQYGSVSHNLQRGNM

SEQ ID NO: 735 - protein, 30 aa, Artificial Sequence
  Description of Artificial Sequence: Synthetic polypeptide
DEEEIRTTNPVATEQYGSVDSTNLQRGNRI

SEQ ID NO: 736 - protein, 30 aa, Artificial Sequence
  Description of Artificial Sequence: Synthetic polypeptide
DEEEIRTTNPVATEQYGSVDSTNLQRGNRL

SEQ ID NO: 737 - protein, 30 aa, Artificial Sequence
  Description of Artificial Sequence: Synthetic polypeptide
DEEEIRTTNPVATEQYGSVDSTNLQRGNWR

SEQ ID NO: 738 - protein, 30 aa, Artificial Sequence
  Description of Artificial Sequence: Synthetic polypeptide
DEEEIRTTNPVATEQYGSVDSTNLRQRGNR

SEQ ID NO: 739 - protein, 29 aa, Artificial Sequence
  Description of Artificial Sequence: Synthetic peptide
DEEEIRTTNPVATEQYGSVDSTNSQRGNR

SEQ ID NO: 740 - protein, 29 aa, Artificial Sequence
  Description of Artificial Sequence: Synthetic peptide
DEAEIRTTNPVATEQYGSVESTNLQRGNR

SEQ ID NO: 741 - protein, 28 aa, Artificial Sequence
  Description of Artificial Sequence: Synthetic peptide
DEEEIRTTNPVATEQYGSVSVSLQRGNR

SEQ ID NO: 742 - protein, 28 aa, Artificial Sequence
  Description of Artificial Sequence: Synthetic peptide
DEETIRPTNPVATEQYGSVSTNLQRGNR

SEQ ID NO: 743 - protein, 28 aa, Artificial Sequence
  Description of Artificial Sequence: Synthetic peptide
DEEEIRTTNPVATEQYGSVSTNLNDGNR

SEQ ID NO: 744 - protein, 28 aa, Artificial Sequence
  Description of Artificial Sequence: Synthetic peptide
DEEEIRTTNPVATEQYGSVSTNLNAGNR

SEQ ID NO: 745 - protein, 30 aa, Artificial Sequence
  Description of Artificial Sequence: Synthetic polypeptide
DEEEIRTTNPVATEQYGSVDSYTNLQRGNR

SEQ ID NO: 746 - protein, 29 aa, Artificial Sequence
  Description of Artificial Sequence: Synthetic peptide
DEEEIRTTNPVATEQYGSVSTNLMRQGNR

SEQ ID NO: 747 - protein, 29 aa, Artificial Sequence
  Description of Artificial Sequence: Synthetic peptide
DEEEIRTTNPVATEQYGSVDTNDLQRGNR

SEQ ID NO: 748 - protein, 28 aa, Artificial Sequence
  Description of Artificial Sequence: Synthetic peptide
AEEEIRTTNPVAGEQYGSVSTNLQRGNR

SEQ ID NO: 749 - protein, 29 aa, Artificial Sequence
  Description of Artificial Sequence: Synthetic peptide
DEEEIRTTNPVATEQYGSVDTNLLQRGNR

SEQ ID NO: 750 - protein, 28 aa, Artificial Sequence
  Description of Artificial Sequence: Synthetic peptide
AEEEIRTTNPFATEQYGSVSTNLQRGNR

SEQ ID NO: 751 - protein, 29 aa, Artificial Sequence
  Description of Artificial Sequence: Synthetic peptide
DEEEIRTTNPVATEQYGSVDTNLNQRGNR

SEQ ID NO: 752 - protein, 28 aa, Artificial Sequence
  Description of Artificial Sequence: Synthetic peptide
DEETIGTTNPVATEQYGSVSTNLQRGNR

SEQ ID NO: 753 - protein, 30 aa, Artificial Sequence
  Description of Artificial Sequence: Synthetic polypeptide
DEEEIRTTNPVATEQYGSVDSTNLPQRGNR

SEQ ID NO: 754 - protein, 30 aa, Artificial Sequence
  Description of Artificial Sequence: Synthetic polypeptide
DEEEIRTTNPVATEQYGSVSMTSNLQRGNR

SEQ ID NO: 755 - protein, 28 aa, Artificial Sequence
  Description of Artificial Sequence: Synthetic peptide
DEEEIRTTNPVATEQYGCVSTNLARGNR

SEQ ID NO: 756 - protein, 29 aa, Artificial Sequence
  Description of Artificial Sequence: Synthetic peptide
DEEEIRTTNPVATEQYGSVDSTNLFRGNR

SEQ ID NO: 757 - protein, 30 aa, Artificial Sequence
  Description of Artificial Sequence: Synthetic polypeptide
DEEEIRTTNPVATEQYGCSVSGTNLQRGNR

SEQ ID NO: 758 - protein, 30 aa, Artificial Sequence
  Description of Artificial Sequence: Synthetic polypeptide
DEEEIRTTNPVATEQYGCSVSETNLQRGNR

SEQ ID NO: 759 - protein, 30 aa, Artificial Sequence
  Description of Artificial Sequence: Synthetic polypeptide
DEEEIRTTNPVATEQYGSVSTNLNQGRGNR

SEQ ID NO: 760 - protein, 30 aa, Artificial Sequence
  Description of Artificial Sequence: Synthetic polypeptide
DEEEIRTTNPVATEQYGCSVLSTNLQRGNR

SEQ ID NO: 761 - protein, 28 aa, Artificial Sequence
  Description of Artificial Sequence: Synthetic peptide
DEETIRTTNPVATEQYGSVSTELQRGNR

SEQ ID NO: 762 - protein, 29 aa, Artificial Sequence
  Description of Artificial Sequence: Synthetic peptide
DDEEIRTTNPVATMEQYGSVSTNLQRGNR

SEQ ID NO: 763 - protein, 29 aa, Artificial Sequence
  Description of Artificial Sequence: Synthetic peptide
DEEEIRTTNPVATEQYGSVSHTNLQPGNR

SEQ ID NO: 764 - protein, 28 aa, Artificial Sequence
  Description of Artificial Sequence: Synthetic peptide
DDEEIRTTNPVAWEQYGSVSTNLQRGNR

SEQ ID NO: 765 - protein, 29 aa, Artificial Sequence
  Description of Artificial Sequence: Synthetic peptide
DEEEIRTTNPVATEQYGSVSATNCQRGNR

SEQ ID NO: 766 - protein, 28 aa, Artificial Sequence
  Description of Artificial Sequence: Synthetic peptide
DEEEIRGTNPVATEQYGSVSTNLERGNR

SEQ ID NO: 767 - protein, 30 aa, Artificial Sequence
  Description of Artificial Sequence: Synthetic polypeptide
DEEEIRTTNPVATEQYGSVSMTNLQRGNFR

SEQ ID NO: 768 - protein, 30 aa, Artificial Sequence
  Description of Artificial Sequence: Synthetic polypeptide
DEEEIRTTNPVATEQYGSVSMTNLQRGTNR

SEQ ID NO: 769 - protein, 29 aa, Artificial Sequence
  Description of Artificial Sequence: Synthetic peptide
DEEEIRTTNPVATEQYGSVSHTELQRGNR

SEQ ID NO: 770 - protein, 29 aa, Artificial Sequence
  Description of Artificial Sequence: Synthetic peptide
DEEEIRTTNPVATEQYGSVSHTDLQRGNR

SEQ ID NO: 771 - protein, 30 aa, Artificial Sequence
  Description of Artificial Sequence: Synthetic polypeptide
DEEEIRTTNPVATEQYGSVDSTGNLQRGNR

SEQ ID NO: 772 - protein, 30 aa, Artificial Sequence
  Description of Artificial Sequence: Synthetic polypeptide
DEEEIRTTNPVATEQYGSVDSTHNLQRGNR

SEQ ID NO: 773 - protein, 29 aa, Artificial Sequence
  Description of Artificial Sequence: Synthetic peptide
DEEEIRTTNPVATEQYGSVDSTILQRGNR

SEQ ID NO: 774 - protein, 29 aa, Artificial Sequence
  Description of Artificial Sequence: Synthetic peptide
DEEEIRTTNPVATEQYGSVSHNLQRGNRI

SEQ ID NO: 775 - protein, 29 aa, Artificial Sequence
  Description of Artificial Sequence: Synthetic peptide
DEEEIRTTNPVATEQYGSVSHNLQRGNRE

SEQ ID NO: 776 - protein, 29 aa, Artificial Sequence
  Description of Artificial Sequence: Synthetic peptide
DEEEIRTTNPVATEQYGSVDSTNEQRGNR

SEQ ID NO: 777 - protein, 29 aa, Artificial Sequence
  Description of Artificial Sequence: Synthetic peptide
DEEEIRTTNPVATEQYGSVSMTNLQRGNW

SEQ ID NO: 778 - protein, 28 aa, Artificial Sequence
  Description of Artificial Sequence: Synthetic peptide
DEEEIRTTNPDATEQYGSVSTNLQRGNL

SEQ ID NO: 779 - protein, 29 aa, Artificial Sequence
  Description of Artificial Sequence: Synthetic peptide
DEEEIRTTNPVATEQYGSVSATNLQRGNT

SEQ ID NO: 780 - protein, 30 aa, Artificial Sequence
  Description of Artificial Sequence: Synthetic polypeptide
DEEEIRTTNPVATEQYGSVSATNLQRGTNR

SEQ ID NO: 781 - protein, 29 aa, Artificial Sequence
  Description of Artificial Sequence: Synthetic peptide
DEEEIRTTNPVATEQYGSVSTNLPQRGNI

SEQ ID NO: 782 - protein, 28 aa, Artificial Sequence
  Description of Artificial Sequence: Synthetic peptide
DEEEIRTTNPVATEQYGSVSQNLQFGNR

SEQ ID NO: 783 - protein, 28 aa, Artificial Sequence
  Description of Artificial Sequence: Synthetic peptide
DEEVIRTTNPVATEQYGSVSTNDQRGNR

SEQ ID NO: 784 - protein, 29 aa, Artificial Sequence
  Description of Artificial Sequence: Synthetic peptide
DEEEIRTTNPVATEQYGSVSQNLQCRGNR

SEQ ID NO: 785 - protein, 28 aa, Artificial Sequence
  Description of Artificial Sequence: Synthetic peptide
DEEEIRTTNPVATEQYGSVSQNAQRGNR

SEQ ID NO: 786 - protein, 29 aa, Artificial Sequence
  Description of Artificial Sequence: Synthetic peptide
DEEEIRTTNPVATEQYGSVSTNLPQLGNR

SEQ ID NO: 787 - protein, 29 aa, Artificial Sequence
  Description of Artificial Sequence: Synthetic peptide
DEEEIRTTNPVATEQYGSVCTNLVQRGNR

SEQ ID NO: 788 - protein, 29 aa, Artificial Sequence
  Description of Artificial Sequence: Synthetic peptide
DDEEIRTTNPVATEQYGSVSLTNLQRGNR

SEQ ID NO: 789 - protein, 29 aa, Artificial Sequence
  Description of Artificial Sequence: Synthetic peptide
DEEVIRTTNPVATEQYGSVSPTNLQRGNR

SEQ ID NO: 790 - protein, 29 aa, Artificial Sequence
  Description of Artificial Sequence: Synthetic peptide
DEAEIRTTNPVATEQYGSVNSTNLQRGNR

SEQ ID NO: 791 - protein, 28 aa, Artificial Sequence
  Description of Artificial Sequence: Synthetic peptide
DEEEIRTTNPVATEQYGSVSQMLQRGNR

SEQ ID NO: 792 - protein, 29 aa, Artificial Sequence
  Description of Artificial Sequence: Synthetic peptide
DEEVIRTTNPVATEQYGSLVSTNLQRGNR

SEQ ID NO: 793 - protein, 29 aa, Artificial Sequence
  Description of Artificial Sequence: Synthetic peptide
DEEEIRTTNPVATEQYGSVSTNLPQKGNR

SEQ ID NO: 794 - protein, 28 aa, Artificial Sequence
  Description of Artificial Sequence: Synthetic peptide
DEEEIRTTNPVATEQYGCVSTLLQRGNR

SEQ ID NO: 795 - protein, 29 aa, Artificial Sequence
  Description of Artificial Sequence: Synthetic peptide
DEEEIRTTNPVATEQYGSVSQINLQRGNR

SEQ ID NO: 796 - protein, 29 aa, Artificial Sequence
  Description of Artificial Sequence: Synthetic peptide
DEEEIRTTNPVATEQYGSVSGNLQRGNNR

SEQ ID NO: 797 - protein, 28 aa, Artificial Sequence
  Description of Artificial Sequence: Synthetic peptide
DEEEIRTTNPVATEQYGSVSAVLQRGNR

SEQ ID NO: 798 - protein, 29 aa, Artificial Sequence
  Description of Artificial Sequence: Synthetic peptide
DEEEIRTTNPVATEQYGSVSIENLQRGNR

SEQ ID NO: 799 - protein, 29 aa, Artificial Sequence
  Description of Artificial Sequence: Synthetic peptide
DEEEIRTTNPVATEQYGSVSTNLPLRGNR

SEQ ID NO: 800 - protein, 29 aa, Artificial Sequence
  Description of Artificial Sequence: Synthetic peptide
DEEEIRTTNPVATEQYGSVSQNLQQRGNR

SEQ ID NO: 801 - protein, 28 aa, Artificial Sequence
  Description of Artificial Sequence: Synthetic peptide
DEEEIRGTNPVATEQYGSVGTNLQRGNR

SEQ ID NO: 802 - protein, 30 aa, Artificial Sequence
  Description of Artificial Sequence: Synthetic polypeptide
DEEEIRTTNPVATEQYGSVSTNLPQRGNMR

SEQ ID NO: 803 - protein, 28 aa, Artificial Sequence
  Description of Artificial Sequence: Synthetic peptide
DEEEIRTTNPVATEQYGSVSQNLQRGNE

SEQ ID NO: 804 - protein, 29 aa, Artificial Sequence
  Description of Artificial Sequence: Synthetic peptide
DEEEIRTTNPVATEQYGSVSQQNLQRGNR

SEQ ID NO: 805 - protein, 29 aa, Artificial Sequence
  Description of Artificial Sequence: Synthetic peptide
DEEEIRTTNPVATEQYGSVCTNLQVRGNR

SEQ ID NO: 806 - protein, 28 aa, Artificial Sequence
  Description of Artificial Sequence: Synthetic peptide
DEEVIRTTNPVATEQYGSVSTNLQRGDR

SEQ ID NO: 807 - protein, 28 aa, Artificial Sequence
  Description of Artificial Sequence: Synthetic peptide
DEEVIRTTNPVATEQYGSVSTNLQMGNR

SEQ ID NO: 808 - protein, 29 aa, Artificial Sequence
  Description of Artificial Sequence: Synthetic peptide
DEEEIRTTNPVATEQYGSVSTNLPRSGNR

SEQ ID NO: 809 - protein, 29 aa, Artificial Sequence
  Description of Artificial Sequence: Synthetic peptide
DEEEIRTTNPVATEQYGSVSTNLPRIGNR

SEQ ID NO: 810 - protein, 28 aa, Artificial Sequence
  Description of Artificial Sequence: Synthetic peptide
DEEEIRTTNPVATEQYGSVSTNLPRGNQ

SEQ ID NO: 811 - protein, 28 aa, Artificial Sequence
  Description of Artificial Sequence: Synthetic peptide
SEEEIATTNPVATEQYGSVSTNLQRGNR

SEQ ID NO: 812 - protein, 29 aa, Artificial Sequence
  Description of Artificial Sequence: Synthetic peptide
DEEEIRTTNPVATEQYGSVSTNLPRGLNR

SEQ ID NO: 813 - protein, 29 aa, Artificial Sequence
  Description of Artificial Sequence: Synthetic peptide
DEEEIRTTNPVATEQYGSVSTNLPRGGNR

SEQ ID NO: 814 - protein, 29 aa, Artificial Sequence
  Description of Artificial Sequence: Synthetic peptide
DEEEIRTTNPVATEQYGSVSTNLPRFGNR

SEQ ID NO: 815 - protein, 28 aa, Artificial Sequence
  Description of Artificial Sequence: Synthetic peptide
DEEEIRTTNPVATEQYGSVSVFLQRGNR

SEQ ID NO: 816 - protein, 29 aa, Artificial Sequence
  Description of Artificial Sequence: Synthetic peptide
DEEEIRTTNPVATEQYGSVSTNLPQRNNR

SEQ ID NO: 817 - protein, 28 aa, Artificial Sequence
  Description of Artificial Sequence: Synthetic peptide
DEEEIRTTNPVATEQYGSVSQNLQRMNR

SEQ ID NO: 818 - protein, 29 aa, Artificial Sequence
  Description of Artificial Sequence: Synthetic peptide
DEEEIRTTNPVATEQYGSVCTNLSQRGNR

SEQ ID NO: 819 - protein, 28 aa, Artificial Sequence
  Description of Artificial Sequence: Synthetic peptide
TEEEIGTTNPVATEQYGSVSTNLQRGNR

SEQ ID NO: 820 - protein, 29 aa, Artificial Sequence
  Description of Artificial Sequence: Synthetic peptide
DEEEIRTTNPVATEQYGSVSQNLQRGNSR

SEQ ID NO: 821 - protein, 30 aa, Artificial Sequence
  Description of Artificial Sequence: Synthetic polypeptide
DEEEIRTTNPVATEQYGSVSTNLPQRGNYR

SEQ ID NO: 822 - protein, 29 aa, Artificial Sequence
  Description of Artificial Sequence: Synthetic peptide
DEEEIRTTNPVATEQYGSVSQNLQRGNRV

SEQ ID NO: 823 - protein, 30 aa, Artificial Sequence
  Description of Artificial Sequence: Synthetic polypeptide
DEEEIRTTNPVATEQYGSVSTNLPQRGNQR

SEQ ID NO: 824 - protein, 29 aa, Artificial Sequence
  Description of Artificial Sequence: Synthetic peptide
DEEEIRTTNPVATEQYGSVSTNLPIRGNR

SEQ ID NO: 825 - protein, 29 aa, Artificial Sequence
  Description of Artificial Sequence: Synthetic peptide
DDEEIRTTNPVATEQYGSVSTLNLQRGNR

SEQ ID NO: 826 - protein, 28 aa, Artificial Sequence
  Description of Artificial Sequence: Synthetic peptide
DEEEIRTTNPVATEQYGSVSQDLQRGNR

SEQ ID NO: 827 - protein, 28 aa, Artificial Sequence
  Description of Artificial Sequence: Synthetic peptide
DEEEIRTTNPVATEQYGSVSTNLNRGNA

SEQ ID NO: 828 - protein, 29 aa, Artificial Sequence
  Description of Artificial Sequence: Synthetic peptide
DEEEIRTTNPVATEQYGSVSVNLQRGNER

SEQ ID NO: 829 - protein, 30 aa, Artificial Sequence
  Description of Artificial Sequence: Synthetic polypeptide
DEEEIRTTNPVATEQYGSVSTNLNQRVGNR

SEQ ID NO: 830 - protein, 29 aa, Artificial Sequence
  Description of Artificial Sequence: Synthetic peptide
DEEEIRTTNPVATEQYGSVSVNLQRGNRS

SEQ ID NO: 831 - protein, 30 aa, Artificial Sequence
  Description of Artificial Sequence: Synthetic polypeptide
DEEEIRTTNPVATEQYGSVSTNLNQRGNVR

SEQ ID NO: 832 - protein, 29 aa, Artificial Sequence
  Description of Artificial Sequence: Synthetic peptide
DEEEIRTTNPVATEQYGSVSTNLNQRGND

SEQ ID NO: 833 - protein, 28 aa, Artificial Sequence
  Description of Artificial Sequence: Synthetic peptide
DEEEIRTTNPVATEQYGCVSTNEQRGNR

SEQ ID NO: 834 - protein, 30 aa, Artificial Sequence
  Description of Artificial Sequence: Synthetic polypeptide
DEEEIRTTNPVATEQYGSVSTNLNQRGLNR

SEQ ID NO: 835 - protein, 28 aa, Artificial Sequence
  Description of Artificial Sequence: Synthetic peptide
DEEEIRTTNPVATEQYGSVSVNLQRLNR

SEQ ID NO: 836 - protein, 30 aa, Artificial Sequence
  Description of Artificial Sequence: Synthetic polypeptide
DEEEIRTTNPVATEQYGSVSTNLNQRGINR

SEQ ID NO: 837 - protein, 29 aa, Artificial Sequence
  Description of Artificial Sequence: Synthetic peptide
DEEEIRTTNPVATEQYGSVCWTNLQRGNR

SEQ ID NO: 838 - protein, 29 aa, Artificial Sequence
  Description of Artificial Sequence: Synthetic peptide
DEEEIRTTNPVATEQYGSVSTNLNQRENR

SEQ ID NO: 839 - protein, 29 aa, Artificial Sequence
  Description of Artificial Sequence: Synthetic peptide
DEEEIRTTNPVATEQYGSVSVNLQRVGNR

SEQ ID NO: 840 - protein, 28 aa, Artificial Sequence
  Description of Artificial Sequence: Synthetic peptide
DEEEIRTTNPVATEQYGSVDCNLQRGNR

SEQ ID NO: 841 - protein, 28 aa, Artificial Sequence
  Description of Artificial Sequence: Synthetic peptide
DEEEIRTTNPVATEQYGSVSVNLQSGNR

SEQ ID NO: 842 - protein, 30 aa, Artificial Sequence
  Description of Artificial Sequence: Synthetic polypeptide
DEEEIRTTNPVATEQYGSVSTNLNQQRGNR

SEQ ID NO: 843 - protein, 30 aa, Artificial Sequence
  Description of Artificial Sequence: Synthetic polypeptide
DEEEIRTTNPVATEQYGSVSATNLQRSGNR

SEQ ID NO: 844 - protein, 29 aa, Artificial Sequence
  Description of Artificial Sequence: Synthetic peptide
DEEEIRTTNPVATEQYGSVSATNLQRINR

SEQ ID NO: 845 - protein, 29 aa, Artificial Sequence
  Description of Artificial Sequence: Synthetic peptide
DEEEIRGTNPVATEQYGSVSTDNLQRGNR

SEQ ID NO: 846 - protein, 29 aa, Artificial Sequence
  Description of Artificial Sequence: Synthetic peptide
DEEEIRTTNPVATEQYGSVSTNLNRGNRL

SEQ ID NO: 847 - protein, 29 aa, Artificial Sequence
  Description of Artificial Sequence: Synthetic peptide
DEEEIRTTNPVATEQYGSVSTNLNRGNRN

SEQ ID NO: 848 - protein, 29 aa, Artificial Sequence
  Description of Artificial Sequence: Synthetic peptide
DEEEIRTTNPVATEQYGSVSTNLNRGNRP

SEQ ID NO: 849 - protein, 28 aa, Artificial Sequence
  Description of Artificial Sequence: Synthetic peptide
DEEEIRTTNPVATEQYGSVSTNLNRGNW

SEQ ID NO: 850 - protein, 28 aa, Artificial Sequence
  Description of Artificial Sequence: Synthetic peptide
TEEEIRTTNPTATEQYGSVSTNLQRGNR

SEQ ID NO: 851 - protein, 28 aa, Artificial Sequence
  Description of Artificial Sequence: Synthetic peptide
DEEEIRTTNPVATEQYGQQSTNLQRGNR

SEQ ID NO: 852 - protein, 29 aa, Artificial Sequence
  Description of Artificial Sequence: Synthetic peptide
DEEEIRTTNPVATEQYGSVSTNLPARGNR

SEQ ID NO: 853 - protein, 29 aa, Artificial Sequence
  Description of Artificial Sequence: Synthetic peptide
DEEEIRGTNPVATEQYGSVSCTNLQRGNR

SEQ ID NO: 854 - protein, 28 aa, Artificial Sequence
  Description of Artificial Sequence: Synthetic peptide
DDEEIRTTNPVATEQYGSVSTNLGRGNR

SEQ ID NO: 855 - protein, 29 aa, Artificial Sequence
  Description of Artificial Sequence: Synthetic peptide
DDEEIRTTNPVATEQYGSVSTNLIQRGNR

SEQ ID NO: 856 - protein, 28 aa, Artificial Sequence
  Description of Artificial Sequence: Synthetic peptide
DDEEIRTTNPVATEQYGSVSTNLQGGNR

SEQ ID NO: 857 - protein, 29 aa, Artificial Sequence
  Description of Artificial Sequence: Synthetic peptide
DDEEIRTTNPVATEQYGSVSTNLQLRGNR

SEQ ID NO: 858 - protein, 28 aa, Artificial Sequence
  Description of Artificial Sequence: Synthetic peptide
DDEEIRTTNPVATEQYGSVSTNLQRDNR

SEQ ID NO: 859 - protein, 29 aa, Artificial Sequence
  Description of Artificial Sequence: Synthetic peptide
DEEEIRTTNPVATEQYGSVSICNLQRGNR

SEQ ID NO: 860 - protein, 28 aa, Artificial Sequence
  Description of Artificial Sequence: Synthetic peptide
DDEEIRTTNPVATEQYGSVSTNLQRGLR

SEQ ID NO: 861 - protein, 29 aa, Artificial Sequence
  Description of Artificial Sequence: Synthetic peptide
DDEEIRTTNPVATEQYGSVSTNLQRGNRT

SEQ ID NO: 862 - protein, 28 aa, Artificial Sequence
  Description of Artificial Sequence: Synthetic peptide
DDEEIRTTNPVATEQYGSVSTNLQRGSR

SEQ ID NO: 863 - protein, 29 aa, Artificial Sequence
  Description of Artificial Sequence: Synthetic peptide
DDEEIRTTNPVATEQYGSVSTNVLQRGNR

SEQ ID NO: 864 - protein, 28 aa, Artificial Sequence
  Description of Artificial Sequence: Synthetic peptide
DEEEIRTTNPVATEQYGSVSTNLNRSNR

SEQ ID NO: 865 - protein, 29 aa, Artificial Sequence
  Description of Artificial Sequence: Synthetic peptide
DEEEIRTTNPVATEQYGSVSMTNAQRGNR

SEQ ID NO: 866 - protein, 29 aa, Artificial Sequence
  Description of Artificial Sequence: Synthetic peptide
DEEEIRTTNPVATEQYGSVSVNLLQRGNR

SEQ ID NO: 867 - protein, 28 aa, Artificial Sequence
  Description of Artificial Sequence: Synthetic peptide
DEEEIRTTNPVATEQYGSVSVNLMRGNR

SEQ ID NO: 868 - protein, 30 aa, Artificial Sequence
  Description of Artificial Sequence: Synthetic polypeptide
DEEEIRTTNPVATEQYGSVSATNSLQRGNR

SEQ ID NO: 869 - protein, 29 aa, Artificial Sequence
  Description of Artificial Sequence: Synthetic peptide
DEEEIRTTNPVATEQYGSVSATNQQRGNR

SEQ ID NO: 870 - protein, 28 aa, Artificial Sequence
  Description of Artificial Sequence: Synthetic peptide
DDEEIRTTNPVATEQYGSVSTNLQRGNH

SEQ ID NO: 871 - protein, 28 aa, Artificial Sequence
  Description of Artificial Sequence: Synthetic peptide
DEEEIRTTNPVATEQYGSVSSNDQRGNR

SEQ ID NO: 872 - protein, 29 aa, Artificial Sequence
  Description of Artificial Sequence: Synthetic peptide
DEEEIRTTNPVATEQYGQVVSTNLQRGNR

SEQ ID NO: 873 - protein, 28 aa, Artificial Sequence
  Description of Artificial Sequence: Synthetic peptide
DEEEIRTTNPDATEQYGSVSTNLQRGNS

SEQ ID NO: 874 - protein, 29 aa, Artificial Sequence
  Description of Artificial Sequence: Synthetic peptide
DEEEIATTNPVATEQYGSVSTNLQFRGNR

SEQ ID NO: 875 - protein, 28 aa, Artificial Sequence
  Description of Artificial Sequence: Synthetic peptide
DCEEIRTTNPVATEQYGSVSTNLQLGNR

SEQ ID NO: 876 - protein, 29 aa, Artificial Sequence
  Description of Artificial Sequence: Synthetic peptide
DCEEIRTTNPVATEQYGSVSTNLQNRGNR

SEQ ID NO: 877 - protein, 29 aa, Artificial Sequence
  Description of Artificial Sequence: Synthetic peptide
DCEEIRTTNPVATEQYGSVSTNLQRGNER

SEQ ID NO: 878 - protein, 29 aa, Artificial Sequence
  Description of Artificial Sequence: Synthetic peptide
DCEEIRTTNPVATEQYGSVSTNLQRGVNR

SEQ ID NO: 879 - protein, 29 aa, Artificial Sequence
  Description of Artificial Sequence: Synthetic peptide
DCEEIRTTNPVATEQYGSVSTNLQRMGNR

SEQ ID NO: 880 - protein, 29 aa, Artificial Sequence
  Description of Artificial Sequence: Synthetic peptide
DCEEIRTTNPVATEQYGSVSTNLTQRGNR

SEQ ID NO: 881 - protein, 28 aa, Artificial Sequence
  Description of Artificial Sequence: Synthetic peptide
FEEEIRTTNPVITEQYGSVSTNLQRGNR

SEQ ID NO: 882 - protein, 28 aa, Artificial Sequence
  Description of Artificial Sequence: Synthetic peptide
FEEEIRTVNPVATEQYGSVSTNLQRGNR

SEQ ID NO: 883 - protein, 29 aa, Artificial Sequence
  Description of Artificial Sequence: Synthetic peptide
DEEEIRTTNPVATEQYGSVSTNLQGWGNR

SEQ ID NO: 884 - protein, 28 aa, Artificial Sequence
  Description of Artificial Sequence: Synthetic peptide
DEDEIRTTNPVATEQYGSVSTNLIRGNR

SEQ ID NO: 885 - protein, 28 aa, Artificial Sequence
  Description of Artificial Sequence: Synthetic peptide
DEHEIRTTNPVATEQYGSVSTSLQRGNR

SEQ ID NO: 886 - protein, 30 aa, Artificial Sequence
  Description of Artificial Sequence: Synthetic polypeptide
DEEEIRTTNPVATEQYGSVSTNLQGRGNVR

SEQ ID NO: 887 - protein, 28 aa, Artificial Sequence
  Description of Artificial Sequence: Synthetic peptide
DEHEIRTTNPVATEQYGSVSTNTQRGNR

SEQ ID NO: 888 - protein, 28 aa, Artificial Sequence
  Description of Artificial Sequence: Synthetic peptide
DCEELRTTNPVATEQYGSVSTNLQRGNR

SEQ ID NO: 889 - protein, 29 aa, Artificial Sequence
  Description of Artificial Sequence: Synthetic peptide
DEEEIRTTNPVATEQYGSVSTNLQGRGNC

SEQ ID NO: 890 - protein, 30 aa, Artificial Sequence
  Description of Artificial Sequence: Synthetic polypeptide
DEEEIRTTNPVATEQYGSVSTNLQGRAGNR

SEQ ID NO: 891 - protein, 29 aa, Artificial Sequence
  Description of Artificial Sequence: Synthetic peptide
DEEEIRTTNPVATEQYGSVSTHLQRAGNR

SEQ ID NO: 892 - protein, 29 aa, Artificial Sequence
  Description of Artificial Sequence: Synthetic peptide
DEDEIRTTNPVATEQYGSVSTNLNQRGNR

SEQ ID NO: 893 - protein, 29 aa, Artificial Sequence
  Description of Artificial Sequence: Synthetic peptide
DEEEIRTTNPVATEQYGSVSTNLQHCGNR

SEQ ID NO: 894 - protein, 28 aa, Artificial Sequence
  Description of Artificial Sequence: Synthetic peptide
DEEEIRTTNPVATEQYGSVSTHLQRQNR

SEQ ID NO: 895 - protein, 29 aa, Artificial Sequence
  Description of Artificial Sequence: Synthetic peptide
DCEEIRTTNPVATEQYGSVESTNLQRGNR

SEQ ID NO: 896 - protein, 29 aa, Artificial Sequence
  Description of Artificial Sequence: Synthetic peptide
DCEEIRTTNPVATEQYGNSVSTNLQRGNR

SEQ ID NO: 897 - protein, 28 aa, Artificial Sequence
  Description of Artificial Sequence: Synthetic peptide
DEEEIATTNPVATEQYGSVSTNLQRENR

SEQ ID NO: 898 - protein, 28 aa, Artificial Sequence
  Description of Artificial Sequence: Synthetic peptide
DEEEIRTTNPEATEQYGSVSFNLQRGNR

SEQ ID NO: 899 - protein, 28 aa, Artificial Sequence
  Description of Artificial Sequence: Synthetic peptide
DEEEIRTTNPVATEQYGSVSTNLQIFNR

SEQ ID NO: 900 - protein, 29 aa, Artificial Sequence
  Description of Artificial Sequence: Synthetic peptide
DEEEIATTNPVATEQYGSVSTNLQRDGNR

SEQ ID NO: 901 - protein, 29 aa, Artificial Sequence
  Description of Artificial Sequence: Synthetic peptide
DEEEIRTTNPVATEQYGSVSTGNLVRGNR

SEQ ID NO: 902 - protein, 28 aa, Artificial Sequence
  Description of Artificial Sequence: Synthetic peptide
DEEEIRTTNPVATEQYGSVSTVLQRGFR

SEQ ID NO: 903 - protein, 29 aa, Artificial Sequence
  Description of Artificial Sequence: Synthetic peptide
DEEEIRTTNPVATEQYGSVSTVLQRNGNR

SEQ ID NO: 904 - protein, 28 aa, Artificial Sequence
  Description of Artificial Sequence: Synthetic peptide
FEEEIRTTNPVATEQYGSVSTVLQRGNR

SEQ ID NO: 905 - protein, 28 aa, Artificial Sequence
  Description of Artificial Sequence: Synthetic peptide
DEEEIRCTNPVATEQYGSVATNLQRGNR

SEQ ID NO: 906 - protein, 30 aa, Artificial Sequence
  Description of Artificial Sequence: Synthetic polypeptide
DEEEIRTTNPVATEQYGSVSTVNALQRGNR

SEQ ID NO: 907 - protein, 28 aa, Artificial Sequence
  Description of Artificial Sequence: Synthetic peptide
DEEEIRTTNPVATEQYGSVSTNLQHGYR

SEQ ID NO: 908 - protein, 29 aa, Artificial Sequence
  Description of Artificial Sequence: Synthetic peptide
DEEEIRTTNPVATEQYGSVSTNLQHGSNR

SEQ ID NO: 909 - protein, 28 aa, Artificial Sequence
  Description of Artificial Sequence: Synthetic peptide
DEEEIRTTNPVATEQYGSVSTNLQHGPR

SEQ ID NO: 910 - protein, 28 aa, Artificial Sequence
  Description of Artificial Sequence: Synthetic peptide
FEEEIRTTNPVATEQYGTVSTNLQRGNR

SEQ ID NO: 911 - protein, 28 aa, Artificial Sequence
  Description of Artificial Sequence: Synthetic peptide
AEEEIRTTNPVATEQYGSVSFNLQRGNR

SEQ ID NO: 912 - protein, 29 aa, Artificial Sequence
  Description of Artificial Sequence: Synthetic peptide
DEEEIRTTNPVATEQYGSVSTVNLDRGNR

SEQ ID NO: 913 - protein, 28 aa, Artificial Sequence
  Description of Artificial Sequence: Synthetic peptide
DCEEIRTTNPEATEQYGSVSTNLQRGNR

SEQ ID NO: 914 - protein, 29 aa, Artificial Sequence
  Description of Artificial Sequence: Synthetic peptide
DEEEIRTTNPVATEQYGSVSTNLQHEGNR

SEQ ID NO: 915 - protein, 29 aa, Artificial Sequence
  Description of Artificial Sequence: Synthetic peptide
DEEEIRTTNPVATEQYGSVSTVNLPRGNR

SEQ ID NO: 916 - protein, 29 aa, Artificial Sequence
  Description of Artificial Sequence: Synthetic peptide
DEEEIRTTNPVATEQYGSVSTVNLQFGNR

SEQ ID NO: 917 - protein, 29 aa, Artificial Sequence
  Description of Artificial Sequence: Synthetic peptide
DEEEIATTNPVATEQYGSVSTNLQRGANR

SEQ ID NO: 918 - protein, 28 aa, Artificial Sequence
  Description of Artificial Sequence: Synthetic peptide
DEHEIRTTNPVATEQYGSVSTNLQRGNL

SEQ ID NO: 919 - protein, 29 aa, Artificial Sequence
  Description of Artificial Sequence: Synthetic peptide
DEEEIRTTNPVATEQYGSVSTHNDQRGNR

SEQ ID NO: 920 - protein, 28 aa, Artificial Sequence
  Description of Artificial Sequence: Synthetic peptide
DEEEIRTTNPVATEQYGSVSTNLQGGNQ

SEQ ID NO: 921 - protein, 28 aa, Artificial Sequence
  Description of Artificial Sequence: Synthetic peptide
GEEEIRTTNPVATEQYGHVSTNLQRGNR

SEQ ID NO: 922 - protein, 28 aa, Artificial Sequence
  Description of Artificial Sequence: Synthetic peptide
GEEEIRTTNPVATEQYGSVSGNLQRGNR

SEQ ID NO: 923 - protein, 30 aa, Artificial Sequence
  Description of Artificial Sequence: Synthetic polypeptide
DEEEIRTTNPVATEQYGSVSTVNMLQRGNR

SEQ ID NO: 924 - protein, 29 aa, Artificial Sequence
  Description of Artificial Sequence: Synthetic peptide
DEAEIRTTNPVATEQYGSVSTTNLQRGNR

SEQ ID NO: 925 - protein, 29 aa, Artificial Sequence
  Description of Artificial Sequence: Synthetic peptide
DEHEIRTTNPVATEQYGSVSTDNLQRGNR

SEQ ID NO: 926 - protein, 28 aa, Artificial Sequence
  Description of Artificial Sequence: Synthetic peptide
GEEEIRTTNPVATEQYGSVSMNLQRGNR

SEQ ID NO: 927 - protein, 28 aa, Artificial Sequence
  Description of Artificial Sequence: Synthetic peptide
GEEEIRTTNPVATEQYGSVSTNDQRGNR

SEQ ID NO: 928 - protein, 28 aa, Artificial Sequence
  Description of Artificial Sequence: Synthetic peptide
GEEEIRTTNPVATEQYGSVSTNLQCGNR

SEQ ID NO: 929 - protein, 28 aa, Artificial Sequence
  Description of Artificial Sequence: Synthetic peptide
GEEEIRTTNPVATEQYGSVSTNLQRFNR

SEQ ID NO: 930 - protein, 29 aa, Artificial Sequence
  Description of Artificial Sequence: Synthetic peptide
GEEEIRTTNPVATEQYGSVSTNLQRGNGR

SEQ ID NO: 931 - protein, 29 aa, Artificial Sequence
  Description of Artificial Sequence: Synthetic peptide
GEEEIRTTNPVATEQYGSVSTNLQRGNRL

SEQ ID NO: 932 - protein, 29 aa, Artificial Sequence
  Description of Artificial Sequence: Synthetic peptide
GEEEIRTTNPVATEQYGSVSTNLQRGQNR

SEQ ID NO: 933 - protein, 29 aa, Artificial Sequence
  Description of Artificial Sequence: Synthetic peptide
GEEEIRTTNPVATEQYGSVSTNLQRMGNR

SEQ ID NO: 934 - protein, 29 aa, Artificial Sequence
  Description of Artificial Sequence: Synthetic peptide
DEEEIRTTNPVATEQYGSVSTINHQRGNR

SEQ ID NO: 935 - protein, 28 aa, Artificial Sequence
  Description of Artificial Sequence: Synthetic peptide
GEEEIRTTNPVAWEQYGSVSTNLQRGNR

SEQ ID NO: 936 - protein, 29 aa, Artificial Sequence
  Description of Artificial Sequence: Synthetic peptide
DEEEIRTTNPVATEQYGSVSTINIQRGNR

SEQ ID NO: 937 - protein, 30 aa, Artificial Sequence
  Description of Artificial Sequence: Synthetic polypeptide
DEEEIRTTNPVATEQYGSVSTINLFQRGNR

SEQ ID NO: 938 - protein, 29 aa, Artificial Sequence
  Description of Artificial Sequence: Synthetic peptide
AEEEIRTTNPVATEQYGSVGSTNLQRGNR

SEQ ID NO: 939 - protein, 28 aa, Artificial Sequence
  Description of Artificial Sequence: Synthetic peptide
GEEEIRTTNPMATEQYGSVSTNLQRGNR

SEQ ID NO: 940 - protein, 29 aa, Artificial Sequence
  Description of Artificial Sequence: Synthetic peptide
DEHEIRTTNPVATEQYGSVSTNLQRGINR

SEQ ID NO: 941 - protein, 28 aa, Artificial Sequence
  Description of Artificial Sequence: Synthetic peptide
DEEEIRTTNPEATEQYGSVFTNLQRGNR

SEQ ID NO: 942 - protein, 28 aa, Artificial Sequence
  Description of Artificial Sequence: Synthetic peptide
DEEEIRTTNPEATEQYGSVGTNLQRGNR

SEQ ID NO: 943 - protein, 29 aa, Artificial Sequence
  Description of Artificial Sequence: Synthetic peptide
DEEEIRTTNPVATEQYGSVSTHNLQEGNR

SEQ ID NO: 944 - protein, 30 aa, Artificial Sequence
  Description of Artificial Sequence: Synthetic polypeptide
DEEEIRTTNPVATEQYGSVSTHNLQERGNR

SEQ ID NO: 945 - protein, 30 aa, Artificial Sequence
  Description of Artificial Sequence: Synthetic polypeptide
DEEEIRTTNPVATEQYGSVSTHNLQRDGNR

SEQ ID NO: 946 - protein, 30 aa, Artificial Sequence
  Description of Artificial Sequence: Synthetic polypeptide
DEEEIRTTNPVATEQYGSVSTHNLQRGNRV

SEQ ID NO: 947 - protein, 29 aa, Artificial Sequence
  Description of Artificial Sequence: Synthetic peptide
DEEEIRTTNPVATEQYGSVSTHNLQRGNT

SEQ ID NO: 948 - protein, 30 aa, Artificial Sequence
  Description of Artificial Sequence: Synthetic polypeptide
DEEEIRTTNPVATEQYGSVSTHNLQRSGNR

SEQ ID NO: 949 - protein, 29 aa, Artificial Sequence
  Description of Artificial Sequence: Synthetic peptide
DEEEIRTTNPVATEQYGSVSTVNLQRGNE

SEQ ID NO: 950 - protein, 28 aa, Artificial Sequence
  Description of Artificial Sequence: Synthetic peptide
DEEEIRTTNPVATEQYGCVSSNLQRGNR

SEQ ID NO: 951 - protein, 30 aa, Artificial Sequence
  Description of Artificial Sequence: Synthetic polypeptide
DEEEIRTTNPVATEQYGSVSTVNLQRGNLR

SEQ ID NO: 952 - protein, 28 aa, Artificial Sequence
  Description of Artificial Sequence: Synthetic peptide
GEAEIRTTNPVATEQYGSVSTNLQRGNR

SEQ ID NO: 953 - protein, 29 aa, Artificial Sequence
  Description of Artificial Sequence: Synthetic peptide
DEEEIRTTNPVATEQYGSVSTICLQRGNR

SEQ ID NO: 954 - protein, 30 aa, Artificial Sequence
  Description of Artificial Sequence: Synthetic polypeptide
DEEEIRTTNPVATEQYGSVSTVNLQRGNNR

SEQ ID NO: 955 - protein, 28 aa, Artificial Sequence
  Description of Artificial Sequence: Synthetic peptide
DEEEIRTTNPVATEQYGSVSTIDQRGNR

SEQ ID NO: 956 - protein, 30 aa, Artificial Sequence
  Description of Artificial Sequence: Synthetic polypeptide
DEEEIRTTNPVATEQYGSVSTVNLQRGNRP

SEQ ID NO: 957 - protein, 28 aa, Artificial Sequence
  Description of Artificial Sequence: Synthetic peptide
AEEEIRTTNPVATEQYGSVPTNLQRGNR

SEQ ID NO: 958 - protein, 29 aa, Artificial Sequence
  Description of Artificial Sequence: Synthetic peptide
DEHEIRTTNPVATEQYGSVSTNLQARGNR

SEQ ID NO: 959 - protein, 29 aa, Artificial Sequence
  Description of Artificial Sequence: Synthetic peptide
DEAEIRTTNPVATEQYGSVSTVNLQRGNR

SEQ ID NO: 960 - protein, 29 aa, Artificial Sequence
  Description of Artificial Sequence: Synthetic peptide
DEEEIRTTNPVATEQYGSVSTILQDRGNR

SEQ ID NO: 961 - protein, 29 aa, Artificial Sequence
  Description of Artificial Sequence: Synthetic peptide
DEEEIRTTNPVATEQYGSVSTILQRGNMR

SEQ ID NO: 962 - protein, 29 aa, Artificial Sequence
  Description of Artificial Sequence: Synthetic peptide
DEEEIRTTNPVATEQYGSVSTILQRGNTR

SEQ ID NO: 963 - protein, 28 aa, Artificial Sequence
  Description of Artificial Sequence: Synthetic peptide
DEEEIRTTNPVATEQYGSVSTNLQIGNH

SEQ ID NO: 964 - protein, 28 aa, Artificial Sequence
  Description of Artificial Sequence: Synthetic peptide
DEEEIATTNPVATEQYGSVSTNLQRGMR

SEQ ID NO: 965 - protein, 29 aa, Artificial Sequence
  Description of Artificial Sequence: Synthetic peptide
DEEEIRTTNPVATEQYGSVSTGNLQVGNR

SEQ ID NO: 966 - protein, 28 aa, Artificial Sequence
  Description of Artificial Sequence: Synthetic peptide
DEHEMRTTNPVATEQYGSVSTNLQRGNR

SEQ ID NO: 967 - protein, 28 aa, Artificial Sequence
  Description of Artificial Sequence: Synthetic peptide
DEHEIYTTNPVATEQYGSVSTNLQRGNR

SEQ ID NO: 968 - protein, 28 aa, Artificial Sequence
  Description of Artificial Sequence: Synthetic peptide
DEEEIRTTNPVATEQYGSVSTNLQLGSR

SEQ ID NO: 969 - protein, 29 aa, Artificial Sequence
  Description of Artificial Sequence: Synthetic peptide
DEEEIRTTNPEATEQYGSVSTNLQRGNYR

SEQ ID NO: 970 - protein, 29 aa, Artificial Sequence
  Description of Artificial Sequence: Synthetic peptide
DEEEIRTTNPEATEQYGSVSTNLQRGNRM

SEQ ID NO: 971 - protein, 29 aa, Artificial Sequence
  Description of Artificial Sequence: Synthetic peptide
DEEEIRTTNPVATEQYGSVSTGNLQLGNR

SEQ ID NO: 972 - protein, 28 aa, Artificial Sequence
  Description of Artificial Sequence: Synthetic peptide
FEEEIRTTNPVATEQYGSVSTNLDRGNR

SEQ ID NO: 973 - protein, 29 aa, Artificial Sequence
  Description of Artificial Sequence: Synthetic peptide
DEEEIRTTNPVATEQYGSVSTNLQLGNRE

SEQ ID NO: 974 - protein, 30 aa, Artificial Sequence
  Description of Artificial Sequence: Synthetic polypeptide
DEEEIRTTNPVATEQYGSVSCTNLQYRGNR

SEQ ID NO: 975 - protein, 29 aa, Artificial Sequence
  Description of Artificial Sequence: Synthetic peptide
DEEEIRTTNPVATEQYGSVSCTNLQYGNR

SEQ ID NO: 976 - protein, 29 aa, Artificial Sequence
  Description of Artificial Sequence: Synthetic peptide
DEEEIRTTNPVATEQYGSVSCTNLQRGNY

SEQ ID NO: 977 - protein, 29 aa, Artificial Sequence
  Description of Artificial Sequence: Synthetic peptide
DEEEIRTTNPEATEQYGSVSTNLQRGMNR

SEQ ID NO: 978 - protein, 28 aa, Artificial Sequence
  Description of Artificial Sequence: Synthetic peptide
DEEEIRTTNPEATEQYGSVSTNLQRGAR

SEQ ID NO: 979 - protein, 28 aa, Artificial Sequence
  Description of Artificial Sequence: Synthetic peptide
DEEEIATTNPVATEQYGSVSTVLQRGNR

SEQ ID NO: 980 - protein, 29 aa, Artificial Sequence
  Description of Artificial Sequence: Synthetic peptide
DEEEIRTTNPVATEQYGSVSTGNLQNGNR

SEQ ID NO: 981 - protein, 30 aa, Artificial Sequence
  Description of Artificial Sequence: Synthetic polypeptide
DEEEIRTTNPVATEQYGSVSCTNLQRGNRL

SEQ ID NO: 982 - protein, 30 aa, Artificial Sequence
  Description of Artificial Sequence: Synthetic polypeptide
DEEEIRTTNPVATEQYGSVSCTNLQRGNRI

SEQ ID NO: 983 - protein, 28 aa, Artificial Sequence
  Description of Artificial Sequence: Synthetic peptide
DEEEIRTTNPEATEQYGSVSTNLQKGNR

SEQ ID NO: 984 - protein, 30 aa, Artificial Sequence
  Description of Artificial Sequence: Synthetic polypeptide
DEEEIRTTNPVATEQYGSVSCTNLQRGNFR

SEQ ID NO: 985 - protein, 29 aa, Artificial Sequence
  Description of Artificial Sequence: Synthetic peptide
DEEEIRTTNPVATEQYGSVSTNLQLGTNR

SEQ ID NO: 986 - protein, 30 aa, Artificial Sequence
  Description of Artificial Sequence: Synthetic polypeptide
DEEEIRTTNPVATEQYGSVSCTNLQRGNER

SEQ ID NO: 987 - protein, 29 aa, Artificial Sequence
  Description of Artificial Sequence: Synthetic peptide
DEEEIRTTNPEATEQYGSVSTNLQRLGNR

SEQ ID NO: 988 - protein, 28 aa, Artificial Sequence
  Description of Artificial Sequence: Synthetic peptide
DEIEIRTTNPIATEQYGSVSTNLQRGNR

SEQ ID NO: 989 - protein, 29 aa, Artificial Sequence
  Description of Artificial Sequence: Synthetic peptide
DELEIRTTNPVATEQYGSVSTNLQRGINR

SEQ ID NO: 990 - protein, 28 aa, Artificial Sequence
  Description of Artificial Sequence: Synthetic peptide
DELEIRTTNPVATEQYGSVSTNLQRGDR

SEQ ID NO: 991 - protein, 29 aa, Artificial Sequence
  Description of Artificial Sequence: Synthetic peptide
DEEEIRTTNPVATEQYGSVSTNLQLRGFR

SEQ ID NO: 992 - protein, 28 aa, Artificial Sequence
  Description of Artificial Sequence: Synthetic peptide
DEKEIWTTNPVATEQYGSVSTNLQRGNR

SEQ ID NO: 993 - protein, 29 aa, Artificial Sequence
  Description of Artificial Sequence: Synthetic peptide
DEKEIRTTNPVATEQYGSVSTNLQRGNIR

SEQ ID NO: 994 - protein, 28 aa, Artificial Sequence
  Description of Artificial Sequence: Synthetic peptide
DEKEIRTTNPVATEQYGSVSTELQRGNR

SEQ ID NO: 995 - protein, 28 aa, Artificial Sequence
  Description of Artificial Sequence: Synthetic peptide
DEKEIRTTNPVATEQYGSVSTDLQRGNR

SEQ ID NO: 996 - protein, 29 aa, Artificial Sequence
  Description of Artificial Sequence: Synthetic peptide
DEEEIRTTNPEATEQYGSVSWTNLQRGNR

SEQ ID NO: 997 - protein, 28 aa, Artificial Sequence
  Description of Artificial Sequence: Synthetic peptide
DEEEIRTTNPEATEQYGSVSTPLQRGNR

SEQ ID NO: 998 - protein, 29 aa, Artificial Sequence
  Description of Artificial Sequence: Synthetic peptide
DEEEIRTTNPEATEQYGSVSTNPLQRGNR

SEQ ID NO: 999 - protein, 29 aa, Artificial Sequence
  Description of Artificial Sequence: Synthetic peptide
DEEEIRTTNPEATEQYGSVSTNLSQRGNR

SEQ ID NO: 1000 - protein, 28 aa, Artificial Sequence
  Description of Artificial Sequence: Synthetic peptide
DEIEIRTTNPVATEQYGSVSTNLQRTNR

SEQ ID NO: 1001 - protein, 29 aa, Artificial Sequence
  Description of Artificial Sequence: Synthetic peptide
DEIEIRTTNPVATEQYGSVSTNLQRGNQR

SEQ ID NO: 1002 - protein, 28 aa, Artificial Sequence
  Description of Artificial Sequence: Synthetic peptide
DEIEIRTTNPVATEQYGSVSTNLQQGNR

SEQ ID NO: 1003 - protein, 29 aa, Artificial Sequence
  Description of Artificial Sequence: Synthetic peptide
DEIEIRTTNPVATEQYGSVSTNLQPRGNR

SEQ ID NO: 1004 - protein, 29 aa, Artificial Sequence
  Description of Artificial Sequence: Synthetic peptide
DEIEIRTTNPVATEQYGSVSTNLQARGNR

SEQ ID NO: 1005 - protein, 28 aa, Artificial Sequence
  Description of Artificial Sequence: Synthetic peptide
DEIEIRTTNPVATEQYGSVSTNEQRGNR

SEQ ID NO: 1006 - protein, 29 aa, Artificial Sequence
  Description of Artificial Sequence: Synthetic peptide
DEEEIRTTNPEATEQYGSVSTNLQRVGNR

SEQ ID NO: 1007 - protein, 28 aa, Artificial Sequence
  Description of Artificial Sequence: Synthetic peptide
DEIEIRTTNPVATEQYGDVSTNLQRGNR

SEQ ID NO: 1008 - protein, 28 aa, Artificial Sequence
  Description of Artificial Sequence: Synthetic peptide
DEEEIRTTNPVATEQYGSVSTNLQLGYR

SEQ ID NO: 1009 - protein, 28 aa, Artificial Sequence
  Description of Artificial Sequence: Synthetic peptide
DEEEIRTTNPEATEQYGSVSTNIQRGNR

SEQ ID NO: 1010 - protein, 30 aa, Artificial Sequence
  Description of Artificial Sequence: Synthetic polypeptide
DEEEIRTTNPVATEQYGSVSCTNLQRGINR

SEQ ID NO: 1011 - protein, 29 aa, Artificial Sequence
  Description of Artificial Sequence: Synthetic peptide
DEEEIRTTNPVATEQYGSVSCTNLQRGER

SEQ ID NO: 1012 - protein, 29 aa, Artificial Sequence
  Description of Artificial Sequence: Synthetic peptide
DEEEIRTTNPVATEQYGSVSTNLQISGNR

SEQ ID NO: 1013 - protein, 29 aa, Artificial Sequence
  Description of Artificial Sequence: Synthetic peptide
DEEEIRTTNPVATEQYGSVSTGNLQRFNR

SEQ ID NO: 1014 - protein, 30 aa, Artificial Sequence
  Description of Artificial Sequence: Synthetic polypeptide
DEEEIRTTNPVATEQYGSVSTGNLQRGFNR

SEQ ID NO: 1015 - protein, 30 aa, Artificial Sequence
  Description of Artificial Sequence: Synthetic polypeptide
DEEEIRTTNPVATEQYGSVSTNLQIRIGNR

SEQ ID NO: 1016 - protein, 29 aa, Artificial Sequence
  Description of Artificial Sequence: Synthetic peptide
DEEEIATTNPVATEQYGSVSTNNLQRGNR

SEQ ID NO: 1017 - protein, 28 aa, Artificial Sequence
  Description of Artificial Sequence: Synthetic peptide
DEEEIRTTNPEATEQYGSVSTALQRGNR

SEQ ID NO: 1018 - protein, 30 aa, Artificial Sequence
  Description of Artificial Sequence: Synthetic polypeptide
DEEEIRTTNPVATEQYGSVSTGNLQRGNNR

SEQ ID NO: 1019 - protein, 29 aa, Artificial Sequence
  Description of Artificial Sequence: Synthetic peptide
DEEEIRTTNPVATEQYGSVSTNLQIRHNR

SEQ ID NO: 1020 - protein, 30 aa, Artificial Sequence
  Description of Artificial Sequence: Synthetic polypeptide
DEEEIRTTNPVATEQYGSVSTGNLQRGTNR

SEQ ID NO: 1021 - protein, 30 aa, Artificial Sequence
  Description of Artificial Sequence: Synthetic polypeptide
DEEEIRTTNPVATEQYGSVSTNLQIRGNQR

SEQ ID NO: 1022 - protein, 29 aa, Artificial Sequence
  Description of Artificial Sequence: Synthetic peptide
DEEEIRTTNPVATEQYGSVSTNLQIRGNI

SEQ ID NO: 1023 - protein, 29 aa, Artificial Sequence
  Description of Artificial Sequence: Synthetic peptide
DEEEIRTTNPEATEQYGSVSMTNLQRGNR

SEQ ID NO: 1024 - protein, 29 aa, Artificial Sequence
  Description of Artificial Sequence: Synthetic peptide
DEEEIRTTNPVATEQYGSVSTNLQIQGNR

SEQ ID NO: 1025 - protein, 28 aa, Artificial Sequence
  Description of Artificial Sequence: Synthetic peptide
DEEEIRTTNPVATEQYGSVSTNLQIPNR

SEQ ID NO: 1026 - protein, 29 aa, Artificial Sequence
  Description of Artificial Sequence: Synthetic peptide
DEEEIRTTNPVATEQYGSVSTNLQIPGNR

SEQ ID NO: 1027 - protein, 28 aa, Artificial Sequence
  Description of Artificial Sequence: Synthetic peptide
DEEEIRTTNPVATEQYGSVSTNLQIGNS

SEQ ID NO: 1028 - protein, 29 aa, Artificial Sequence
  Description of Artificial Sequence: Synthetic peptide
DEEEIATTNPVATEQYGSVSTNLQSRGNR

SEQ ID NO: 1029 - protein, 29 aa, Artificial Sequence
  Description of Artificial Sequence: Synthetic peptide
DEEEIRTTNPVATEQYGSVSTNLQIGNPR

SEQ ID NO: 1030 - protein, 28 aa, Artificial Sequence
  Description of Artificial Sequence: Synthetic peptide
DEEEIATTNPVATEQYGSVSTNLQRGNS

SEQ ID NO: 1031 - protein, 28 aa, Artificial Sequence
  Description of Artificial Sequence: Synthetic peptide
DEEEIRTTNPVATEQYGSVSTVLQCGNR

SEQ ID NO: 1032 - protein, 29 aa, Artificial Sequence
  Description of Artificial Sequence: Synthetic peptide
DEEEIRTTNPVATEQYGSVSTVLQARGNR

SEQ ID NO: 1033 - protein, 28 aa, Artificial Sequence
  Description of Artificial Sequence: Synthetic peptide
DAEEIRTTNPVATEQYGSYSTNLQRGNR

SEQ ID NO: 1034 - protein, 28 aa, Artificial Sequence
  Description of Artificial Sequence: Synthetic peptide
DAEEIRTTNPVATEQYGSVSTNLQRGNT

SEQ ID NO: 1035 - protein, 29 aa, Artificial Sequence
  Description of Artificial Sequence: Synthetic peptide
DEEEIRTTNPVATEQYGSVSCTNLQRGDR

SEQ ID NO: 1036 - protein, 30 aa, Artificial Sequence
  Description of Artificial Sequence: Synthetic polypeptide
DEEEIRTTNPVATEQYGSVSCTNLQREGNR

SEQ ID NO: 1037 - protein, 29 aa, Artificial Sequence
  Description of Artificial Sequence: Synthetic peptide
DEEEIRTTNPVATEQYGSVSTVLDQRGNR

SEQ ID NO: 1038 - protein, 29 aa, Artificial Sequence
  Description of Artificial Sequence: Synthetic peptide
DEEEIRTTNPVATEQYGSVSTNLQLGDNR

SEQ ID NO: 1039 - protein, 29 aa, Artificial Sequence
  Description of Artificial Sequence: Synthetic peptide
FEEEIRTTNPVATEQYGSVSTNLQRDGNR

SEQ ID NO: 1040 - protein, 28 aa, Artificial Sequence
  Description of Artificial Sequence: Synthetic peptide
DEEEIATTNPVATEQYGSVSTSLQRGNR

SEQ ID NO: 1041 - protein, 29 aa, Artificial Sequence
  Description of Artificial Sequence: Synthetic peptide
FEEEIRTTNPVATEQYGSVSTNLQRGLNR

SEQ ID NO: 1042 - protein, 29 aa, Artificial Sequence
  Description of Artificial Sequence: Synthetic peptide
FEEEIRTTNPVATEQYGSVSTNLQRGNAR

SEQ ID NO: 1043 - protein, 29 aa, Artificial Sequence
  Description of Artificial Sequence: Synthetic peptide
FEEEIRTTNPVATEQYGSVSTNLQRLGNR

SEQ ID NO: 1044 - protein, 28 aa, Artificial Sequence
  Description of Artificial Sequence: Synthetic peptide
GEPEIRTTNPVATEQYGSVSTNLQRGNR

SEQ ID NO: 1045 - protein, 29 aa, Artificial Sequence
  Description of Artificial Sequence: Synthetic peptide
FEEEIRTTNPVATEQYGSVSTNLQRNGNR

SEQ ID NO: 1046 - protein, 28 aa, Artificial Sequence
  Description of Artificial Sequence: Synthetic peptide
DEEEIATTNPVATEQYGSVSTQLQRGNR

SEQ ID NO: 1047 - protein, 29 aa, Artificial Sequence
  Description of Artificial Sequence: Synthetic peptide
DEDEIRTTNPVATEQYGSVSTDNLQRGNR

SEQ ID NO: 1048 - protein, 29 aa, Artificial Sequence
  Description of Artificial Sequence: Synthetic peptide
DEEEIRTTNPVATEQYGSVSTNLQLGCNR

SEQ ID NO: 1049 - protein, 29 aa, Artificial Sequence
  Description of Artificial Sequence: Synthetic peptide
FEEEIRTTNPVATEQYGSVSTNLTQRGNR

SEQ ID NO: 1050 - protein, 28 aa, Artificial Sequence
  Description of Artificial Sequence: Synthetic peptide
DEEEIRTTNPEATEQYGSVSTDLQRGNR

SEQ ID NO: 1051 - protein, 29 aa, Artificial Sequence
  Description of Artificial Sequence: Synthetic peptide
DEEEIRTTNPVATEQYGSVSTNLQIVGNR

SEQ ID NO: 1052 - protein, 28 aa, Artificial Sequence
  Description of Artificial Sequence: Synthetic peptide
DAEEIRTTNPVATEQYGSVSTNLQLGNR

SEQ ID NO: 1053 - protein, 29 aa, Artificial Sequence
  Description of Artificial Sequence: Synthetic peptide
DAEEIRTTNPVATEQYGSVSTNLQRGENR

SEQ ID NO: 1054 - protein, 28 aa, Artificial Sequence
  Description of Artificial Sequence: Synthetic peptide
DAEEIRTTNPVATEQYGSVSTNLQRGNQ

SEQ ID NO: 1055 - protein, 29 aa, Artificial Sequence
  Description of Artificial Sequence: Synthetic peptide
FEEEIRTTNPVATEQYGSVSTNLQRTGNR

SEQ ID NO: 1056 - protein, 28 aa, Artificial Sequence
  Description of Artificial Sequence: Synthetic peptide
DEEEIRTTNPVATEQYGSVSTNLQGGLR

SEQ ID NO: 1057 - protein, 29 aa, Artificial Sequence
  Description of Artificial Sequence: Synthetic peptide
DEHEIRTTNPVATEQYGSVSETNLQRGNR

SEQ ID NO: 1058 - protein, 30 aa, Artificial Sequence
  Description of Artificial Sequence: Synthetic polypeptide
DEEEIRTTNPVATEQYGSVSTINLQREGNR

SEQ ID NO: 1059 - protein, 28 aa, Artificial Sequence
  Description of Artificial Sequence: Synthetic peptide
LEEEIITTNPVATEQYGSVSTNLQRGNR

SEQ ID NO: 1060 - protein, 28 aa, Artificial Sequence
  Description of Artificial Sequence: Synthetic peptide
LEEEIQTTNPVATEQYGSVSTNLQRGNR

SEQ ID NO: 1061 - protein, 28 aa, Artificial Sequence
  Description of Artificial Sequence: Synthetic peptide
LEEEIRATNPVATEQYGSVSTNLQRGNR

SEQ ID NO: 1062 - protein, 28 aa, Artificial Sequence
  Description of Artificial Sequence: Synthetic peptide
LEEEIRTTNPVASEQYGSVSTNLQRGNR

SEQ ID NO: 1063 - protein, 29 aa, Artificial Sequence
  Description of Artificial Sequence: Synthetic peptide
LEEEIRTTNPVATEQYGCSVSTNLQRGNR

SEQ ID NO: 1064 - protein, 28 aa, Artificial Sequence
  Description of Artificial Sequence: Synthetic peptide
DEEEIRCTNPVATEQYGSVSTNLQRENR

SEQ ID NO: 1065 - protein, 29 aa, Artificial Sequence
  Description of Artificial Sequence: Synthetic peptide
DEEEIRTTNPVATEQYGSVSMFNLQRGNR

SEQ ID NO: 1066 - protein, 28 aa, Artificial Sequence
  Description of Artificial Sequence: Synthetic peptide
LEEEIRTTNPVATEQYGSVSTHLQRGNR

SEQ ID NO: 1067 - protein, 28 aa, Artificial Sequence
  Description of Artificial Sequence: Synthetic peptide
LEEEIRTTNPVATEQYGSVSTNIQRGNR

SEQ ID NO: 1068 - protein, 29 aa, Artificial Sequence
  Description of Artificial Sequence: Synthetic peptide
LEEEIRTTNPVATEQYGSVSTNLQCRGNR

SEQ ID NO: 1069 - protein, 28 aa, Artificial Sequence
  Description of Artificial Sequence: Synthetic peptide
LEEEIRTTNPVATEQYGSVSTNLQRGNA

SEQ ID NO: 1070 - protein, 29 aa, Artificial Sequence
  Description of Artificial Sequence: Synthetic peptide
LEEEIRTTNPVATEQYGSVSTNLQRGNRI

SEQ ID NO: 1071 - protein, 28 aa, Artificial Sequence
  Description of Artificial Sequence: Synthetic peptide
LEEEIRTTNPVATEQYGSVSTNLQRGQR

SEQ ID NO: 1072 - protein, 28 aa, Artificial Sequence
  Description of Artificial Sequence: Synthetic peptide
LEEEIRTTNPVATEQYGSVSTNWQRGNR

SEQ ID NO: 1073 - protein, 29 aa, Artificial Sequence
  Description of Artificial Sequence: Synthetic peptide
LEEEIRTTNPVATEQYGSVSTVNLQRGNR

SEQ ID NO: 1074 - protein, 29 aa, Artificial Sequence
  Description of Artificial Sequence: Synthetic peptide
LEEEIRTTNPVATEQYGSYVSTNLQRGNR

SEQ ID NO: 1075 - protein, 29 aa, Artificial Sequence
  Description of Artificial Sequence: Synthetic peptide
DEEEIRTTNPVATEAYGSVSTNLQQRGNR

SEQ ID NO: 1076 - protein, 28 aa, Artificial Sequence
  Description of Artificial Sequence: Synthetic peptide
LEEEIWTTNPVATEQYGSVSTNLQRGNR

SEQ ID NO: 1077 - protein, 28 aa, Artificial Sequence
  Description of Artificial Sequence: Synthetic peptide
DEEEIRCTNPVATEQYGSVSTNLQRGIR

SEQ ID NO: 1078 - protein, 28 aa, Artificial Sequence
  Description of Artificial Sequence: Synthetic peptide
KETEIRTTNPVATEQYGSVSTNLQRGNR

SEQ ID NO: 1079 - protein, 29 aa, Artificial Sequence
  Description of Artificial Sequence: Synthetic peptide
DEEEIRTTNPVATEQYGSVCSTNLYRGNR

SEQ ID NO: 1080 - protein, 28 aa, Artificial Sequence
  Description of Artificial Sequence: Synthetic peptide
KEHEIRTTNPVATEQYGSVSTNLQRGNR

SEQ ID NO: 1081 - protein, 28 aa, Artificial Sequence
  Description of Artificial Sequence: Synthetic peptide
KEEEIRTTNPVATEVYGSVSTNLQRGNR

SEQ ID NO: 1082 - protein, 28 aa, Artificial Sequence
  Description of Artificial Sequence: Synthetic peptide
DEEEIRCTNPVATEQYGSVSTNLMRGNR

SEQ ID NO: 1083 - protein, 28 aa, Artificial Sequence
  Description of Artificial Sequence: Synthetic peptide
DEEEIRCTNPVATEQYGSVSTNLQPGNR

SEQ ID NO: 1084 - protein, 28 aa, Artificial Sequence
  Description of Artificial Sequence: Synthetic peptide
KEEEIRCTNPVATEQYGSVSTNLQRGNR

SEQ ID NO: 1085 - protein, 28 aa, Artificial Sequence
  Description of Artificial Sequence: Synthetic peptide
KEEEIRTTNPVASEQYGSVSTNLQRGNR

SEQ ID NO: 1086 - protein, 28 aa, Artificial Sequence
  Description of Artificial Sequence: Synthetic peptide
KEEEIRTTNPVATEQYGDVSTNLQRGNR

SEQ ID NO: 1087 - protein, 28 aa, Artificial Sequence
  Description of Artificial Sequence: Synthetic peptide
DEEEIRTTNPVATEQYGSVSTLLVRGNR

SEQ ID NO: 1088 - protein, 28 aa, Artificial Sequence
  Description of Artificial Sequence: Synthetic peptide
KEEEIRTTNPVATEQYGSVSDNLQRGNR

SEQ ID NO: 1089 - protein, 28 aa, Artificial Sequence
  Description of Artificial Sequence: Synthetic peptide
KEEEIRTTNPVATEQYGSVSTNLQKGNR

SEQ ID NO: 1090 - protein, 29 aa, Artificial Sequence
  Description of Artificial Sequence: Synthetic peptide
DEEEIRTTNPVATEQYGSVCSTNLQRGER

SEQ ID NO: 1091 - protein, 29 aa, Artificial Sequence
  Description of Artificial Sequence: Synthetic peptide
DEEEIRTTNPVATEQYGSVCSTNLQRGNA

SEQ ID NO: 1092 - protein, 29 aa, Artificial Sequence
  Description of Artificial Sequence: Synthetic peptide
KEEEIRTTNPVATEQYGSVSTNLQRAGNR

SEQ ID NO: 1093 - protein, 29 aa, Artificial Sequence
  Description of Artificial Sequence: Synthetic peptide
KEEEIRTTNPVATEQYGSVSTNLQRGNRG

SEQ ID NO: 1094 - protein, 29 aa, Artificial Sequence
  Description of Artificial Sequence: Synthetic peptide
DEEEIRTTNPVATEQYGSVCSTNLQRTNR

SEQ ID NO: 1095 - protein, 28 aa, Artificial Sequence
  Description of Artificial Sequence: Synthetic peptide
KEEEIRTTNPVATEQYGSVSTNLQRGNW

SEQ ID NO: 1096 - protein, 28 aa, Artificial Sequence
  Description of Artificial Sequence: Synthetic peptide
AEEEIRTTNPVATEQYGEVSTNLQRGNR

SEQ ID NO: 1097 - protein, 28 aa, Artificial Sequence
  Description of Artificial Sequence: Synthetic peptide
KEEEIRTTNPVATEQYGSVSTNLQRLNR

SEQ ID NO: 1098 - protein, 28 aa, Artificial Sequence
  Description of Artificial Sequence: Synthetic peptide
KEEEIRTTNPVATEQYGSVSTQLQRGNR

SEQ ID NO: 1099 - protein, 29 aa, Artificial Sequence
  Description of Artificial Sequence: Synthetic peptide
DEEEIRTTNPVATEQYGSVSSINLQRGNR

SEQ ID NO: 1100 - protein, 28 aa, Artificial Sequence
  Description of Artificial Sequence: Synthetic peptide
KEEEIRTTNPVATEQYGSVSTVLQRGNR

SEQ ID NO: 1101 - protein, 28 aa, Artificial Sequence
  Description of Artificial Sequence: Synthetic peptide
KEEEIRTTNPVAYEQYGSVSTNLQRGNR

SEQ ID NO: 1102 - protein, 29 aa, Artificial Sequence
  Description of Artificial Sequence: Synthetic peptide
DEEEIATTNPVATEQYGSVSFTNLQRGNR

SEQ ID NO: 1103 - protein, 30 aa, Artificial Sequence
  Description of Artificial Sequence: Synthetic polypeptide
DEEEIRTTNPVATEQYGSVCSTNMLQRGNR

SEQ ID NO: 1104 - protein, 29 aa, Artificial Sequence
  Description of Artificial Sequence: Synthetic peptide
DEEEIATTNPVATEQYGSVSETNLQRGNR

SEQ ID NO: 1105 - protein, 28 aa, Artificial Sequence
  Description of Artificial Sequence: Synthetic peptide
DEEEIRTTNPDATFQYGSVSTNLQRGNR

SEQ ID NO: 1106 - protein, 28 aa, Artificial Sequence
  Description of Artificial Sequence: Synthetic peptide
DEGEIRTTNPVATEQYGSVSTNLQRGNC

SEQ ID NO: 1107 - protein, 29 aa, Artificial Sequence
  Description of Artificial Sequence: Synthetic peptide
DEGEIRTTNPVATEQYGSVSTNLQRGDNR

SEQ ID NO: 1108 - protein, 28 aa, Artificial Sequence
  Description of Artificial Sequence: Synthetic peptide
DEGEIRTTNPVATEQYGSVSTNLQPGNR

SEQ ID NO: 1109 - protein, 28 aa, Artificial Sequence
  Description of Artificial Sequence: Synthetic peptide
DEEEIRTTNPVATEAYGSVSTNVQRGNR

SEQ ID NO: 1110 - protein, 28 aa, Artificial Sequence
  Description of Artificial Sequence: Synthetic peptide
DEEEIRCTNPVATEQYGSVSTNLQVGNR

SEQ ID NO: 1111 - protein, 28 aa, Artificial Sequence
  Description of Artificial Sequence: Synthetic peptide
DEEEIRCTNPVATEQYGSVSTNLQWGNR

SEQ ID NO: 1112 - protein, 28 aa, Artificial Sequence
  Description of Artificial Sequence: Synthetic peptide
DEEEIRCTNPVATEQYGSVSTNLVRGNR

SEQ ID NO: 1113 - protein, 28 aa, Artificial Sequence
  Description of Artificial Sequence: Synthetic peptide
DEGEIRTTNPVATEQYGSVSTNLQDGNR

SEQ ID NO: 1114 - protein, 28 aa, Artificial Sequence
  Description of Artificial Sequence: Synthetic peptide
DEGEIRTTNPVATEQYGSVSTNLCRGNR

SEQ ID NO: 1115 - protein, 29 aa, Artificial Sequence
  Description of Artificial Sequence: Synthetic peptide
DEEEIRTTNPVATEQYGRVSTNLDQRGNR

SEQ ID NO: 1116 - protein, 29 aa, Artificial Sequence
  Description of Artificial Sequence: Synthetic peptide
DEEEIRTTNPDATEQYGSVSTTNLQRGNR

SEQ ID NO: 1117 - protein, 29 aa, Artificial Sequence
  Description of Artificial Sequence: Synthetic peptide
DEEEIRTTNPVATEQYGSVSTWLQRGNAR

SEQ ID NO: 1118 - protein, 29 aa, Artificial Sequence
  Description of Artificial Sequence: Synthetic peptide
DEEEIRCTNPVATEQYGSVSTPNLQRGNR

SEQ ID NO: 1119 - protein, 29 aa, Artificial Sequence
  Description of Artificial Sequence: Synthetic peptide
DEEEIRTTNPVATEQYGRSVSTNLQRGNE

SEQ ID NO: 1120 - protein, 28 aa, Artificial Sequence
  Description of Artificial Sequence: Synthetic peptide
DEEEIRTTNPVATEQYGSVSTWLQRPNR

SEQ ID NO: 1121 - protein, 28 aa, Artificial Sequence
  Description of Artificial Sequence: Synthetic peptide
DEEEIRTTNPVATEQYGSVSTWMQRGNR

SEQ ID NO: 1122 - protein, 30 aa, Artificial Sequence
  Description of Artificial Sequence: Synthetic polypeptide
DEEEIRTTNPVATEQYGRSVSTNLQERGNR

SEQ ID NO: 1123 - protein, 28 aa, Artificial Sequence
  Description of Artificial Sequence: Synthetic peptide
DEEEIRTTNPDATEQYGSVSTNLQRYNR

SEQ ID NO: 1124 - protein, 29 aa, Artificial Sequence
  Description of Artificial Sequence: Synthetic peptide
DEGEIRTTNPVATEQYGSVSTNLQRGNRV

SEQ ID NO: 1125 - protein, 28 aa, Artificial Sequence
  Description of Artificial Sequence: Synthetic peptide
DEGEIRTTNPVATEQYGSVSTNWQRGNR

SEQ ID NO: 1126 - protein, 29 aa, Artificial Sequence
  Description of Artificial Sequence: Synthetic peptide
DEEEIRTTNPVATEQYGSVSTNLQFEGNR

SEQ ID NO: 1127 - protein, 29 aa, Artificial Sequence
  Description of Artificial Sequence: Synthetic peptide
DEGEIRTTNPVATEQYGSVSTQNLQRGNR

SEQ ID NO: 1128 - protein, 29 aa, Artificial Sequence
  Description of Artificial Sequence: Synthetic peptide
DEEEIRTTNPVATEQYGSVSTLNLQGGNR

SEQ ID NO: 1129 - protein, 28 aa, Artificial Sequence
  Description of Artificial Sequence: Synthetic peptide
LETEIRTTNPVATEQYGSVSTNLQRGNR

SEQ ID NO: 1130 - protein, 30 aa, Artificial Sequence
  Description of Artificial Sequence: Synthetic polypeptide
DEEEIRTTNPVATEQYGSVSTLNLQRGNDR

SEQ ID NO: 1131 - protein, 28 aa, Artificial Sequence
  Description of Artificial Sequence: Synthetic peptide
DEEEIRTTNPVATEAYGSVSTNLQRGER

SEQ ID NO: 1132 - protein, 29 aa, Artificial Sequence
  Description of Artificial Sequence: Synthetic peptide
DEEEIRCTNPVATEQYGSVSTNLQRGNER

SEQ ID NO: 1133 - protein, 30 aa, Artificial Sequence
  Description of Artificial Sequence: Synthetic polypeptide
DEEEIRTTNPVATEQYGSVSTLNLQRGNFR

SEQ ID NO: 1134 - protein, 28 aa, Artificial Sequence
  Description of Artificial Sequence: Synthetic peptide
DEEEIRTTNPVATEAYGSVSTNLQRGNE

SEQ ID NO: 1135 - protein, 29 aa, Artificial Sequence
  Description of Artificial Sequence: Synthetic peptide
DEEEIRTTNPVATEAYGSVSTNLQRGNMR

SEQ ID NO: 1136 - protein, 28 aa, Artificial Sequence
  Description of Artificial Sequence: Synthetic peptide
DEEEIRCTNPVATEQYGSVSTNLQRGNL

SEQ ID NO: 1137 - protein, 29 aa, Artificial Sequence
  Description of Artificial Sequence: Synthetic peptide
DEEEIRTTNPVATEQYGRVSTNLQNRGNR

SEQ ID NO: 1138 - protein, 30 aa, Artificial Sequence
  Description of Artificial Sequence: Synthetic polypeptide
DEEEIRTTNPVATEQYGSVSTLNLQRGNRS

SEQ ID NO: 1139 - protein, 29 aa, Artificial Sequence
  Description of Artificial Sequence: Synthetic peptide
DEEEIRTTNPVATEQYGSVSTLNLQRNNR

SEQ ID NO: 1140 - protein, 29 aa, Artificial Sequence
  Description of Artificial Sequence: Synthetic peptide
DEEEIRCTNPVATEQYGSVSTNLQRGNNR

SEQ ID NO: 1141 - protein, 29 aa, Artificial Sequence
  Description of Artificial Sequence: Synthetic peptide
DEEEIRTTNPVATEQYGSVSTLNLVRGNR

SEQ ID NO: 1142 - protein, 28 aa, Artificial Sequence
  Description of Artificial Sequence: Synthetic peptide
DEEEIRTTNPEAIEQYGSVSTNLQRGNR

SEQ ID NO: 1143 - protein, 28 aa, Artificial Sequence
  Description of Artificial Sequence: Synthetic peptide
DEEEIRCTNPVATEQYGSVSTNLQRGNQ

SEQ ID NO: 1144 - protein, 28 aa, Artificial Sequence
  Description of Artificial Sequence: Synthetic peptide
DEEEIRTTNPEACEQYGSVSTNLQRGNR

SEQ ID NO: 1145 - protein, 29 aa, Artificial Sequence
  Description of Artificial Sequence: Synthetic peptide
DEGEIRTTNPVATEQYGSVSTYNLQRGNR

SEQ ID NO: 1146 - protein, 28 aa, Artificial Sequence
  Description of Artificial Sequence: Synthetic peptide
DEGEIRTTNPVATEQYGSVSTYLQRGNR

SEQ ID NO: 1147 - protein, 29 aa, Artificial Sequence
  Description of Artificial Sequence: Synthetic peptide
DEGEIRTTNPVATEQYGSVSTVNLQRGNR

SEQ ID NO: 1148 - protein, 29 aa, Artificial Sequence
  Description of Artificial Sequence: Synthetic peptide
DEEEIRTTNPVATEAYGSVSTNLQVRGNR

SEQ ID NO: 1149 - protein, 29 aa, Artificial Sequence
  Description of Artificial Sequence: Synthetic peptide
DEAEIRTTNPVATEQYGSVSTDNLQRGNR

SEQ ID NO: 1150 - protein, 29 aa, Artificial Sequence
  Description of Artificial Sequence: Synthetic peptide
DEEEIRCTNPVATEQYGSVSTNGLQRGNR

SEQ ID NO: 1151 - protein, 28 aa, Artificial Sequence
  Description of Artificial Sequence: Synthetic peptide
IEEEIRTTNPYATEQYGSVSTNLQRGNR

SEQ ID NO: 1152 - protein, 29 aa, Artificial Sequence
  Description of Artificial Sequence: Synthetic peptide
HEEEIRTTNPVATEQYGSVSETNLQRGNR

SEQ ID NO: 1153 - protein, 29 aa, Artificial Sequence
  Description of Artificial Sequence: Synthetic peptide
DEEEIRCTNPVATEQYGSVSPTNLQRGNR

SEQ ID NO: 1154 - protein, 28 aa, Artificial Sequence
  Description of Artificial Sequence: Synthetic peptide
HEEEIRTTNPVATEQYGSVSTALQRGNR

SEQ ID NO: 1155 - protein, 28 aa, Artificial Sequence
  Description of Artificial Sequence: Synthetic peptide
DEHEIRTTNPVATEQYGLVSTNLQRGNR

SEQ ID NO: 1156 - protein, 28 aa, Artificial Sequence
  Description of Artificial Sequence: Synthetic peptide
HEEEIRTTNPVATEQYGSVSTCLQRGNR

SEQ ID NO: 1157 - protein, 28 aa, Artificial Sequence
  Description of Artificial Sequence: Synthetic peptide
DEAEIRTTNPVATEQYGSVSTNLTRGNR

SEQ ID NO: 1158 - protein, 28 aa, Artificial Sequence
  Description of Artificial Sequence: Synthetic peptide
DEEEIATTNPVATEQYGSVSTNEQRGNR

SEQ ID NO: 1159 - protein, 29 aa, Artificial Sequence
  Description of Artificial Sequence: Synthetic peptide
HEEEIRTTNPVATEQYGSVSTNLQCRGNR

SEQ ID NO: 1160 - protein, 28 aa, Artificial Sequence
  Description of Artificial Sequence: Synthetic peptide
HEEEIRTTNPVATEQYGSVSTNLQPGNR

SEQ ID NO: 1161 - protein, 29 aa, Artificial Sequence
  Description of Artificial Sequence: Synthetic peptide
DEDEIRTTNPVATEQYGSVSTNLQNRGNR

SEQ ID NO: 1162 - protein, 29 aa, Artificial Sequence
  Description of Artificial Sequence: Synthetic peptide
DEAEIRTTNPVATEQYGSVSTNLQYRGNR

SEQ ID NO: 1163 - protein, 29 aa, Artificial Sequence
  Description of Artificial Sequence: Synthetic peptide
HEEEIRTTNPVATEQYGSVSTNLQPRGNR

SEQ ID NO: 1164 - protein, 29 aa, Artificial Sequence
  Description of Artificial Sequence: Synthetic peptide
HEEEIRTTNPVATEQYGSVSTNLQRGINR

SEQ ID NO: 1165 - protein, 29 aa, Artificial Sequence
  Description of Artificial Sequence: Synthetic peptide
DEAEIRTTNPVATEQYGSVSTNLQRVGNR

SEQ ID NO: 1166 - protein, 28 aa, Artificial Sequence
  Description of Artificial Sequence: Synthetic peptide
HEEEIRTTNPVATEQYGSVSTNLQRGND

SEQ ID NO: 1167 - protein, 28 aa, Artificial Sequence
  Description of Artificial Sequence: Synthetic peptide
HEEEIRTTNPVATEQYGSVSTNLQRGNF

SEQ ID NO: 1168 - protein, 28 aa, Artificial Sequence
  Description of Artificial Sequence: Synthetic peptide
HEEEIRTTNPVATEQYGSVSTNLQRGPR

SEQ ID NO: 1169 - protein, 29 aa, Artificial Sequence
  Description of Artificial Sequence: Synthetic peptide
DEAEIRTTNPVATEQYGSVSTNLQRGNPR

SEQ ID NO: 1170 - protein, 28 aa, Artificial Sequence
  Description of Artificial Sequence: Synthetic peptide
DEAEIRTTNPVATEQYGSVSTNLQRGNM

SEQ ID NO: 1171 - protein, 29 aa, Artificial Sequence
  Description of Artificial Sequence: Synthetic peptide
HEEEIRTTNPVATEQYGSVSDTNLQRGNR

SEQ ID NO: 1172 - protein, 29 aa, Artificial Sequence
  Description of Artificial Sequence: Synthetic peptide
DEAEIRTTNPVATEQYGSVSTNLQRGNLR

SEQ ID NO: 1173 - protein, 28 aa, Artificial Sequence
  Description of Artificial Sequence: Synthetic peptide
HEEEIRTTNPVATEQYGSVSDNLQRGNR

SEQ ID NO: 1174 - protein, 28 aa, Artificial Sequence
  Description of Artificial Sequence: Synthetic peptide
DEEEIRTTNPVATEQYGSVSTKLQRGNY

SEQ ID NO: 1175 - protein, 30 aa, Artificial Sequence
  Description of Artificial Sequence: Synthetic polypeptide
DEEEIRTTNPVATEQYGSVSTINLQRGHNR

SEQ ID NO: 1176 - protein, 29 aa, Artificial Sequence
  Description of Artificial Sequence: Synthetic peptide
DEEEIRTTNPVATEQYGSVSTINLQRGNM

SEQ ID NO: 1177 - protein, 28 aa, Artificial Sequence
  Description of Artificial Sequence: Synthetic peptide
DEHEIRTTNPVATEQYGSVSANLQRGNR

SEQ ID NO: 1178 - protein, 30 aa, Artificial Sequence
  Description of Artificial Sequence: Synthetic polypeptide
DEEEIRTTNPVATEQYGSVSTINLQRGNRA

SEQ ID NO: 1179 - protein, 30 aa, Artificial Sequence
  Description of Artificial Sequence: Synthetic polypeptide
DEEEIRTTNPVATEQYGSVSTINLQRGNRV

SEQ ID NO: 1180 - protein, 30 aa, Artificial Sequence
  Description of Artificial Sequence: Synthetic polypeptide
DEEEIRTTNPVATEQYGSVSTINSLQRGNR

SEQ ID NO: 1181 - protein, 28 aa, Artificial Sequence
  Description of Artificial Sequence: Synthetic peptide
DEHEIRTTNPVATEQYGSTSTNLQRGNR

SEQ ID NO: 1182 - protein, 28 aa, Artificial Sequence
  Description of Artificial Sequence: Synthetic peptide
HEEEIRCTNPVATEQYGSVSTNLQRGNR

SEQ ID NO: 1183 - protein, 28 aa, Artificial Sequence
  Description of Artificial Sequence: Synthetic peptide
DEEEIRTTNPEATEQYGSHSTNLQRGNR

SEQ ID NO: 1184 - protein, 29 aa, Artificial Sequence
  Description of Artificial Sequence: Synthetic peptide
DEEEIRTTNPVATEQYGSVSTIPLQRGNR

SEQ ID NO: 1185 - protein, 28 aa, Artificial Sequence
  Description of Artificial Sequence: Synthetic peptide
DEEEIRTTNPEATEQYGQVSTNLQRGNR

SEQ ID NO: 1186 - protein, 28 aa, Artificial Sequence
  Description of Artificial Sequence: Synthetic peptide
HEEEIRTTNPVATCQYGSVSTNLQRGNR

SEQ ID NO: 1187 - protein, 29 aa, Artificial Sequence
  Description of Artificial Sequence: Synthetic peptide
DEEEIRTTNPVATEQYGSVSGNLQIRGNR

SEQ ID NO: 1188 - protein, 28 aa, Artificial Sequence
  Description of Artificial Sequence: Synthetic peptide
HEEEIRTTNPVATDQYGSVSTNLQRGNR

SEQ ID NO: 1189 - protein, 28 aa, Artificial Sequence
  Description of Artificial Sequence: Synthetic peptide
HEEEIRTTNPVATEQYGFVSTNLQRGNR

SEQ ID NO: 1190 - protein, 28 aa, Artificial Sequence
  Description of Artificial Sequence: Synthetic peptide
DEEEIRTTNPVATEQYGSVSTIYQRGNR

SEQ ID NO: 1191 - protein, 28 aa, Artificial Sequence
  Description of Artificial Sequence: Synthetic peptide
DEEEIRTTNPVATEQYGSVSTKLQRGNC

SEQ ID NO: 1192 - protein, 28 aa, Artificial Sequence
  Description of Artificial Sequence: Synthetic peptide
HEEEIRTTNPVATEQYGIVSTNLQRGNR

SEQ ID NO: 1193 - protein, 28 aa, Artificial Sequence
  Description of Artificial Sequence: Synthetic peptide
DEEEIRTTNPVATEQYGSVSTKLQRGNS

SEQ ID NO: 1194 - protein, 29 aa, Artificial Sequence
  Description of Artificial Sequence: Synthetic peptide
DEEEIRTTNPVATEQYGSVSTLALQRGNR

SEQ ID NO: 1195 - protein, 28 aa, Artificial Sequence
  Description of Artificial Sequence: Synthetic peptide
DEAEIRTTNPVATEQYGSVSTNLQRGNK

SEQ ID NO: 1196 - protein, 28 aa, Artificial Sequence
  Description of Artificial Sequence: Synthetic peptide
DEAEIRTTNPVATEQYGSVSTNLQRGIR

SEQ ID NO: 1197 - protein, 29 aa, Artificial Sequence
  Description of Artificial Sequence: Synthetic peptide
DEEEIATTNPVATEQYGSVSTMNLQRGNR

SEQ ID NO: 1198 - protein, 28 aa, Artificial Sequence
  Description of Artificial Sequence: Synthetic peptide
DEEEIRTTNPVATEQYGSVSTNLQFGIR

SEQ ID NO: 1199 - protein, 29 aa, Artificial Sequence
  Description of Artificial Sequence: Synthetic peptide
DEEEIRCTNPVATEQYGSVSTCNLQRGNR

SEQ ID NO: 1200 - protein, 28 aa, Artificial Sequence
  Description of Artificial Sequence: Synthetic peptide
DEDEIRTTNPVATEQYGSVSTNLQRGNM

SEQ ID NO: 1201 - protein, 29 aa, Artificial Sequence
  Description of Artificial Sequence: Synthetic peptide
DEDEIRTTNPVATEQYGSVSTNLQRNGNR

SEQ ID NO: 1202 - protein, 29 aa, Artificial Sequence
  Description of Artificial Sequence: Synthetic peptide
IEEEIRTTNPVATEQYGSVSLTNLQRGNR

SEQ ID NO: 1203 - protein, 28 aa, Artificial Sequence
  Description of Artificial Sequence: Synthetic peptide
IEEEIRTTNPVATEQYGSVSTNLARGNR

SEQ ID NO: 1204 - protein, 29 aa, Artificial Sequence
  Description of Artificial Sequence: Synthetic peptide
IEEEIRTTNPVATEQYGSVSTNLPQRGNR

SEQ ID NO: 1205 - protein, 29 aa, Artificial Sequence
  Description of Artificial Sequence: Synthetic peptide
IEEEIRTTNPVATEQYGSVSTNLQRGANR

SEQ ID NO: 1206 - protein, 28 aa, Artificial Sequence
  Description of Artificial Sequence: Synthetic peptide
IEEEIRTTNPVATEQYGSVSTNLQRGLR

SEQ ID NO: 1207 - protein, 29 aa, Artificial Sequence
  Description of Artificial Sequence: Synthetic peptide
IEEEIRTTNPVATEQYGSVSTNLQRGQNR

SEQ ID NO: 1208 - protein, 28 aa, Artificial Sequence
  Description of Artificial Sequence: Synthetic peptide
DEEEIRTTNPVATEQYGSVSTLLQRGNI

SEQ ID NO: 1209 - protein, 29 aa, Artificial Sequence
  Description of Artificial Sequence: Synthetic peptide
DEEEIRTTNPVATEQYGSVSTLLQRGNRA

SEQ ID NO: 1210 - protein, 28 aa, Artificial Sequence
  Description of Artificial Sequence: Synthetic peptide
DEEEIRTTNPVATEQYGSVSTLLQRGNS

SEQ ID NO: 1211 - protein, 28 aa, Artificial Sequence
  Description of Artificial Sequence: Synthetic peptide
IEEEIRTTNPVATEQYGSVSTNLSRGNR

SEQ ID NO: 1212 - protein, 28 aa, Artificial Sequence
  Description of Artificial Sequence: Synthetic peptide
DEEEIRTTNPVATEQYGSVSTLLQRHNR

SEQ ID NO: 1213 - protein, 29 aa, Artificial Sequence
  Description of Artificial Sequence: Synthetic peptide
DEEEIRTTNPVATEQYGSVSTLLQRMGNR

SEQ ID NO: 1214 - protein, 29 aa, Artificial Sequence
  Description of Artificial Sequence: Synthetic peptide
IEEEIRTTNPVATEQYGSVSTNLTQRGNR

SEQ ID NO: 1215 - protein, 28 aa, Artificial Sequence
  Description of Artificial Sequence: Synthetic peptide
IEEEIRTTNPVGTEQYGSVSTNLQRGNR

SEQ ID NO: 1216 - protein, 29 aa, Artificial Sequence
  Description of Artificial Sequence: Synthetic peptide
DEEEIRTTNPVATEQYGSVCSTNLQMGNR

SEQ ID NO: 1217 - protein, 28 aa, Artificial Sequence
  Description of Artificial Sequence: Synthetic peptide
DEHEIRTTNPTATEQYGSVSTNLQRGNR

SEQ ID NO: 1218 - protein, 29 aa, Artificial Sequence
  Description of Artificial Sequence: Synthetic peptide
DEDEIRTTNPVATEQYGSVSTNLQRGNLR

SEQ ID NO: 1219 - protein, 29 aa, Artificial Sequence
  Description of Artificial Sequence: Synthetic peptide
DEDEIRTTNPVATEQYGSVSTNLQRGHNR

SEQ ID NO: 1220 - protein, 28 aa, Artificial Sequence
  Description of Artificial Sequence: Synthetic peptide
DEEEIRTTNPVATEQYGSVSTLLQNGNR

SEQ ID NO: 1221 - protein, 30 aa, Artificial Sequence
  Description of Artificial Sequence: Synthetic polypeptide
DEEEIRTTNPVATEQYGSVCSTNLDQRGNR

SEQ ID NO: 1222 - protein, 28 aa, Artificial Sequence
  Description of Artificial Sequence: Synthetic peptide
DEEEIATTNPVATEQYGSVSTLLQRGNR

SEQ ID NO: 1223 - protein, 28 aa, Artificial Sequence
  Description of Artificial Sequence: Synthetic peptide
DEAEIRTTNPVATEQYGSVSTNLQRFNR

SEQ ID NO: 1224 - protein, 29 aa, Artificial Sequence
  Description of Artificial Sequence: Synthetic peptide
DEDEIRTTNPVATEQYGSVSTNLQQRGNR

SEQ ID NO: 1225 - protein, 28 aa, Artificial Sequence
  Description of Artificial Sequence: Synthetic peptide
DEEEIATTNPVATEQYGSVSTGLQRGNR

SEQ ID NO: 1226 - protein, 29 aa, Artificial Sequence
  Description of Artificial Sequence: Synthetic peptide
HEEEIRTTNPVATEQYGSVSTNLQSRGNR

SEQ ID NO: 1227 - protein, 29 aa, Artificial Sequence
  Description of Artificial Sequence: Synthetic peptide
DEEEIRTTNPVATEQYGSVSTNLQFRVNR

SEQ ID NO: 1228 - protein, 29 aa, Artificial Sequence
  Description of Artificial Sequence: Synthetic peptide
HEEEIRTTNPVATEQYGSVSTNWLQRGNR

SEQ ID NO: 1229 - protein, 29 aa, Artificial Sequence
  Description of Artificial Sequence: Synthetic peptide
DEEEIRTTNPVATEQYGSVSTNLQFRNNR

SEQ ID NO: 1230 - protein, 29 aa, Artificial Sequence
  Description of Artificial Sequence: Synthetic peptide
DEEEIRCTNPVATEQYGSVSTINLQRGNR

SEQ ID NO: 1231 - protein, 30 aa, Artificial Sequence
  Description of Artificial Sequence: Synthetic polypeptide
DEEEIRTTNPVATEQYGSVSTNLQFRGNRI

SEQ ID NO: 1232 - protein, 30 aa, Artificial Sequence
  Description of Artificial Sequence: Synthetic polypeptide
DEEEIRTTNPVATEQYGSVSTNLQFRGNPR

SEQ ID NO: 1233 - protein, 30 aa, Artificial Sequence
  Description of Artificial Sequence: Synthetic polypeptide
DEEEIRTTNPVATEQYGSVSTNLQFRGINR

SEQ ID NO: 1234 - protein, 29 aa, Artificial Sequence
  Description of Artificial Sequence: Synthetic peptide
DEEEIRTTNPVATEQYGSVSTLLLQRGNR

SEQ ID NO: 1235 - protein, 28 aa, Artificial Sequence
  Description of Artificial Sequence: Synthetic peptide
HEEEIRTTNPVCTEQYGSVSTNLQRGNR

SEQ ID NO: 1236 - protein, 29 aa, Artificial Sequence
  Description of Artificial Sequence: Synthetic peptide
DEEEIRTTNPVATEQYGSVSTLLQARGNR

SEQ ID NO: 1237 - protein, 28 aa, Artificial Sequence
  Description of Artificial Sequence: Synthetic peptide
HEEEIRTTNPVSTEQYGSVSTNLQRGNR

SEQ ID NO: 1238 - protein, 28 aa, Artificial Sequence
  Description of Artificial Sequence: Synthetic peptide
DEDEIRTTNPVATEQYGSVSTNLQRGDR

SEQ ID NO: 1239 - protein, 28 aa, Artificial Sequence
  Description of Artificial Sequence: Synthetic peptide
DEEEIRTTNPVATEQYGSVSTNLQFGNT

SEQ ID NO: 1240 - protein, 29 aa, Artificial Sequence
  Description of Artificial Sequence: Synthetic peptide
DEEEIRTTNPVATEQYGSVSTNLQFGNRL

SEQ ID NO: 1241 - protein, 28 aa, Artificial Sequence
  Description of Artificial Sequence: Synthetic peptide
HEEEIRTTNPVATESYGSVSTNLQRGNR

SEQ ID NO: 1242 - protein, 28 aa, Artificial Sequence
  Description of Artificial Sequence: Synthetic peptide
DEEEIRTTNPVAIEQYGSVSTNLQRQNR

SEQ ID NO: 1243 - protein, 30 aa, Artificial Sequence
  Description of Artificial Sequence: Synthetic polypeptide
DEEEIRTTNPVATEQYGSVSNTNLQRGFNR

SEQ ID NO: 1244 - protein, 29 aa, Artificial Sequence
  Description of Artificial Sequence: Synthetic peptide
DEEEIRTTNPVATEQYGSVSENLQNRGNR

SEQ ID NO: 1245 - protein, 29 aa, Artificial Sequence
  Description of Artificial Sequence: Synthetic peptide
DEYEIRTTNPVATEQYGSVSSTNLQRGNR

SEQ ID NO: 1246 - protein, 29 aa, Artificial Sequence
  Description of Artificial Sequence: Synthetic peptide
DEEEIRTTNPVATEQYGSVSTNLSQRGNA

SEQ ID NO: 1247 - protein, 29 aa, Artificial Sequence
  Description of Artificial Sequence: Synthetic peptide
DEEEIRTTNPVATEQYGSVSEWNLQRGNR

SEQ ID NO: 1248 - protein, 29 aa, Artificial Sequence
  Description of Artificial Sequence: Synthetic peptide
DEEEIRTTNPVATEQYGSVSTNNTQRGNR

SEQ ID NO: 1249 - protein, 28 aa, Artificial Sequence
  Description of Artificial Sequence: Synthetic peptide
DEEEIGTTNPVATEQYGSVSTNDQRGNR

SEQ ID NO: 1250 - protein, 28 aa, Artificial Sequence
  Description of Artificial Sequence: Synthetic peptide
DEEEIRTTNPVATEQYGSVSKNLQRGNV

SEQ ID NO: 1251 - protein, 28 aa, Artificial Sequence
  Description of Artificial Sequence: Synthetic peptide
DEEEIRTTNPVATEQYGSVSKNLQRGNQ

SEQ ID NO: 1252 - protein, 30 aa, Artificial Sequence
  Description of Artificial Sequence: Synthetic polypeptide
DEEEIRTTNPVATEQYGSVSTNLSQRGANR

SEQ ID NO: 1253 - protein, 29 aa, Artificial Sequence
  Description of Artificial Sequence: Synthetic peptide
DEEEIRTTNPVATEQYGSGSTNLQNRGNR

SEQ ID NO: 1254 - protein, 29 aa, Artificial Sequence
  Description of Artificial Sequence: Synthetic peptide
DEEEIRTTNPVATEQYGSVSKNLQRGNER

SEQ ID NO: 1255 - protein, 29 aa, Artificial Sequence
  Description of Artificial Sequence: Synthetic peptide
DEEEIRTTNPVATEQYGSVSKNLQRGDNR

SEQ ID NO: 1256 - protein, 29 aa, Artificial Sequence
  Description of Artificial Sequence: Synthetic peptide
DEEEIRTTNPVATEQYGSVSTNLSQRANR

SEQ ID NO: 1257 - protein, 29 aa, Artificial Sequence
  Description of Artificial Sequence: Synthetic peptide
DEEEIRTTNPVATEQYGSVSTNPIQRGNR

SEQ ID NO: 1258 - protein, 30 aa, Artificial Sequence
  Description of Artificial Sequence: Synthetic polypeptide
DEEEIRTTNPVATEQYGSVSTNLSQRAGNR

SEQ ID NO: 1259 - protein, 29 aa, Artificial Sequence
  Description of Artificial Sequence: Synthetic peptide
DEEEIRTTNPVATEQYGSVSTNPLQFGNR

SEQ ID NO: 1260 - protein, 30 aa, Artificial Sequence
  Description of Artificial Sequence: Synthetic polypeptide
DEEEIRTTNPVATEQYGSVSTNPLQRGANR

SEQ ID NO: 1261 - protein, 30 aa, Artificial Sequence
  Description of Artificial Sequence: Synthetic polypeptide
DEEEIRTTNPVATEQYGSVSTNPLQRGNRN

SEQ ID NO: 1262 - protein, 29 aa, Artificial Sequence
  Description of Artificial Sequence: Synthetic peptide
DEEEIRTTNPVATEQYGSQVSTNLQNGNR

SEQ ID NO: 1263 - protein, 28 aa, Artificial Sequence
  Description of Artificial Sequence: Synthetic peptide
DEEEIRTTNPVATEQYGSVSKNLQRGNC

SEQ ID NO: 1264 - protein, 29 aa, Artificial Sequence
  Description of Artificial Sequence: Synthetic peptide
DEEEIRTTNPVATEQYGSVSTNPLQRGVR

SEQ ID NO: 1265 - protein, 28 aa, Artificial Sequence
  Description of Artificial Sequence: Synthetic peptide
DEEEIRTTNPVATEQYGSGSTNLQPGNR

SEQ ID NO: 1266 - protein, 30 aa, Artificial Sequence
  Description of Artificial Sequence: Synthetic polypeptide
DEEEIRTTNPVATEQYGSVSTNLSQRGNDR

SEQ ID NO: 1267 - protein, 29 aa, Artificial Sequence
  Description of Artificial Sequence: Synthetic peptide
DEEEIRTTNPVATEQYGSVSTNNQRGNRI

SEQ ID NO: 1268 - protein, 29 aa, Artificial Sequence
  Description of Artificial Sequence: Synthetic peptide
DEEEIGTTNPVATEQYGSVSTNLQWRGNR

SEQ ID NO: 1269 - protein, 29 aa, Artificial Sequence
  Description of Artificial Sequence: Synthetic peptide
DEEEIGTTNPVATEQYGSVSTNLQRWGNR

SEQ ID NO: 1270 - protein, 29 aa, Artificial Sequence
  Description of Artificial Sequence: Synthetic peptide
DEEEIRTTNPVATEQYGSVSTDNLQSGNR

SEQ ID NO: 1271 - protein, 29 aa, Artificial Sequence
  Description of Artificial Sequence: Synthetic peptide
DEEEIGTTNPVATEQYGSVSTNLQRGPNR

SEQ ID NO: 1272 - protein, 29 aa, Artificial Sequence
  Description of Artificial Sequence: Synthetic peptide
DEEEIGTTNPVATEQYGSVSTNLQRGNRQ

SEQ ID NO: 1273 - protein, 29 aa, Artificial Sequence
  Description of Artificial Sequence: Synthetic peptide
DEEEIRTTNPVATEQYGSVSTNNQRGNRL

SEQ ID NO: 1274 - protein, 29 aa, Artificial Sequence
  Description of Artificial Sequence: Synthetic peptide
DEEEIRTTNPVATEQYGSVSTNNQRGNRP

SEQ ID NO: 1275 - protein, 29 aa, Artificial Sequence
  Description of Artificial Sequence: Synthetic peptide
DEEEIRTTNPVATEQYGSGSTNLQREGNR

SEQ ID NO: 1276 - protein, 28 aa, Artificial Sequence
  Description of Artificial Sequence: Synthetic peptide
DEEEIGTTNPVATEQYGSVSTNLQRGNK

SEQ ID NO: 1277 - protein, 29 aa, Artificial Sequence
  Description of Artificial Sequence: Synthetic peptide
DEEEIGTTNPVATEQYGSVSTNLQRGNER

SEQ ID NO: 1278 - protein, 28 aa, Artificial Sequence
  Description of Artificial Sequence: Synthetic peptide
DEEEIGTTNPVATEQYGSVSTNLQRGNC

SEQ ID NO: 1279 - protein, 29 aa, Artificial Sequence
  Description of Artificial Sequence: Synthetic peptide
DEEEIRTTNPVATEQYGSVSTNNQRGQNR

SEQ ID NO: 1280 - protein, 28 aa, Artificial Sequence
  Description of Artificial Sequence: Synthetic peptide
DEEEIGTTNPVATEQYGSVSTNLQRGLR

SEQ ID NO: 1281 - protein, 28 aa, Artificial Sequence
  Description of Artificial Sequence: Synthetic peptide
DEEEIGTTNPVATEQYGSVSTNLQRGER

SEQ ID NO: 1282 - protein, 28 aa, Artificial Sequence
  Description of Artificial Sequence: Synthetic peptide
DEEEIRTTNPVATEQYGSGSTNLQRGNN

SEQ ID NO: 1283 - protein, 28 aa, Artificial Sequence
  Description of Artificial Sequence: Synthetic peptide
DEEEIGTTNPVATEQYGSVSTNLQAGNR

SEQ ID NO: 1284 - protein, 28 aa, Artificial Sequence
  Description of Artificial Sequence: Synthetic peptide
DEEEIRTTNPVATEQYGSGSTNLQRGNM

SEQ ID NO: 1285 - protein, 28 aa, Artificial Sequence
  Description of Artificial Sequence: Synthetic peptide
DEEEIGTTNPVATEQYGSVSTNLQRGNF

SEQ ID NO: 1286 - protein, 30 aa, Artificial Sequence
  Description of Artificial Sequence: Synthetic polypeptide
DEEEIRTTNPVATEQYGSVSTNPLQRLGNR

SEQ ID NO: 1287 - protein, 29 aa, Artificial Sequence
  Description of Artificial Sequence: Synthetic peptide
DEYEIRTTNPVATEQYGSVSTLNLQRGNR

SEQ ID NO: 1288 - protein, 29 aa, Artificial Sequence
  Description of Artificial Sequence: Synthetic peptide
DEEEIRTTNPVATEQYGSQVSTNLQRGNS

SEQ ID NO: 1289 - protein, 29 aa, Artificial Sequence
  Description of Artificial Sequence: Synthetic peptide
DEEEIRTTNPVATEQYGSVSTNPQTRGNR

SEQ ID NO: 1290 - protein, 29 aa, Artificial Sequence
  Description of Artificial Sequence: Synthetic peptide
DEYEIRTTNPVATEQYGSVSTNLQTRGNR

SEQ ID NO: 1291 - protein, 29 aa, Artificial Sequence
  Description of Artificial Sequence: Synthetic peptide
DEEEIRTTNPVATEQYGSVSTNLSQIGNR

SEQ ID NO: 1292 - protein, 28 aa, Artificial Sequence
  Description of Artificial Sequence: Synthetic peptide
DEEEIRTTNPVATEQYGSRSDNLQRGNR

SEQ ID NO: 1293 - protein, 28 aa, Artificial Sequence
  Description of Artificial Sequence: Synthetic peptide
DEEEIRTTNPVATEQYGSRSTNLQRGNA

SEQ ID NO: 1294 - protein, 28 aa, Artificial Sequence
  Description of Artificial Sequence: Synthetic peptide
DEEEIRTTNPVATEQYGSRSTNLQRGNE

SEQ ID NO: 1295 - protein, 29 aa, Artificial Sequence
  Description of Artificial Sequence: Synthetic peptide
DEYEIRTTNPVATSEQYGSVSTNLQRGNR

SEQ ID NO: 1296 - protein, 30 aa, Artificial Sequence
  Description of Artificial Sequence: Synthetic polypeptide
DEEEIRTTNPVATEQYGSVSTNQLEQRGNR

SEQ ID NO: 1297 - protein, 29 aa, Artificial Sequence
  Description of Artificial Sequence: Synthetic peptide
DEYEIRTTNPVATEQYGSVSTNLQRNGNR

SEQ ID NO: 1298 - protein, 29 aa, Artificial Sequence
  Description of Artificial Sequence: Synthetic peptide
DEEEIRTTNPVATEQYGSVSTNQLQAGNR

SEQ ID NO: 1299 - protein, 28 aa, Artificial Sequence
  Description of Artificial Sequence: Synthetic peptide
DEEEIRTTNPTATEQYGSVSQNLQRGNR

SEQ ID NO: 1300 - protein, 28 aa, Artificial Sequence
  Description of Artificial Sequence: Synthetic peptide
DEDEIRTTNPVASEQYGSVSTNLQRGNR

SEQ ID NO: 1301 - protein, 29 aa, Artificial Sequence
  Description of Artificial Sequence: Synthetic peptide
DEEEIRTTNPVATEQYGSRVSTNLQGGNR

SEQ ID NO: 1302 - protein, 28 aa, Artificial Sequence
  Description of Artificial Sequence: Synthetic peptide
DEEEIGTTNPVATEQYGSTSTNLQRGNR

SEQ ID NO: 1303 - protein, 29 aa, Artificial Sequence
  Description of Artificial Sequence: Synthetic peptide
DEEEIRTTNPVATEQYGSVSTNQLQFGNR

SEQ ID NO: 1304 - protein, 28 aa, Artificial Sequence
  Description of Artificial Sequence: Synthetic peptide
DEEEIGTTNPVATEQYGSCSTNLQRGNR

SEQ ID NO: 1305 - protein, 30 aa, Artificial Sequence
  Description of Artificial Sequence: Synthetic polypeptide
DEEEIRTTNPVATEQYGSVSTNQLQRGMNR

SEQ ID NO: 1306 - protein, 30 aa, Artificial Sequence
  Description of Artificial Sequence: Synthetic polypeptide
DEEEIRTTNPVATEQYGSVSTNQLQRGNCR

SEQ ID NO: 1307 - protein, 29 aa, Artificial Sequence
  Description of Artificial Sequence: Synthetic peptide
DEEEIRTTNPVATEQYGSRSTNLQRGNRE

SEQ ID NO: 1308 - protein, 28 aa, Artificial Sequence
  Description of Artificial Sequence: Synthetic peptide
DEEEIRTTNPVATEQYGSVSTNPQRGVR

SEQ ID NO: 1309 - protein, 28 aa, Artificial Sequence
  Description of Artificial Sequence: Synthetic peptide
DEYEIRTTNPVATEQYGSVSTNLQRGSR

SEQ ID NO: 1310 - protein, 29 aa, Artificial Sequence
  Description of Artificial Sequence: Synthetic peptide
DEEEIRTTNPVATEQYGSVSTNPQRGNRI

SEQ ID NO: 1311 - protein, 30 aa, Artificial Sequence
  Description of Artificial Sequence: Synthetic polypeptide
DEEEIRTTNPVATEQYGSVSTNPLQRNGNR

SEQ ID NO: 1312 - protein, 29 aa, Artificial Sequence
  Description of Artificial Sequence: Synthetic peptide
DEEEIRTTNPVATEQYGSVSTNPLQRPNR

SEQ ID NO: 1313 - protein, 30 aa, Artificial Sequence
  Description of Artificial Sequence: Synthetic polypeptide
DEEEIRTTNPVATEQYGSVSTNPLWQRGNR

SEQ ID NO: 1314 - protein, 29 aa, Artificial Sequence
  Description of Artificial Sequence: Synthetic peptide
DEYEIRTTNPVATEQYGSVSTNLGQRGNR

SEQ ID NO: 1315 - protein, 29 aa, Artificial Sequence
  Description of Artificial Sequence: Synthetic peptide
DEYEIRTTNPVATEQYGSVSTNLPQRGNR

SEQ ID NO: 1316 - protein, 28 aa, Artificial Sequence
  Description of Artificial Sequence: Synthetic peptide
DEYEIRTTNPVATEQYGSVSTNLQHGNR

SEQ ID NO: 1317 - protein, 29 aa, Artificial Sequence
  Description of Artificial Sequence: Synthetic peptide
DEEEIRTTNPVATEQYGSVSTNPNQRGNR

SEQ ID NO: 1318 - protein, 28 aa, Artificial Sequence
  Description of Artificial Sequence: Synthetic peptide
DEEEIGTTNPVATEQYGSVSENLQRGNR

SEQ ID NO: 1319 - protein, 29 aa, Artificial Sequence
  Description of Artificial Sequence: Synthetic peptide
DEYEIRTTNPVATEQYGSVSTNLQIRGNR

SEQ ID NO: 1320 - protein, 28 aa, Artificial Sequence
  Description of Artificial Sequence: Synthetic peptide
DEYEIRTTNPVATEQYGSVSTNLQRGIR

SEQ ID NO: 1321 - protein, 29 aa, Artificial Sequence
  Description of Artificial Sequence: Synthetic peptide
DEYEIRTTNPVATEQYGSVSTNLQRGNDR

SEQ ID NO: 1322 - protein, 28 aa, Artificial Sequence
  Description of Artificial Sequence: Synthetic peptide
DEYEIRTTNPVATEQYGSVSTNLQRGNQ

SEQ ID NO: 1323 - protein, 29 aa, Artificial Sequence
  Description of Artificial Sequence: Synthetic peptide
DEEEIRTTNPVATEQYGSVSEVNLQRGNR

SEQ ID NO: 1324 - protein, 28 aa, Artificial Sequence
  Description of Artificial Sequence: Synthetic peptide
DEEEIRTTNPVATEQYGSVSTNPQRGNE

SEQ ID NO: 1325 - protein, 29 aa, Artificial Sequence
  Description of Artificial Sequence: Synthetic peptide
DEYEIRTTNPVATEQYGSVSTNLQRGNRL

SEQ ID NO: 1326 - protein, 28 aa, Artificial Sequence
  Description of Artificial Sequence: Synthetic peptide
DEYEIRTTNPVATEQYGSVSTNLQRGNY

SEQ ID NO: 1327 - protein, 29 aa, Artificial Sequence
  Description of Artificial Sequence: Synthetic peptide
DEEEIRTTNPVATEQYGSVSTNPQRGNFR

SEQ ID NO: 1328 - protein, 30 aa, Artificial Sequence
  Description of Artificial Sequence: Synthetic polypeptide
DEEEIRTTNPVATEQYGSQVSWTNLQRGNR

SEQ ID NO: 1329 - protein, 29 aa, Artificial Sequence
  Description of Artificial Sequence: Synthetic peptide
DEEEIRTTNPVATEQYGSVSTNPQRGNRA

SEQ ID NO: 1330 - protein, 28 aa, Artificial Sequence
  Description of Artificial Sequence: Synthetic peptide
AEEEIRTTNPVATEQYGSVSTTLQRGNR

SEQ ID NO: 1331 - protein, 28 aa, Artificial Sequence
  Description of Artificial Sequence: Synthetic peptide
DEEEIGTTNPVATEQYGSVSTNLYRGNR

SEQ ID NO: 1332 - protein, 29 aa, Artificial Sequence
  Description of Artificial Sequence: Synthetic peptide
DEEEIRTTNPVATEQYGSVSTDNLQRWNR

SEQ ID NO: 1333 - protein, 29 aa, Artificial Sequence
  Description of Artificial Sequence: Synthetic peptide
DEEEIRTTNPVATEQYGSVSTNNQRGNGR

SEQ ID NO: 1334 - protein, 30 aa, Artificial Sequence
  Description of Artificial Sequence: Synthetic polypeptide
DEEEIRTTNPVATEQYGSVSTNNLQRGNYR

SEQ ID NO: 1335 - protein, 28 aa, Artificial Sequence
  Description of Artificial Sequence: Synthetic peptide
DEEEIRTTNPSATEQYGSVSTLLQRGNR

SEQ ID NO: 1336 - protein, 29 aa, Artificial Sequence
  Description of Artificial Sequence: Synthetic peptide
DEEEIRTTNPSATEQYGSVSTLNLQRGNR

SEQ ID NO: 1337 - protein, 28 aa, Artificial Sequence
  Description of Artificial Sequence: Synthetic peptide
DEEEIRTTNPSATEQYGSVSTNAQRGNR

SEQ ID NO: 1338 - protein, 28 aa, Artificial Sequence
  Description of Artificial Sequence: Synthetic peptide
DEEEIRTTNPSATEQYGSVSTNLNRGNR

SEQ ID NO: 1339 - protein, 29 aa, Artificial Sequence
  Description of Artificial Sequence: Synthetic peptide
DEEEIRTTNPSATEQYGSVSTNLQRAGNR

SEQ ID NO: 1340 - protein, 30 aa, Artificial Sequence
  Description of Artificial Sequence: Synthetic polypeptide
DEEEIRTTNPVATEQYGSVSTNNLQRNGNR

SEQ ID NO: 1341 - protein, 29 aa, Artificial Sequence
  Description of Artificial Sequence: Synthetic peptide
DEEEIRTTNPSATEQYGSVSTNLQRGNGR

SEQ ID NO: 1342 - protein, 29 aa, Artificial Sequence
  Description of Artificial Sequence: Synthetic peptide
DEEEIRTTNPSATEQYGSVSNTNLQRGNR

SEQ ID NO: 1343 - protein, 29 aa, Artificial Sequence
  Description of Artificial Sequence: Synthetic peptide
DEEEIHTTNPVATEQYGSVSTNLQRGNIR

SEQ ID NO: 1344 - protein, 29 aa, Artificial Sequence
  Description of Artificial Sequence: Synthetic peptide
DEEEIRTTNPSATEQYGSVSTNLQRGNRL

SEQ ID NO: 1345 - protein, 28 aa, Artificial Sequence
  Description of Artificial Sequence: Synthetic peptide
DEEEIRTTNPSATEQYGSVSTNLQRGNY

SEQ ID NO: 1346 - protein, 28 aa, Artificial Sequence
  Description of Artificial Sequence: Synthetic peptide
DEEEIHTTNPVATEQYGSVSTNLQRGIR

SEQ ID NO: 1347 - protein, 29 aa, Artificial Sequence
  Description of Artificial Sequence: Synthetic peptide
DEEEIHTTNPVATEQYGSVSTNLQDRGNR

SEQ ID NO: 1348 - protein, 30 aa, Artificial Sequence
  Description of Artificial Sequence: Synthetic polypeptide
DEEEIRTTNPVATEQYGSGVSTNLQERGNR

SEQ ID NO: 1349 - protein, 29 aa, Artificial Sequence
  Description of Artificial Sequence: Synthetic peptide
DEEEIRTTNPVATEQYGSVSTNLSRGLNR

SEQ ID NO: 1350 - protein, 28 aa, Artificial Sequence
  Description of Artificial Sequence: Synthetic peptide
DEEEIHTTNPVATEQYGSVSTNLDRGNR

SEQ ID NO: 1351 - protein, 28 aa, Artificial Sequence
  Description of Artificial Sequence: Synthetic peptide
DEEEIRTTNPSATEQYGSVSTNLQRGVR

SEQ ID NO: 1352 - protein, 29 aa, Artificial Sequence
  Description of Artificial Sequence: Synthetic peptide
DEEEIRTTNPSATEQYGSVSTNLQRGNRC

SEQ ID NO: 1353 - protein, 29 aa, Artificial Sequence
  Description of Artificial Sequence: Synthetic peptide
DEEEIHTTNPVATEQYGSVSTNLQRGNRV

SEQ ID NO: 1354 - protein, 28 aa, Artificial Sequence
  Description of Artificial Sequence: Synthetic peptide
DEEEIHTTNPVATEQYGSVSTNLQRGNS

SEQ ID NO: 1355 - protein, 28 aa, Artificial Sequence
  Description of Artificial Sequence: Synthetic peptide
DEEEIHTTNPVATEQYGSVSTNLQRGNV

SEQ ID NO: 1356 - protein, 29 aa, Artificial Sequence
  Description of Artificial Sequence: Synthetic peptide
DEEEIRTTNPSATEQYGSVGSTNLQRGNR

SEQ ID NO: 1357 - protein, 29 aa, Artificial Sequence
  Description of Artificial Sequence: Synthetic peptide
DEEEIITTNPVATEQYGSVSTNLQRGNER

SEQ ID NO: 1358 - protein, 28 aa, Artificial Sequence
  Description of Artificial Sequence: Synthetic peptide
DEEEIITTNPVATEQYGSVSTNLQRGND

SEQ ID NO: 1359 - protein, 28 aa, Artificial Sequence
  Description of Artificial Sequence: Synthetic peptide
DEEEIITTNPVATEQYGSVSTNLQRGER

SEQ ID NO: 1360 - protein, 28 aa, Artificial Sequence
  Description of Artificial Sequence: Synthetic peptide
DEEEIITTNPVATEQYGSVSTNLQRGDR

SEQ ID NO: 1361 - protein, 30 aa, Artificial Sequence
  Description of Artificial Sequence: Synthetic polypeptide
DEEEIRTTNPVATEQYGSVSTNNLQRGNRP

SEQ ID NO: 1362 - protein, 28 aa, Artificial Sequence
  Description of Artificial Sequence: Synthetic peptide
DEEEIITTNPVATEQYGSVSTNLQLGNR

SEQ ID NO: 1363 - protein, 28 aa, Artificial Sequence
  Description of Artificial Sequence: Synthetic peptide
DEEEIITTNPVATEQYGSVSTNLQHGNR

SEQ ID NO: 1364 - protein, 28 aa, Artificial Sequence
  Description of Artificial Sequence: Synthetic peptide
DEEEIITTNPVATEQYGSVSANLQRGNR

SEQ ID NO: 1365 - protein, 28 aa, Artificial Sequence
  Description of Artificial Sequence: Synthetic peptide
DEEEIITTNPVAFEQYGSVSTNLQRGNR

SEQ ID NO: 1366 - protein, 29 aa, Artificial Sequence
  Description of Artificial Sequence: Synthetic peptide
DEEEIRTTNPVATEQYGSPPSTNLQRGNR

SEQ ID NO: 1367 - protein, 28 aa, Artificial Sequence
  Description of Artificial Sequence: Synthetic peptide
DEEEIHTTNPVATEQYGTVSTNLQRGNR

SEQ ID NO: 1368 - protein, 28 aa, Artificial Sequence
  Description of Artificial Sequence: Synthetic peptide
DEEEIRTTNPVATEQYGSPSTNLQRGND

SEQ ID NO: 1369 - protein, 29 aa, Artificial Sequence
  Description of Artificial Sequence: Synthetic peptide
DEEEIHTTNPVATEQYGSVSTQNLQRGNR

SEQ ID NO: 1370 - protein, 28 aa, Artificial Sequence
  Description of Artificial Sequence: Synthetic peptide
DEEEIHTTNPVATEQYGSVSTQLQRGNR

SEQ ID NO: 1371 - protein, 28 aa, Artificial Sequence
  Description of Artificial Sequence: Synthetic peptide
DEEEIHTTNPVATEQYGSVSTPLQRGNR

SEQ ID NO: 1372 - protein, 28 aa, Artificial Sequence
  Description of Artificial Sequence: Synthetic peptide
DEEEIHTTNPVATEQYGSVSTNLTRGNR

SEQ ID NO: 1373 - protein, 29 aa, Artificial Sequence
  Description of Artificial Sequence: Synthetic peptide
DEEEIHTTNPVATEQYGSVSTNLQRYGNR

SEQ ID NO: 1374 - protein, 28 aa, Artificial Sequence
  Description of Artificial Sequence: Synthetic peptide
DEEEIHTTNPVATEQYGSVSTNLQRGSR

SEQ ID NO: 1375 - protein, 28 aa, Artificial Sequence
  Description of Artificial Sequence: Synthetic peptide
DEEEIRTTNPSATEQYGSVSTNLQYGNR

SEQ ID NO: 1376 - protein, 29 aa, Artificial Sequence
  Description of Artificial Sequence: Synthetic peptide
DEEEIRTTNPVATEQYGSVSTNLSLRGNR

SEQ ID NO: 1377 - protein, 29 aa, Artificial Sequence
  Description of Artificial Sequence: Synthetic peptide
DEEEIRTTNPVATEQYGSPVSTNLDRGNR

SEQ ID NO: 1378 - protein, 28 aa, Artificial Sequence
  Description of Artificial Sequence: Synthetic peptide
DEEEIHTTNPVATEQYGSVSDNLQRGNR

SEQ ID NO: 1379 - protein, 28 aa, Artificial Sequence
  Description of Artificial Sequence: Synthetic peptide
DEEEIGTTNPVATEQYGYVSTNLQRGNR

SEQ ID NO: 1380 - protein, 28 aa, Artificial Sequence
  Description of Artificial Sequence: Synthetic peptide
DEEEIRTTNPVATEQYGSGSTNLQRTNR

SEQ ID NO: 1381 - protein, 29 aa, Artificial Sequence
  Description of Artificial Sequence: Synthetic peptide
DEVEEIRTTNPVATGQYGSVSTNLQRGNR

SEQ ID NO: 1382 - protein, 28 aa, Artificial Sequence
  Description of Artificial Sequence: Synthetic peptide
DEYEINTTNPVATEQYGSVSTNLQRGNR

SEQ ID NO: 1383 - protein, 29 aa, Artificial Sequence
  Description of Artificial Sequence: Synthetic peptide
DEEEIRTTNPVATEQYGSVSTNLSQRGNQ

SEQ ID NO: 1384 - protein, 28 aa, Artificial Sequence
  Description of Artificial Sequence: Synthetic peptide
DEEEIGTTNPVATEQYGSVSTVLQRGNR

SEQ ID NO: 1385 - protein, 30 aa, Artificial Sequence
  Description of Artificial Sequence: Synthetic polypeptide
DEEEIRTTNPVATEQYGSVSTDNLQREGNR

SEQ ID NO: 1386 - protein, 30 aa, Artificial Sequence
  Description of Artificial Sequence: Synthetic polypeptide
DEEEIRTTNPVATEQYGSQVSTNGLQRGNR

SEQ ID NO: 1387 - protein, 28 aa, Artificial Sequence
  Description of Artificial Sequence: Synthetic peptide
DEEEIRTTNPVATEQYGSGSTNVQRGNR

SEQ ID NO: 1388 - protein, 30 aa, Artificial Sequence
  Description of Artificial Sequence: Synthetic polypeptide
DEEEIRTTNPVATEQYGSQVSTNLLQRGNR

SEQ ID NO: 1389 - protein, 30 aa, Artificial Sequence
  Description of Artificial Sequence: Synthetic polypeptide
DEEEIRTTNPVATEQYGSVSTDNLQRGNRW

SEQ ID NO: 1390 - protein, 30 aa, Artificial Sequence
  Description of Artificial Sequence: Synthetic polypeptide
DEEEIRTTNPVATEQYGSVSTDNLQRGVNR

SEQ ID NO: 1391 - protein, 28 aa, Artificial Sequence
  Description of Artificial Sequence: Synthetic peptide
DEEEIRTTNPVATEQYGSGSTNLQRGNS

SEQ ID NO: 1392 - protein, 29 aa, Artificial Sequence
  Description of Artificial Sequence: Synthetic peptide
DEEEIRTTNPVATEQYGSVSTNNQNRGNR

SEQ ID NO: 1393 - protein, 29 aa, Artificial Sequence
  Description of Artificial Sequence: Synthetic peptide
DEEEIRTTNPVATEQYGSQVSTNLQFGNR

SEQ ID NO: 1394 - protein, 28 aa, Artificial Sequence
  Description of Artificial Sequence: Synthetic peptide
DEEEIRTTNPTATEEYGSVSTNLQRGNR

SEQ ID NO: 1395 - protein, 29 aa, Artificial Sequence
  Description of Artificial Sequence: Synthetic peptide
DEEEIRTTNPVATEQYGSVSTNNQRDGNR

SEQ ID NO: 1396 - protein, 28 aa, Artificial Sequence
  Description of Artificial Sequence: Synthetic peptide
DEEEIRTTNPVATEQYGSVSTNNQRGNA

SEQ ID NO: 1397 - protein, 29 aa, Artificial Sequence
  Description of Artificial Sequence: Synthetic peptide
DEEEIRTTNPVATEQYGSVSFTNLQRGNP

SEQ ID NO: 1398 - protein, 30 aa, Artificial Sequence
  Description of Artificial Sequence: Synthetic polypeptide
DEEEIRTTNPVATEQYGSVSTNLSQRPGNR

SEQ ID NO: 1399 - protein, 29 aa, Artificial Sequence
  Description of Artificial Sequence: Synthetic peptide
DEEEIRTTNPVATEQYGSVSFENLQRGNR

SEQ ID NO: 1400 - protein, 28 aa, Artificial Sequence
  Description of Artificial Sequence: Synthetic peptide
DEEEIRTTNPVATEQYGSVSFFLQRGNR

SEQ ID NO: 1401 - protein, 28 aa, Artificial Sequence
  Description of Artificial Sequence: Synthetic peptide
DEEEIHTTNPVATEQYGSASTNLQRGNR

SEQ ID NO: 1402 - protein, 30 aa, Artificial Sequence
  Description of Artificial Sequence: Synthetic polypeptide
DEEEIRTTNPVATEQYGSVSTNNLQRQGNR

SEQ ID NO: 1403 - protein, 28 aa, Artificial Sequence
  Description of Artificial Sequence: Synthetic peptide
DEEEIHTTNPVATEQYGIVSTNLQRGNR

SEQ ID NO: 1404 - protein, 29 aa, Artificial Sequence
  Description of Artificial Sequence: Synthetic peptide
DEEEIRTTNPVATEQYGSVSTNLSRGFNR

SEQ ID NO: 1405 - protein, 30 aa, Artificial Sequence
  Description of Artificial Sequence: Synthetic polypeptide
DEEEIRTTNPVATEQYGSVSTNNLQRVGNR

SEQ ID NO: 1406 - protein, 29 aa, Artificial Sequence
  Description of Artificial Sequence: Synthetic peptide
DEEEIRTTNPVATEQYGSQLSTNLQRGNR

SEQ ID NO: 1407 - protein, 28 aa, Artificial Sequence
  Description of Artificial Sequence: Synthetic peptide
DEEEIRTTNPTAEEQYGSVSTNLQRGNR

SEQ ID NO: 1408 - protein, 28 aa, Artificial Sequence
  Description of Artificial Sequence: Synthetic peptide
DEEEIHTTNPCATEQYGSVSTNLQRGNR

SEQ ID NO: 1409 - protein, 29 aa, Artificial Sequence
  Description of Artificial Sequence: Synthetic peptide
DEEEIRTTNPVATEQYGSVSTNLSRGANR

SEQ ID NO: 1410 - protein, 28 aa, Artificial Sequence
  Description of Artificial Sequence: Synthetic peptide
DEEEIRTTNPVATEQYGSQSPNLQRGNR

SEQ ID NO: 1411 - protein, 30 aa, Artificial Sequence
  Description of Artificial Sequence: Synthetic polypeptide
DEEEIRTTNPVATEQYGSVSKTENLQRGNR

SEQ ID NO: 1412 - protein, 29 aa, Artificial Sequence
  Description of Artificial Sequence: Synthetic peptide
DEEEIRTTNPVATEQYGSQSTNLQRGNQR

SEQ ID NO: 1413 - protein, 29 aa, Artificial Sequence
  Description of Artificial Sequence: Synthetic peptide
DEEEIRTTNPVATEQYGSQSTNLQRGNRM

SEQ ID NO: 1414 - protein, 28 aa, Artificial Sequence
  Description of Artificial Sequence: Synthetic peptide
DEEEIRTTNPVATEQYGSQSTNLQRGNV

SEQ ID NO: 1415 - protein, 29 aa, Artificial Sequence
  Description of Artificial Sequence: Synthetic peptide
DEEEIRTTNPVATEQYGSGVETNLQRGNR

SEQ ID NO: 1416 - protein, 29 aa, Artificial Sequence
  Description of Artificial Sequence: Synthetic peptide
DEEEIRTTNPVATEQYGSQSTPNLQRGNR

SEQ ID NO: 1417 - protein, 29 aa, Artificial Sequence
  Description of Artificial Sequence: Synthetic peptide
DEEEIRTTNPVATEQYGSQSTVNLQRGNR

SEQ ID NO: 1418 - protein, 29 aa, Artificial Sequence
  Description of Artificial Sequence: Synthetic peptide
DEEEIRTTNPVATEQYGSQSTYNLQRGNR

SEQ ID NO: 1419 - protein, 28 aa, Artificial Sequence
  Description of Artificial Sequence: Synthetic peptide
DEEEIRTTNPVATEQYGSVSTDHQRGNR

SEQ ID NO: 1420 - protein, 29 aa, Artificial Sequence
  Description of Artificial Sequence: Synthetic peptide
DEEEIRTTNPVATEQYGSVSTNNLQRPNR

SEQ ID NO: 1421 - protein, 28 aa, Artificial Sequence
  Description of Artificial Sequence: Synthetic peptide
DETEIRTTNPVAVEQYGSVSTNLQRGNR

SEQ ID NO: 1422 - protein, 29 aa, Artificial Sequence
  Description of Artificial Sequence: Synthetic peptide
DEEEIRTTNPVATEQYGSVSTNQLQRPNR

SEQ ID NO: 1423 - protein, 29 aa, Artificial Sequence
  Description of Artificial Sequence: Synthetic peptide
DEEEIRTTNPVATEQYGSSCSTNLQRGNR

SEQ ID NO: 1424 - protein, 29 aa, Artificial Sequence
  Description of Artificial Sequence: Synthetic peptide
DETEIRTTNPVATEQYGSVQSTNLQRGNR

SEQ ID NO: 1425 - protein, 30 aa, Artificial Sequence
  Description of Artificial Sequence: Synthetic polypeptide
DEEEIRTTNPVATEQYGSSVSTNLYQRGNR

SEQ ID NO: 1426 - protein, 28 aa, Artificial Sequence
  Description of Artificial Sequence: Synthetic peptide
DEDEIRTTNPVATDQYGSVSTNLQRGNR

SEQ ID NO: 1427 - protein, 29 aa, Artificial Sequence
  Description of Artificial Sequence: Synthetic peptide
DEEEIRTTNPTATEQYGSVVSTNLQRGNR

SEQ ID NO: 1428 - protein, 28 aa, Artificial Sequence
  Description of Artificial Sequence: Synthetic peptide
DEEEIRTTNPTATEQYGTVSTNLQRGNR

SEQ ID NO: 1429 - protein, 30 aa, Artificial Sequence
  Description of Artificial Sequence: Synthetic polypeptide
DEEEIRTTNPVATEQYGSSVSTNNLQRGNR

SEQ ID NO: 1430 - protein, 30 aa, Artificial Sequence
  Description of Artificial Sequence: Synthetic polypeptide
DEEEIRTTNPVATEQYGSSVSTNQLQRGNR

SEQ ID NO: 1431 - protein, 28 aa, Artificial Sequence
  Description of Artificial Sequence: Synthetic peptide
DETEIRTTNPVATEQYGSVGTNLQRGNR

SEQ ID NO: 1432 - protein, 29 aa, Artificial Sequence
  Description of Artificial Sequence: Synthetic peptide
DEEEIRTTNPVATEQYGSSVSTNLQVGNR

SEQ ID NO: 1433 - protein, 29 aa, Artificial Sequence
  Description of Artificial Sequence: Synthetic peptide
DETEIRTTNPVATEQYGSVESTNLQRGNR

SEQ ID NO: 1434 - protein, 29 aa, Artificial Sequence
  Description of Artificial Sequence: Synthetic peptide
DEEEIRTTNPVATEQYGSVSTNSQQRGNR

SEQ ID NO: 1435 - protein, 30 aa, Artificial Sequence
  Description of Artificial Sequence: Synthetic polypeptide
DEEEIRTTNPVATEQYGSSVSTNVLQRGNR

SEQ ID NO: 1436 - protein, 29 aa, Artificial Sequence
  Description of Artificial Sequence: Synthetic peptide
DEEEIRTTNPVATEQYGSSVSTQLQRGNR

SEQ ID NO: 1437 - protein, 30 aa, Artificial Sequence
  Description of Artificial Sequence: Synthetic polypeptide
DEEEIRTTNPVATEQYGSVSTNLQYREGNR

SEQ ID NO: 1438 - protein, 28 aa, Artificial Sequence
  Description of Artificial Sequence: Synthetic peptide
DEEEIRTTNPVATEQYGSVSTNSQRGNH

SEQ ID NO: 1439 - protein, 28 aa, Artificial Sequence
  Description of Artificial Sequence: Synthetic peptide
DEEEIRTTNPVATEQYGSVSTNSQRGNI

SEQ ID NO: 1440 - protein, 29 aa, Artificial Sequence
  Description of Artificial Sequence: Synthetic peptide
DEEEIRTTNPVATEQYGSVSTNSQRGNMR

SEQ ID NO: 1441 - protein, 29 aa, Artificial Sequence
  Description of Artificial Sequence: Synthetic peptide
DEEEIRTTNPVATEQYGSVSTNSQRLGNR

SEQ ID NO: 1442 - protein, 30 aa, Artificial Sequence
  Description of Artificial Sequence: Synthetic polypeptide
DEEEIRTTNPVATEQYGSVSTNLQYRGMNR

SEQ ID NO: 1443 - protein, 30 aa, Artificial Sequence
  Description of Artificial Sequence: Synthetic polypeptide
DEEEIRTTNPVATEQYGSSVSTNLQRPGNR

SEQ ID NO: 1444 - protein, 30 aa, Artificial Sequence
  Description of Artificial Sequence: Synthetic polypeptide
DEEEIRTTNPVATEQYGSSVSTNLQRLGNR

SEQ ID NO: 1445 - protein, 30 aa, Artificial Sequence
  Description of Artificial Sequence: Synthetic polypeptide
DEEEIRTTNPVATEQYGSSVSTNLQRGYNR

SEQ ID NO: 1446 - protein, 30 aa, Artificial Sequence
  Description of Artificial Sequence: Synthetic polypeptide
DEEEIRTTNPVATEQYGSSVSTNLEQRGNR

SEQ ID NO: 1447 - protein, 30 aa, Artificial Sequence
  Description of Artificial Sequence: Synthetic polypeptide
DEEEIRTTNPVATEQYGSSVSTNLLQRGNR

SEQ ID NO: 1448 - protein, 28 aa, Artificial Sequence
  Description of Artificial Sequence: Synthetic peptide
SEEEIRGTNPVATEQYGSVSTNLQRGNR

SEQ ID NO: 1449 - protein, 28 aa, Artificial Sequence
  Description of Artificial Sequence: Synthetic peptide
DETEIRTTNPVATEQYGSVSTDLQRGNR

SEQ ID NO: 1450 - protein, 30 aa, Artificial Sequence
  Description of Artificial Sequence: Synthetic polypeptide
DEEEIRTTNPVATEQYGSSVSTNLQPRGNR

SEQ ID NO: 1451 - protein, 29 aa, Artificial Sequence
  Description of Artificial Sequence: Synthetic peptide
DEEEIRTTNPVATEQYGSVSTNLQYRGNM

SEQ ID NO: 1452 - protein, 30 aa, Artificial Sequence
  Description of Artificial Sequence: Synthetic polypeptide
DEEEIRTTNPVATEQYGSVSTNSLQFRGNR

SEQ ID NO: 1453 - protein, 29 aa, Artificial Sequence
  Description of Artificial Sequence: Synthetic peptide
DEEEIRTTNPVATEQYGSSVSTNLQRANR

SEQ ID NO: 1454 - protein, 29 aa, Artificial Sequence
  Description of Artificial Sequence: Synthetic peptide
DEEEIRTTNPVATEQYGSVSTNLQYRGNE

SEQ ID NO: 1455 - protein, 29 aa, Artificial Sequence
  Description of Artificial Sequence: Synthetic peptide
DEEEIRTTNPVATEQYGSVSTNSLQRGNQ

SEQ ID NO: 1456 - protein, 29 aa, Artificial Sequence
  Description of Artificial Sequence: Synthetic peptide
DEEEIRTTNPVATEQYGSSVSTNLQRDNR

SEQ ID NO: 1457 - protein, 29 aa, Artificial Sequence
  Description of Artificial Sequence: Synthetic peptide
DEEEIRTTNPVATEQYGSSVSTNLQRGER

SEQ ID NO: 1458 - protein, 30 aa, Artificial Sequence
  Description of Artificial Sequence: Synthetic polypeptide
DEEEIRTTNPVATEQYGSSVSTNLQRGGNR

SEQ ID NO: 1459 - protein, 30 aa, Artificial Sequence
  Description of Artificial Sequence: Synthetic polypeptide
DEEEIRTTNPVATEQYGSSVSTNLQRGLNR

SEQ ID NO: 1460 - protein, 29 aa, Artificial Sequence
  Description of Artificial Sequence: Synthetic peptide
SEEEIRTTNPVATEQYGSVSTNPLQRGNR

SEQ ID NO: 1461 - protein, 30 aa, Artificial Sequence
  Description of Artificial Sequence: Synthetic polypeptide
DEEEIRTTNPVATEQYGSVSTNSLQRGVNR

SEQ ID NO: 1462 - protein, 29 aa, Artificial Sequence
  Description of Artificial Sequence: Synthetic peptide
DEEEIRTTNPVATEQYGSVSTNSLQTGNR

SEQ ID NO: 1463 - protein, 29 aa, Artificial Sequence
  Description of Artificial Sequence: Synthetic peptide
DEEEIRTTNPVATEQYGSSVSTNLQRGNT

SEQ ID NO: 1464 - protein, 29 aa, Artificial Sequence
  Description of Artificial Sequence: Synthetic peptide
DEEEIRTTNPVATEQYGSSVSTNLQRGTR

SEQ ID NO: 1465 - protein, 28 aa, Artificial Sequence
  Description of Artificial Sequence: Synthetic peptide
DEEEIRTTNPVATEQYGSVSTNSQRNNR

SEQ ID NO: 1466 - protein, 28 aa, Artificial Sequence
  Description of Artificial Sequence: Synthetic peptide
DEEEIRTTNPIATEQYGSVSTNGQRGNR

SEQ ID NO: 1467 - protein, 28 aa, Artificial Sequence
  Description of Artificial Sequence: Synthetic peptide
DEEEIRTTNPVATEQYGSVSTNSQRPNR

SEQ ID NO: 1468 - protein, 28 aa, Artificial Sequence
  Description of Artificial Sequence: Synthetic peptide
DETEIRTTNPVATEQYGSNSTNLQRGNR

SEQ ID NO: 1469 - protein, 28 aa, Artificial Sequence
  Description of Artificial Sequence: Synthetic peptide
DEEEIRTTNPVATEQYGSVSTNLQYGNM

SEQ ID NO: 1470 - protein, 28 aa, Artificial Sequence
  Description of Artificial Sequence: Synthetic peptide
DEEEIRTTNPVAAEQYGSVSTNLQRVNR

SEQ ID NO: 1471 - protein, 29 aa, Artificial Sequence
  Description of Artificial Sequence: Synthetic peptide
DEEEIRTTNPVATEQYGSVSTNLQYGNLR

SEQ ID NO: 1472 - protein, 28 aa, Artificial Sequence
  Description of Artificial Sequence: Synthetic peptide
DEEEIRTTNPIATEQYGSVSINLQRGNR

SEQ ID NO: 1473 - protein, 28 aa, Artificial Sequence
  Description of Artificial Sequence: Synthetic peptide
DEEEIRTTNPVAAEQYGSVSTNLQVGNR

SEQ ID NO: 1474 - protein, 29 aa, Artificial Sequence
  Description of Artificial Sequence: Synthetic peptide
DEEEIRTTNPVATEQYGSVSTCLSQRGNR

SEQ ID NO: 1475 - protein, 28 aa, Artificial Sequence
  Description of Artificial Sequence: Synthetic peptide
DEEEIRTTNPVACELYGSVSTNLQRGNR

SEQ ID NO: 1476 - protein, 29 aa, Artificial Sequence
  Description of Artificial Sequence: Synthetic peptide
DEEEIRTTNPVATEQYGSVSTCLQRWGNR

SEQ ID NO: 1477 - protein, 30 aa, Artificial Sequence
  Description of Artificial Sequence: Synthetic polypeptide
DEEEIRTTNPVATEQYGSVSTCNLQLRGNR

SEQ ID NO: 1478 - protein, 28 aa, Artificial Sequence
  Description of Artificial Sequence: Synthetic peptide
DEEEIRTTNPVATEQYGSVSTCLQRPNR

SEQ ID NO: 1479 - protein, 28 aa, Artificial Sequence
  Description of Artificial Sequence: Synthetic peptide
DEEEIRTTNPVACEQYGLVSTNLQRGNR

SEQ ID NO: 1480 - protein, 28 aa, Artificial Sequence
  Description of Artificial Sequence: Synthetic peptide
DEEEIRTTNPVATEQYGSVSTCLQRGPR

SEQ ID NO: 1481 - protein, 28 aa, Artificial Sequence
  Description of Artificial Sequence: Synthetic peptide
DEEEIRTTNPVATEQYGSVSTCLQRGNW

SEQ ID NO: 1482 - protein, 28 aa, Artificial Sequence
  Description of Artificial Sequence: Synthetic peptide
DMEEIRTTNPVATEQYGSVSTLLQRGNR

SEQ ID NO: 1483 - protein, 29 aa, Artificial Sequence
  Description of Artificial Sequence: Synthetic peptide
DMEEIRTTNPVATEQYGSVSTNLQFRGNR

SEQ ID NO: 1484 - protein, 30 aa, Artificial Sequence
  Description of Artificial Sequence: Synthetic polypeptide
DEEEIRTTNPVATEQYGSVSTNTLQERGNR

SEQ ID NO: 1485 - protein, 29 aa, Artificial Sequence
  Description of Artificial Sequence: Synthetic peptide
DEEEIRTTNPVATEQYGSVSTCLQRGNQR

SEQ ID NO: 1486 - protein, 28 aa, Artificial Sequence
  Description of Artificial Sequence: Synthetic peptide
SEEEIRCTNPVATEQYGSVSTNLQRGNR

SEQ ID NO: 1487 - protein, 28 aa, Artificial Sequence
  Description of Artificial Sequence: Synthetic peptide
DEEEIRTTNPVATEQYGSVSTCLQRMNR

SEQ ID NO: 1488 - protein, 29 aa, Artificial Sequence
  Description of Artificial Sequence: Synthetic peptide
DEEEIRTTNPVAAEQYGSVSTNLQRGNRQ

SEQ ID NO: 1489 - protein, 29 aa, Artificial Sequence
  Description of Artificial Sequence: Synthetic peptide
DEEEIRTTNPVATEQYGSVSTCNLQMGNR

SEQ ID NO: 1490 - protein, 30 aa, Artificial Sequence
  Description of Artificial Sequence: Synthetic polypeptide
DEEEIRTTNPVATEQYGSVSTCNLQRDGNR

SEQ ID NO: 1491 - protein, 29 aa, Artificial Sequence
  Description of Artificial Sequence: Synthetic peptide
DEEEIRTTNPVATEQYGSVSTNLQYNGNR

SEQ ID NO: 1492 - protein, 30 aa, Artificial Sequence
  Description of Artificial Sequence: Synthetic polypeptide
DEEEIRTTNPVATEQYGSVSTCNNLQRGNR

SEQ ID NO: 1493 - protein, 29 aa, Artificial Sequence
  Description of Artificial Sequence: Synthetic peptide
DEEEIRTTNPVATEQYGSVSTDNWQRGNR

SEQ ID NO: 1494 - protein, 30 aa, Artificial Sequence
  Description of Artificial Sequence: Synthetic polypeptide
DEEEIRTTNPVATEQYGSVSTCNLQVRGNR

SEQ ID NO: 1495 - protein, 28 aa, Artificial Sequence
  Description of Artificial Sequence: Synthetic peptide
DEEEIRTTNPVATEQYGSVSTNSSRGNR

SEQ ID NO: 1496 - protein, 28 aa, Artificial Sequence
  Description of Artificial Sequence: Synthetic peptide
DEEEIRTTNPVATEQYGSVSTNSVRGNR

SEQ ID NO: 1497 - protein, 29 aa, Artificial Sequence
  Description of Artificial Sequence: Synthetic peptide
DEEEIRTTNPVATEQYGSVSTCNLQRGQR

SEQ ID NO: 1498 - protein, 29 aa, Artificial Sequence
  Description of Artificial Sequence: Synthetic peptide
SEEEIRTTNPVATEQYGSVSTTNLQRGNR

SEQ ID NO: 1499 - protein, 29 aa, Artificial Sequence
  Description of Artificial Sequence: Synthetic peptide
DEEEIRTTNPVATEQYGSVSTNSWQRGNR

SEQ ID NO: 1500 - protein, 28 aa, Artificial Sequence
  Description of Artificial Sequence: Synthetic peptide
DEEEIRTTNPVATEQYGSVSTNLQYGVR

SEQ ID NO: 1501 - protein, 29 aa, Artificial Sequence
  Description of Artificial Sequence: Synthetic peptide
DEEEIRTTNPVATEQYGSVSTNLQYGNTR

SEQ ID NO: 1502 - protein, 28 aa, Artificial Sequence
  Description of Artificial Sequence: Synthetic peptide
SEEEIRTTNPVATEQYGSVSTVLQRGNR

SEQ ID NO: 1503 - protein, 29 aa, Artificial Sequence
  Description of Artificial Sequence: Synthetic peptide
DEEEIRTTNPVATEQYGSVSTNLQYGNSR

SEQ ID NO: 1504 - protein, 29 aa, Artificial Sequence
  Description of Artificial Sequence: Synthetic peptide
DETEIRTTNPVATEQYGDSVSTNLQRGNR

SEQ ID NO: 1505 - protein, 28 aa, Artificial Sequence
  Description of Artificial Sequence: Synthetic peptide
DEEEIRTTNPVAAEQYGSVSTNLQPGNR

SEQ ID NO: 1506 - protein, 29 aa, Artificial Sequence
  Description of Artificial Sequence: Synthetic peptide
DEEEIRTTNPVATEQYGSVSTNLQYGNRN

SEQ ID NO: 1507 - protein, 28 aa, Artificial Sequence
  Description of Artificial Sequence: Synthetic peptide
DEEEIRTTNPVAAEQYGSVSTNLQRGGR

SEQ ID NO: 1508 - protein, 30 aa, Artificial Sequence
  Description of Artificial Sequence: Synthetic polypeptide
DEEEIRTTNPVATEQYGSFVSQTNLQRGNR

SEQ ID NO: 1509 - protein, 30 aa, Artificial Sequence
  Description of Artificial Sequence: Synthetic polypeptide
DEEEIRTTNPVATEQYGSVSTCNLQRGNGR

SEQ ID NO: 1510 - protein, 29 aa, Artificial Sequence
  Description of Artificial Sequence: Synthetic peptide
DEEEIRTTNPVATEQYGSVSTNSQRVGNR

SEQ ID NO: 1511 - protein, 28 aa, Artificial Sequence
  Description of Artificial Sequence: Synthetic peptide
DEEEIITTNPVATEQYGSVSTNLQRGNI

SEQ ID NO: 1512 - protein, 28 aa, Artificial Sequence
  Description of Artificial Sequence: Synthetic peptide
DEEEIRTTNPIATEQYGSVSTNLQCGNR

SEQ ID NO: 1513 - protein, 28 aa, Artificial Sequence
  Description of Artificial Sequence: Synthetic peptide
DLEEIRTTNPVATEQYGSVSTNLQRGNG

SEQ ID NO: 1514 - protein, 28 aa, Artificial Sequence
  Description of Artificial Sequence: Synthetic peptide
DEEEIRTTNPVATEQYGSVSTNQPRGNR

SEQ ID NO: 1515 - protein, 28 aa, Artificial Sequence
  Description of Artificial Sequence: Synthetic peptide
DEEEIRTTNPVATEQYGSVSTNLSCGNR

SEQ ID NO: 1516 - protein, 28 aa, Artificial Sequence
  Description of Artificial Sequence: Synthetic peptide
DEEEIRTTNPVATEQYGSVSTNQQNGNR

SEQ ID NO: 1517 - protein, 28 aa, Artificial Sequence
  Description of Artificial Sequence: Synthetic peptide
DEEEIRTTNPVATEQYGSVSTNLSAGNR

SEQ ID NO: 1518 - protein, 30 aa, Artificial Sequence
  Description of Artificial Sequence: Synthetic polypeptide
DEEEIRTTNPVATEQYGSVSFTNLQRGNTR

SEQ ID NO: 1519 - protein, 29 aa, Artificial Sequence
  Description of Artificial Sequence: Synthetic peptide
DEEEIRTTNPVATEQYGSVSTNQQRGNAR

SEQ ID NO: 1520 - protein, 28 aa, Artificial Sequence
  Description of Artificial Sequence: Synthetic peptide
DEEEIRTTNPVATEQYGSVSTNQQRGNE

SEQ ID NO: 1521 - protein, 28 aa, Artificial Sequence
  Description of Artificial Sequence: Synthetic peptide
DEEEIRTTNPVATEQYGSVSTNQQRGNF

SEQ ID NO: 1522 - protein, 29 aa, Artificial Sequence
  Description of Artificial Sequence: Synthetic peptide
DEEEIRTTNPVATEQYGSVSTNQPQRGNR

SEQ ID NO: 1523 - protein, 28 aa, Artificial Sequence
  Description of Artificial Sequence: Synthetic peptide
DEEEIRTTNPVATEQYGSVSTNQQRGNM

SEQ ID NO: 1524 - protein, 29 aa, Artificial Sequence
  Description of Artificial Sequence: Synthetic peptide
DEEEIRTTNPVATEQYGSVSTNQQRGNRT

SEQ ID NO: 1525 - protein, 28 aa, Artificial Sequence
  Description of Artificial Sequence: Synthetic peptide
DEEEIRTTNPVATEQYGSVSTNQQYGNR

SEQ ID NO: 1526 - protein, 28 aa, Artificial Sequence
  Description of Artificial Sequence: Synthetic peptide
DEEEIRTTNPVATEQYGSVSTCTQRGNR

SEQ ID NO: 1527 - protein, 29 aa, Artificial Sequence
  Description of Artificial Sequence: Synthetic peptide
SEEEIRTTNPVATEQYGSVSTNLDQRGNR

SEQ ID NO: 1528 - protein, 29 aa, Artificial Sequence
  Description of Artificial Sequence: Synthetic peptide
DEEEIRTTNPVATEQYGSVSTNLRRGDNR

SEQ ID NO: 1529 - protein, 28 aa, Artificial Sequence
  Description of Artificial Sequence: Synthetic peptide
DEEEIRTTNPVATEQYGSSSTVLQRGNR

SEQ ID NO: 1530 - protein, 29 aa, Artificial Sequence
  Description of Artificial Sequence: Synthetic peptide
DEEEIRTTNPVATEQYGSVSTNLRQSGNR

SEQ ID NO: 1531 - protein, 28 aa, Artificial Sequence
  Description of Artificial Sequence: Synthetic peptide
DEEEIRTTNPTATEQYGSVSTNLQRGPR

SEQ ID NO: 1532 - protein, 29 aa, Artificial Sequence
  Description of Artificial Sequence: Synthetic peptide
DEEEIRTTNPVATEQYGSVSTNQQRGNRI

SEQ ID NO: 1533 - protein, 28 aa, Artificial Sequence
  Description of Artificial Sequence: Synthetic peptide
DEEEIGTTNPVATEQYGEVSTNLQRGNR

SEQ ID NO: 1534 - protein, 28 aa, Artificial Sequence
  Description of Artificial Sequence: Synthetic peptide
DEEEIRTTNPVATEQYGSSSTNLQRMNR

SEQ ID NO: 1535 - protein, 28 aa, Artificial Sequence
  Description of Artificial Sequence: Synthetic peptide
DEEEIRTTNPVATEQYGSSSTNLQRGPR

SEQ ID NO: 1536 - protein, 29 aa, Artificial Sequence
  Description of Artificial Sequence: Synthetic peptide
SEEEIRTTNPVATEQYGSVSTCNLQRGNR

SEQ ID NO: 1537 - protein, 28 aa, Artificial Sequence
  Description of Artificial Sequence: Synthetic peptide
DEEEIRTTNPTATEQYGSVSTNEQRGNR

SEQ ID NO: 1538 - protein, 29 aa, Artificial Sequence
  Description of Artificial Sequence: Synthetic peptide
DEEEIRTTNPTATEQYGSVSTNLQCRGNR

SEQ ID NO: 1539 - protein, 29 aa, Artificial Sequence
  Description of Artificial Sequence: Synthetic peptide
DEEEIRTTNPVATEQYGSSNSTNLQRGNR

SEQ ID NO: 1540 - protein, 29 aa, Artificial Sequence
  Description of Artificial Sequence: Synthetic peptide
DEEEIRTTNPVATEQYGSVSTNQLQRTNR

SEQ ID NO: 1541 - protein, 29 aa, Artificial Sequence
  Description of Artificial Sequence: Synthetic peptide
DEEEIRTTNPVATEQYGSVSTNLSIRGNR

SEQ ID NO: 1542 - protein, 29 aa, Artificial Sequence
  Description of Artificial Sequence: Synthetic peptide
DEEEIRTTNPVATEQYGSSSMTNLQRGNR

SEQ ID NO: 1543 - protein, 30 aa, Artificial Sequence
  Description of Artificial Sequence: Synthetic polypeptide
DEEEIRTTNPVATEQYGSVSFTNLQRGNRT

SEQ ID NO: 1544 - protein, 29 aa, Artificial Sequence
  Description of Artificial Sequence: Synthetic peptide
DEEEIRTTNPVATEQYGSSSTDNLQRGNR

SEQ ID NO: 1545 - protein, 28 aa, Artificial Sequence
  Description of Artificial Sequence: Synthetic peptide
DEEEIRTTNPVATEQYGSSSTILQRGNR

SEQ ID NO: 1546 - protein, 30 aa, Artificial Sequence
  Description of Artificial Sequence: Synthetic polypeptide
DGEEEIRTTNPVATEQYYGSVSTNLQRGNR

SEQ ID NO: 1547 - protein, 29 aa, Artificial Sequence
  Description of Artificial Sequence: Synthetic peptide
DEEEIRTTNPVATEQYGSSSTNLQRAGNR

SEQ ID NO: 1548 - protein, 29 aa, Artificial Sequence
  Description of Artificial Sequence: Synthetic peptide
DEEEIRTTNPVATEQYGSFVSTNQQRGNR

SEQ ID NO: 1549 - protein, 30 aa, Artificial Sequence
  Description of Artificial Sequence: Synthetic polypeptide
DEEEIRTTNPVATEQYGSFVSTNLQRGNRP

SEQ ID NO: 1550 - protein, 29 aa, Artificial Sequence
  Description of Artificial Sequence: Synthetic peptide
DEEEIRTTNPVATEQYGSFVSTNLQRGNN

SEQ ID NO: 1551 - protein, 29 aa, Artificial Sequence
  Description of Artificial Sequence: Synthetic peptide
DEEEIRTTNPVATEQYGSSSTNLQRGNYR

SEQ ID NO: 1552 - protein, 30 aa, Artificial Sequence
  Description of Artificial Sequence: Synthetic polypeptide
DEEEIRTTNPVATEQYGSFVSTNLQRGNFR

SEQ ID NO: 1553 - protein, 29 aa, Artificial Sequence
  Description of Artificial Sequence: Synthetic peptide
DEEEIRTTNPVATEQYGSFVSTNLQRGNF

SEQ ID NO: 1554 - protein, 29 aa, Artificial Sequence
  Description of Artificial Sequence: Synthetic peptide
DEEEIRTTNPVATEQYGSFVSTNLQRGGR

SEQ ID NO: 1555 - protein, 30 aa, Artificial Sequence
  Description of Artificial Sequence: Synthetic polypeptide
DEEEIRTTNPVATEQYGSVSFTNLQRGPNR

SEQ ID NO: 1556 - protein, 29 aa, Artificial Sequence
  Description of Artificial Sequence: Synthetic peptide
DEEEIRTTNPVATEQYGSVSTNLRQDGNR

SEQ ID NO: 1557 - protein, 28 aa, Artificial Sequence
  Description of Artificial Sequence: Synthetic peptide
DEEEIRTTNPVATEQYGSVSTNRQTGNR

SEQ ID NO: 1558 - protein, 29 aa, Artificial Sequence
  Description of Artificial Sequence: Synthetic peptide
DETEIRTTNPVATEQYGSVSTTNLQRGNR

SEQ ID NO: 1559 - protein, 28 aa, Artificial Sequence
  Description of Artificial Sequence: Synthetic peptide
DEEEIRTTNPTATEQYGSVSTNLQTGNR

SEQ ID NO: 1560 - protein, 28 aa, Artificial Sequence
  Description of Artificial Sequence: Synthetic peptide
DEEEIRTTNPIATEQYGSVSTNLQSGNR

SEQ ID NO: 1561 - protein, 28 aa, Artificial Sequence
  Description of Artificial Sequence: Synthetic peptide
DIEEIRTTNPVATEQYGSVSTNLQSGNR

SEQ ID NO: 1562 - protein, 28 aa, Artificial Sequence
  Description of Artificial Sequence: Synthetic peptide
DEEEIRTTNPIATEQYGSVSTNLQRGQR

SEQ ID NO: 1563 - protein, 29 aa, Artificial Sequence
  Description of Artificial Sequence: Synthetic peptide
DIEEIRTTNPVHATEQYGSVSTNLQRGNR

SEQ ID NO: 1564 - protein, 28 aa, Artificial Sequence
  Description of Artificial Sequence: Synthetic peptide
DLEEIRTTNPVATEQYGSVSTNLQLGNR

SEQ ID NO: 1565 - protein, 29 aa, Artificial Sequence
  Description of Artificial Sequence: Synthetic peptide
DLEEIRTTNPVATEQYGSVSTNLQRGNER

SEQ ID NO: 1566 - protein, 29 aa, Artificial Sequence
  Description of Artificial Sequence: Synthetic peptide
SEEEIRTTNPVATEQYGSVSTNLQRGENR

SEQ ID NO: 1567 - protein, 28 aa, Artificial Sequence
  Description of Artificial Sequence: Synthetic peptide
DHEEIRTTNPVATEQYGSVSTNTQRGNR

SEQ ID NO: 1568 - protein, 29 aa, Artificial Sequence
  Description of Artificial Sequence: Synthetic peptide
SEEEIRTTNPVATEQYGSVSTNLQRGGNR

SEQ ID NO: 1569 - protein, 29 aa, Artificial Sequence
  Description of Artificial Sequence: Synthetic peptide
DEEEIRTTNPTATEQYGSVSTNPLQRGNR

SEQ ID NO: 1570 - protein, 28 aa, Artificial Sequence
  Description of Artificial Sequence: Synthetic peptide
DEEEIRTTNPTATEQYGSVSTNPQRGNR

SEQ ID NO: 1571 - protein, 29 aa, Artificial Sequence
  Description of Artificial Sequence: Synthetic peptide
DEEEIRTTNPIATEQYGSVSTNLQRGNRL

SEQ ID NO: 1572 - protein, 28 aa, Artificial Sequence
  Description of Artificial Sequence: Synthetic peptide
SEEEIRTTNPVATEQYGSVSTNLQRGNV

SEQ ID NO: 1573 - protein, 30 aa, Artificial Sequence
  Description of Artificial Sequence: Synthetic polypeptide
DEEEIRTTNPVATEQYGSSVISTNLQRGNR

SEQ ID NO: 1574 - protein, 29 aa, Artificial Sequence
  Description of Artificial Sequence: Synthetic peptide
DEEEIRTTNPVATEQYGSSVSQNLQRGNR

SEQ ID NO: 1575 - protein, 30 aa, Artificial Sequence
  Description of Artificial Sequence: Synthetic polypeptide
DEEEIRTTNPVATEQYGSSVSTMNLQRGNR

SEQ ID NO: 1576 - protein, 30 aa, Artificial Sequence
  Description of Artificial Sequence: Synthetic polypeptide
DEEEIRTTNPVATEQYGSSVSTNELQRGNR

SEQ ID NO: 1577 - protein, 29 aa, Artificial Sequence
  Description of Artificial Sequence: Synthetic peptide
SEEEIRTTNPVATEQYGSVSTNLQRGNAR

SEQ ID NO: 1578 - protein, 28 aa, Artificial Sequence
  Description of Artificial Sequence: Synthetic peptide
DHEEIRTTNPVATEQYGSVSTNLQRGNA

SEQ ID NO: 1579 - protein, 29 aa, Artificial Sequence
  Description of Artificial Sequence: Synthetic peptide
SEEEIRTTNPVATEQYGSVSTNLQPRGNR

SEQ ID NO: 1580 - protein, 28 aa, Artificial Sequence
  Description of Artificial Sequence: Synthetic peptide
DHEEIRTTNPVATEQYGSVSTNLDRGNR

SEQ ID NO: 1581 - protein, 29 aa, Artificial Sequence
  Description of Artificial Sequence: Synthetic peptide
DEEEIRTTNPVATEQYGSSTSTNLQRGNR

SEQ ID NO: 1582 - protein, 29 aa, Artificial Sequence
  Description of Artificial Sequence: Synthetic peptide
SEEEIRTTNPVATEQYGSVSTNLQARGNR

SEQ ID NO: 1583 - protein, 29 aa, Artificial Sequence
  Description of Artificial Sequence: Synthetic peptide
DGEEIRTTNPVATEQYGSVSTENLQRGNR

SEQ ID NO: 1584 - protein, 29 aa, Artificial Sequence
  Description of Artificial Sequence: Synthetic peptide
DGEEIRTTNPVATEQYGSVSTGNLQRGNR

SEQ ID NO: 1585 - protein, 28 aa, Artificial Sequence
  Description of Artificial Sequence: Synthetic peptide
DGEEIRTTNPVATEQYGSVSTNLQPGNR

SEQ ID NO: 1586 - protein, 28 aa, Artificial Sequence
  Description of Artificial Sequence: Synthetic peptide
DGEEIRTTNPVATEQYGSVSTNLQQGNR

SEQ ID NO: 1587 - protein, 28 aa, Artificial Sequence
  Description of Artificial Sequence: Synthetic peptide
DEEEIRTTNPVATEQYGSVSTCPQRGNR

SEQ ID NO: 1588 - protein, 28 aa, Artificial Sequence
  Description of Artificial Sequence: Synthetic peptide
DGEEIRTTNPVATEQYGSVSTNLQRGNC

SEQ ID NO: 1589 - protein, 29 aa, Artificial Sequence
  Description of Artificial Sequence: Synthetic peptide
DETEIRTTNPVATEQYGSVSTNLQRSGNR

SEQ ID NO: 1590 - protein, 29 aa, Artificial Sequence
  Description of Artificial Sequence: Synthetic peptide
DEEEIRTTNPTATEQYGSVSTNLQRVGNR

SEQ ID NO: 1591 - protein, 29 aa, Artificial Sequence
  Description of Artificial Sequence: Synthetic peptide
DETEIRTTNPVATEQYGSVSTNLQRLGNR

SEQ ID NO: 1592 - protein, 29 aa, Artificial Sequence
  Description of Artificial Sequence: Synthetic peptide
DETEIRTTNPVATEQYGSVSTNLQRGQNR

SEQ ID NO: 1593 - protein, 28 aa, Artificial Sequence
  Description of Artificial Sequence: Synthetic peptide
DETEIRTTNPVATEQYGSVSTNLQRGNS

SEQ ID NO: 1594 - protein, 29 aa, Artificial Sequence
  Description of Artificial Sequence: Synthetic peptide
DETEIRTTNPVATEQYGSVSTNLQRGNER

SEQ ID NO: 1595 - protein, 28 aa, Artificial Sequence
  Description of Artificial Sequence: Synthetic peptide
DETEIRTTNPVATEQYGSVSTNLQRGMR

SEQ ID NO: 1596 - protein, 28 aa, Artificial Sequence
  Description of Artificial Sequence: Synthetic peptide
SEEEIRTTNPVATEQYGSVSTNLQMGNR

SEQ ID NO: 1597 - protein, 28 aa, Artificial Sequence
  Description of Artificial Sequence: Synthetic peptide
DGEEIRTTNPVATEQYGSVSTNLQRGND

SEQ ID NO: 1598 - protein, 28 aa, Artificial Sequence
  Description of Artificial Sequence: Synthetic peptide
DGEEIRTTNPVATEQYGSVSTNLQRGNL

SEQ ID NO: 1599 - protein, 28 aa, Artificial Sequence
  Description of Artificial Sequence: Synthetic peptide
DEEEIRTTNPVATEQYGSVSTNLRQGNR

SEQ ID NO: 1600 - protein, 29 aa, Artificial Sequence
  Description of Artificial Sequence: Synthetic peptide
SEEEIRTTNPVATEQYGSVSTNLNQRGNR

SEQ ID NO: 1601 - protein, 28 aa, Artificial Sequence
  Description of Artificial Sequence: Synthetic peptide
DEEEIRTTNPVATEQYGSVSTCLQRGND

SEQ ID NO: 1602 - protein, 29 aa, Artificial Sequence
  Description of Artificial Sequence: Synthetic peptide
DEEEIITTNPVATEQYGSVSTNLQRGSNR

SEQ ID NO: 1603 - protein, 28 aa, Artificial Sequence
  Description of Artificial Sequence: Synthetic peptide
DEEEIITTNPVATEQYGSVSTNQQRGNR

SEQ ID NO: 1604 - protein, 30 aa, Artificial Sequence
  Description of Artificial Sequence: Synthetic polypeptide
DEEEIRTTNPVATEQYGSVSTNMLQRGMNR

SEQ ID NO: 1605 - protein, 30 aa, Artificial Sequence
  Description of Artificial Sequence: Synthetic polypeptide
DEEEIRTTNPVATEQYGSHVSTNLQRGDNR

SEQ ID NO: 1606 - protein, 30 aa, Artificial Sequence
  Description of Artificial Sequence: Synthetic polypeptide
DEEEIRTTNPVATEQYGSVSTNMLQRGNDR

SEQ ID NO: 1607 - protein, 30 aa, Artificial Sequence
  Description of Artificial Sequence: Synthetic polypeptide
DEEEIRTTNPVATEQYGSVSTNMLQRGNER

SEQ ID NO: 1608 - protein, 28 aa, Artificial Sequence
  Description of Artificial Sequence: Synthetic peptide
DEVEIRTTNPVATEQYGSVSTTLQRGNR

SEQ ID NO: 1609 - protein, 30 aa, Artificial Sequence
  Description of Artificial Sequence: Synthetic polypeptide
DEEEIRTTNPVATEQYGSVSTNMLQRGNRD

SEQ ID NO: 1610 - protein, 29 aa, Artificial Sequence
  Description of Artificial Sequence: Synthetic peptide
DEEEIRTTNPLATEQYGSVSETNLQRGNR

SEQ ID NO: 1611 - protein, 30 aa, Artificial Sequence
  Description of Artificial Sequence: Synthetic polypeptide
DEEEIRTTNPVATEQYGSVSTNMLQRGVNR

SEQ ID NO: 1612 - protein, 28 aa, Artificial Sequence
  Description of Artificial Sequence: Synthetic peptide
DEVEIRTTNPVATEQYGSSSTNLQRGNR

SEQ ID NO: 1613 - protein, 28 aa, Artificial Sequence
  Description of Artificial Sequence: Synthetic peptide
SEEEIRTTNPVAGEQYGSVSTNLQRGNR

SEQ ID NO: 1614 - protein, 29 aa, Artificial Sequence
  Description of Artificial Sequence: Synthetic peptide
DEEEIRTTNPVATEQYGSHVSTNLQRENR

SEQ ID NO: 1615 - protein, 29 aa, Artificial Sequence
  Description of Artificial Sequence: Synthetic peptide
DEEEIRTTNPVATEQYGSHVSTGLQRGNR

SEQ ID NO: 1616 - protein, 28 aa, Artificial Sequence
  Description of Artificial Sequence: Synthetic peptide
DEEEIRTTNPVATEQYGSHSTQLQRGNR

SEQ ID NO: 1617 - protein, 29 aa, Artificial Sequence
  Description of Artificial Sequence: Synthetic peptide
DEEEINTTNPVATEQYGSVSTNLQRNGNR

SEQ ID NO: 1618 - protein, 29 aa, Artificial Sequence
  Description of Artificial Sequence: Synthetic peptide
DEEEINTTNPVATEQYGSVSTNLQRGVNR

SEQ ID NO: 1619 - protein, 29 aa, Artificial Sequence
  Description of Artificial Sequence: Synthetic peptide
DEEEINTTNPVATEQYGSVSTNLQRGNRY

SEQ ID NO: 1620 - protein, 28 aa, Artificial Sequence
  Description of Artificial Sequence: Synthetic peptide
DEEEIRTTNPVATEQYGSHSTNVQRGNR

SEQ ID NO: 1621 - protein, 29 aa, Artificial Sequence
  Description of Artificial Sequence: Synthetic peptide
DEEEINTTNPVATEQYGSVSTNLQRGNNR

SEQ ID NO: 1622 - protein, 29 aa, Artificial Sequence
  Description of Artificial Sequence: Synthetic peptide
DEEEIRTTNPVATEQYGSVSTNMLQRLNR

SEQ ID NO: 1623 - protein, 28 aa, Artificial Sequence
  Description of Artificial Sequence: Synthetic peptide
DEEEIRTTNPVATEQYGSHSTNPQRGNR

SEQ ID NO: 1624 - protein, 29 aa, Artificial Sequence
  Description of Artificial Sequence: Synthetic peptide
DEEEIRTTNPVATEQYGSHVSTNLQRGNK

SEQ ID NO: 1625 - protein, 29 aa, Artificial Sequence
  Description of Artificial Sequence: Synthetic peptide
DEEEIRTTNPVATEQYGSVSTNMLQIGNR

SEQ ID NO: 1626 - protein, 29 aa, Artificial Sequence
  Description of Artificial Sequence: Synthetic peptide
DEEEIRTTNPVATEQYGSVSTNLYQQGNR

SEQ ID NO: 1627 - protein, 29 aa, Artificial Sequence
  Description of Artificial Sequence: Synthetic peptide
DEEEIRTTNPVATEQYGSISTNLQRGNRT

SEQ ID NO: 1628 - protein, 28 aa, Artificial Sequence
  Description of Artificial Sequence: Synthetic peptide
DEEEIRTTNPVATEQYGSVSTNLYRGND

SEQ ID NO: 1629 - protein, 28 aa, Artificial Sequence
  Description of Artificial Sequence: Synthetic peptide
DEEEINTTNPVATEQYGVVSTNLQRGNR

SEQ ID NO: 1630 - protein, 28 aa, Artificial Sequence
  Description of Artificial Sequence: Synthetic peptide
DEEEIRTTNPVATEQYGSVSTNLYRTNR

SEQ ID NO: 1631 - protein, 28 aa, Artificial Sequence
  Description of Artificial Sequence: Synthetic peptide
DEEEINTTNPVATEQYGSYSTNLQRGNR

SEQ ID NO: 1632 - protein, 29 aa, Artificial Sequence
  Description of Artificial Sequence: Synthetic peptide
DEEEIRTTNPLATEQYGSVSTNLQFRGNR

SEQ ID NO: 1633 - protein, 29 aa, Artificial Sequence
  Description of Artificial Sequence: Synthetic peptide
DEVEIRTTNPVATEQYGSVSITNLQRGNR

SEQ ID NO: 1634 - protein, 30 aa, Artificial Sequence
  Description of Artificial Sequence: Synthetic polypeptide
DEEEIRTTNPVATEQYGSVSTNMLQMRGNR

SEQ ID NO: 1635 - protein, 29 aa, Artificial Sequence
  Description of Artificial Sequence: Synthetic peptide
DEEEINTTNPVATEQYGSVSVTNLQRGNR

SEQ ID NO: 1636 - protein, 30 aa, Artificial Sequence
  Description of Artificial Sequence: Synthetic polypeptide
DEEEIRTTNPVATEQYGSVSTNLTQARGNR

SEQ ID NO: 1637 - protein, 29 aa, Artificial Sequence
  Description of Artificial Sequence: Synthetic peptide
DEEEIRTTNPVATEQYGSIASTNLQRGNR

SEQ ID NO: 1638 - protein, 28 aa, Artificial Sequence
  Description of Artificial Sequence: Synthetic peptide
DEEEIRTTNPVATEQYGSISTNLQTGNR

SEQ ID NO: 1639 - protein, 29 aa, Artificial Sequence
  Description of Artificial Sequence: Synthetic peptide
DEEEIRTTNPVATEQYGSISTNLQYRGNR

SEQ ID NO: 1640 - protein, 30 aa, Artificial Sequence
  Description of Artificial Sequence: Synthetic polypeptide
DEEEIRTTNPVATEQYGSHVSVTNLQRGNR

SEQ ID NO: 1641 - protein, 30 aa, Artificial Sequence
  Description of Artificial Sequence: Synthetic polypeptide
DEEEIRTTNPVATEQYGSHVSTNLQRYGNR

SEQ ID NO: 1642 - protein, 30 aa, Artificial Sequence
  Description of Artificial Sequence: Synthetic polypeptide
DEEEIRTTNPVATEQYGSVSTNMLQGRGNR

SEQ ID NO: 1643 - protein, 30 aa, Artificial Sequence
  Description of Artificial Sequence: Synthetic polypeptide
DEEEIRTTNPVATEQYGSHVSTNLQRGNRE

SEQ ID NO: 1644 - protein, 28 aa, Artificial Sequence
  Description of Artificial Sequence: Synthetic peptide
DEVEIRTTNPVATEQYGSVSCNLQRGNR

SEQ ID NO: 1645 - protein, 28 aa, Artificial Sequence
  Description of Artificial Sequence: Synthetic peptide
DEEEINTTNPVATEQYGSVSTNLQRENR

SEQ ID NO: 1646 - protein, 29 aa, Artificial Sequence
  Description of Artificial Sequence: Synthetic peptide
DEEEINTTNPVATEQYGSVSTNLQPRGNR

SEQ ID NO: 1647 - protein, 28 aa, Artificial Sequence
  Description of Artificial Sequence: Synthetic peptide
DEEEIRTTNPMATEQYGSVSGNLQRGNR

SEQ ID NO: 1648 - protein, 28 aa, Artificial Sequence
  Description of Artificial Sequence: Synthetic peptide
DEEEINTTNPVATEQYGSLSTNLQRGNR

SEQ ID NO: 1649 - protein, 28 aa, Artificial Sequence
  Description of Artificial Sequence: Synthetic peptide
DEEEINTTNPVATEQYGSCSTNLQRGNR

SEQ ID NO: 1650 - protein, 29 aa, Artificial Sequence
  Description of Artificial Sequence: Synthetic peptide
DEEEIRTTNPVATEQYGSVSTNMQQRGNR

SEQ ID NO: 1651 - protein, 29 aa, Artificial Sequence
  Description of Artificial Sequence: Synthetic peptide
DEEEIRTTNPVATEQYGSVSTNMQRFGNR

SEQ ID NO: 1652 - protein, 29 aa, Artificial Sequence
  Description of Artificial Sequence: Synthetic peptide
DEEEIRTTNPVATEQYGSHSTNLQQRGNR

SEQ ID NO: 1653 - protein, 29 aa, Artificial Sequence
  Description of Artificial Sequence: Synthetic peptide
DEEEIRTTNPVATEQYGSVSTNMQRGNIR

SEQ ID NO: 1654 - protein, 29 aa, Artificial Sequence
  Description of Artificial Sequence: Synthetic peptide
DEEEIRTTNPVATEQYGSVSTNMQRGNRE

SEQ ID NO: 1655 - protein, 29 aa, Artificial Sequence
  Description of Artificial Sequence: Synthetic peptide
DEEEIRTTNPVATEQYGSVSTNMQRGNRV

SEQ ID NO: 1656 - protein, 29 aa, Artificial Sequence
  Description of Artificial Sequence: Synthetic peptide
DEEEIRTTNPVATEQYGSVSTDLQRNGNR

SEQ ID NO: 1657 - protein, 29 aa, Artificial Sequence
  Description of Artificial Sequence: Synthetic peptide
DEEEIRTTNPVATEQYGSVSTNMQRIGNR

SEQ ID NO: 1658 - protein, 29 aa, Artificial Sequence
  Description of Artificial Sequence: Synthetic peptide
DEEEIRTTNPVATEQYGSIVITNLQRGNR

SEQ ID NO: 1659 - protein, 29 aa, Artificial Sequence
  Description of Artificial Sequence: Synthetic peptide
DEEEIRTTNPVATEQYGSVSTDLQRGQNR

SEQ ID NO: 1660 - protein, 28 aa, Artificial Sequence
  Description of Artificial Sequence: Synthetic peptide
DEEEIRTTNPVATEQYGSVSTDLQRGNS

SEQ ID NO: 1661 - protein, 29 aa, Artificial Sequence
  Description of Artificial Sequence: Synthetic peptide
DEEEIRTTNPVATEQYGSVSTDLQRGNRQ

SEQ ID NO: 1662 - protein, 28 aa, Artificial Sequence
  Description of Artificial Sequence: Synthetic peptide
DEEEIRTTNPMATEQYGSVSTNLQIGNR

SEQ ID NO: 1663 - protein, 29 aa, Artificial Sequence
  Description of Artificial Sequence: Synthetic peptide
DEEEIRTTNPVATEQYGSVSTNMQRSGNR

SEQ ID NO: 1664 - protein, 28 aa, Artificial Sequence
  Description of Artificial Sequence: Synthetic peptide
DEEEIRTTNPMATEQYGSVSTNLQRANR

SEQ ID NO: 1665 - protein, 30 aa, Artificial Sequence
  Description of Artificial Sequence: Synthetic polypeptide
DEEEIRTTNPVATEQYGSIVSTANLQRGNR

SEQ ID NO: 1666 - protein, 29 aa, Artificial Sequence
  Description of Artificial Sequence: Synthetic peptide
DEEEIRTTNPVATEQYGSIVFTNLQRGNR

SEQ ID NO: 1667 - protein, 28 aa, Artificial Sequence
  Description of Artificial Sequence: Synthetic peptide
DEEEIRTTNPMATEQYGSVSTNLQFGNR

SEQ ID NO: 1668 - protein, 28 aa, Artificial Sequence
  Description of Artificial Sequence: Synthetic peptide
DEEEINTTNPVATEQYGSMSTNLQRGNR

SEQ ID NO: 1669 - protein, 28 aa, Artificial Sequence
  Description of Artificial Sequence: Synthetic peptide
DEEEIRTTNPMATEQYGSVSTNLLRGNR

SEQ ID NO: 1670 - protein, 28 aa, Artificial Sequence
  Description of Artificial Sequence: Synthetic peptide
DEEEIRTTNPVATEQYGSHSTNLQRGVR

SEQ ID NO: 1671 - protein, 30 aa, Artificial Sequence
  Description of Artificial Sequence: Synthetic polypeptide
DEEEIRTTNPVATEQYGSVSTDNLQFRGNR

SEQ ID NO: 1672 - protein, 29 aa, Artificial Sequence
  Description of Artificial Sequence: Synthetic peptide
DEEEIRTTNPMATEQYGSVSGTNLQRGNR

SEQ ID NO: 1673 - protein, 28 aa, Artificial Sequence
  Description of Artificial Sequence: Synthetic peptide
DEEEIRTTNPVATEQYGSHSTNLQRGNG

SEQ ID NO: 1674 - protein, 29 aa, Artificial Sequence
  Description of Artificial Sequence: Synthetic peptide
DEEEIRTTNPVATEQYGSHSTNLQRGDNR

SEQ ID NO: 1675 - protein, 29 aa, Artificial Sequence
  Description of Artificial Sequence: Synthetic peptide
DEEEIRTTNPVATEQYGSISTNLSQRGNR

SEQ ID NO: 1676 - protein, 29 aa, Artificial Sequence
  Description of Artificial Sequence: Synthetic peptide
DEEEIRTTNPVATEQYGSISTNLWQRGNR

SEQ ID NO: 1677 - protein, 29 aa, Artificial Sequence
  Description of Artificial Sequence: Synthetic peptide
DEEEIRTTNPVATEQYGSVSFTNLQRGNC

SEQ ID NO: 1678 - protein, 28 aa, Artificial Sequence
  Description of Artificial Sequence: Synthetic peptide
DEEEINTTNPVATEQYGSVSCNLQRGNR

SEQ ID NO: 1679 - protein, 28 aa, Artificial Sequence
  Description of Artificial Sequence: Synthetic peptide
DEEEINTTNPVATEQYGSVCTNLQRGNR

SEQ ID NO: 1680 - protein, 28 aa, Artificial Sequence
  Description of Artificial Sequence: Synthetic peptide
DEEEIRTTNPVATEQYGSHSTNLQRFNR

SEQ ID NO: 1681 - protein, 29 aa, Artificial Sequence
  Description of Artificial Sequence: Synthetic peptide
DEEEIRTTNPMATEQYGSVSTCNLQRGNR

SEQ ID NO: 1682 - protein, 29 aa, Artificial Sequence
  Description of Artificial Sequence: Synthetic peptide
DEEEIRTTNPVATEQYGSVSTDLQRTGNR

SEQ ID NO: 1683 - protein, 29 aa, Artificial Sequence
  Description of Artificial Sequence: Synthetic peptide
DEEEIRTTNPVATEQYGSHSTNLQRFGNR

SEQ ID NO: 1684 - protein, 28 aa, Artificial Sequence
  Description of Artificial Sequence: Synthetic peptide
DEEEIRTTNPVATEQYGSISTSLQRGNR

SEQ ID NO: 1685 - protein, 29 aa, Artificial Sequence
  Description of Artificial Sequence: Synthetic peptide
DEEEIRTTNPVATEQYGSVSFTNLQRGNM

SEQ ID NO: 1686 - protein, 28 aa, Artificial Sequence
  Description of Artificial Sequence: Synthetic peptide
DEVEIRTTNPEATEQYGSVSTNLQRGNR

SEQ ID NO: 1687 - protein, 28 aa, Artificial Sequence
  Description of Artificial Sequence: Synthetic peptide
DEEEIRTTNPLATEQYGQVSTNLQRGNR

SEQ ID NO: 1688 - protein, 28 aa, Artificial Sequence
  Description of Artificial Sequence: Synthetic peptide
DEVEINTTNPVATEQYGSVSTNLQRGNR

SEQ ID NO: 1689 - protein, 30 aa, Artificial Sequence
  Description of Artificial Sequence: Synthetic polypeptide
DEEEIRTTNPVATEQYGSVSTNLYQARGNR

SEQ ID NO: 1690 - protein, 28 aa, Artificial Sequence
  Description of Artificial Sequence: Synthetic peptide
DEEEIRTTNPVATEQYGSISTNLQRGDR

SEQ ID NO: 1691 - protein, 29 aa, Artificial Sequence
  Description of Artificial Sequence: Synthetic peptide
DEEEIRTTNPVATEQYGSISTNLQRGDNR

SEQ ID NO: 1692 - protein, 28 aa, Artificial Sequence
  Description of Artificial Sequence: Synthetic peptide
DEEEIRTTNPLATEQYGSVSTNLQRGNG

SEQ ID NO: 1693 - protein, 28 aa, Artificial Sequence
  Description of Artificial Sequence: Synthetic peptide
DEEEIRATNPVATCQYGSVSTNLQRGNR

SEQ ID NO: 1694 - protein, 28 aa, Artificial Sequence
  Description of Artificial Sequence: Synthetic peptide
DEVEIRTTNPVATEQYGSVSTNLVRGNR

SEQ ID NO: 1695 - protein, 28 aa, Artificial Sequence
  Description of Artificial Sequence: Synthetic peptide
DEEEIRATNPVAHEQYGSVSTNLQRGNR

SEQ ID NO: 1696 - protein, 30 aa, Artificial Sequence
  Description of Artificial Sequence: Synthetic polypeptide
DEEEIRTTNPVATEQYGSVSTNLTQRNGNR

SEQ ID NO: 1697 - protein, 28 aa, Artificial Sequence
  Description of Artificial Sequence: Synthetic peptide
DEEEIRTTNPVATEQYGSVSLDLQRGNR

SEQ ID NO: 1698 - protein, 30 aa, Artificial Sequence
  Description of Artificial Sequence: Synthetic polypeptide
DEEEIRTTNPVATEQYGSVSTNLVQFRGNR

SEQ ID NO: 1699 - protein, 29 aa, Artificial Sequence
  Description of Artificial Sequence: Synthetic peptide
DEEEIRTTNPVATEQYGSVSTNLTQRMNR

SEQ ID NO: 1700 - protein, 29 aa, Artificial Sequence
  Description of Artificial Sequence: Synthetic peptide
DEEEIRTTNPVATEQYGSVSTNLTQRGNS

SEQ ID NO: 1701 - protein, 28 aa, Artificial Sequence
  Description of Artificial Sequence: Synthetic peptide
DEEEIRTTNPVATEQYGSVSTNLVPGNR

SEQ ID NO: 1702 - protein, 30 aa, Artificial Sequence
  Description of Artificial Sequence: Synthetic polypeptide
DEEEIRTTNPVATEQYGSVSTNLTQRGNRS

SEQ ID NO: 1703 - protein, 30 aa, Artificial Sequence
  Description of Artificial Sequence: Synthetic polypeptide
DEEEIRTTNPVATEQYGSVSTNLTQRGNRD

SEQ ID NO: 1704 - protein, 29 aa, Artificial Sequence
  Description of Artificial Sequence: Synthetic peptide
DEEEIRTTNPVATEQYGSVSTNLVQRGLR

SEQ ID NO: 1705 - protein, 28 aa, Artificial Sequence
  Description of Artificial Sequence: Synthetic peptide
DEEEIQTTNPYATEQYGSVSTNLQRGNR

SEQ ID NO: 1706 - protein, 29 aa, Artificial Sequence
  Description of Artificial Sequence: Synthetic peptide
DEEEIRTTNPVATEQYGSISTANLQRGNR

SEQ ID NO: 1707 - protein, 30 aa, Artificial Sequence
  Description of Artificial Sequence: Synthetic polypeptide
DEEEIRTTNPVATEQYGSVSTNLTQRGNCR

SEQ ID NO: 1708 - protein, 29 aa, Artificial Sequence
  Description of Artificial Sequence: Synthetic peptide
DEEEIRTTNPVATEQYGSVSTNLVQRGNN

SEQ ID NO: 1709 - protein, 29 aa, Artificial Sequence
  Description of Artificial Sequence: Synthetic peptide
DEEEIRTTNPLATEQYGSVSTNLQRGNRQ

SEQ ID NO: 1710 - protein, 29 aa, Artificial Sequence
  Description of Artificial Sequence: Synthetic peptide
DEEEIRTTNPVATEQYGSVSTNLTQRGER

SEQ ID NO: 1711 - protein, 30 aa, Artificial Sequence
  Description of Artificial Sequence: Synthetic polypeptide
DEEEIRTTNPVATEQYGSVSTNLVQRGENR

SEQ ID NO: 1712 - protein, 29 aa, Artificial Sequence
  Description of Artificial Sequence: Synthetic peptide
DEVEIRTTNPVATEQYGSVSTNLQRPGNR

SEQ ID NO: 1713 - protein, 28 aa, Artificial Sequence
  Description of Artificial Sequence: Synthetic peptide
DEVEIRTTNPVATEQYGSVSTNLQRGTR

SEQ ID NO: 1714 - protein, 28 aa, Artificial Sequence
  Description of Artificial Sequence: Synthetic peptide
DEEEIRTTNPLATEQYGSVSTNLQRGSR

SEQ ID NO: 1715 - protein, 28 aa, Artificial Sequence
  Description of Artificial Sequence: Synthetic peptide
DEEEIRTTNPVATEQYGSVSLALQRGNR

SEQ ID NO: 1716 - protein, 28 aa, Artificial Sequence
  Description of Artificial Sequence: Synthetic peptide
DEEEIRTTNPVATEQYGSVSTNLTRGVR

SEQ ID NO: 1717 - protein, 28 aa, Artificial Sequence
  Description of Artificial Sequence: Synthetic peptide
DEEEIRTTNPVATEQYGSVSTNLTRGSR

SEQ ID NO: 1718 - protein, 29 aa, Artificial Sequence
  Description of Artificial Sequence: Synthetic peptide
DEEEIRTTNPVATEQYGSVSTNLTRGNYR

SEQ ID NO: 1719 - protein, 28 aa, Artificial Sequence
  Description of Artificial Sequence: Synthetic peptide
DEDEILTTNPVATEQYGSVSTNLQRGNR

SEQ ID NO: 1720 - protein, 29 aa, Artificial Sequence
  Description of Artificial Sequence: Synthetic peptide
DEEEIRTTNPVATEQYGSVSTNLTRGNRI

SEQ ID NO: 1721 - protein, 29 aa, Artificial Sequence
  Description of Artificial Sequence: Synthetic peptide
DEEEIRTTNPVATEQYGSVSTNLTRGNPR

SEQ ID NO: 1722 - protein, 28 aa, Artificial Sequence
  Description of Artificial Sequence: Synthetic peptide
DEEEIRTTNPVATEQYGSVSTNLTSGNR

SEQ ID NO: 1723 - protein, 28 aa, Artificial Sequence
  Description of Artificial Sequence: Synthetic peptide
DEEEIRTTNPVATEQYGSVSTNLTYGNR

SEQ ID NO: 1724 - protein, 28 aa, Artificial Sequence
  Description of Artificial Sequence: Synthetic peptide
DEEEIRTTNPVATEQYGSVSTNLTRGIR

SEQ ID NO: 1725 - protein, 28 aa, Artificial Sequence
  Description of Artificial Sequence: Synthetic peptide
DEEEIRATNPVATEHYGSVSTNLQRGNR

SEQ ID NO: 1726 - protein, 28 aa, Artificial Sequence
  Description of Artificial Sequence: Synthetic peptide
DEEEIRTTNPVATEQYGSVSTNLTRGGR

SEQ ID NO: 1727 - protein, 28 aa, Artificial Sequence
  Description of Artificial Sequence: Synthetic peptide
DEEEIRTTNPLATEQYGWVSTNLQRGNR

SEQ ID NO: 1728 - protein, 28 aa, Artificial Sequence
  Description of Artificial Sequence: Synthetic peptide
DEEEIRATNPVATEQCGSVSTNLQRGNR

SEQ ID NO: 1729 - protein, 28 aa, Artificial Sequence
  Description of Artificial Sequence: Synthetic peptide
DEEEIRTTNPLATEQYGSVSTNPQRGNR

SEQ ID NO: 1730 - protein, 28 aa, Artificial Sequence
  Description of Artificial Sequence: Synthetic peptide
DEEEIRTTNPVATEQYGSVSTNLTRGAR

SEQ ID NO: 1731 - protein, 28 aa, Artificial Sequence
  Description of Artificial Sequence: Synthetic peptide
DEEEIRTTNPVATEQYGSVSTNLTRANR

SEQ ID NO: 1732 - protein, 28 aa, Artificial Sequence
  Description of Artificial Sequence: Synthetic peptide
DEEEIRTTNPLATEQYGSVSTNLQSGNR

SEQ ID NO: 1733 - protein, 29 aa, Artificial Sequence
  Description of Artificial Sequence: Synthetic peptide
DEEEIRTTNPLATEQYGSVSTNLQRQGNR

SEQ ID NO: 1734 - protein, 28 aa, Artificial Sequence
  Description of Artificial Sequence: Synthetic peptide
DEEEIQTTNPVATEQYGSVTTNLQRGNR

SEQ ID NO: 1735 - protein, 29 aa, Artificial Sequence
  Description of Artificial Sequence: Synthetic peptide
DEEEIRTTNPVATEQYGSHSQTNLQRGNR

SEQ ID NO: 1736 - protein, 29 aa, Artificial Sequence
  Description of Artificial Sequence: Synthetic peptide
DEEEIQTTNPVATEQYGSVSTPNLQRGNR

SEQ ID NO: 1737 - protein, 29 aa, Artificial Sequence
  Description of Artificial Sequence: Synthetic peptide
DEEEIQTTNPVATEQYGSVSTNLQRSGNR

SEQ ID NO: 1738 - protein, 29 aa, Artificial Sequence
  Description of Artificial Sequence: Synthetic peptide
DEEEIRTTNPVATEQYGSVSTNLVRGNTR

SEQ ID NO: 1739 - protein, 28 aa, Artificial Sequence
  Description of Artificial Sequence: Synthetic peptide
DEEEIRTTNPVATEQYGSVSTNLVRGNW

SEQ ID NO: 1740 - protein, 28 aa, Artificial Sequence
  Description of Artificial Sequence: Synthetic peptide
DEEEIQTTNPVATELYGSVSTNLQRGNR

SEQ ID NO: 1741 - protein, 28 aa, Artificial Sequence
  Description of Artificial Sequence: Synthetic peptide
DEVEIRTTNPVATEQYGSVSTNSQRGNR

SEQ ID NO: 1742 - protein, 29 aa, Artificial Sequence
  Description of Artificial Sequence: Synthetic peptide
DEEEIRTTNPVATEQYGSVSTNLWDRGNR

SEQ ID NO: 1743 - protein, 30 aa, Artificial Sequence
  Description of Artificial Sequence: Synthetic polypeptide
DEEEIRTTNPVATEQYGSVSTNLWQARGNR

SEQ ID NO: 1744 - protein, 28 aa, Artificial Sequence
  Description of Artificial Sequence: Synthetic peptide
DEEEIRTTNPVATEQYGSISTNLERGNR

SEQ ID NO: 1745 - protein, 28 aa, Artificial Sequence
  Description of Artificial Sequence: Synthetic peptide
DEEEIQTTNPVACEQYGSVSTNLQRGNR

SEQ ID NO: 1746 - protein, 28 aa, Artificial Sequence
  Description of Artificial Sequence: Synthetic peptide
DEEEIQTTNPVATEQCGSVSTNLQRGNR

SEQ ID NO: 1747 - protein, 28 aa, Artificial Sequence
  Description of Artificial Sequence: Synthetic peptide
DEEEIRTTNPVATEQYGSISTNLLRGNR

SEQ ID NO: 1748 - protein, 28 aa, Artificial Sequence
  Description of Artificial Sequence: Synthetic peptide
DEVEIRTTNPVATEQYGSVSTALQRGNR

SEQ ID NO: 1749 - protein, 29 aa, Artificial Sequence
  Description of Artificial Sequence: Synthetic peptide
DEEEIRTTNPVATEQYGSVSTNLWQPGNR

SEQ ID NO: 1750 - protein, 29 aa, Artificial Sequence
  Description of Artificial Sequence: Synthetic peptide
DEEEIRTTNPVATEQYGSVSTNLWQQGNR

SEQ ID NO: 1751 - protein, 28 aa, Artificial Sequence
  Description of Artificial Sequence: Synthetic peptide
DEEEIRTTNPVATEQYGSISTNLMRGNR

SEQ ID NO: 1752 - protein, 29 aa, Artificial Sequence
  Description of Artificial Sequence: Synthetic peptide
DEEEIRTTNPLATEQYGSVSTNLQRGNLR

SEQ ID NO: 1753 - protein, 28 aa, Artificial Sequence
  Description of Artificial Sequence: Synthetic peptide
DEEEIRTTNPVATEQYGSVSTNLWRENR

SEQ ID NO: 1754 - protein, 29 aa, Artificial Sequence
  Description of Artificial Sequence: Synthetic peptide
DEEEIRTTNPVATEQYGSVSTNLWRGNAR

SEQ ID NO: 1755 - protein, 28 aa, Artificial Sequence
  Description of Artificial Sequence: Synthetic peptide
DEEEIRTTNPLATEQYGSVSTNLQRGNH

SEQ ID NO: 1756 - protein, 30 aa, Artificial Sequence
  Description of Artificial Sequence: Synthetic polypeptide
DEEEIRTTNPVATEQYGSVSTNLWQIRGNR

SEQ ID NO: 1757 - protein, 28 aa, Artificial Sequence
  Description of Artificial Sequence: Synthetic peptide
DEEEIQTTNPVATEQYGGVSTNLQRGNR

SEQ ID NO: 1758 - protein, 28 aa, Artificial Sequence
  Description of Artificial Sequence: Synthetic peptide
DEEEIRTTNPVATEQYGSVSTNLVRGNK

SEQ ID NO: 1759 - protein, 29 aa, Artificial Sequence
  Description of Artificial Sequence: Synthetic peptide
DEEEIRTTNPVATEQYGSVSTDNAQRGNR

SEQ ID NO: 1760 - protein, 28 aa, Artificial Sequence
  Description of Artificial Sequence: Synthetic peptide
DEEEIQTTNPVATEQYGSVSTNLQRMNR

SEQ ID NO: 1761 - protein, 29 aa, Artificial Sequence
  Description of Artificial Sequence: Synthetic peptide
DEEEIQTTNPVATEQYGSVSTNLQRGNRF

SEQ ID NO: 1762 - protein, 28 aa, Artificial Sequence
  Description of Artificial Sequence: Synthetic peptide
DEEEIRTTNPMATEQYGFVSTNLQRGNR

SEQ ID NO: 1763 - protein, 29 aa, Artificial Sequence
  Description of Artificial Sequence: Synthetic peptide
DEEEIQTTNPVATEQYGSVSTNLQRGNRD

SEQ ID NO: 1764 - protein, 28 aa, Artificial Sequence
  Description of Artificial Sequence: Synthetic peptide
DEEEIRTTNPMATEQYGLVSTNLQRGNR

SEQ ID NO: 1765 - protein, 28 aa, Artificial Sequence
  Description of Artificial Sequence: Synthetic peptide
DEEEIRTTNPMATEQYGNVSTNLQRGNR

SEQ ID NO: 1766 - protein, 30 aa, Artificial Sequence
  Description of Artificial Sequence: Synthetic polypeptide
DEEEIRTTNPVATEQYGSVSTNLVQRGSNR

SEQ ID NO: 1767 - protein, 28 aa, Artificial Sequence
  Description of Artificial Sequence: Synthetic peptide
DEEEIQTTNPVATEQYGSVSTNLQRGAR

SEQ ID NO: 1768 - protein, 28 aa, Artificial Sequence
  Description of Artificial Sequence: Synthetic peptide
DEEEIQTTNPVATEQYGSVSTNLQHGNR

SEQ ID NO: 1769 - protein, 29 aa, Artificial Sequence
  Description of Artificial Sequence: Synthetic peptide
DEEEIRTTNPLATEQYGSVSTNLQRGNRD

SEQ ID NO: 1770 - protein, 28 aa, Artificial Sequence
  Description of Artificial Sequence: Synthetic peptide
DEEEIQTTNPVATEQYGSVSTNLARGNR

SEQ ID NO: 1771 - protein, 28 aa, Artificial Sequence
  Description of Artificial Sequence: Synthetic peptide
DEEEIQTTNPVATEQYGSVSTNIQRGNR

SEQ ID NO: 1772 - protein, 28 aa, Artificial Sequence
  Description of Artificial Sequence: Synthetic peptide
DEEEIQTTNPVATEQYGSVSTDLQRGNR

SEQ ID NO: 1773 - protein, 28 aa, Artificial Sequence
  Description of Artificial Sequence: Synthetic peptide
DEEEIRTTNPVATEQYGSISTMLQRGNR

SEQ ID NO: 1774 - protein, 29 aa, Artificial Sequence
  Description of Artificial Sequence: Synthetic peptide
DEEEIRTTNPVATEQYGSVSTNLVRGLNR

SEQ ID NO: 1775 - protein, 29 aa, Artificial Sequence
  Description of Artificial Sequence: Synthetic peptide
DEEEIQTTNPVATEQYGSVSETNLQRGNR

SEQ ID NO: 1776 - protein, 29 aa, Artificial Sequence
  Description of Artificial Sequence: Synthetic peptide
DEEEIRTTNPVATEQYGSVSTNLVRGNFR

SEQ ID NO: 1777 - protein, 29 aa, Artificial Sequence
  Description of Artificial Sequence: Synthetic peptide
DEEEIRTTNPVATEQYGSVSTNLVRGNGR

SEQ ID NO: 1778 - protein, 28 aa, Artificial Sequence
  Description of Artificial Sequence: Synthetic peptide
DEEEIRTTNPVATEQYGSISTNEQRGNR

SEQ ID NO: 1779 - protein, 28 aa, Artificial Sequence
  Description of Artificial Sequence: Synthetic peptide
DEEEIQTTNPVATEQYGSVSTNLQYGNR

SEQ ID NO: 1780 - protein, 29 aa, Artificial Sequence
  Description of Artificial Sequence: Synthetic peptide
DEEEIRTTNPVATEQYGSVSTDLQRGNFR

SEQ ID NO: 1781 - protein, 28 aa, Artificial Sequence
  Description of Artificial Sequence: Synthetic peptide
DEEEIRTTNPMATEQYGSVSTNLQRGGR

SEQ ID NO: 1782 - protein, 29 aa, Artificial Sequence
  Description of Artificial Sequence: Synthetic peptide
DEEEIRTTNPMATEQYGSVSTNLQRGMNR

SEQ ID NO: 1783 - protein, 28 aa, Artificial Sequence
  Description of Artificial Sequence: Synthetic peptide
SEEEIRTTNPVATEQYGEVSTNLQRGNR

SEQ ID NO: 1784 - protein, 29 aa, Artificial Sequence
  Description of Artificial Sequence: Synthetic peptide
DEEEIRTTNPQATEQYGSVSTNHLQRGNR

SEQ ID NO: 1785 - protein, 28 aa, Artificial Sequence
  Description of Artificial Sequence: Synthetic peptide
SEEEIRTTNPVATEQYGIVSTNLQRGNR

SEQ ID NO: 1786 - protein, 29 aa, Artificial Sequence
  Description of Artificial Sequence: Synthetic peptide
DEEEIRTTNPQATEQYGSVSTNLPQRGNR

SEQ ID NO: 1787 - protein, 28 aa, Artificial Sequence
  Description of Artificial Sequence: Synthetic peptide
DEEEIRTTNPQATEQYGSVSTNLQLGNR

SEQ ID NO: 1788 - protein, 29 aa, Artificial Sequence
  Description of Artificial Sequence: Synthetic peptide
DEEEIRTTNPQATEQYGSVSTNLQRDGNR

SEQ ID NO: 1789 - protein, 29 aa, Artificial Sequence
  Description of Artificial Sequence: Synthetic peptide
DEEEIRTTNPVATEQYGSVSTNLSRGMNR

SEQ ID NO: 1790 - protein, 29 aa, Artificial Sequence
  Description of Artificial Sequence: Synthetic peptide
DEEEIRTTNPVATEQYGSMVSTNLQRGNQ

SEQ ID NO: 1791 - protein, 28 aa, Artificial Sequence
  Description of Artificial Sequence: Synthetic peptide
DEEEIRTTNPQATEQYGSVSTCLQRGNR

SEQ ID NO: 1792 - protein, 29 aa, Artificial Sequence
  Description of Artificial Sequence: Synthetic peptide
DEWEIRTTNPVATEQYGSVDSTNLQRGNR

SEQ ID NO: 1793 - protein, 30 aa, Artificial Sequence
  Description of Artificial Sequence: Synthetic polypeptide
DEEEIRTTNPVATEQYGSMVSYTNLQRGNR

SEQ ID NO: 1794 - protein, 28 aa, Artificial Sequence
  Description of Artificial Sequence: Synthetic peptide
DEWEIRTTNPVATEQYGSVSTNLQLGNR

SEQ ID NO: 1795 - protein, 28 aa, Artificial Sequence
  Description of Artificial Sequence: Synthetic peptide
DEWEIRTTNPVATEQYGSVSTNLQRDNR

SEQ ID NO: 1796 - protein, 29 aa, Artificial Sequence
  Description of Artificial Sequence: Synthetic peptide
DEEEIRTTNPQATEQYGSVSTNLQRGMNR

SEQ ID NO: 1797 - protein, 28 aa, Artificial Sequence
  Description of Artificial Sequence: Synthetic peptide
DEEEIRTTNPVATEQYGSNSHNLQRGNR

SEQ ID NO: 1798 - protein, 28 aa, Artificial Sequence
  Description of Artificial Sequence: Synthetic peptide
DEWEIRTTNPVATEQYGSVSTNLQRGNN

SEQ ID NO: 1799 - protein, 28 aa, Artificial Sequence
  Description of Artificial Sequence: Synthetic peptide
DEWEIRTTNPVATEQYGSVSTNLQRGNT

SEQ ID NO: 1800 - protein, 29 aa, Artificial Sequence
  Description of Artificial Sequence: Synthetic peptide
SEEEIRTTNPVATEQYGSAVSTNLQRGNR

SEQ ID NO: 1801 - protein, 29 aa, Artificial Sequence
  Description of Artificial Sequence: Synthetic peptide
DEEEIRTTNPVATEQYGSMVSWNLQRGNR

SEQ ID NO: 1802 - protein, 29 aa, Artificial Sequence
  Description of Artificial Sequence: Synthetic peptide
DEEEIRTTNPVATEQYGSVSTNLSRGNRP

SEQ ID NO: 1803 - protein, 30 aa, Artificial Sequence
  Description of Artificial Sequence: Synthetic polypeptide
DEEEIRTTNPVATEQYGSMVSTNLQRGGNR

SEQ ID NO: 1804 - protein, 29 aa, Artificial Sequence
  Description of Artificial Sequence: Synthetic peptide
DEEEIRTTNPVATEQYGSMVSTNLQMGNR

SEQ ID NO: 1805 - protein, 28 aa, Artificial Sequence
  Description of Artificial Sequence: Synthetic peptide
DEEEIRTTNPVATEQYGSMSTNLQRGNM

SEQ ID NO: 1806 - protein, 29 aa, Artificial Sequence
  Description of Artificial Sequence: Synthetic peptide
DEEEIRTTNPNATEQYGSVSTNLQRGNLR

SEQ ID NO: 1807 - protein, 29 aa, Artificial Sequence
  Description of Artificial Sequence: Synthetic peptide
DEEEIRTTNPVATEQYGSMSTNLQRGNMR

SEQ ID NO: 1808 - protein, 30 aa, Artificial Sequence
  Description of Artificial Sequence: Synthetic polypeptide
DEEEIRTTNPVATEQYGSGVSTNLQRGDNR

SEQ ID NO: 1809 - protein, 29 aa, Artificial Sequence
  Description of Artificial Sequence: Synthetic peptide
DEEEIRTTNPVATEQYGSMSTNLQRGNRL

SEQ ID NO: 1810 - protein, 29 aa, Artificial Sequence
  Description of Artificial Sequence: Synthetic peptide
DEEEIRTTNPVATEQYGSMSTNLQRGNRN

SEQ ID NO: 1811 - protein, 29 aa, Artificial Sequence
  Description of Artificial Sequence: Synthetic peptide
DEEEIRTTNPVATEQYGSMSTNLQRIGNR

SEQ ID NO: 1812 - protein, 28 aa, Artificial Sequence
  Description of Artificial Sequence: Synthetic peptide
DEEEIRTTNPVATEQYGSVSTDLKRGNR

SEQ ID NO: 1813 - protein, 28 aa, Artificial Sequence
  Description of Artificial Sequence: Synthetic peptide
DEEEIRTTNPNATEQYGSVSTNLQRQNR

SEQ ID NO: 1814 - protein, 29 aa, Artificial Sequence
  Description of Artificial Sequence: Synthetic peptide
DEEEIRTTNPVATEQYGSVSFNLQRAGNR

SEQ ID NO: 1815 - protein, 28 aa, Artificial Sequence
  Description of Artificial Sequence: Synthetic peptide
DEEEIRTTNPNATEQYGSVSTNWQRGNR

SEQ ID NO: 1816 - protein, 29 aa, Artificial Sequence
  Description of Artificial Sequence: Synthetic peptide
DEEEIRTTNPVATEQYGSMSTNLQTRGNR

SEQ ID NO: 1817 - protein, 29 aa, Artificial Sequence
  Description of Artificial Sequence: Synthetic peptide
DEEEIRTTNPVATEQYGSVSTNNLERGNR

SEQ ID NO: 1818 - protein, 30 aa, Artificial Sequence
  Description of Artificial Sequence: Synthetic polypeptide
DEEEIRTTNPVATEQYGSMVSDTNLQRGNR

SEQ ID NO: 1819 - protein, 29 aa, Artificial Sequence
  Description of Artificial Sequence: Synthetic peptide
DEEEIRTTNPPATEQYGSVSTNLQRGENR

SEQ ID NO: 1820 - protein, 28 aa, Artificial Sequence
  Description of Artificial Sequence: Synthetic peptide
DEEEIRTTNPVATEQYGSVSFNFQRGNR

SEQ ID NO: 1821 - protein, 28 aa, Artificial Sequence
  Description of Artificial Sequence: Synthetic peptide
DEEEIRTTNPQATEQYGSVSINLQRGNR

SEQ ID NO: 1822 - protein, 29 aa, Artificial Sequence
  Description of Artificial Sequence: Synthetic peptide
DEEEIRTTNPVATEQYGSMVSTNDQRGNR

SEQ ID NO: 1823 - protein, 29 aa, Artificial Sequence
  Description of Artificial Sequence: Synthetic peptide
DEEEIRTTNPVATEQYGSMVSTNLQGGNR

SEQ ID NO: 1824 - protein, 28 aa, Artificial Sequence
  Description of Artificial Sequence: Synthetic peptide
DEEEIRTTNPQATEQYGSVSTNLQRGNK

SEQ ID NO: 1825 - protein, 28 aa, Artificial Sequence
  Description of Artificial Sequence: Synthetic peptide
DEEEIKTTNPVATEQYGSNSTNLQRGNR

SEQ ID NO: 1826 - protein, 28 aa, Artificial Sequence
  Description of Artificial Sequence: Synthetic peptide
DEEEIRTTNPVATEQYGSNSTNDQRGNR

SEQ ID NO: 1827 - protein, 29 aa, Artificial Sequence
  Description of Artificial Sequence: Synthetic peptide
DEEEIRTTNPQATEQYGSVSTNLQRGNLR

SEQ ID NO: 1828 - protein, 28 aa, Artificial Sequence
  Description of Artificial Sequence: Synthetic peptide
DEEEIRTTNPVATEQYGSVSTDLDRGNR

SEQ ID NO: 1829 - protein, 28 aa, Artificial Sequence
  Description of Artificial Sequence: Synthetic peptide
DEEEIKTTNPQATEQYGSVSTNLQRGNR

SEQ ID NO: 1830 - protein, 28 aa, Artificial Sequence
  Description of Artificial Sequence: Synthetic peptide
DEEEIKTTNPCATEQYGSVSTNLQRGNR

SEQ ID NO: 1831 - protein, 30 aa, Artificial Sequence
  Description of Artificial Sequence: Synthetic polypeptide
DEEEIRTTNPVATEQYGSNVISTNLQRGNR

SEQ ID NO: 1832 - protein, 30 aa, Artificial Sequence
  Description of Artificial Sequence: Synthetic polypeptide
DEEEIRTTNPVATEQYGSVSTNNLQRFGNR

SEQ ID NO: 1833 - protein, 30 aa, Artificial Sequence
  Description of Artificial Sequence: Synthetic polypeptide
DEEEIRTTNPVATEQYGSVSTNNLQRGLNR

SEQ ID NO: 1834 - protein, 29 aa, Artificial Sequence
  Description of Artificial Sequence: Synthetic peptide
DEEEIRTTNPVATEQYGSNVSSNLQRGNR

SEQ ID NO: 1835 - protein, 30 aa, Artificial Sequence
  Description of Artificial Sequence: Synthetic polypeptide
DEEEIRTTNPVATEQYGSVSTNNLQRGNPR

SEQ ID NO: 1836 - protein, 28 aa, Artificial Sequence
  Description of Artificial Sequence: Synthetic peptide
DEEEIKTTNPTATEQYGSVSTNLQRGNR

SEQ ID NO: 1837 - protein, 30 aa, Artificial Sequence
  Description of Artificial Sequence: Synthetic polypeptide
DEEEIRTTNPVATEQYGSNVSTNELQRGNR

SEQ ID NO: 1838 - protein, 29 aa, Artificial Sequence
  Description of Artificial Sequence: Synthetic peptide
DEEEIRTTNPVATEQYGSNVSTNLQEGNR

SEQ ID NO: 1839 - protein, 29 aa, Artificial Sequence
  Description of Artificial Sequence: Synthetic peptide
DEEEIRTTNPVATEQYGSNVSTNLQRGNG

SEQ ID NO: 1840 - protein, 30 aa, Artificial Sequence
  Description of Artificial Sequence: Synthetic polypeptide
DEEEIRTTNPVATEQYGSNVSTNLQRGNIR

SEQ ID NO: 1841 - protein, 29 aa, Artificial Sequence
  Description of Artificial Sequence: Synthetic peptide
DEEEIRTTNPVATEQYGSVSKTNLQRGNC

SEQ ID NO: 1842 - protein, 28 aa, Artificial Sequence
  Description of Artificial Sequence: Synthetic peptide
DEEEIRTTNPLATCQYGSVSTNLQRGNR

SEQ ID NO: 1843 - protein, 28 aa, Artificial Sequence
  Description of Artificial Sequence: Synthetic peptide
DEEEIITTNPVATEQYGSVSVNLQRGNR

SEQ ID NO: 1844 - protein, 28 aa, Artificial Sequence
  Description of Artificial Sequence: Synthetic peptide
DEEEIRTTNPSATEQYGDVSTNLQRGNR

SEQ ID NO: 1845 - protein, 29 aa, Artificial Sequence
  Description of Artificial Sequence: Synthetic peptide
DEEEIRTTNPSATEQYGSCVSTNLQRGNR

SEQ ID NO: 1846 - protein, 30 aa, Artificial Sequence
  Description of Artificial Sequence: Synthetic polypeptide
DEEEIRTTNPVATEQYGSNVSTNLEQRGNR

SEQ ID NO: 1847 - protein, 28 aa, Artificial Sequence
  Description of Artificial Sequence: Synthetic peptide
DEWEIRTTNPVATEQYGSVSTNLQWGNR

SEQ ID NO: 1848 - protein, 28 aa, Artificial Sequence
  Description of Artificial Sequence: Synthetic peptide
DEEEIRTTNPRATEQYGSVSTNLQSGNR

SEQ ID NO: 1849 - protein, 28 aa, Artificial Sequence
  Description of Artificial Sequence: Synthetic peptide
DEEEIRTTNPRATEQYGSVSTNLQRGNV

SEQ ID NO: 1850 - protein, 29 aa, Artificial Sequence
  Description of Artificial Sequence: Synthetic peptide
DEEEIRTTNPVATEQYGSNSTNLQMRGNR

SEQ ID NO: 1851 - protein, 29 aa, Artificial Sequence
  Description of Artificial Sequence: Synthetic peptide
DEEEIRTTNPVATEQYGSNSTNLQRCGNR

SEQ ID NO: 1852 - protein, 29 aa, Artificial Sequence
  Description of Artificial Sequence: Synthetic peptide
DEEEIRTTNPVATEQYGSNSTNLQRGNAR

SEQ ID NO: 1853 - protein, 28 aa, Artificial Sequence
  Description of Artificial Sequence: Synthetic peptide
DEEEIRTTNPVATEQYGSNSTNLQRGNG

SEQ ID NO: 1854 - protein, 29 aa, Artificial Sequence
  Description of Artificial Sequence: Synthetic peptide
DEEEIRTTNPVATEQYGSVSTNNLQFGNR

SEQ ID NO: 1855 - protein, 28 aa, Artificial Sequence
  Description of Artificial Sequence: Synthetic peptide
DEWEIRTTNPVATEQYGSVSTNLQRGNW

SEQ ID NO: 1856 - protein, 28 aa, Artificial Sequence
  Description of Artificial Sequence: Synthetic peptide
DEEEIRTTNPVATEQYGSNSTNLQRPNR

SEQ ID NO: 1857 - protein, 29 aa, Artificial Sequence
  Description of Artificial Sequence: Synthetic peptide
DEEEIRTTNPQATEQYGSVSTNLQRGNRE

SEQ ID NO: 1858 - protein, 30 aa, Artificial Sequence
  Description of Artificial Sequence: Synthetic polypeptide
DEEEIRTTNPVATEQYGSVSKTNLQRGNER

SEQ ID NO: 1859 - protein, 29 aa, Artificial Sequence
  Description of Artificial Sequence: Synthetic peptide
DEEEIRTTNPQATEQYGSVSTNLQRGNRV

SEQ ID NO: 1860 - protein, 28 aa, Artificial Sequence
  Description of Artificial Sequence: Synthetic peptide
DEEEIRTTNPQATEQYGSVSTNLQRGNS

SEQ ID NO: 1861 - protein, 28 aa, Artificial Sequence
  Description of Artificial Sequence: Synthetic peptide
DEEEIRTTNPQATEQYGSVSTNLQTGNR

SEQ ID NO: 1862 - protein, 28 aa, Artificial Sequence
  Description of Artificial Sequence: Synthetic peptide
DEEEIRTTNPQATEQYGSVSTNPQRGNR

SEQ ID NO: 1863 - protein, 29 aa, Artificial Sequence
  Description of Artificial Sequence: Synthetic peptide
DEWEIRTTNPVATEQYGSVSTNLQSRGNR

SEQ ID NO: 1864 - protein, 28 aa, Artificial Sequence
  Description of Artificial Sequence: Synthetic peptide
DEEEIRTTNPQATEQYGSVSTNSQRGNR

SEQ ID NO: 1865 - protein, 29 aa, Artificial Sequence
  Description of Artificial Sequence: Synthetic peptide
DEEEIRTTNPVATEQYGSNSTNLQRQGNR

SEQ ID NO: 1866 - protein, 28 aa, Artificial Sequence
  Description of Artificial Sequence: Synthetic peptide
DEEEIRTTNPVATEQYGSNSTNLQYGNR

SEQ ID NO: 1867 - protein, 28 aa, Artificial Sequence
  Description of Artificial Sequence: Synthetic peptide
DEEEIRTTNPQATQQYGSVSTNLQRGNR

SEQ ID NO: 1868 - protein, 29 aa, Artificial Sequence
  Description of Artificial Sequence: Synthetic peptide
DEEEIRTTNPVATEQYGSNSTNLSQRGNR

SEQ ID NO: 1869 - protein, 28 aa, Artificial Sequence
  Description of Artificial Sequence: Synthetic peptide
DEEEIRTTNPVATEQYGSNSTNLLRGNR

SEQ ID NO: 1870 - protein, 28 aa, Artificial Sequence
  Description of Artificial Sequence: Synthetic peptide
DEEEIITTNPVATEQYGSVSTNLTRGNR

SEQ ID NO: 1871 - protein, 28 aa, Artificial Sequence
  Description of Artificial Sequence: Synthetic peptide
DEEEIRTTNPNATEQYGSVSTNLQRGNI

SEQ ID NO: 1872 - protein, 29 aa, Artificial Sequence
  Description of Artificial Sequence: Synthetic peptide
DEEEIRTTNPVATEQYGSVSFNLQRGNFR

SEQ ID NO: 1873 - protein, 28 aa, Artificial Sequence
  Description of Artificial Sequence: Synthetic peptide
DEEEIMTTNPVATEQYGSVSTNLERGNR

SEQ ID NO: 1874 - protein, 29 aa, Artificial Sequence
  Description of Artificial Sequence: Synthetic peptide
DEEEIMTTNPVATEQYGSVSETNLQRGNR

SEQ ID NO: 1875 - protein, 28 aa, Artificial Sequence
  Description of Artificial Sequence: Synthetic peptide
DEEEIMTTNPVATEQYGSVATNLQRGNR

SEQ ID NO: 1876 - protein, 29 aa, Artificial Sequence
  Description of Artificial Sequence: Synthetic peptide
DEEEILTTNPVATEQYGSVSTNLQRGNRE

SEQ ID NO: 1877 - protein, 28 aa, Artificial Sequence
  Description of Artificial Sequence: Synthetic peptide
DEEEILTTNPVATEQYGSVSTNLQRGNC

SEQ ID NO: 1878 - protein, 28 aa, Artificial Sequence
  Description of Artificial Sequence: Synthetic peptide
DEEEILTTNPVATEQYGSVSTNLQLGNR

SEQ ID NO: 1879 - protein, 29 aa, Artificial Sequence
  Description of Artificial Sequence: Synthetic peptide
DEEEIRTTNPVATEQYGSHSDTNLQRGNR

SEQ ID NO: 1880 - protein, 29 aa, Artificial Sequence
  Description of Artificial Sequence: Synthetic peptide
DEEEIRTTNPVATEQYGSIVVTNLQRGNR

SEQ ID NO: 1881 - protein, 28 aa, Artificial Sequence
  Description of Artificial Sequence: Synthetic peptide
DEEEIMTTNPVATEQYGSVSTNLQRGNE

SEQ ID NO: 1882 - protein, 30 aa, Artificial Sequence
  Description of Artificial Sequence: Synthetic polypeptide
DEEEIRTTNPVATEQYGSGVSTYNLQRGNR

SEQ ID NO: 1883 - protein, 28 aa, Artificial Sequence
  Description of Artificial Sequence: Synthetic peptide
DEEEIRTTNPVATEQYGSKSTNDQRGNR

SEQ ID NO: 1884 - protein, 28 aa, Artificial Sequence
  Description of Artificial Sequence: Synthetic peptide
DEEEIRTTNPVATEQYGSKSTNLQRGNQ

SEQ ID NO: 1885 - protein, 29 aa, Artificial Sequence
  Description of Artificial Sequence: Synthetic peptide
DEEEIRTTNPVATEQYGSVSFQNLQRGNR

SEQ ID NO: 1886 - protein, 28 aa, Artificial Sequence
  Description of Artificial Sequence: Synthetic peptide
DEEEIRTTNPVATEQYGSKSTNLQRGNS

SEQ ID NO: 1887 - protein, 30 aa, Artificial Sequence
  Description of Artificial Sequence: Synthetic polypeptide
DEEEIRTTNPVATEQYGSKVSTNDLQRGNR

SEQ ID NO: 1888 - protein, 30 aa, Artificial Sequence
  Description of Artificial Sequence: Synthetic polypeptide
DEEEIRTTNPVATEQYGSKVSTNLDQRGNR

SEQ ID NO: 1889 - protein, 29 aa, Artificial Sequence
  Description of Artificial Sequence: Synthetic peptide
DEEEIRTTNPVATEQYGSKVSTNLERGNR

SEQ ID NO: 1890 - protein, 29 aa, Artificial Sequence
  Description of Artificial Sequence: Synthetic peptide
DEEEIRTTNPVATEQYGSKVSTNLQAGNR

SEQ ID NO: 1891 - protein, 30 aa, Artificial Sequence
  Description of Artificial Sequence: Synthetic polypeptide
DEEEIRTTNPVATEQYGSGVSTNSLQRGNR

SEQ ID NO: 1892 - protein, 29 aa, Artificial Sequence
  Description of Artificial Sequence: Synthetic peptide
DEEEIMTTNPVATEQYGSVSTNLQVRGNR

SEQ ID NO: 1893 - protein, 29 aa, Artificial Sequence
  Description of Artificial Sequence: Synthetic peptide
DEEEIMTTNPVATEQYGSVSTNNLQRGNR

SEQ ID NO: 1894 - protein, 28 aa, Artificial Sequence
  Description of Artificial Sequence: Synthetic peptide
DEEEIRTTNPMATEQYGSVSTQLQRGNR

SEQ ID NO: 1895 - protein, 28 aa, Artificial Sequence
  Description of Artificial Sequence: Synthetic peptide
DEEEIRTTNPMATEQYGSVSTNLQRGNA

SEQ ID NO: 1896 - protein, 28 aa, Artificial Sequence
  Description of Artificial Sequence: Synthetic peptide
DEEEIRTTNPMATEQYGSVSTNLQRGNE

SEQ ID NO: 1897 - protein, 29 aa, Artificial Sequence
  Description of Artificial Sequence: Synthetic peptide
DEEEIRTTNPVATEQYGSVSTDLQRGLNR

SEQ ID NO: 1898 - protein, 28 aa, Artificial Sequence
  Description of Artificial Sequence: Synthetic peptide
DEEEIRTTNPMATEQYGSVSTNLQRGNQ

SEQ ID NO: 1899 - protein, 30 aa, Artificial Sequence
  Description of Artificial Sequence: Synthetic polypeptide
DEEEIRTTNPVATEQYGSIVSTCNLQRGNR

SEQ ID NO: 1900 - protein, 28 aa, Artificial Sequence
  Description of Artificial Sequence: Synthetic peptide
DEEEINTTNPVATEQFGSVSTNLQRGNR

SEQ ID NO: 1901 - protein, 30 aa, Artificial Sequence
  Description of Artificial Sequence: Synthetic polypeptide
DEEEIRTTNPVATEQYGSIVSTNLQRGMNR

SEQ ID NO: 1902 - protein, 28 aa, Artificial Sequence
  Description of Artificial Sequence: Synthetic peptide
DEEEINTTNPVASEQYGSVSTNLQRGNR

SEQ ID NO: 1903 - protein, 30 aa, Artificial Sequence
  Description of Artificial Sequence: Synthetic polypeptide
DEEEIRTTNPVATEQYGSIVSTNLQRGNRT

SEQ ID NO: 1904 - protein, 29 aa, Artificial Sequence
  Description of Artificial Sequence: Synthetic peptide
DEEEIRTTNPVATEQYGSIVSTNLQRINR

SEQ ID NO: 1905 - protein, 28 aa, Artificial Sequence
  Description of Artificial Sequence: Synthetic peptide
DEEEINTTNPHATEQYGSVSTNLQRGNR

SEQ ID NO: 1906 - protein, 29 aa, Artificial Sequence
  Description of Artificial Sequence: Synthetic peptide
DEEEIRTTNPMATEQYGSVSTNLQRGNRM

SEQ ID NO: 1907 - protein, 29 aa, Artificial Sequence
  Description of Artificial Sequence: Synthetic peptide
DEEEIRTTNPMATEQYGSVSTNLQRGPNR

SEQ ID NO: 1908 - protein, 29 aa, Artificial Sequence
  Description of Artificial Sequence: Synthetic peptide
DEEEIRTTNPMATEQYGSVSTNLQRGTNR

SEQ ID NO: 1909 - protein, 28 aa, Artificial Sequence
  Description of Artificial Sequence: Synthetic peptide
DEEEIRTTNPMATEQYGSVSTNLQRGTR

SEQ ID NO: 1910 - protein, 29 aa, Artificial Sequence
  Description of Artificial Sequence: Synthetic peptide
DEEEIRTTNPMATEQYGSVSTNLQRQGNR

SEQ ID NO: 1911 - protein, 28 aa, Artificial Sequence
  Description of Artificial Sequence: Synthetic peptide
DEEEIMTTNPVATEQYGVVSTNLQRGNR

SEQ ID NO: 1912 - protein, 29 aa, Artificial Sequence
  Description of Artificial Sequence: Synthetic peptide
DEEEIMTTNPVATEQYGSVSTPNLQRGNR

SEQ ID NO: 1913 - protein, 29 aa, Artificial Sequence
  Description of Artificial Sequence: Synthetic peptide
DEEEIRTTNPMATEQYGSVSTNLQSRGNR

SEQ ID NO: 1914 - protein, 30 aa, Artificial Sequence
  Description of Artificial Sequence: Synthetic polypeptide
DEEEIRTTNPVATEQYGSKVSTNLQRGDNR

SEQ ID NO: 1915 - protein, 28 aa, Artificial Sequence
  Description of Artificial Sequence: Synthetic peptide
DEEEIRTTNPVATEQYGSMSTNLQEGNR

SEQ ID NO: 1916 - protein, 28 aa, Artificial Sequence
  Description of Artificial Sequence: Synthetic peptide
DEEEIRTTNPVATEQYGSLITNLQRGNR

SEQ ID NO: 1917 - protein, 28 aa, Artificial Sequence
  Description of Artificial Sequence: Synthetic peptide
DEEEIRTTNPVATEQYGSLSTMLQRGNR

SEQ ID NO: 1918 - protein, 28 aa, Artificial Sequence
  Description of Artificial Sequence: Synthetic peptide
DEEEIRTTNPVATEQYGSVSFNLQRQNR

SEQ ID NO: 1919 - protein, 30 aa, Artificial Sequence
  Description of Artificial Sequence: Synthetic polypeptide
DEEEIRTTNPVATEQYGSLVSTNDLQRGNR

SEQ ID NO: 1920 - protein, 30 aa, Artificial Sequence
  Description of Artificial Sequence: Synthetic polypeptide
DEEEIRTTNPVATEQYGSLVSTNLQRGANR

SEQ ID NO: 1921 - protein, 30 aa, Artificial Sequence
  Description of Artificial Sequence: Synthetic polypeptide
DEEEIRTTNPVATEQYGSVSTNNGLQRGNR

SEQ ID NO: 1922 - protein, 29 aa, Artificial Sequence
  Description of Artificial Sequence: Synthetic peptide
DEEEIRTTNPVATEQYGSLVSTNLQRGNC

SEQ ID NO: 1923 - protein, 29 aa, Artificial Sequence
  Description of Artificial Sequence: Synthetic peptide
DEEEIRTTNPVATEQYGSLVSTNLQRGNL

SEQ ID NO: 1924 - protein, 29 aa, Artificial Sequence
  Description of Artificial Sequence: Synthetic peptide
DEEEIRTTNPVATEQYGSVSTNLSRGNTR

SEQ ID NO: 1925 - protein, 29 aa, Artificial Sequence
  Description of Artificial Sequence: Synthetic peptide
DEEEIRTTNPVATEQYGSGVSTNLQRGVR

SEQ ID NO: 1926 - protein, 29 aa, Artificial Sequence
  Description of Artificial Sequence: Synthetic peptide
DEEEIRTTNPVATEQYGSVSFNLQSRGNR

SEQ ID NO: 1927 - protein, 30 aa, Artificial Sequence
  Description of Artificial Sequence: Synthetic polypeptide
DEEEIRTTNPVATEQYGSGVSTNLQRGTNR

SEQ ID NO: 1928 - protein, 29 aa, Artificial Sequence
  Description of Artificial Sequence: Synthetic peptide
DEEEIRTTNPNATEQYGSVPSTNLQRGNR

SEQ ID NO: 1929 - protein, 29 aa, Artificial Sequence
  Description of Artificial Sequence: Synthetic peptide
DEEEIRTTNPVATEQYGSVSTNLSRGNRT

SEQ ID NO: 1930 - protein, 28 aa, Artificial Sequence
  Description of Artificial Sequence: Synthetic peptide
DEEEIRTTNPVATEQYGSMSPNLQRGNR

SEQ ID NO: 1931 - protein, 28 aa, Artificial Sequence
  Description of Artificial Sequence: Synthetic peptide
DEEEIRTTNPNATEQYGSVSPNLQRGNR

SEQ ID NO: 1932 - protein, 29 aa, Artificial Sequence
  Description of Artificial Sequence: Synthetic peptide
DEEEIRTTNPVATEQYGSVSTNLSRGNRQ

SEQ ID NO: 1933 - protein, 30 aa, Artificial Sequence
  Description of Artificial Sequence: Synthetic polypeptide
DEEEIRTTNPVATEQYGSGVSTNLQRGINR

SEQ ID NO: 1934 - protein, 28 aa, Artificial Sequence
  Description of Artificial Sequence: Synthetic peptide
DEEEIRTTNPVATEQYGSMSTNLARGNR

SEQ ID NO: 1935 - protein, 29 aa, Artificial Sequence
  Description of Artificial Sequence: Synthetic peptide
DEEEIRTTNPNATEQYGSVSTNLIQRGNR

SEQ ID NO: 1936 - protein, 30 aa, Artificial Sequence
  Description of Artificial Sequence: Synthetic polypeptide
DEEEIRTTNPVATEQYGSGVSTNLQRGNNR

SEQ ID NO: 1937 - protein, 28 aa, Artificial Sequence
  Description of Artificial Sequence: Synthetic peptide
DEEEIRTTNPVATEQYGSVSFNLSRGNR

SEQ ID NO: 1938 - protein, 29 aa, Artificial Sequence
  Description of Artificial Sequence: Synthetic peptide
DEEEIRTTNPVATEQYGSVSTNNFQRGNR

SEQ ID NO: 1939 - protein, 29 aa, Artificial Sequence
  Description of Artificial Sequence: Synthetic peptide
DEEEIRTTNPVATEQYGSVSTNLSVRGNR

SEQ ID NO: 1940 - protein, 29 aa, Artificial Sequence
  Description of Artificial Sequence: Synthetic peptide
DEEEIRTTNPVATEQYGSLSTNLQIRGNR

SEQ ID NO: 1941 - protein, 28 aa, Artificial Sequence
  Description of Artificial Sequence: Synthetic peptide
DEEEIKTTNPVATEQYGVVSTNLQRGNR

SEQ ID NO: 1942 - protein, 28 aa, Artificial Sequence
  Description of Artificial Sequence: Synthetic peptide
DEEEIRTTNPVATEQYGSLSTNLQRENR

SEQ ID NO: 1943 - protein, 28 aa, Artificial Sequence
  Description of Artificial Sequence: Synthetic peptide
DEEEIRTTNPVATEQYGSLSTNLQRGGR

SEQ ID NO: 1944 - protein, 28 aa, Artificial Sequence
  Description of Artificial Sequence: Synthetic peptide
DEEEIRTTNPVATEQYGSLSTNLQRGLR

SEQ ID NO: 1945 - protein, 28 aa, Artificial Sequence
  Description of Artificial Sequence: Synthetic peptide
DEEEIKTTNPVATEQYGSVTTNLQRGNR

SEQ ID NO: 1946 - protein, 29 aa, Artificial Sequence
  Description of Artificial Sequence: Synthetic peptide
DEEEIRTTNPVATEQYGSLSTNLQRGTNR

SEQ ID NO: 1947 - protein, 29 aa, Artificial Sequence
  Description of Artificial Sequence: Synthetic peptide
DEEEIRTTNPVATEQYGSLSTNLQRTGNR

SEQ ID NO: 1948 - protein, 29 aa, Artificial Sequence
  Description of Artificial Sequence: Synthetic peptide
DEEEIRTTNPVATEQYGSLSTNLQRYGNR

SEQ ID NO: 1949 - protein, 29 aa, Artificial Sequence
  Description of Artificial Sequence: Synthetic peptide
DEEEIRTTNPVATEQYGSLSTQNLQRGNR

SEQ ID NO: 1950 - protein, 28 aa, Artificial Sequence
  Description of Artificial Sequence: Synthetic peptide
DEEEIKTTNPVATEQYGSVSTNLVRGNR

SEQ ID NO: 1951 - protein, 28 aa, Artificial Sequence
  Description of Artificial Sequence: Synthetic peptide
DEEEIKTTNPVATEQYGSVSTNLQRGNY

SEQ ID NO: 1952 - protein, 29 aa, Artificial Sequence
  Description of Artificial Sequence: Synthetic peptide
DEEEIKTTNPVATEQYGSVSTNLQRGNER

SEQ ID NO: 1953 - protein, 28 aa, Artificial Sequence
  Description of Artificial Sequence: Synthetic peptide
DEEEIKTTNPVATEQYGSVSTNLQRGIR

SEQ ID NO: 1954 - protein, 28 aa, Artificial Sequence
  Description of Artificial Sequence: Synthetic peptide
DEEEIRATNPVATEQWGSVSTNLQRGNR

SEQ ID NO: 1955 - protein, 29 aa, Artificial Sequence
  Description of Artificial Sequence: Synthetic peptide
DEEEIRTTNPVATEQYGSVSTDLQFRGNR

SEQ ID NO: 1956 - protein, 29 aa, Artificial Sequence
  Description of Artificial Sequence: Synthetic peptide
DEEEIKTTNPVATEQYGSVSTNLQRFGNR

SEQ ID NO: 1957 - protein, 28 aa, Artificial Sequence
  Description of Artificial Sequence: Synthetic peptide
DEEEIKTTNPVATEQYGSVSTNLQRENR

SEQ ID NO: 1958 - protein, 30 aa, Artificial Sequence
  Description of Artificial Sequence: Synthetic polypeptide
DEEEIRTTNPVATEQYGSGVSTNLQVRGNR

SEQ ID NO: 1959 - protein, 29 aa, Artificial Sequence
  Description of Artificial Sequence: Synthetic peptide
DEEEIRTTNPVATEQYGSLSCTNLQRGNR

SEQ ID NO: 1960 - protein, 30 aa, Artificial Sequence
  Description of Artificial Sequence: Synthetic polypeptide
DEEEIRTTNPVATEQYGSVSTNTLQFRGNR

SEQ ID NO: 1961 - protein, 29 aa, Artificial Sequence
  Description of Artificial Sequence: Synthetic peptide
DEEEIRTTNPVATEQYGSVSTCLQRGMNR

SEQ ID NO: 1962 - protein, 29 aa, Artificial Sequence
  Description of Artificial Sequence: Synthetic peptide
DEEEIRTTNPVATEQYGSVSTCLQRDGNR

SEQ ID NO: 1963 - protein, 29 aa, Artificial Sequence
  Description of Artificial Sequence: Synthetic peptide
DEEEIRTTNPVATEQYGSVSTNLQRLNRI

SEQ ID NO: 1964 - protein, 28 aa, Artificial Sequence
  Description of Artificial Sequence: Synthetic peptide
DSEEIRTTNPVITEQYGSVSTNLQRGNR

SEQ ID NO: 1965 - protein, 29 aa, Artificial Sequence
  Description of Artificial Sequence: Synthetic peptide
DEEEIRTTNPVATEQYGSVSTNLQRLNRC

SEQ ID NO: 1966 - protein, 28 aa, Artificial Sequence
  Description of Artificial Sequence: Synthetic peptide
DSEEIRTTNPYATEQYGSVSTNLQRGNR

SEQ ID NO: 1967 - protein, 28 aa, Artificial Sequence
  Description of Artificial Sequence: Synthetic peptide
DEEEIRTTNPVATEQYGSVSTNLQRLNA

SEQ ID NO: 1968 - protein, 28 aa, Artificial Sequence
  Description of Artificial Sequence: Synthetic peptide
DEEEIRATNPVATEQYGSVSTNLQRFNR

SEQ ID NO: 1969 - protein, 30 aa, Artificial Sequence
  Description of Artificial Sequence: Synthetic polypeptide
DEEEIRTTNPVATEQYGSVSTNLQRLGQNR

SEQ ID NO: 1970 - protein, 29 aa, Artificial Sequence
  Description of Artificial Sequence: Synthetic peptide
AEEEIRTTNPVATEQYGSVSTNLQRLGNR

SEQ ID NO: 1971 - protein, 29 aa, Artificial Sequence
  Description of Artificial Sequence: Synthetic peptide
DEEEIRTTNPVATEQYGSVSTNLQRLNYR

SEQ ID NO: 1972 - protein, 28 aa, Artificial Sequence
  Description of Artificial Sequence: Synthetic peptide
AEEEIRTTNPVATEQYGSVSTNLQRGQR

SEQ ID NO: 1973 - protein, 29 aa, Artificial Sequence
  Description of Artificial Sequence: Synthetic peptide
AEEEIRTTNPVATEQYGSVSTNLQRGNRP

SEQ ID NO: 1974 - protein, 29 aa, Artificial Sequence
  Description of Artificial Sequence: Synthetic peptide
AEEEIRTTNPVATEQYGSVSTNLQRGNRN

SEQ ID NO: 1975 - protein, 28 aa, Artificial Sequence
  Description of Artificial Sequence: Synthetic peptide
DEREIRTTNPVATEQYGVVSTNLQRGNR

SEQ ID NO: 1976 - protein, 28 aa, Artificial Sequence
  Description of Artificial Sequence: Synthetic peptide
AEEEIRTTNPVATEQYGSVSTNLQRGNL

SEQ ID NO: 1977 - protein, 28 aa, Artificial Sequence
  Description of Artificial Sequence: Synthetic peptide
AEEEIRTTNPVATEQYGSVSTNLQRGNK

SEQ ID NO: 1978 - protein, 28 aa, Artificial Sequence
  Description of Artificial Sequence: Synthetic peptide
AEEEIRTTNPVATEQYGSVSTNLQRGNI

SEQ ID NO: 1979 - protein, 28 aa, Artificial Sequence
  Description of Artificial Sequence: Synthetic peptide
DEREIRTTNPVATEQYGSVSTYLQRGNR

SEQ ID NO: 1980 - protein, 28 aa, Artificial Sequence
  Description of Artificial Sequence: Synthetic peptide
DEREIRTTNPVATEQYGSVSTQLQRGNR

SEQ ID NO: 1981 - protein, 29 aa, Artificial Sequence
  Description of Artificial Sequence: Synthetic peptide
AEEEIRTTNPVATEQYGSVSTNLQRGNRT

SEQ ID NO: 1982 - protein, 28 aa, Artificial Sequence
  Description of Artificial Sequence: Synthetic peptide
DEREIRTTNPVATEQYGSVSTNPQRGNR

SEQ ID NO: 1983 - protein, 29 aa, Artificial Sequence
  Description of Artificial Sequence: Synthetic peptide
DEEEIRTTNPVATEQYGSVSTNLQRMGAR

SEQ ID NO: 1984 - protein, 30 aa, Artificial Sequence
  Description of Artificial Sequence: Synthetic polypeptide
DEEEIRTTNPVATEQYGSVSTPNLQDRGNR

SEQ ID NO: 1985 - protein, 28 aa, Artificial Sequence
  Description of Artificial Sequence: Synthetic peptide
DEEEICTTNPVATEQMGSVSTNLQRGNR

SEQ ID NO: 1986 - protein, 29 aa, Artificial Sequence
  Description of Artificial Sequence: Synthetic peptide
DEEEIRATNPVATEQYGSVSTNLIQRGNR

SEQ ID NO: 1987 - protein, 29 aa, Artificial Sequence
  Description of Artificial Sequence: Synthetic peptide
DEEEIRTTNPVATEQYGSVSTNLQRNENR

SEQ ID NO: 1988 - protein, 29 aa, Artificial Sequence
  Description of Artificial Sequence: Synthetic peptide
DEEEIRTTNPVATEQYGSVSTNLQRNANR

SEQ ID NO: 1989 - protein, 29 aa, Artificial Sequence
  Description of Artificial Sequence: Synthetic peptide
DEEEIRTTNPVATEQYGSVSTNLQRMPNR

SEQ ID NO: 1990 - protein, 29 aa, Artificial Sequence
  Description of Artificial Sequence: Synthetic peptide
DEEEIRTTNPVATEQYGSVSTNLQRMNRA

SEQ ID NO: 1991 - protein, 30 aa, Artificial Sequence
  Description of Artificial Sequence: Synthetic polypeptide
DEEEIRTTNPVATEQYGSVSTENFLQRGNR

SEQ ID NO: 1992 - protein, 29 aa, Artificial Sequence
  Description of Artificial Sequence: Synthetic peptide
DEEEIRTTNPVATEQYGSVSTNLQRMNNR

SEQ ID NO: 1993 - protein, 30 aa, Artificial Sequence
  Description of Artificial Sequence: Synthetic polypeptide
DEEEIRTTNPVATEQYGSVSTNLQRMGNPR

SEQ ID NO: 1994 - protein, 29 aa, Artificial Sequence
  Description of Artificial Sequence: Synthetic peptide
DEEEIRTTNPVATEQYGSVSTNLQRMNGR

SEQ ID NO: 1995 - protein, 29 aa, Artificial Sequence
  Description of Artificial Sequence: Synthetic peptide
DEEEIRTTNPVATEQYGSVSTNLQRMNAR

SEQ ID NO: 1996 - protein, 29 aa, Artificial Sequence
  Description of Artificial Sequence: Synthetic peptide
DEEEIRTTNPVATEQYGSVADTNLQRGNR

SEQ ID NO: 1997 - protein, 28 aa, Artificial Sequence
  Description of Artificial Sequence: Synthetic peptide
DEEEIRATNPVATEQYGSVSTNLQCGNR

SEQ ID NO: 1998 - protein, 28 aa, Artificial Sequence
  Description of Artificial Sequence: Synthetic peptide
DEEEIRTTNPVATEQYGCVSGNLQRGNR

SEQ ID NO: 1999 - protein, 29 aa, Artificial Sequence
  Description of Artificial Sequence: Synthetic peptide
DEEEIRTTNPVATEQYGSVSTNLQRMGTR

SEQ ID NO: 2000 - protein, 30 aa, Artificial Sequence
  Description of Artificial Sequence: Synthetic polypeptide
DEEEIRTTNPVATEQYGSVSTNLQRMGPNR

SEQ ID NO: 2001 - protein, 29 aa, Artificial Sequence
  Description of Artificial Sequence: Synthetic peptide
DEEEIRTTNPVATEQYGSVSFVNLQRGNR

SEQ ID NO: 2002 - protein, 29 aa, Artificial Sequence
  Description of Artificial Sequence: Synthetic peptide
DEEEIRATNPVATEQYGSVSTNLQNRGNR

SEQ ID NO: 2003 - protein, 29 aa, Artificial Sequence
  Description of Artificial Sequence: Synthetic peptide
DEEEIRTTNPVATEQYGSVSTNLQRMNDR

SEQ ID NO: 2004 - protein, 28 aa, Artificial Sequence
  Description of Artificial Sequence: Synthetic peptide
DEREIRTTNPVATEQYGSVSTNLQVGNR

SEQ ID NO: 2005 - protein, 29 aa, Artificial Sequence
  Description of Artificial Sequence: Synthetic peptide
DEEEIRTTNPVATEQYGSVSTNLQRLGNQ

SEQ ID NO: 2006 - protein, 28 aa, Artificial Sequence
  Description of Artificial Sequence: Synthetic peptide
DEREIRTTNPVATEQYGSVSTNLQRTNR

SEQ ID NO: 2007 - protein, 28 aa, Artificial Sequence
  Description of Artificial Sequence: Synthetic peptide
DEREIRTTNPSATEQYGSVSTNLQRGNR

SEQ ID NO: 2008 - protein, 30 aa, Artificial Sequence
  Description of Artificial Sequence: Synthetic polypeptide
DEEEIRTTNPVATEQYGSVSTNLQRIGNSR

SEQ ID NO: 2009 - protein, 28 aa, Artificial Sequence
  Description of Artificial Sequence: Synthetic peptide
DEEEIRATNPVATEQYGSVSTNTQRGNR

SEQ ID NO: 2010 - protein, 29 aa, Artificial Sequence
  Description of Artificial Sequence: Synthetic peptide
DEEEIRTTNPVATEQYGSVSTNLQRIFNR

SEQ ID NO: 2011 - protein, 28 aa, Artificial Sequence
  Description of Artificial Sequence: Synthetic peptide
DEEEIRTTNPVATEQYGSVSTNLQRHNW

SEQ ID NO: 2012 - protein, 28 aa, Artificial Sequence
  Description of Artificial Sequence: Synthetic peptide
DEQEISTTNPVATEQYGSVSTNLQRGNR

SEQ ID NO: 2013 - protein, 28 aa, Artificial Sequence
  Description of Artificial Sequence: Synthetic peptide
DEEEIRTTNPVATEQYGSVSTNLQRHNG

SEQ ID NO: 2014 - protein, 30 aa, Artificial Sequence
  Description of Artificial Sequence: Synthetic polypeptide
DEEEIRTTNPVATEQYGSVSTNLQRHGGNR

SEQ ID NO: 2015 - protein, 28 aa, Artificial Sequence
  Description of Artificial Sequence: Synthetic peptide
DEREIRTTNPVATEFYGSVSTNLQRGNR

SEQ ID NO: 2016 - protein, 28 aa, Artificial Sequence
  Description of Artificial Sequence: Synthetic peptide
DEEEIRTTNPVATEQYGSVSTNLQRHDR

SEQ ID NO: 2017 - protein, 28 aa, Artificial Sequence
  Description of Artificial Sequence: Synthetic peptide
DEQEIRTTNPVATEVYGSVSTNLQRGNR

SEQ ID NO: 2018 - protein, 29 aa, Artificial Sequence
  Description of Artificial Sequence: Synthetic peptide
DEEEIRTTNPVATEQYGSVSTNLQRGYNE

SEQ ID NO: 2019 - protein, 30 aa, Artificial Sequence
  Description of Artificial Sequence: Synthetic polypeptide
DEEEIRTTNPVATEQYGSVSLTNGLQRGNR

SEQ ID NO: 2020 - protein, 29 aa, Artificial Sequence
  Description of Artificial Sequence: Synthetic peptide
DEEEIRTTNPVATEQYGSVASINLQRGNR

SEQ ID NO: 2021 - protein, 29 aa, Artificial Sequence
  Description of Artificial Sequence: Synthetic peptide
DEEEIRTTNPVATEQYGSVSTNLQRGVRC

SEQ ID NO: 2022 - protein, 28 aa, Artificial Sequence
  Description of Artificial Sequence: Synthetic peptide
DEEEIRTTNPVATEQYGSVSTNLQRGVA

SEQ ID NO: 2023 - protein, 29 aa, Artificial Sequence
  Description of Artificial Sequence: Synthetic peptide
DEEEIRTTNPVATEQYGSVSTNLQRGTVR

SEQ ID NO: 2024 - protein, 28 aa, Artificial Sequence
  Description of Artificial Sequence: Synthetic peptide
DEEEIRTTNPVATEQYGSVSTNLQRGTV

SEQ ID NO: 2025 - protein, 30 aa, Artificial Sequence
  Description of Artificial Sequence: Synthetic polypeptide
DEEEIRTTNPVATEQYGSVSTNLQRGYNSR

SEQ ID NO: 2026 - protein, 28 aa, Artificial Sequence
  Description of Artificial Sequence: Synthetic peptide
DEREIRTTNPVATEQCGSVSTNLQRGNR

SEQ ID NO: 2027 - protein, 28 aa, Artificial Sequence
  Description of Artificial Sequence: Synthetic peptide
DEREIRTTNPVATEQWGSVSTNLQRGNR

SEQ ID NO: 2028 - protein, 29 aa, Artificial Sequence
  Description of Artificial Sequence: Synthetic peptide
DEEEIRTTNPVATEQYGDVSTNLQFRGNR

SEQ ID NO: 2029 - protein, 29 aa, Artificial Sequence
  Description of Artificial Sequence: Synthetic peptide
DEREIRTTNPVATEQYGSVSTNLQRGTNR

SEQ ID NO: 2030 - protein, 29 aa, Artificial Sequence
  Description of Artificial Sequence: Synthetic peptide
DEREIRTTNPVATEQYGSVSTNLQRGNRD

SEQ ID NO: 2031 - protein, 29 aa, Artificial Sequence
  Description of Artificial Sequence: Synthetic peptide
DEREIRTTNPVATEQYGSVSTNLQRGNRA

SEQ ID NO: 2032 - protein, 29 aa, Artificial Sequence
  Description of Artificial Sequence: Synthetic peptide
DEREIRTTNPVATEQYGSVSTNLQRGNNR

SEQ ID NO: 2033 - protein, 29 aa, Artificial Sequence
  Description of Artificial Sequence: Synthetic peptide
DEREIRTTNPVATEQYGSVSTNLQRGNHR

SEQ ID NO: 2034 - protein, 29 aa, Artificial Sequence
  Description of Artificial Sequence: Synthetic peptide
DEREIRTTNPVATEQYGSVSTNLQRGINR

SEQ ID NO: 2035 - protein, 29 aa, Artificial Sequence
  Description of Artificial Sequence: Synthetic peptide
DEEEIRATNPVATEQYGSVSTNLQRGNFR

SEQ ID NO: 2036 - protein, 28 aa, Artificial Sequence
  Description of Artificial Sequence: Synthetic peptide
DEEEIRATNPVATEQYGSVSTNLQRGNK

SEQ ID NO: 2037 - protein, 29 aa, Artificial Sequence
  Description of Artificial Sequence: Synthetic peptide
DEEEIRTTNPVATEQYGSVSTNLQRLFNR

SEQ ID NO: 2038 - protein, 28 aa, Artificial Sequence
  Description of Artificial Sequence: Synthetic peptide
DEEEIRTTNPVATEQYGSVSTNLQRKNM

SEQ ID NO: 2039 - protein, 29 aa, Artificial Sequence
  Description of Artificial Sequence: Synthetic peptide
DEEEIRATNPVATEQYGSVSTNLQRGNRS

SEQ ID NO: 2040 - protein, 29 aa, Artificial Sequence
  Description of Artificial Sequence: Synthetic peptide
DEEEIRTTNPVATEQYGSVSTENLMRGNR

SEQ ID NO: 2041 - protein, 29 aa, Artificial Sequence
  Description of Artificial Sequence: Synthetic peptide
DEEEIRTTNPVATEQYGSVSTNLQRKDNR

SEQ ID NO: 2042 - protein, 30 aa, Artificial Sequence
  Description of Artificial Sequence: Synthetic polypeptide
DEEEIRTTNPVATEQYGSVSLTLNLQRGNR

SEQ ID NO: 2043 - protein, 28 aa, Artificial Sequence
  Description of Artificial Sequence: Synthetic peptide
DEEEIRATNPVATEQYGSVSTNLQRPNR

SEQ ID NO: 2044 - protein, 28 aa, Artificial Sequence
  Description of Artificial Sequence: Synthetic peptide
DEREIRTTNPVATEQYGSVSPNLQRGNR

SEQ ID NO: 2045 - protein, 28 aa, Artificial Sequence
  Description of Artificial Sequence: Synthetic peptide
DEREIRTTNPVATEQYGSVPTNLQRGNR

SEQ ID NO: 2046 - protein, 29 aa, Artificial Sequence
  Description of Artificial Sequence: Synthetic peptide
DEEEIRATNPVATEQYGSVSTNLVQRGNR

SEQ ID NO: 2047 - protein, 29 aa, Artificial Sequence
  Description of Artificial Sequence: Synthetic peptide
DEREIRTTNPVATEQYGESVSTNLQRGNR

SEQ ID NO: 2048 - protein, 28 aa, Artificial Sequence
  Description of Artificial Sequence: Synthetic peptide
DEDEIRTTNPVATEMYGSVSTNLQRGNR

SEQ ID NO: 2049 - protein, 30 aa, Artificial Sequence
  Description of Artificial Sequence: Synthetic polypeptide
DEEEIRTTNPVATEQYGSVSTNLQRNGNAR

SEQ ID NO: 2050 - protein, 30 aa, Artificial Sequence
  Description of Artificial Sequence: Synthetic polypeptide
DEEEIRTTNPVATEQYGSVSTNLQRNGNDR

SEQ ID NO: 2051 - protein, 29 aa, Artificial Sequence
  Description of Artificial Sequence: Synthetic peptide
DEEEIRATNPVATEQYGSVSTNLDQRGNR

SEQ ID NO: 2052 - protein, 29 aa, Artificial Sequence
  Description of Artificial Sequence: Synthetic peptide
DEEEIRTTNPVATEQYGSTVSTNMQRGNR

SEQ ID NO: 2053 - protein, 29 aa, Artificial Sequence
  Description of Artificial Sequence: Synthetic peptide
DEEEIRTTNPVATEQYGSVSTELQRGNPR

SEQ ID NO: 2054 - protein, 30 aa, Artificial Sequence
  Description of Artificial Sequence: Synthetic polypeptide
DEEEIRTTNPVATEQYGSTVSTNQLQRGNR

SEQ ID NO: 2055 - protein, 29 aa, Artificial Sequence
  Description of Artificial Sequence: Synthetic peptide
DEEEIRTTNPVATEQYGSVSTELQRIGNR

SEQ ID NO: 2056 - protein, 30 aa, Artificial Sequence
  Description of Artificial Sequence: Synthetic polypeptide
DEEEIRTTNPVATEQYGSVSTNLQRSGDNR

SEQ ID NO: 2057 - protein, 29 aa, Artificial Sequence
  Description of Artificial Sequence: Synthetic peptide
DEEEIRTTNPVATEQYGSVSLNTLQRGNR

SEQ ID NO: 2058 - protein, 28 aa, Artificial Sequence
  Description of Artificial Sequence: Synthetic peptide
DEEEIRTTNPVATEQYGSVSTELQRWNR

SEQ ID NO: 2059 - protein, 28 aa, Artificial Sequence
  Description of Artificial Sequence: Synthetic peptide
DEEEICTTNPVATEQYGSVSANLQRGNR

SEQ ID NO: 2060 - protein, 29 aa, Artificial Sequence
  Description of Artificial Sequence: Synthetic peptide
DEEEIRTTNPVATEQYGSVSTELQRGNFR

SEQ ID NO: 2061 - protein, 29 aa, Artificial Sequence
  Description of Artificial Sequence: Synthetic peptide
DEEEIRTTNPVAGEQYGSVSTPNLQRGNR

SEQ ID NO: 2062 - protein, 28 aa, Artificial Sequence
  Description of Artificial Sequence: Synthetic peptide
DEEEIRTTNPVATEQYGSVSTNLQRRNF

SEQ ID NO: 2063 - protein, 28 aa, Artificial Sequence
  Description of Artificial Sequence: Synthetic peptide
DEEEIRTTNPVATEQYGSVSTELQTGNR

SEQ ID NO: 2064 - protein, 29 aa, Artificial Sequence
  Description of Artificial Sequence: Synthetic peptide
DEEEIRTTNPVATEQYGSVSTNLQRRGNM

SEQ ID NO: 2065 - protein, 28 aa, Artificial Sequence
  Description of Artificial Sequence: Synthetic peptide
DEEEIRTTNPVATEQYGSVSTELQWGNR

SEQ ID NO: 2066 - protein, 28 aa, Artificial Sequence
  Description of Artificial Sequence: Synthetic peptide
DEEEIRTTNPVAGEQYGSVSTVLQRGNR

SEQ ID NO: 2067 - protein, 29 aa, Artificial Sequence
  Description of Artificial Sequence: Synthetic peptide
DEEEIRTTNPVATEQYGSVSTELQYRGNR

SEQ ID NO: 2068 - protein, 28 aa, Artificial Sequence
  Description of Artificial Sequence: Synthetic peptide
DSEEIRTTNPVATEQYGNVSTNLQRGNR

SEQ ID NO: 2069 - protein, 29 aa, Artificial Sequence
  Description of Artificial Sequence: Synthetic peptide
DEEEIRTTNPVATEQYGSVSTNLQRQPNR

SEQ ID NO: 2070 - protein, 28 aa, Artificial Sequence
  Description of Artificial Sequence: Synthetic peptide
DEEEIRTTNPVATEQYGSVSTNLQRRNW

SEQ ID NO: 2071 - protein, 29 aa, Artificial Sequence
  Description of Artificial Sequence: Synthetic peptide
DEEEIRTTNPVATEQYGSVSTNLQRSTNR

SEQ ID NO: 2072 - protein, 28 aa, Artificial Sequence
  Description of Artificial Sequence: Synthetic peptide
DEEEIRTTNPVATEQYGSVSTELQRGAR

SEQ ID NO: 2073 - protein, 29 aa, Artificial Sequence
  Description of Artificial Sequence: Synthetic peptide
DEEEIRTTNPVATEQYGSVSTNLQRTGGR

SEQ ID NO: 2074 - protein, 29 aa, Artificial Sequence
  Description of Artificial Sequence: Synthetic peptide
DEEEIRTTNPVATEQYGSVSTNLQRTNRM

SEQ ID NO: 2075 - protein, 28 aa, Artificial Sequence
  Description of Artificial Sequence: Synthetic peptide
DEEEIRTTNPVAGEQYGSVGTNLQRGNR

SEQ ID NO: 2076 - protein, 28 aa, Artificial Sequence
  Description of Artificial Sequence: Synthetic peptide
DEEEIRTTNPIATENYGSVSTNLQRGNR

SEQ ID NO: 2077 - protein, 29 aa, Artificial Sequence
  Description of Artificial Sequence: Synthetic peptide
DEEEIRTTNPVAGEQYGSVSQTNLQRGNR

SEQ ID NO: 2078 - protein, 29 aa, Artificial Sequence
  Description of Artificial Sequence: Synthetic peptide
DEEEIRTTNPVATEQYGSVSTNLQRTNLR

SEQ ID NO: 2079 - protein, 29 aa, Artificial Sequence
  Description of Artificial Sequence: Synthetic peptide
DEEEIRTTNPVATEQYGSVSTNLQRTNER

SEQ ID NO: 2080 - protein, 29 aa, Artificial Sequence
  Description of Artificial Sequence: Synthetic peptide
DEEEIRTTNPVATEQYGSTVSTNLQRGNY

SEQ ID NO: 2081 - protein, 30 aa, Artificial Sequence
  Description of Artificial Sequence: Synthetic polypeptide
DEEEIRTTNPVATEQYGSTVSTNLQRGPNR

SEQ ID NO: 2082 - protein, 29 aa, Artificial Sequence
  Description of Artificial Sequence: Synthetic peptide
DEEEIRTTNPVAGEQYGSVSTNLQRAGNR

SEQ ID NO: 2083 - protein, 28 aa, Artificial Sequence
  Description of Artificial Sequence: Synthetic peptide
DEEEIRTTNPVAGEQYGSVSTNLQRFNR

SEQ ID NO: 2084 - protein, 29 aa, Artificial Sequence
  Description of Artificial Sequence: Synthetic peptide
DEEEIRTTNPVATEQYGSCSTQNLQRGNR

SEQ ID NO: 2085 - protein, 29 aa, Artificial Sequence
  Description of Artificial Sequence: Synthetic peptide
DEEEIRTTNPVATEQYGSVSTELQLRGNR

SEQ ID NO: 2086 - protein, 30 aa, Artificial Sequence
  Description of Artificial Sequence: Synthetic polypeptide
DEEEIRTTNPVATEQYGSTVSTNLQRQGNR

SEQ ID NO: 2087 - protein, 28 aa, Artificial Sequence
  Description of Artificial Sequence: Synthetic peptide
DEEEIRTTNPVATEQYGSVSTELQMGNR

SEQ ID NO: 2088 - protein, 29 aa, Artificial Sequence
  Description of Artificial Sequence: Synthetic peptide
DEEEIRTTNPVATEQYGSVSTNLQRTLNR

SEQ ID NO: 2089 - protein, 30 aa, Artificial Sequence
  Description of Artificial Sequence: Synthetic polypeptide
DEEEIRTTNPVATEQYGSTVSTNLVQRGNR

SEQ ID NO: 2090 - protein, 29 aa, Artificial Sequence
  Description of Artificial Sequence: Synthetic peptide
DEEEIRTTNPVAGEQYGSVSTNLQRGNNR

SEQ ID NO: 2091 - protein, 28 aa, Artificial Sequence
  Description of Artificial Sequence: Synthetic peptide
DEEEIRTTNPVAGEQYGSVSTNLQRGNQ

SEQ ID NO: 2092 - protein, 28 aa, Artificial Sequence
  Description of Artificial Sequence: Synthetic peptide
DEEEIRTTNPIATECYGSVSTNLQRGNR

SEQ ID NO: 2093 - protein, 28 aa, Artificial Sequence
  Description of Artificial Sequence: Synthetic peptide
DEEEIRTTNPVAGFQYGSVSTNLQRGNR

SEQ ID NO: 2094 - protein, 28 aa, Artificial Sequence
  Description of Artificial Sequence: Synthetic peptide
DEEEIRTTNPVATEQYGSVSTNLQRGTT

SEQ ID NO: 2095 - protein, 29 aa, Artificial Sequence
  Description of Artificial Sequence: Synthetic peptide
DEEEIRTTNPVATEQYGSVSTNLQRQNSR

SEQ ID NO: 2096 - protein, 29 aa, Artificial Sequence
  Description of Artificial Sequence: Synthetic peptide
DEEEIRTTNPVATEQYGSVSTELTQRGNR

SEQ ID NO: 2097 - protein, 30 aa, Artificial Sequence
  Description of Artificial Sequence: Synthetic polypeptide
DEEEIRTTNPVATEQYGSVSTNLQRQGNLR

SEQ ID NO: 2098 - protein, 28 aa, Artificial Sequence
  Description of Artificial Sequence: Synthetic peptide
DESEIRHTNPVATEQYGSVSTNLQRGNR

SEQ ID NO: 2099 - protein, 29 aa, Artificial Sequence
  Description of Artificial Sequence: Synthetic peptide
DEEEIRTTNPVATEQYGSVSTNLQRQGNL

SEQ ID NO: 2100 - protein, 30 aa, Artificial Sequence
  Description of Artificial Sequence: Synthetic polypeptide
DEEEIRTTNPVATEQYGSVSTNLQRQGNAR

SEQ ID NO: 2101 - protein, 29 aa, Artificial Sequence
  Description of Artificial Sequence: Synthetic peptide
DEEEIRTTNPVATEQYGSVSETNIQRGNR

SEQ ID NO: 2102 - protein, 28 aa, Artificial Sequence
  Description of Artificial Sequence: Synthetic peptide
DEEEIRTTNPVAHEQYGSASTNLQRGNR

SEQ ID NO: 2103 - protein, 28 aa, Artificial Sequence
  Description of Artificial Sequence: Synthetic peptide
DEEEIRTTNPVATEQYGSVSTNLQRPNL

SEQ ID NO: 2104 - protein, 29 aa, Artificial Sequence
  Description of Artificial Sequence: Synthetic peptide
DEEEICTTNPVATEQYGSSVSTNLQRGNR

SEQ ID NO: 2105 - protein, 30 aa, Artificial Sequence
  Description of Artificial Sequence: Synthetic polypeptide
DEEEIRTTNPVATEQYGSVSTNLQRQGNRI

SEQ ID NO: 2106 - protein, 29 aa, Artificial Sequence
  Description of Artificial Sequence: Synthetic peptide
DEEEIRTTNPVATEQYGSVSTNLQRPGND

SEQ ID NO: 2107 - protein, 29 aa, Artificial Sequence
  Description of Artificial Sequence: Synthetic peptide
DEEEIRTTNPVATEQYGSVSTNLQRPGFR

SEQ ID NO: 2108 - protein, 28 aa, Artificial Sequence
  Description of Artificial Sequence: Synthetic peptide
DEEEIRTTNPVATEQYGSVSTNLQRPFR

SEQ ID NO: 2109 - protein, 29 aa, Artificial Sequence
  Description of Artificial Sequence: Synthetic peptide
DEEEIRTTNPVATEQYGSVSTNLQRNNRQ

SEQ ID NO: 2110 - protein, 29 aa, Artificial Sequence
  Description of Artificial Sequence: Synthetic peptide
DEEEIRTTNPVATEQYGSVSTNLQRNNGR

SEQ ID NO: 2111 - protein, 28 aa, Artificial Sequence
  Description of Artificial Sequence: Synthetic peptide
DEEEIRTTNPVATEQYGSVSTNLQRNNC

SEQ ID NO: 2112 - protein, 28 aa, Artificial Sequence
  Description of Artificial Sequence: Synthetic peptide
DEEEIRATNPVATEQYGSVSTNHQRGNR

SEQ ID NO: 2113 - protein, 29 aa, Artificial Sequence
  Description of Artificial Sequence: Synthetic peptide
DEEEIRTTNPVATEQYGSVSTNLQRNGNY

SEQ ID NO: 2114 - protein, 29 aa, Artificial Sequence
  Description of Artificial Sequence: Synthetic peptide
DEECIRTTNPVATDEQYGSVSTNLQRGNR

SEQ ID NO: 2115 - protein, 30 aa, Artificial Sequence
  Description of Artificial Sequence: Synthetic polypeptide
DEEEIRTTNPVATEQYGSVSTNLQRPGMNR

SEQ ID NO: 2116 - protein, 29 aa, Artificial Sequence
  Description of Artificial Sequence: Synthetic peptide
DSEEIRTTNPVATEQYGSVSTNLQRGSNR

SEQ ID NO: 2117 - protein, 28 aa, Artificial Sequence
  Description of Artificial Sequence: Synthetic peptide
DSEEIRTTNPVATEQYGSVSTNLQRGNT

SEQ ID NO: 2118 - protein, 28 aa, Artificial Sequence
  Description of Artificial Sequence: Synthetic peptide
DSEEIRTTNPVATEQYGSVSTNLQRGNQ

SEQ ID NO: 2119 - protein, 29 aa, Artificial Sequence
  Description of Artificial Sequence: Synthetic peptide
DEEEIRTTNPVATEQYGSVSTNLQRQNRQ

SEQ ID NO: 2120 - protein, 28 aa, Artificial Sequence
  Description of Artificial Sequence: Synthetic peptide
DEEEIRTTNPVAHEQFGSVSTNLQRGNR

SEQ ID NO: 2121 - protein, 29 aa, Artificial Sequence
  Description of Artificial Sequence: Synthetic peptide
DSEEIRTTNPVATEQYGSVESTNLQRGNR

SEQ ID NO: 2122 - protein, 29 aa, Artificial Sequence
  Description of Artificial Sequence: Synthetic peptide
DEEEIRTTNPVATEQYGSVSTNLQRQNER

SEQ ID NO: 2123 - protein, 30 aa, Artificial Sequence
  Description of Artificial Sequence: Synthetic polypeptide
DEEEIRTTNPVATEQYGSVSETNLHQRGNR

SEQ ID NO: 2124 - protein, 28 aa, Artificial Sequence
  Description of Artificial Sequence: Synthetic peptide
DEEEIRTTNPVATEQYGSVSTNLQRQNC

SEQ ID NO: 2125 - protein, 28 aa, Artificial Sequence
  Description of Artificial Sequence: Synthetic peptide
DEEEIRTTNPVATEQYGSVSTNLQRQMR

SEQ ID NO: 2126 - protein, 29 aa, Artificial Sequence
  Description of Artificial Sequence: Synthetic peptide
DSEEIRTTNPVATEQYGSVSTENLQRGNR

SEQ ID NO: 2127 - protein, 29 aa, Artificial Sequence
  Description of Artificial Sequence: Synthetic peptide
DSEEIRTTNPVATEQYGSVSTGNLQRGNR

SEQ ID NO: 2128 - protein, 29 aa, Artificial Sequence
  Description of Artificial Sequence: Synthetic peptide
DEEEIRTTNPVATEQYGSVSLQNLQRGNR

SEQ ID NO: 2129 - protein, 30 aa, Artificial Sequence
  Description of Artificial Sequence: Synthetic polypeptide
DEEEIRTTNPVATEQYGSVSTNLQRQGSNR

SEQ ID NO: 2130 - protein, 29 aa, Artificial Sequence
  Description of Artificial Sequence: Synthetic peptide
DEEEIRTTNPVATEQYGSVSTNLQRQGNV

SEQ ID NO: 2131 - protein, 29 aa, Artificial Sequence
  Description of Artificial Sequence: Synthetic peptide
DSEEIRTTNPVATEQYGSVSTNLEQRGNR

SEQ ID NO: 2132 - protein, 28 aa, Artificial Sequence
  Description of Artificial Sequence: Synthetic peptide
DESEIRTTNPVAEEQYGSVSTNLQRGNR

SEQ ID NO: 2133 - protein, 28 aa, Artificial Sequence
  Description of Artificial Sequence: Synthetic peptide
DESEIRTTNPSATEQYGSVSTNLQRGNR

SEQ ID NO: 2134 - protein, 28 aa, Artificial Sequence
  Description of Artificial Sequence: Synthetic peptide
DESEIRTTNPLATEQYGSVSTNLQRGNR

SEQ ID NO: 2135 - protein, 28 aa, Artificial Sequence
  Description of Artificial Sequence: Synthetic peptide
DSEEIRTTNPVATEQYGSVSTNLERGNR

SEQ ID NO: 2136 - protein, 29 aa, Artificial Sequence
  Description of Artificial Sequence: Synthetic peptide
DSEEIRTTNPVATEQYGSVSTNLQMRGNR

SEQ ID NO: 2137 - protein, 28 aa, Artificial Sequence
  Description of Artificial Sequence: Synthetic peptide
DSEEIRTTNPVATEQYGSVSTNLQRGNI

SEQ ID NO: 2138 - protein, 28 aa, Artificial Sequence
  Description of Artificial Sequence: Synthetic peptide
DEEEIRTTNPVAGYQYGSVSTNLQRGNR

SEQ ID NO: 2139 - protein, 29 aa, Artificial Sequence
  Description of Artificial Sequence: Synthetic peptide
DEEEIRTTNPVATEQYGSVSTNLQRGTRN

SEQ ID NO: 2140 - protein, 30 aa, Artificial Sequence
  Description of Artificial Sequence: Synthetic polypeptide
DEEEIRTTNPVATEQYGSVSSTPNLQRGNR

SEQ ID NO: 2141 - protein, 30 aa, Artificial Sequence
  Description of Artificial Sequence: Synthetic polypeptide
DEEEIRTTNPVATEQYGSVSTNLQRGTNRV

SEQ ID NO: 2142 - protein, 30 aa, Artificial Sequence
  Description of Artificial Sequence: Synthetic polypeptide
DEEEIRTTNPVATEQYGSVSSTNLQRGQNR

SEQ ID NO: 2143 - protein, 30 aa, Artificial Sequence
  Description of Artificial Sequence: Synthetic polypeptide
DEEEIRTTNPVATEQYGSVSSTNLQRGNRQ

SEQ ID NO: 2144 - protein, 30 aa, Artificial Sequence
  Description of Artificial Sequence: Synthetic polypeptide
DEEEIRTTNPVATEQYGSVSSTNLQRGNRD

SEQ ID NO: 2145 - protein, 30 aa, Artificial Sequence
  Description of Artificial Sequence: Synthetic polypeptide
DEEEIRTTNPVATEQYGSVSSTNLQRGNMR

SEQ ID NO: 2146 - protein, 28 aa, Artificial Sequence
  Description of Artificial Sequence: Synthetic peptide
DEEEIRTTNPVAHVQYGSVSTNLQRGNR

SEQ ID NO: 2147 - protein, 29 aa, Artificial Sequence
  Description of Artificial Sequence: Synthetic peptide
DEEEIRTTNPVATEQYGSVSSTNLQRGNM

SEQ ID NO: 2148 - protein, 28 aa, Artificial Sequence
  Description of Artificial Sequence: Synthetic peptide
DEEEIRTTNPGATEQYGCVSTNLQRGNR

SEQ ID NO: 2149 - protein, 29 aa, Artificial Sequence
  Description of Artificial Sequence: Synthetic peptide
DEEEIRTTNPVATEQYGSVSSTNLQRGNI

SEQ ID NO: 2150 - protein, 29 aa, Artificial Sequence
  Description of Artificial Sequence: Synthetic peptide
DEEEIRTTNPVATEQYGSVSSTNLQRINR

SEQ ID NO: 2151 - protein, 30 aa, Artificial Sequence
  Description of Artificial Sequence: Synthetic polypeptide
DEEEIRTTNPVATEQYGSVSSTNLQRGNGR

SEQ ID NO: 2152 - protein, 29 aa, Artificial Sequence
  Description of Artificial Sequence: Synthetic peptide
DEEEIRTTNPVATEQYGSVSSTNLQRGER

SEQ ID NO: 2153 - protein, 28 aa, Artificial Sequence
  Description of Artificial Sequence: Synthetic peptide
DEEEIRTTNPVAIEQYGSVSFNLQRGNR

SEQ ID NO: 2154 - protein, 29 aa, Artificial Sequence
  Description of Artificial Sequence: Synthetic peptide
DEEEIRTTNPVATEQYGSVSTNLQRGNIT

SEQ ID NO: 2155 - protein, 28 aa, Artificial Sequence
  Description of Artificial Sequence: Synthetic peptide
DEEEIRTTNPVAIEQYGSVSTNLERGNR

SEQ ID NO: 2156 - protein, 28 aa, Artificial Sequence
  Description of Artificial Sequence: Synthetic peptide
DEEEIRTTNPVAIEQYGSVSTNLQAGNR

SEQ ID NO: 2157 - protein, 29 aa, Artificial Sequence
  Description of Artificial Sequence: Synthetic peptide
DEEEIRTTNPVAIEQYGSVSTNLQRGNFR

SEQ ID NO: 2158 - protein, 28 aa, Artificial Sequence
  Description of Artificial Sequence: Synthetic peptide
DEEEIRTTNPVATEQYGSCSTNLQCGNR

SEQ ID NO: 2159 - protein, 29 aa, Artificial Sequence
  Description of Artificial Sequence: Synthetic peptide
DEEEIRTTNPVATEQYGSVSTNLQRGNIM

SEQ ID NO: 2160 - protein, 30 aa, Artificial Sequence
  Description of Artificial Sequence: Synthetic polypeptide
DEEEIRTTNPVATEQYGSVSSTNLQRGNER

SEQ ID NO: 2161 - protein, 29 aa, Artificial Sequence
  Description of Artificial Sequence: Synthetic peptide
DEEEIRTTNPGATEQYGSVSDTNLQRGNR

SEQ ID NO: 2162 - protein, 29 aa, Artificial Sequence
  Description of Artificial Sequence: Synthetic peptide
DEEEIRTTNPVATEQYGSVSTNLQRGNKA

SEQ ID NO: 2163 - protein, 29 aa, Artificial Sequence
  Description of Artificial Sequence: Synthetic peptide
DEEEIRTTNPVATEQYGSVSTNLQRGNKW

SEQ ID NO: 2164 - protein, 29 aa, Artificial Sequence
  Description of Artificial Sequence: Synthetic peptide
DEEEIRTTNPVAHEQYGSVSTNLQRGNRP

SEQ ID NO: 2165 - protein, 28 aa, Artificial Sequence
  Description of Artificial Sequence: Synthetic peptide
DEEEIRTTNPGATEQYGSVSTNLQQGNR

SEQ ID NO: 2166 - protein, 28 aa, Artificial Sequence
  Description of Artificial Sequence: Synthetic peptide
DEEEIRTTNPGATEQYGSVSTNLQLGNR

SEQ ID NO: 2167 - protein, 29 aa, Artificial Sequence
  Description of Artificial Sequence: Synthetic peptide
DEEEIRTTNPGATEQYGSVSTNLQERGNR

SEQ ID NO: 2168 - protein, 28 aa, Artificial Sequence
  Description of Artificial Sequence: Synthetic peptide
DEEEIRTTNPVAHEQYGSVSTNLQRNNR

SEQ ID NO: 2169 - protein, 29 aa, Artificial Sequence
  Description of Artificial Sequence: Synthetic peptide
DEEEIRTTNPVAHEQYGSVSVTNLQRGNR

SEQ ID NO: 2170 - protein, 28 aa, Artificial Sequence
  Description of Artificial Sequence: Synthetic peptide
DEEEIRTTNPGATEQYGSVSTNLQDGNR

SEQ ID NO: 2171 - protein, 28 aa, Artificial Sequence
  Description of Artificial Sequence: Synthetic peptide
DEEEICATNPVATEQYGSVSTNLQRGNR

SEQ ID NO: 2172 - protein, 29 aa, Artificial Sequence
  Description of Artificial Sequence: Synthetic peptide
DEEEIRTTNPVATEQYGSVSTNLQRGNPN

SEQ ID NO: 2173 - protein, 29 aa, Artificial Sequence
  Description of Artificial Sequence: Synthetic peptide
DEEEIRTTNPVATEQYGSVSTNLQRGNPE

SEQ ID NO: 2174 - protein, 29 aa, Artificial Sequence
  Description of Artificial Sequence: Synthetic peptide
DEEEIRTTNPVATEQYGSVSENNLQRGNR

SEQ ID NO: 2175 - protein, 29 aa, Artificial Sequence
  Description of Artificial Sequence: Synthetic peptide
DEEEIRTTNPVATEQYGSVSTNLQRGNMH

SEQ ID NO: 2176 - protein, 29 aa, Artificial Sequence
  Description of Artificial Sequence: Synthetic peptide
DEEEIRTTNPGATEQYGSVSTGNLQRGNR

SEQ ID NO: 2177 - protein, 29 aa, Artificial Sequence
  Description of Artificial Sequence: Synthetic peptide
DEEEIRTTNPVATEQYGSCSTNLQNRGNR

SEQ ID NO: 2178 - protein, 28 aa, Artificial Sequence
  Description of Artificial Sequence: Synthetic peptide
DEEEIRTTNPGATEQYGSVSTGLQRGNR

SEQ ID NO: 2179 - protein, 30 aa, Artificial Sequence
  Description of Artificial Sequence: Synthetic polypeptide
DEEEIRTTNPVATEQYGSVSSTNLSQRGNR

SEQ ID NO: 2180 - protein, 30 aa, Artificial Sequence
  Description of Artificial Sequence: Synthetic polypeptide
DEEEIRTTNPVATEQYGSVSSTNLQVRGNR

SEQ ID NO: 2181 - protein, 29 aa, Artificial Sequence
  Description of Artificial Sequence: Synthetic peptide
DEEEIRTTNPVATEQYGSVSSTNLQVGNR

SEQ ID NO: 2182 - protein, 29 aa, Artificial Sequence
  Description of Artificial Sequence: Synthetic peptide
DEEEIRTTNPVATEQYGSCSTNLQMRGNR

SEQ ID NO: 2183 - protein, 29 aa, Artificial Sequence
  Description of Artificial Sequence: Synthetic peptide
DEEEIRTTNPVATEQYGSVSTNLQRGNIK

SEQ ID NO: 2184 - protein, 30 aa, Artificial Sequence
  Description of Artificial Sequence: Synthetic polypeptide
DEEEIRTTNPVATEQYGSVSTNLQRGNPRT

SEQ ID NO: 2185 - protein, 30 aa, Artificial Sequence
  Description of Artificial Sequence: Synthetic polypeptide
DEEEIRTTNPVATEQYGSVSTNLQRGNHRE

SEQ ID NO: 2186 - protein, 29 aa, Artificial Sequence
  Description of Artificial Sequence: Synthetic peptide
DEEEIRTTNPVATEQYGSVSTQLQQRGNR

SEQ ID NO: 2187 - protein, 29 aa, Artificial Sequence
  Description of Artificial Sequence: Synthetic peptide
DEEEIRTTNPVATEQYGSVSENLQRGNVR

SEQ ID NO: 2188 - protein, 29 aa, Artificial Sequence
  Description of Artificial Sequence: Synthetic peptide
DEEEIRTTNPVATEQYGSVSTNLQRGNDW

SEQ ID NO: 2189 - protein, 29 aa, Artificial Sequence
  Description of Artificial Sequence: Synthetic peptide
DEEEIRTTNPVATEQYGSVSENLQRGNPR

SEQ ID NO: 2190 - protein, 29 aa, Artificial Sequence
  Description of Artificial Sequence: Synthetic peptide
DEEEIRTTNPVATEQYGSVSENLQRGNFR

SEQ ID NO: 2191 - protein, 29 aa, Artificial Sequence
  Description of Artificial Sequence: Synthetic peptide
DEEEIRTTNPVATEQYGSVSTNLQRGNDS

SEQ ID NO: 2192 - protein, 30 aa, Artificial Sequence
  Description of Artificial Sequence: Synthetic polypeptide
DEEEIRTTNPVATEQYGSVSITNLQRGENR

SEQ ID NO: 2193 - protein, 28 aa, Artificial Sequence
  Description of Artificial Sequence: Synthetic peptide
DEEEIRTTNPVATEQYGSVSGNDQRGNR

SEQ ID NO: 2194 - protein, 29 aa, Artificial Sequence
  Description of Artificial Sequence: Synthetic peptide
DEEEIRTTNPVATEQYGSVSENLQRGINR

SEQ ID NO: 2195 - protein, 29 aa, Artificial Sequence
  Description of Artificial Sequence: Synthetic peptide
DEEEIRTTNPVATEQYGSVSENLQRGYNR

SEQ ID NO: 2196 - protein, 29 aa, Artificial Sequence
  Description of Artificial Sequence: Synthetic peptide
DEEEIRTTNPVATEQYGSVSENLQRGGNR

SEQ ID NO: 2197 - protein, 30 aa, Artificial Sequence
  Description of Artificial Sequence: Synthetic polypeptide
DEEEIRTTNPVATEQYGSVSTNLQRGNDRA

SEQ ID NO: 2198 - protein, 28 aa, Artificial Sequence
  Description of Artificial Sequence: Synthetic peptide
CEEEIRTTNPVATEIYGSVSTNLQRGNR

SEQ ID NO: 2199 - protein, 29 aa, Artificial Sequence
  Description of Artificial Sequence: Synthetic peptide
DEEEIRTTNPVATEQYGSVSTNLQRGNDM

SEQ ID NO: 2200 - protein, 29 aa, Artificial Sequence
  Description of Artificial Sequence: Synthetic peptide
DEEEIRTTNPVATEQYGSVSTNLQRGNCD

SEQ ID NO: 2201 - protein, 28 aa, Artificial Sequence
  Description of Artificial Sequence: Synthetic peptide
DEPEIRTTNPVATEQYGSVSTNLTRGNR

SEQ ID NO: 2202 - protein, 29 aa, Artificial Sequence
  Description of Artificial Sequence: Synthetic peptide
DEPEIRTTNPVATEQYGSVSTNLQTRGNR

SEQ ID NO: 2203 - protein, 29 aa, Artificial Sequence
  Description of Artificial Sequence: Synthetic peptide
DEEEIRTTNPVATEQYGSVSTFLQERGNR

SEQ ID NO: 2204 - protein, 28 aa, Artificial Sequence
  Description of Artificial Sequence: Synthetic peptide
DEPEIRTTNPVATEQYGSVSTNLQRGNY

SEQ ID NO: 2205 - protein, 29 aa, Artificial Sequence
  Description of Artificial Sequence: Synthetic peptide
DEEEIRTTNPVATEQYGSVSITNLQRGDR

SEQ ID NO: 2206 - protein, 29 aa, Artificial Sequence
  Description of Artificial Sequence: Synthetic peptide
DEEEIRTTNPVATEQYGSVSITNLQRGNA

SEQ ID NO: 2207 - protein, 29 aa, Artificial Sequence
  Description of Artificial Sequence: Synthetic peptide
DEEEIRTTNPVATEQYGSVSITNLQRGND

SEQ ID NO: 2208 - protein, 29 aa, Artificial Sequence
  Description of Artificial Sequence: Synthetic peptide
DEEEIRTTNPVATEQYGSVSENLQRMGNR

SEQ ID NO: 2209 - protein, 28 aa, Artificial Sequence
  Description of Artificial Sequence: Synthetic peptide
DEEEIRTTNPVATEQYGSVSTQLQRFNR

SEQ ID NO: 2210 - protein, 28 aa, Artificial Sequence
  Description of Artificial Sequence: Synthetic peptide
DEEEIRTTNPVATEQYGSVSTQLQRGER

SEQ ID NO: 2211 - protein, 28 aa, Artificial Sequence
  Description of Artificial Sequence: Synthetic peptide
CEEEIQTTNPVATEQYGSVSTNLQRGNR

SEQ ID NO: 2212 - protein, 28 aa, Artificial Sequence
  Description of Artificial Sequence: Synthetic peptide
DEEEIRTTNPFATEQYGTVSTNLQRGNR

SEQ ID NO: 2213 - protein, 29 aa, Artificial Sequence
  Description of Artificial Sequence: Synthetic peptide
DEEEIRTTNPVATEQYGSVSTQLQRGNPR

SEQ ID NO: 2214 - protein, 29 aa, Artificial Sequence
  Description of Artificial Sequence: Synthetic peptide
DEEEIRTTNPVATEQYGSVSTNLQRGNHP

SEQ ID NO: 2215 - protein, 28 aa, Artificial Sequence
  Description of Artificial Sequence: Synthetic peptide
DEEEIRTTNPVATEQYGSVSTQLQVGNR

SEQ ID NO: 2216 - protein, 28 aa, Artificial Sequence
  Description of Artificial Sequence: Synthetic peptide
DEEEIRTTNPVATEQYGSVSGMLQRGNR

SEQ ID NO: 2217 - protein, 30 aa, Artificial Sequence
  Description of Artificial Sequence: Synthetic polypeptide
DEEEIRTTNPVATEQYGSVSTNLQRGNGRI

SEQ ID NO: 2218 - protein, 29 aa, Artificial Sequence
  Description of Artificial Sequence: Synthetic peptide
DEEEIRTTNPVATEQYGSVSITNLQRGNV

SEQ ID NO: 2219 - protein, 30 aa, Artificial Sequence
  Description of Artificial Sequence: Synthetic polypeptide
DEEEIRTTNPVATEQYGSVSITNLQRGNRS

SEQ ID NO: 2220 - protein, 29 aa, Artificial Sequence
  Description of Artificial Sequence: Synthetic peptide
DEEEIRTTNPVATEQYGSVSTNLQRGNGI

SEQ ID NO: 2221 - protein, 29 aa, Artificial Sequence
  Description of Artificial Sequence: Synthetic peptide
DEEEIRTTNPVATEQYGSVSTNLQRGNGG

SEQ ID NO: 2222 - protein, 28 aa, Artificial Sequence
  Description of Artificial Sequence: Synthetic peptide
CEEEIRTTNPAATEQYGSVSTNLQRGNR

SEQ ID NO: 2223 - protein, 29 aa, Artificial Sequence
  Description of Artificial Sequence: Synthetic peptide
DEEEIRTTNPVATEQYGSVSTNLQRGNFT

SEQ ID NO: 2224 - protein, 29 aa, Artificial Sequence
  Description of Artificial Sequence: Synthetic peptide
DEEEIRTTNPVATEQYGSVSENLQRSGNR

SEQ ID NO: 2225 - protein, 29 aa, Artificial Sequence
  Description of Artificial Sequence: Synthetic peptide
DEEEIRTTNPVATEQYGSVSTFCLQRGNR

SEQ ID NO: 2226 - protein, 30 aa, Artificial Sequence
  Description of Artificial Sequence: Synthetic polypeptide
DEEEIRTTNPVATEQYGSVSTNLQRGNFRI

SEQ ID NO: 2227 - protein, 28 aa, Artificial Sequence
  Description of Artificial Sequence: Synthetic peptide
DEEEIRTTNPVATEQYGSVSENLQRQNR

SEQ ID NO: 2228 - protein, 30 aa, Artificial Sequence
  Description of Artificial Sequence: Synthetic polypeptide
DEEEIRTTNPVATEQYGSVSITNLQRGSNR

SEQ ID NO: 2229 - protein, 28 aa, Artificial Sequence
  Description of Artificial Sequence: Synthetic peptide
DEEEIRTTNPVAGEQYGCVSTNLQRGNR

SEQ ID NO: 2230 - protein, 29 aa, Artificial Sequence
  Description of Artificial Sequence: Synthetic peptide
DEEEIRTTNPGATEQYGSVSTNLQRGDNR

SEQ ID NO: 2231 - protein, 28 aa, Artificial Sequence
  Description of Artificial Sequence: Synthetic peptide
DEEEIRTTNPVAHEQYGSVSTNLQRGNF

SEQ ID NO: 2232 - protein, 29 aa, Artificial Sequence
  Description of Artificial Sequence: Synthetic peptide
DEEEIRTTNPVATEQYGSVSTNLQRGSLR

SEQ ID NO: 2233 - protein, 30 aa, Artificial Sequence
  Description of Artificial Sequence: Synthetic polypeptide
DEEEIRTTNPVATEQYGSVSTENLQREGNR

SEQ ID NO: 2234 - protein, 29 aa, Artificial Sequence
  Description of Artificial Sequence: Synthetic peptide
DEQEIRTTNPVATEQYGSVSTNLQERGNR

SEQ ID NO: 2235 - protein, 29 aa, Artificial Sequence
  Description of Artificial Sequence: Synthetic peptide
DEEEIRTTNPVATEQYGSVSTNLQRGRNY

SEQ ID NO: 2236 - protein, 29 aa, Artificial Sequence
  Description of Artificial Sequence: Synthetic peptide
DEQEIRTTNPVATEQYGSVSTNLQCRGNR

SEQ ID NO: 2237 - protein, 29 aa, Artificial Sequence
  Description of Artificial Sequence: Synthetic peptide
DEQEIRTTNPVATEQYGSVSTNLNQRGNR

SEQ ID NO: 2238 - protein, 29 aa, Artificial Sequence
  Description of Artificial Sequence: Synthetic peptide
DEEEIRTTNPVATEQYGSVSTNLQRGRND

SEQ ID NO: 2239 - protein, 30 aa, Artificial Sequence
  Description of Artificial Sequence: Synthetic polypeptide
DEEEIRTTNPVATEQYGSVSTENLQRGNRC

SEQ ID NO: 2240 - protein, 29 aa, Artificial Sequence
  Description of Artificial Sequence: Synthetic peptide
DEEEIRTTNPHATEQYGSVSTNLQRGNSR

SEQ ID NO: 2241 - protein, 28 aa, Artificial Sequence
  Description of Artificial Sequence: Synthetic peptide
DEEEIRTTNPVAHEQYGSVSINLQRGNR

SEQ ID NO: 2242 - protein, 29 aa, Artificial Sequence
  Description of Artificial Sequence: Synthetic peptide
DEEEIRTTNPVATEQYGSVSLTNLERGNR

SEQ ID NO: 2243 - protein, 29 aa, Artificial Sequence
  Description of Artificial Sequence: Synthetic peptide
DEEEIRTTNPHATEQYGSVSTNLQRGNLR

SEQ ID NO: 2244 - protein, 29 aa, Artificial Sequence
  Description of Artificial Sequence: Synthetic peptide
DEEEIRTTNPVATEQYGSVSTNLQRGQTR

SEQ ID NO: 2245 - protein, 28 aa, Artificial Sequence
  Description of Artificial Sequence: Synthetic peptide
AEEEIRTTNPVATEQYGSVSTNLQMGNR

SEQ ID NO: 2246 - protein, 28 aa, Artificial Sequence
  Description of Artificial Sequence: Synthetic peptide
DEQEIRTTNPVATEQYGSVSTILQRGNR

SEQ ID NO: 2247 - protein, 29 aa, Artificial Sequence
  Description of Artificial Sequence: Synthetic peptide
DEEEIRTTNPVATEQYGSVASTNLQRGLR

SEQ ID NO: 2248 - protein, 29 aa, Artificial Sequence
  Description of Artificial Sequence: Synthetic peptide
DEEEIRTTNPHATEQYGSVSTNLQRGNGR

SEQ ID NO: 2249 - protein, 30 aa, Artificial Sequence
  Description of Artificial Sequence: Synthetic polypeptide
DEEEIRTTNPVATEQYGSVSTENLQRGNRQ

SEQ ID NO: 2250 - protein, 30 aa, Artificial Sequence
  Description of Artificial Sequence: Synthetic polypeptide
DEEEIRTTNPVATEQYGSVSTENLQRGNRH

SEQ ID NO: 2251 - protein, 29 aa, Artificial Sequence
  Description of Artificial Sequence: Synthetic peptide
DEQEIRTTNPVATEQYGSVSTNLQLRGNR

SEQ ID NO: 2252 - protein, 28 aa, Artificial Sequence
  Description of Artificial Sequence: Synthetic peptide
DEEEIRTTNPHATEQYGSVSTNQQRGNR

SEQ ID NO: 2253 - protein, 28 aa, Artificial Sequence
  Description of Artificial Sequence: Synthetic peptide
DEQEIRTTNPVATEQYGSVSTNLQRENR

SEQ ID NO: 2254 - protein, 29 aa, Artificial Sequence
  Description of Artificial Sequence: Synthetic peptide
DEEEIRTTNPVATEQYGSVSTNLQRGTNQ

SEQ ID NO: 2255 - protein, 30 aa, Artificial Sequence
  Description of Artificial Sequence: Synthetic polypeptide
DEEEIRTTNPVATEQYGSVSTNLQRGTNIR

SEQ ID NO: 2256 - protein, 29 aa, Artificial Sequence
  Description of Artificial Sequence: Synthetic peptide
DEEEIRTTNPVATEQYGSVSTNLQRGTNE

SEQ ID NO: 2257 - protein, 29 aa, Artificial Sequence
  Description of Artificial Sequence: Synthetic peptide
DEEEIRTTNPVATEQYGSVASTILQRGNR

SEQ ID NO: 2258 - protein, 29 aa, Artificial Sequence
  Description of Artificial Sequence: Synthetic peptide
DEEEIRTTNPVATEQYGSVSTNLQRGTER

SEQ ID NO: 2259 - protein, 28 aa, Artificial Sequence
  Description of Artificial Sequence: Synthetic peptide
DEEEIRTTNPVATEQYGSVSTNLQRGTD

SEQ ID NO: 2260 - protein, 28 aa, Artificial Sequence
  Description of Artificial Sequence: Synthetic peptide
DEQEIRTTNPVATEQYGSVSTSLQRGNR

SEQ ID NO: 2261 - protein, 29 aa, Artificial Sequence
  Description of Artificial Sequence: Synthetic peptide
DEEEIRTTNPVATEQYGSVSTPNLQRGNM

SEQ ID NO: 2262 - protein, 29 aa, Artificial Sequence
  Description of Artificial Sequence: Synthetic peptide
DEEEIRTTNPVATEQYGSVSTPNLQRGNQ

SEQ ID NO: 2263 - protein, 29 aa, Artificial Sequence
  Description of Artificial Sequence: Synthetic peptide
DEEEIRTTNPVATEQYGSVSTPNLQRGQR

SEQ ID NO: 2264 - protein, 28 aa, Artificial Sequence
  Description of Artificial Sequence: Synthetic peptide
DEEEIRTTNPVATEQYGSVSTNLQRGSS

SEQ ID NO: 2265 - protein, 28 aa, Artificial Sequence
  Description of Artificial Sequence: Synthetic peptide
DEEEIRTTNPHATEQYGSVSTNTQRGNR

SEQ ID NO: 2266 - protein, 29 aa, Artificial Sequence
  Description of Artificial Sequence: Synthetic peptide
DEQEIRTTNPVATEQYGSVSTNLQVRGNR

SEQ ID NO: 2267 - protein, 29 aa, Artificial Sequence
  Description of Artificial Sequence: Synthetic peptide
DEEEIRTTNPVATEQYGSVSTNLQRGSQR

SEQ ID NO: 2268 - protein, 30 aa, Artificial Sequence
  Description of Artificial Sequence: Synthetic polypeptide
DEEEIRTTNPVATEQYGSVSTNLQRGSNRS

SEQ ID NO: 2269 - protein, 29 aa, Artificial Sequence
  Description of Artificial Sequence: Synthetic peptide
DEQEIRTTNPVATEQYGSVSTNLQRHGNR

SEQ ID NO: 2270 - protein, 29 aa, Artificial Sequence
  Description of Artificial Sequence: Synthetic peptide
DEQEIRTTNPVATEQYGSVSTNLQRGTNR

SEQ ID NO: 2271 - protein, 29 aa, Artificial Sequence
  Description of Artificial Sequence: Synthetic peptide
DEQEIRTTNPVATEQYGSVSTNLQRGSNR

SEQ ID NO: 2272 - protein, 29 aa, Artificial Sequence
  Description of Artificial Sequence: Synthetic peptide
DEQEIRTTNPVATEQYGSVSTNLQRFGNR

SEQ ID NO: 2273 - protein, 29 aa, Artificial Sequence
  Description of Artificial Sequence: Synthetic peptide
DEEEIRTTNPVATEQYGSVSTNLQRGQRV

SEQ ID NO: 2274 - protein, 28 aa, Artificial Sequence
  Description of Artificial Sequence: Synthetic peptide
DEEEIRTTNPGATEQYGSVSTNLQRGNA

SEQ ID NO: 2275 - protein, 29 aa, Artificial Sequence
  Description of Artificial Sequence: Synthetic peptide
DEEEIRTTNPVATEQYGSVASTNLQRGNT

SEQ ID NO: 2276 - protein, 28 aa, Artificial Sequence
  Description of Artificial Sequence: Synthetic peptide
DEEEIRTTNPVAHEQYGSVSTNLQRDNR

SEQ ID NO: 2277 - protein, 29 aa, Artificial Sequence
  Description of Artificial Sequence: Synthetic peptide
DEEEIRTTNPVATEQYGSVSTNLQRGNYK

SEQ ID NO: 2278 - protein, 29 aa, Artificial Sequence
  Description of Artificial Sequence: Synthetic peptide
DEEEIRTTNPVATEQYGSVSSTNWQRGNR

SEQ ID NO: 2279 - protein, 29 aa, Artificial Sequence
  Description of Artificial Sequence: Synthetic peptide
DEEEIRTTNPVATEQYGSVSSTNVQRGNR

SEQ ID NO: 2280 - protein, 28 aa, Artificial Sequence
  Description of Artificial Sequence: Synthetic peptide
DEQEIRTTNPVATEQYGMVSTNLQRGNR

SEQ ID NO: 2281 - protein, 28 aa, Artificial Sequence
  Description of Artificial Sequence: Synthetic peptide
DEQEIRTTNPVATEQYGEVSTNLQRGNR

SEQ ID NO: 2282 - protein, 30 aa, Artificial Sequence
  Description of Artificial Sequence: Synthetic polypeptide
DEEEIRTTNPVATEQYGSVSTNLQRGNTRI

SEQ ID NO: 2283 - protein, 29 aa, Artificial Sequence
  Description of Artificial Sequence: Synthetic peptide
DEEEIRTTNPVATEQYGSVSTNLQRGNTQ

SEQ ID NO: 2284 - protein, 29 aa, Artificial Sequence
  Description of Artificial Sequence: Synthetic peptide
DEEEIRTTNPVATEQYGSVSTNLQRGNTN

SEQ ID NO: 2285 - protein, 28 aa, Artificial Sequence
  Description of Artificial Sequence: Synthetic peptide
DEQEIRTTNPVATEQYGSLSTNLQRGNR

SEQ ID NO: 2286 - protein, 29 aa, Artificial Sequence
  Description of Artificial Sequence: Synthetic peptide
DEEEIRTTNPVATEQYGSVSTNLQRGNTH

SEQ ID NO: 2287 - protein, 29 aa, Artificial Sequence
  Description of Artificial Sequence: Synthetic peptide
DEEEIRTTNPVATEQYGSCSTNLQRYGNR

SEQ ID NO: 2288 - protein, 28 aa, Artificial Sequence
  Description of Artificial Sequence: Synthetic peptide
DEQEIRCTNPVATEQYGSVSTNLQRGNR

SEQ ID NO: 2289 - protein, 28 aa, Artificial Sequence
  Description of Artificial Sequence: Synthetic peptide
DEEEIRTTNPGATEQYGSVSTNLQRGNP

SEQ ID NO: 2290 - protein, 29 aa, Artificial Sequence
  Description of Artificial Sequence: Synthetic peptide
DEEEIRTTNPVATEQYGSCSTNLQRGNRY

SEQ ID NO: 2291 - protein, 28 aa, Artificial Sequence
  Description of Artificial Sequence: Synthetic peptide
DEEEIRTTNPVATEQYGSCSTNLQRGND

SEQ ID NO: 2292 - protein, 29 aa, Artificial Sequence
  Description of Artificial Sequence: Synthetic peptide
DEEEIRTTNPVATEQYGSCSTNLQPRGNR

SEQ ID NO: 2293 - protein, 28 aa, Artificial Sequence
  Description of Artificial Sequence: Synthetic peptide
DEEEICTTNPDATEQYGSVSTNLQRGNR

SEQ ID NO: 2294 - protein, 28 aa, Artificial Sequence
  Description of Artificial Sequence: Synthetic peptide
DEEEIRTTNPGATEQYGSVSTNLQRGNN

SEQ ID NO: 2295 - protein, 28 aa, Artificial Sequence
  Description of Artificial Sequence: Synthetic peptide
DEQEIRTTNPVATEPYGSVSTNLQRGNR

SEQ ID NO: 2296 - protein, 28 aa, Artificial Sequence
  Description of Artificial Sequence: Synthetic peptide
DEEEIRTTNPGATEQYGSVSTNLQRGNQ

SEQ ID NO: 2297 - protein, 29 aa, Artificial Sequence
  Description of Artificial Sequence: Synthetic peptide
DEEEIRTTNPVATEQYGSVSTNLQRGPIR

SEQ ID NO: 2298 - protein, 30 aa, Artificial Sequence
  Description of Artificial Sequence: Synthetic polypeptide
DEEEIRTTNPVATEQYGSVSTNLQRGPNHR

SEQ ID NO: 2299 - protein, 30 aa, Artificial Sequence
  Description of Artificial Sequence: Synthetic polypeptide
DEEEIRTTNPVATEQYGSVSLTNLIQRGNR

SEQ ID NO: 2300 - protein, 30 aa, Artificial Sequence
  Description of Artificial Sequence: Synthetic polypeptide
DEEEIRTTNPVATEQYGSVASTNLQRPGNR

SEQ ID NO: 2301 - protein, 29 aa, Artificial Sequence
  Description of Artificial Sequence: Synthetic peptide
DEEEIRTTNPVATEQYGSVASTNLQRQNR

SEQ ID NO: 2302 - protein, 28 aa, Artificial Sequence
  Description of Artificial Sequence: Synthetic peptide
DEEEIRTTNPHATEQYGSVSTNLQRGMR

SEQ ID NO: 2303 - protein, 28 aa, Artificial Sequence
  Description of Artificial Sequence: Synthetic peptide
DEEEIRTTNPHATEQYGSVSTNLQNGNR

SEQ ID NO: 2304 - protein, 29 aa, Artificial Sequence
  Description of Artificial Sequence: Synthetic peptide
DEEEIRTTNPHATEQYGSVSTNGLQRGNR

SEQ ID NO: 2305 - protein, 30 aa, Artificial Sequence
  Description of Artificial Sequence: Synthetic polypeptide
DEEEIRTTNPVATEQYGSVSTNLQRGQNTR

SEQ ID NO: 2306 - protein, 29 aa, Artificial Sequence
  Description of Artificial Sequence: Synthetic peptide
DEQEIRTTNPVATEQYGSVSQTNLQRGNR

SEQ ID NO: 2307 - protein, 28 aa, Artificial Sequence
  Description of Artificial Sequence: Synthetic peptide
DEQEIRTTNPVATEQYGSVSQNLQRGNR

SEQ ID NO: 2308 - protein, 29 aa, Artificial Sequence
  Description of Artificial Sequence: Synthetic peptide
DEEEIRTTNPVATEQYGSVASTNLQSGNR

SEQ ID NO: 2309 - protein, 29 aa, Artificial Sequence
  Description of Artificial Sequence: Synthetic peptide
DEEEIRTTNPHATEQYGSVSCTNLQRGNR

SEQ ID NO: 2310 - protein, 30 aa, Artificial Sequence
  Description of Artificial Sequence: Synthetic polypeptide
DEEEIRTTNPVATEQYGSVASTNLSQRGNR

SEQ ID NO: 2311 - protein, 29 aa, Artificial Sequence
  Description of Artificial Sequence: Synthetic peptide
DEQEIRTTNPVATEQYGSVSGTNLQRGNR

SEQ ID NO: 2312 - protein, 30 aa, Artificial Sequence
  Description of Artificial Sequence: Synthetic polypeptide
DEEEIRTTNPVATEQYGSVSTNLQRGQNNR

SEQ ID NO: 2313 - protein, 28 aa, Artificial Sequence
  Description of Artificial Sequence: Synthetic peptide
DEEEIRTTNPVATEQYGSVSTNLQRGQL

SEQ ID NO: 2314 - protein, 29 aa, Artificial Sequence
  Description of Artificial Sequence: Synthetic peptide
DEEEIRTTNPGATEQYGSVSTNLTQRGNR

SEQ ID NO: 2315 - protein, 29 aa, Artificial Sequence
  Description of Artificial Sequence: Synthetic peptide
DEEEIRTTNPVATEQYGSVSTNLQRGPPR

SEQ ID NO: 2316 - protein, 28 aa, Artificial Sequence
  Description of Artificial Sequence: Synthetic peptide
DEEEIRTTNPVAHEQYGSVSTNLQRGNC

SEQ ID NO: 2317 - protein, 29 aa, Artificial Sequence
  Description of Artificial Sequence: Synthetic peptide
DEEEIRTTNPVATEQYGSVASTNQQRGNR

SEQ ID NO: 2318 - protein, 28 aa, Artificial Sequence
  Description of Artificial Sequence: Synthetic peptide
DEEEIRTTNPHATEQYGSVSTNLQRGNG

SEQ ID NO: 2319 - protein, 28 aa, Artificial Sequence
  Description of Artificial Sequence: Synthetic peptide
DESEIRTTNPVATEQYASVSTNLQRGNR

SEQ ID NO: 2320 - protein, 28 aa, Artificial Sequence
  Description of Artificial Sequence: Synthetic peptide
DEEEIRTTNPVATEQYGSVSTNLQRTTR

SEQ ID NO: 2321 - protein, 29 aa, Artificial Sequence
  Description of Artificial Sequence: Synthetic peptide
DEEEIRTTNPVATEQYGSVSTNLQRVANR

SEQ ID NO: 2322 - protein, 28 aa, Artificial Sequence
  Description of Artificial Sequence: Synthetic peptide
DEEEICTTNPWATEQYGSVSTNLQRGNR

SEQ ID NO: 2323 - protein, 30 aa, Artificial Sequence
  Description of Artificial Sequence: Synthetic polypeptide
DEEEIRTTNPVATEQYGSVSTNYLQRGLNR

SEQ ID NO: 2324 - protein, 30 aa, Artificial Sequence
  Description of Artificial Sequence: Synthetic polypeptide
DEEEIRTTNPVATEQYGSVSTNYLQRGNER

SEQ ID NO: 2325 - protein, 30 aa, Artificial Sequence
  Description of Artificial Sequence: Synthetic polypeptide
DEEEIRTTNPVATEQYGSVSTNYLQRGNWR

SEQ ID NO: 2326 - protein, 29 aa, Artificial Sequence
  Description of Artificial Sequence: Synthetic peptide
DEEEIRTTNPVATEQYGSVSTNYLQTGNR

SEQ ID NO: 2327 - protein, 30 aa, Artificial Sequence
  Description of Artificial Sequence: Synthetic polypeptide
DEEEIRTTNPVATEQYGSVSTANLQFRGNR

SEQ ID NO: 2328 - protein, 29 aa, Artificial Sequence
  Description of Artificial Sequence: Synthetic peptide
DEEEIRTTNPVATEQYGSVSTNYQFRGNR

SEQ ID NO: 2329 - protein, 28 aa, Artificial Sequence
  Description of Artificial Sequence: Synthetic peptide
DEEEIRTTNPVATEQYGSTSTNLQRGNW

SEQ ID NO: 2330 - protein, 28 aa, Artificial Sequence
  Description of Artificial Sequence: Synthetic peptide
DEEEIRTTNPVATEQYGSVSTNYDRGNR

SEQ ID NO: 2331 - protein, 28 aa, Artificial Sequence
  Description of Artificial Sequence: Synthetic peptide
DEEEIRTTNPVATEQYGSTSTNLQRGVR

SEQ ID NO: 2332 - protein, 29 aa, Artificial Sequence
  Description of Artificial Sequence: Synthetic peptide
DEEEIRTTNPVATEQYGSVSTNYQLRGNR

SEQ ID NO: 2333 - protein, 29 aa, Artificial Sequence
  Description of Artificial Sequence: Synthetic peptide
DEEEIRTTNPVATEQYGSVSTNYQRGNIR

SEQ ID NO: 2334 - protein, 29 aa, Artificial Sequence
  Description of Artificial Sequence: Synthetic peptide
DEEEIRTTNPVATEQYGSTSTTNLQRGNR

SEQ ID NO: 2335 - protein, 28 aa, Artificial Sequence
  Description of Artificial Sequence: Synthetic peptide
DEEEICTTNPVGTEQYGSVSTNLQRGNR

SEQ ID NO: 2336 - protein, 29 aa, Artificial Sequence
  Description of Artificial Sequence: Synthetic peptide
DEEEIRTTNPVATEQYGSVSTNYQRNGNR

SEQ ID NO: 2337 - protein, 29 aa, Artificial Sequence
  Description of Artificial Sequence: Synthetic peptide
DEEEIRTTNPVATEQYGSVSTNLQWLGNR

SEQ ID NO: 2338 - protein, 29 aa, Artificial Sequence
  Description of Artificial Sequence: Synthetic peptide
DEEEIRTTNPVATEQYGSVSTNLQWGTNR

SEQ ID NO: 2339 - protein, 29 aa, Artificial Sequence
  Description of Artificial Sequence: Synthetic peptide
DEEEIRTTNPVATEQYGSFVSNNLQRGNR

SEQ ID NO: 2340 - protein, 28 aa, Artificial Sequence
  Description of Artificial Sequence: Synthetic peptide
DEEEIRTTNPVATEQYGSVSTNYQIGNR

SEQ ID NO: 2341 - protein, 29 aa, Artificial Sequence
  Description of Artificial Sequence: Synthetic peptide
DEEEIDTTNPVATEQYGSVSTNLNQRGNR

SEQ ID NO: 2342 - protein, 28 aa, Artificial Sequence
  Description of Artificial Sequence: Synthetic peptide
DEEEIDTTNPVATEQYGSVSTNLQRPNR

SEQ ID NO: 2343 - protein, 28 aa, Artificial Sequence
  Description of Artificial Sequence: Synthetic peptide
DEEEIDTTNPVATEQYGSVSTPLQRGNR

SEQ ID NO: 2344 - protein, 29 aa, Artificial Sequence
  Description of Artificial Sequence: Synthetic peptide
DEEEIETTNPVATEQYGSVSTNLQRGNRV

SEQ ID NO: 2345 - protein, 28 aa, Artificial Sequence
  Description of Artificial Sequence: Synthetic peptide
DEEEIRTTNPVADEQYGSVSTNLPRGNR

SEQ ID NO: 2346 - protein, 29 aa, Artificial Sequence
  Description of Artificial Sequence: Synthetic peptide
DEEEIRTTNPVATEQYGSVSTNWQRGNRV

SEQ ID NO: 2347 - protein, 29 aa, Artificial Sequence
  Description of Artificial Sequence: Synthetic peptide
DEEEIETTNPVATEQYGSVSTNLQRGNRD

SEQ ID NO: 2348 - protein, 28 aa, Artificial Sequence
  Description of Artificial Sequence: Synthetic peptide
DEEEIRTTNPVATEQYGSVSTNWQRGVR

SEQ ID NO: 2349 - protein, 30 aa, Artificial Sequence
  Description of Artificial Sequence: Synthetic polypeptide
DEEEIRTTNPVATEQYGSVSTNLQWRGGNR

SEQ ID NO: 2350 - protein, 29 aa, Artificial Sequence
  Description of Artificial Sequence: Synthetic peptide
DEEEIRTTNPVATEQYGSVSTNWQRPGNR

SEQ ID NO: 2351 - protein, 28 aa, Artificial Sequence
  Description of Artificial Sequence: Synthetic peptide
DEEEIETTNPVATEQYGSVSTNLQRGNI

SEQ ID NO: 2352 - protein, 28 aa, Artificial Sequence
  Description of Artificial Sequence: Synthetic peptide
DEEEIETTNPVATEQYGSVSTNLQRGAR

SEQ ID NO: 2353 - protein, 29 aa, Artificial Sequence
  Description of Artificial Sequence: Synthetic peptide
DEEEIETTNPVATEQYGSVSTNLQRGANR

SEQ ID NO: 2354 - protein, 29 aa, Artificial Sequence
  Description of Artificial Sequence: Synthetic peptide
DEEEIRTTNPVATEQYGSTSTNLQRGNRH

SEQ ID NO: 2355 - protein, 29 aa, Artificial Sequence
  Description of Artificial Sequence: Synthetic peptide
DEEEIETTNPVATEQYGSVSMTNLQRGNR

SEQ ID NO: 2356 - protein, 28 aa, Artificial Sequence
  Description of Artificial Sequence: Synthetic peptide
DEEEIETTNPVATECYGSVSTNLQRGNR

SEQ ID NO: 2357 - protein, 29 aa, Artificial Sequence
  Description of Artificial Sequence: Synthetic peptide
DEEEIRTTNPVADEQYGSVSTNLQIRGNR

SEQ ID NO: 2358 - protein, 29 aa, Artificial Sequence
  Description of Artificial Sequence: Synthetic peptide
DEEEIETTNPEVATEQYGSVSTNLQRGNR

SEQ ID NO: 2359 - protein, 28 aa, Artificial Sequence
  Description of Artificial Sequence: Synthetic peptide
DEEEIETTNPDATEQYGSVSTNLQRGNR

SEQ ID NO: 2360 - protein, 29 aa, Artificial Sequence
  Description of Artificial Sequence: Synthetic peptide
DEEEIRTTNPVATEQYGSTSTNLQRGNRN

SEQ ID NO: 2361 - protein, 29 aa, Artificial Sequence
  Description of Artificial Sequence: Synthetic peptide
DEEEIDTTNPVATEQYGSVSTPNLQRGNR

SEQ ID NO: 2362 - protein, 28 aa, Artificial Sequence
  Description of Artificial Sequence: Synthetic peptide
DEEEIRTTNPVADEQYGSVSTNLQRGND

SEQ ID NO: 2363 - protein, 29 aa, Artificial Sequence
  Description of Artificial Sequence: Synthetic peptide
DEEEIRTTNPVATEQYGSVSTNLQWGNNR

SEQ ID NO: 2364 - protein, 28 aa, Artificial Sequence
  Description of Artificial Sequence: Synthetic peptide
DEEEIETTNPVATEQYGSVSTNLQRGNW

SEQ ID NO: 2365 - protein, 28 aa, Artificial Sequence
  Description of Artificial Sequence: Synthetic peptide
DEEEIRTTNPVATEQYGSVSTNLQWGNG

SEQ ID NO: 2366 - protein, 28 aa, Artificial Sequence
  Description of Artificial Sequence: Synthetic peptide
DEEEIRTTNPVATEQYGSVSTNLQWGER

SEQ ID NO: 2367 - protein, 29 aa, Artificial Sequence
  Description of Artificial Sequence: Synthetic peptide
DEEEIRTTNPVADEQYGSVSTNLQRGQNR

SEQ ID NO: 2368 - protein, 29 aa, Artificial Sequence
  Description of Artificial Sequence: Synthetic peptide
DEEEIRTTNPVADEQYGSVSTNLQRGVNR

SEQ ID NO: 2369 - protein, 28 aa, Artificial Sequence
  Description of Artificial Sequence: Synthetic peptide
DPEEIRTTNPVATEQYGSVSTCLQRGNR

SEQ ID NO: 2370 - protein, 29 aa, Artificial Sequence
  Description of Artificial Sequence: Synthetic peptide
DEEEIRTTNPVADEQYGSVSTNLQTRGNR

SEQ ID NO: 2371 - protein, 29 aa, Artificial Sequence
  Description of Artificial Sequence: Synthetic peptide
DPEEIRTTNPVATEQYGSVSTNLPQRGNR

SEQ ID NO: 2372 - protein, 28 aa, Artificial Sequence
  Description of Artificial Sequence: Synthetic peptide
DEEEIRTTNPVADEQYGSVSTNVQRGNR

SEQ ID NO: 2373 - protein, 28 aa, Artificial Sequence
  Description of Artificial Sequence: Synthetic peptide
DPEEIRTTNPVATEQYGSVSTNLQEGNR

SEQ ID NO: 2374 - protein, 29 aa, Artificial Sequence
  Description of Artificial Sequence: Synthetic peptide
DEEEIRTTNPVADEQYGSVSTTNLQRGNR

SEQ ID NO: 2375 - protein, 29 aa, Artificial Sequence
  Description of Artificial Sequence: Synthetic peptide
DEEEIRTTNPVATEQYGSVSETNLQRFNR

SEQ ID NO: 2376 - protein, 28 aa, Artificial Sequence
  Description of Artificial Sequence: Synthetic peptide
DEEEIRTTNPVADEYYGSVSTNLQRGNR

SEQ ID NO: 2377 - protein, 28 aa, Artificial Sequence
  Description of Artificial Sequence: Synthetic peptide
DEEEIRTTNPVAEEQYGSVSTNLERGNR

SEQ ID NO: 2378 - protein, 29 aa, Artificial Sequence
  Description of Artificial Sequence: Synthetic peptide
DEEEIRTTNPVAEEQYGSVSTNLQREGNR

SEQ ID NO: 2379 - protein, 28 aa, Artificial Sequence
  Description of Artificial Sequence: Synthetic peptide
DEEEIRTTNPVAEEQYGSVSTNLQRGNA

SEQ ID NO: 2380 - protein, 28 aa, Artificial Sequence
  Description of Artificial Sequence: Synthetic peptide
DPEEIRTTNPVATEQYGSVSTNLQPGNR

SEQ ID NO: 2381 - protein, 29 aa, Artificial Sequence
  Description of Artificial Sequence: Synthetic peptide
DEEEIRTTNPVAEEQYGSVSTNLQRGNRV

SEQ ID NO: 2382 - protein, 29 aa, Artificial Sequence
  Description of Artificial Sequence: Synthetic peptide
DPEEIRTTNPVATEQYGSVSTNLQRGDNR

SEQ ID NO: 2383 - protein, 28 aa, Artificial Sequence
  Description of Artificial Sequence: Synthetic peptide
DPEEIRTTNPVATEQYGSVSTNLQRGNS

SEQ ID NO: 2384 - protein, 28 aa, Artificial Sequence
  Description of Artificial Sequence: Synthetic peptide
DPEEIRTTNPVATEQYGSVSTNLQTGNR

SEQ ID NO: 2385 - protein, 28 aa, Artificial Sequence
  Description of Artificial Sequence: Synthetic peptide
DEEEIRTTNPVAEEHYGSVSTNLQRGNR

SEQ ID NO: 2386 - protein, 28 aa, Artificial Sequence
  Description of Artificial Sequence: Synthetic peptide
DPEEIRTTNPVATEQYGEVSTNLQRGNR

SEQ ID NO: 2387 - protein, 30 aa, Artificial Sequence
  Description of Artificial Sequence: Synthetic polypeptide
DEEEIRTTNPVATEQYGSVSETNLQRGDNR

SEQ ID NO: 2388 - protein, 28 aa, Artificial Sequence
  Description of Artificial Sequence: Synthetic peptide
DEEEIRTTNPVADEQYGSVSTNLQRGPR

SEQ ID NO: 2389 - protein, 29 aa, Artificial Sequence
  Description of Artificial Sequence: Synthetic peptide
DEEEIRTTNPVATEQYGSVSTNLQVSGNR

SEQ ID NO: 2390 - protein, 30 aa, Artificial Sequence
  Description of Artificial Sequence: Synthetic polypeptide
DEEEIRTTNPVATEQYGSVSTNLQVRQGNR

SEQ ID NO: 2391 - protein, 30 aa, Artificial Sequence
  Description of Artificial Sequence: Synthetic polypeptide
DEEEIRTTNPVATEQYGSVSTNLQVRGNSR

SEQ ID NO: 2392 - protein, 30 aa, Artificial Sequence
  Description of Artificial Sequence: Synthetic polypeptide
DEEEIRTTNPVATEQYGSVSTNLQVRGNRV

SEQ ID NO: 2393 - protein, 29 aa, Artificial Sequence
  Description of Artificial Sequence: Synthetic peptide
DEEEIRTTNPVADEQYGSVSTNLQRGNRG

SEQ ID NO: 2394 - protein, 29 aa, Artificial Sequence
  Description of Artificial Sequence: Synthetic peptide
AEEEIRTTNPVATEQYGSVSTNWLQRGNR

SEQ ID NO: 2395 - protein, 28 aa, Artificial Sequence
  Description of Artificial Sequence: Synthetic peptide
AEEEIRTTNPVATEQYGSVSTNVQRGNR

SEQ ID NO: 2396 - protein, 28 aa, Artificial Sequence
  Description of Artificial Sequence: Synthetic peptide
DEEEIRTTNPVADEQYGSVSTNLQRGNS

SEQ ID NO: 2397 - protein, 29 aa, Artificial Sequence
  Description of Artificial Sequence: Synthetic peptide
DEEEIRTTNPVATEQYGSVSTNLQVRGNF

SEQ ID NO: 2398 - protein, 29 aa, Artificial Sequence
  Description of Artificial Sequence: Synthetic peptide
DEEEIRTTNPVATEQYGSTVLTNLQRGNR

SEQ ID NO: 2399 - protein, 29 aa, Artificial Sequence
  Description of Artificial Sequence: Synthetic peptide
DEEEIRTTNPVATEQYGSFSTNLTQRGNR

SEQ ID NO: 2400 - protein, 30 aa, Artificial Sequence
  Description of Artificial Sequence: Synthetic polypeptide
DEEEIRTTNPVATEQYGSVSTNLQVRGGNR

SEQ ID NO: 2401 - protein, 30 aa, Artificial Sequence
  Description of Artificial Sequence: Synthetic polypeptide
DEEEIRTTNPVATEQYGSVSTNLQVRGANR

SEQ ID NO: 2402 - protein, 29 aa, Artificial Sequence
  Description of Artificial Sequence: Synthetic peptide
DEEEIRTTNPVATEQYGSFSTNLQRQGNR

SEQ ID NO: 2403 - protein, 30 aa, Artificial Sequence
  Description of Artificial Sequence: Synthetic polypeptide
DEEEIRTTNPVATEQYGSVSTANLQERGNR

SEQ ID NO: 2404 - protein, 30 aa, Artificial Sequence
  Description of Artificial Sequence: Synthetic polypeptide
DEEEIRTTNPVATEQYGSVSTNLQVRDGNR

SEQ ID NO: 2405 - protein, 30 aa, Artificial Sequence
  Description of Artificial Sequence: Synthetic polypeptide
DEEEIRTTNPVATEQYGSVSETNLQRGNYR

SEQ ID NO: 2406 - protein, 28 aa, Artificial Sequence
  Description of Artificial Sequence: Synthetic peptide
DEEEIRTTNPVADEQYGSVSTNLQRGNW

SEQ ID NO: 2407 - protein, 29 aa, Artificial Sequence
  Description of Artificial Sequence: Synthetic peptide
DEEEIRTTNPVATEQYGSVSTPGLQRGNR

SEQ ID NO: 2408 - protein, 28 aa, Artificial Sequence
  Description of Artificial Sequence: Synthetic peptide
DEEEIRTTNPVATEQYGSVSTNLQWGNF

SEQ ID NO: 2409 - protein, 29 aa, Artificial Sequence
  Description of Artificial Sequence: Synthetic peptide
DPEEIRTTNPVATEQYGSVSTNLTQRGNR

SEQ ID NO: 2410 - protein, 28 aa, Artificial Sequence
  Description of Artificial Sequence: Synthetic peptide
DEEEIETTNPVATEQYGSVSTNLSRGNR

SEQ ID NO: 2411 - protein, 28 aa, Artificial Sequence
  Description of Artificial Sequence: Synthetic peptide
DEEEIETTNPVATEQYGYVSTNLQRGNR

SEQ ID NO: 2412 - protein, 28 aa, Artificial Sequence
  Description of Artificial Sequence: Synthetic peptide
DNEEIRTTNPVATECYGSVSTNLQRGNR

SEQ ID NO: 2413 - protein, 29 aa, Artificial Sequence
  Description of Artificial Sequence: Synthetic peptide
DEEEIRTTNPVATEQYGSVSTNVLPRGNR

SEQ ID NO: 2414 - protein, 28 aa, Artificial Sequence
  Description of Artificial Sequence: Synthetic peptide
DNEEIRTTNPVATEQYGGVSTNLQRGNR

SEQ ID NO: 2415 - protein, 30 aa, Artificial Sequence
  Description of Artificial Sequence: Synthetic polypeptide
DEEEIRTTNPVATEQYGSVSTNVLQRGNRQ

SEQ ID NO: 2416 - protein, 29 aa, Artificial Sequence
  Description of Artificial Sequence: Synthetic peptide
DEEEIRTTNPVATEQYGSVSTNLQYAGNR

SEQ ID NO: 2417 - protein, 29 aa, Artificial Sequence
  Description of Artificial Sequence: Synthetic peptide
DNEEIRTTNPVATEQYGSVDSTNLQRGNR

SEQ ID NO: 2418 - protein, 30 aa, Artificial Sequence
  Description of Artificial Sequence: Synthetic polypeptide
DEEEIRTTNPVATEQYGSVSTNLQWRTGNR

SEQ ID NO: 2419 - protein, 29 aa, Artificial Sequence
  Description of Artificial Sequence: Synthetic peptide
DEEEIRTTNPVATEQYGSVSLNELQRGNR

SEQ ID NO: 2420 - protein, 29 aa, Artificial Sequence
  Description of Artificial Sequence: Synthetic peptide
DEEEIRTTNPVATEQYGSVSTNTQWRGNR

SEQ ID NO: 2421 - protein, 28 aa, Artificial Sequence
  Description of Artificial Sequence: Synthetic peptide
DNEEIRTTNPVATEQYGSVSTNEQRGNR

SEQ ID NO: 2422 - protein, 28 aa, Artificial Sequence
  Description of Artificial Sequence: Synthetic peptide
DNEEIRTTNPVATEQYGSVSTNLQFGNR

SEQ ID NO: 2423 - protein, 28 aa, Artificial Sequence
  Description of Artificial Sequence: Synthetic peptide
DEEEIRTTNPVATEQYGSVSTNVQPGNR

SEQ ID NO: 2424 - protein, 29 aa, Artificial Sequence
  Description of Artificial Sequence: Synthetic peptide
DEEEIRTTNPVATEQYGSVSTNVQREGNR

SEQ ID NO: 2425 - protein, 29 aa, Artificial Sequence
  Description of Artificial Sequence: Synthetic peptide
DEEEIRTTNPVATEQYGSVSTNVQRGANR

SEQ ID NO: 2426 - protein, 28 aa, Artificial Sequence
  Description of Artificial Sequence: Synthetic peptide
DEEEIRTTNPVATEQYGSVSTNVQRGGR

SEQ ID NO: 2427 - protein, 28 aa, Artificial Sequence
  Description of Artificial Sequence: Synthetic peptide
DNEEIRTTNPVATEQYGSVSTNLQRGNP

SEQ ID NO: 2428 - protein, 28 aa, Artificial Sequence
  Description of Artificial Sequence: Synthetic peptide
DEEEIGTTNPVASEQYGSVSTNLQRGNR

SEQ ID NO: 2429 - protein, 29 aa, Artificial Sequence
  Description of Artificial Sequence: Synthetic peptide
DEEEIRTTNPVATEQYGSVSTNVQRGNRG

SEQ ID NO: 2430 - protein, 29 aa, Artificial Sequence
  Description of Artificial Sequence: Synthetic peptide
DEEEIRTTNPVATEQYGSVSTNVQGRGNR

SEQ ID NO: 2431 - protein, 29 aa, Artificial Sequence
  Description of Artificial Sequence: Synthetic peptide
DEEEIRTTNPVATEQYGSVSTNTQRLGNR

SEQ ID NO: 2432 - protein, 28 aa, Artificial Sequence
  Description of Artificial Sequence: Synthetic peptide
DNEEIRTTNPFATEQYGSVSTNLQRGNR

SEQ ID NO: 2433 - protein, 29 aa, Artificial Sequence
  Description of Artificial Sequence: Synthetic peptide
DEEEIRTTNPVATEQYGSVSTNTQRIGNR

SEQ ID NO: 2434 - protein, 28 aa, Artificial Sequence
  Description of Artificial Sequence: Synthetic peptide
DEEEIRTTNPVACEQYGSVSCNLQRGNR

SEQ ID NO: 2435 - protein, 29 aa, Artificial Sequence
  Description of Artificial Sequence: Synthetic peptide
DEEEIRTTNPVATEQYGSVSTCILQRGNR

SEQ ID NO: 2436 - protein, 29 aa, Artificial Sequence
  Description of Artificial Sequence: Synthetic peptide
DMEEIRTTNPVATEQYGSVSTNLQNRGNR

SEQ ID NO: 2437 - protein, 29 aa, Artificial Sequence
  Description of Artificial Sequence: Synthetic peptide
DMEEIRTTNPVATEQYGSVSTNLQRGENR

SEQ ID NO: 2438 - protein, 30 aa, Artificial Sequence
  Description of Artificial Sequence: Synthetic polypeptide
DEEEIRTTNPVATEQYGSVSTNTLQRQGNR

SEQ ID NO: 2439 - protein, 28 aa, Artificial Sequence
  Description of Artificial Sequence: Synthetic peptide
DEEEIRTTNPVACEQYGSVSLNLQRGNR

SEQ ID NO: 2440 - protein, 29 aa, Artificial Sequence
  Description of Artificial Sequence: Synthetic peptide
DEEEIRTTNPVATEQYGSFVSQNLQRGNR

SEQ ID NO: 2441 - protein, 29 aa, Artificial Sequence
  Description of Artificial Sequence: Synthetic peptide
DMEEIRTTNPVATEQYGSVSTQNLQRGNR

SEQ ID NO: 2442 - protein, 28 aa, Artificial Sequence
  Description of Artificial Sequence: Synthetic peptide
DEEEIRTTNPVACEQYGSVSTDLQRGNR

SEQ ID NO: 2443 - protein, 29 aa, Artificial Sequence
  Description of Artificial Sequence: Synthetic peptide
DEEEIRTTNPVACEQYGSVSTNLQHRGNR

SEQ ID NO: 2444 - protein, 29 aa, Artificial Sequence
  Description of Artificial Sequence: Synthetic peptide
DEEEIRTTNPVACEQYGSVSTNLQREGNR

SEQ ID NO: 2445 - protein, 29 aa, Artificial Sequence
  Description of Artificial Sequence: Synthetic peptide
DEEEIRTTNPVACEQYGSVSTNLQRGNNR

SEQ ID NO: 2446 - protein, 29 aa, Artificial Sequence
  Description of Artificial Sequence: Synthetic peptide
DEEEIRTTNPVATEQYGSVSTNLQYGENR

SEQ ID NO: 2447 - protein, 29 aa, Artificial Sequence
  Description of Artificial Sequence: Synthetic peptide
DEEEIRTTNPVATEQYGSVSTCCLQRGNR

SEQ ID NO: 2448 - protein, 28 aa, Artificial Sequence
  Description of Artificial Sequence: Synthetic peptide
DEEEIRTTNPVATEQYGSTSINLQRGNR

SEQ ID NO: 2449 - protein, 29 aa, Artificial Sequence
  Description of Artificial Sequence: Synthetic peptide
DEEEIRTTNPVACEQYGSVSTNLQRVGNR

SEQ ID NO: 2450 - protein, 29 aa, Artificial Sequence
  Description of Artificial Sequence: Synthetic peptide
DEEEIRTTNPVATEQYGSVSTNLQYGANR

SEQ ID NO: 2451 - protein, 28 aa, Artificial Sequence
  Description of Artificial Sequence: Synthetic peptide
DEEEIRTTNPVATEQYGSVSTNTQFGNR

SEQ ID NO: 2452 - protein, 28 aa, Artificial Sequence
  Description of Artificial Sequence: Synthetic peptide
DEEEIRTTNPVATEQYGSVSTNTQMGNR

SEQ ID NO: 2453 - protein, 28 aa, Artificial Sequence
  Description of Artificial Sequence: Synthetic peptide
DEEEIRTTNPVATEQYGSVSTNVQRLNR

SEQ ID NO: 2454 - protein, 28 aa, Artificial Sequence
  Description of Artificial Sequence: Synthetic peptide
DEEEIETTNPVATEQYGSVSTNLYRGNR

SEQ ID NO: 2455 - protein, 29 aa, Artificial Sequence
  Description of Artificial Sequence: Synthetic peptide
DEEEIRTTNPVATEQYGSVSTNVQRVGNR

SEQ ID NO: 2456 - protein, 28 aa, Artificial Sequence
  Description of Artificial Sequence: Synthetic peptide
DNEEIRTTNPVATEQYGSVSTNLQRGNV

SEQ ID NO: 2457 - protein, 30 aa, Artificial Sequence
  Description of Artificial Sequence: Synthetic polypeptide
DEEEIRTTNPVATEQYGSVSTNWLQRGNRE

SEQ ID NO: 2458 - protein, 29 aa, Artificial Sequence
  Description of Artificial Sequence: Synthetic peptide
DEEEIRTTNPVATEQYGSVSTNLQWRGIR

SEQ ID NO: 2459 - protein, 30 aa, Artificial Sequence
  Description of Artificial Sequence: Synthetic polypeptide
DEEEIRTTNPVATEQYGSVSTNWLQRGVNR

SEQ ID NO: 2460 - protein, 28 aa, Artificial Sequence
  Description of Artificial Sequence: Synthetic peptide
DEEEIFTTNPVATEQYGSVSTNLQRGNN

SEQ ID NO: 2461 - protein, 29 aa, Artificial Sequence
  Description of Artificial Sequence: Synthetic peptide
DEEEIFTTNPVATEQYGSVSTNLQRGDNR

SEQ ID NO: 2462 - protein, 29 aa, Artificial Sequence
  Description of Artificial Sequence: Synthetic peptide
DEEEIRTTNPVATEQYGSVSTNWLQRINR

SEQ ID NO: 2463 - protein, 28 aa, Artificial Sequence
  Description of Artificial Sequence: Synthetic peptide
DEEEIFTTNPVATEQYGSVSTNLQRENR

SEQ ID NO: 2464 - protein, 29 aa, Artificial Sequence
  Description of Artificial Sequence: Synthetic peptide
DEEEIRTTNPVATEQYGSVSTNWLQRMNR

SEQ ID NO: 2465 - protein, 29 aa, Artificial Sequence
  Description of Artificial Sequence: Synthetic peptide
DEEEIRTTNPVATEQYGSTSTNLQRGNRE

SEQ ID NO: 2466 - protein, 28 aa, Artificial Sequence
  Description of Artificial Sequence: Synthetic peptide
DEEEIRTTNPVADEAYGSVSTNLQRGNR

SEQ ID NO: 2467 - protein, 29 aa, Artificial Sequence
  Description of Artificial Sequence: Synthetic peptide
DEEEIRTTNPVATEQYGSVSTNWNQRGNR

SEQ ID NO: 2468 - protein, 29 aa, Artificial Sequence
  Description of Artificial Sequence: Synthetic peptide
DEEEIRTTNPVADEQYGSVSDTNLQRGNR

SEQ ID NO: 2469 - protein, 28 aa, Artificial Sequence
  Description of Artificial Sequence: Synthetic peptide
DEEEIRTTNPVADEQYGSVSLNLQRGNR

SEQ ID NO: 2470 - protein, 29 aa, Artificial Sequence
  Description of Artificial Sequence: Synthetic peptide
DEEEIRTTNPVADEQYGSVSSTNLQRGNR

SEQ ID NO: 2471 - protein, 28 aa, Artificial Sequence
  Description of Artificial Sequence: Synthetic peptide
DEEEIFTTNPVATEQYGSVSINLQRGNR

SEQ ID NO: 2472 - protein, 28 aa, Artificial Sequence
  Description of Artificial Sequence: Synthetic peptide
DEEEIFTTNPVATEPYGSVSTNLQRGNR

SEQ ID NO: 2473 - protein, 28 aa, Artificial Sequence
  Description of Artificial Sequence: Synthetic peptide
DEEEIFTTNPVAEEQYGSVSTNLQRGNR

SEQ ID NO: 2474 - protein, 28 aa, Artificial Sequence
  Description of Artificial Sequence: Synthetic peptide
DEEEIETTNPVATEVYGSVSTNLQRGNR

SEQ ID NO: 2475 - protein, 29 aa, Artificial Sequence
  Description of Artificial Sequence: Synthetic peptide
DEEEIFTTNPVATEQYGSVSTNLDQRGNR

SEQ ID NO: 2476 - protein, 30 aa, Artificial Sequence
  Description of Artificial Sequence: Synthetic polypeptide
DEEEIRTTNPVATEQYGSVSTNLQWRGLNR

SEQ ID NO: 2477 - protein, 30 aa, Artificial Sequence
  Description of Artificial Sequence: Synthetic polypeptide
DEEEIRTTNPVATEQYGSVSTANLQRGNER

SEQ ID NO: 2478 - protein, 29 aa, Artificial Sequence
  Description of Artificial Sequence: Synthetic peptide
DEEEIRTTNPVATEQYGSVSTANLQRGNI

SEQ ID NO: 2479 - protein, 29 aa, Artificial Sequence
  Description of Artificial Sequence: Synthetic peptide
DNEEIRTTNPVATEQYGSVSTNLVQRGNR

SEQ ID NO: 2480 - protein, 28 aa, Artificial Sequence
  Description of Artificial Sequence: Synthetic peptide
DEEEIRTTNPVATEQYGSTSTHLQRGNR

SEQ ID NO: 2481 - protein, 29 aa, Artificial Sequence
  Description of Artificial Sequence: Synthetic peptide
DNEEIRTTNPVATEQYGSVSTPNLQRGNR

SEQ ID NO: 2482 - protein, 28 aa, Artificial Sequence
  Description of Artificial Sequence: Synthetic peptide
DNEEIRTTNPVATQQYGSVSTNLQRGNR

SEQ ID NO: 2483 - protein, 29 aa, Artificial Sequence
  Description of Artificial Sequence: Synthetic peptide
DEEEIGRTTNPVATEKYGSVSTNLQRGNR

SEQ ID NO: 2484 - protein, 28 aa, Artificial Sequence
  Description of Artificial Sequence: Synthetic peptide
DEEEIRTTNPVATEQYGSTSTNLQRANR

SEQ ID NO: 2485 - protein, 28 aa, Artificial Sequence
  Description of Artificial Sequence: Synthetic peptide
DEEEIRTTNPVATEQYGSTSTNLQRGNM

SEQ ID NO: 2486 - protein, 30 aa, Artificial Sequence
  Description of Artificial Sequence: Synthetic polypeptide
DEEEIRTTNPVATEQYGSVSTNLQWRSGNR

SEQ ID NO: 2487 - protein, 29 aa, Artificial Sequence
  Description of Artificial Sequence: Synthetic peptide
DEEEIRTTNPVATEQYGSVSTNWAQRGNR

SEQ ID NO: 2488 - protein, 29 aa, Artificial Sequence
  Description of Artificial Sequence: Synthetic peptide
DEEEIRTTNPVATEQYGSTSTNLQRGNPR

SEQ ID NO: 2489 - protein, 28 aa, Artificial Sequence
  Description of Artificial Sequence: Synthetic peptide
DEEEIRTTNPVATEQYGSVSTNWGRGNR

SEQ ID NO: 2490 - protein, 29 aa, Artificial Sequence
  Description of Artificial Sequence: Synthetic peptide
DEEEIRTTNPVATEQYGSVSTNWLQEGNR

SEQ ID NO: 2491 - protein, 29 aa, Artificial Sequence
  Description of Artificial Sequence: Synthetic peptide
DEEEIRTTNPVATEQYGSTSTNLQRGNRA

SEQ ID NO: 2492 - protein, 29 aa, Artificial Sequence
  Description of Artificial Sequence: Synthetic peptide
DEEEIRTTNPVATEQYGSVSTNLQWRGNL

SEQ ID NO: 2493 - protein, 30 aa, Artificial Sequence
  Description of Artificial Sequence: Synthetic polypeptide
DEEEIRTTNPVATEQYGSVSTNWLQRDGNR

SEQ ID NO: 2494 - protein, 30 aa, Artificial Sequence
  Description of Artificial Sequence: Synthetic polypeptide
DEEEIRTTNPVATEQYGSVSTANLQRGYNR

SEQ ID NO: 2495 - protein, 30 aa, Artificial Sequence
  Description of Artificial Sequence: Synthetic polypeptide
DEEEIRTTNPVATEQYGSVSTANLQRGSNR

SEQ ID NO: 2496 - protein, 30 aa, Artificial Sequence
  Description of Artificial Sequence: Synthetic polypeptide
DEEEIRTTNPVATEQYGSVSTANLQRGNRS

SEQ ID NO: 2497 - protein, 29 aa, Artificial Sequence
  Description of Artificial Sequence: Synthetic peptide
DEEEIRTTNPVATEQYGSVSTNWLQRGDR

SEQ ID NO: 2498 - protein, 28 aa, Artificial Sequence
  Description of Artificial Sequence: Synthetic peptide
DEEEIRTTNPVATEQYGSVSLNLDRGNR

SEQ ID NO: 2499 - protein, 29 aa, Artificial Sequence
  Description of Artificial Sequence: Synthetic peptide
DEPEIRTTNPVATEQYGSVSTNLQRGINR

SEQ ID NO: 2500 - protein, 28 aa, Artificial Sequence
  Description of Artificial Sequence: Synthetic peptide
DEEEIRTTNPVATEQYGSVSTPLCRGNR

SEQ ID NO: 2501 - protein, 28 aa, Artificial Sequence
  Description of Artificial Sequence: Synthetic peptide
DEEEIRTTNPVATEQYGSFSTNLQRGNM

SEQ ID NO: 2502 - protein, 28 aa, Artificial Sequence
  Description of Artificial Sequence: Synthetic peptide
DESEIRTTNPVATEQYGSVSTNLQEGNR

SEQ ID NO: 2503 - protein, 30 aa, Artificial Sequence
  Description of Artificial Sequence: Synthetic polypeptide
DEEEIRTTNPVATEQYGSCVSTMNLQRGNR

SEQ ID NO: 2504 - protein, 29 aa, Artificial Sequence
  Description of Artificial Sequence: Synthetic peptide
DEEEIRTTNPVATEQYGSVSTALQARGNR

SEQ ID NO: 2505 - protein, 30 aa, Artificial Sequence
  Description of Artificial Sequence: Synthetic polypeptide
DEEEIRTTNPVATEQYGSCVSTDNLQRGNR

SEQ ID NO: 2506 - protein, 30 aa, Artificial Sequence
  Description of Artificial Sequence: Synthetic polypeptide
DEEEIRTTNPVATEQYGSCVSFTNLQRGNR

SEQ ID NO: 2507 - protein, 29 aa, Artificial Sequence
  Description of Artificial Sequence: Synthetic peptide
DEEEIRTTNPVATEQYGSVSTNLQSKGNR

SEQ ID NO: 2508 - protein, 28 aa, Artificial Sequence
  Description of Artificial Sequence: Synthetic peptide
DESEIRTTNPVATEQYGSVSTNLIRGNR

SEQ ID NO: 2509 - protein, 28 aa, Artificial Sequence
  Description of Artificial Sequence: Synthetic peptide
DESEIRTTNPVATEQYGSVSTNIQRGNR

SEQ ID NO: 2510 - protein, 29 aa, Artificial Sequence
  Description of Artificial Sequence: Synthetic peptide
DEEEIRTTNPVATEQYGSVSTEHLQRGNR

SEQ ID NO: 2511 - protein, 28 aa, Artificial Sequence
  Description of Artificial Sequence: Synthetic peptide
DEEEIRTTNPVATEQYGSVSTALNRGNR

SEQ ID NO: 2512 - protein, 29 aa, Artificial Sequence
  Description of Artificial Sequence: Synthetic peptide
DEEEIRTTNPVATEQYGSVSTNLQSGNRD

SEQ ID NO: 2513 - protein, 29 aa, Artificial Sequence
  Description of Artificial Sequence: Synthetic peptide
DESEIRTTNPVATEQYGSVSTMNLQRGNR

SEQ ID NO: 2514 - protein, 28 aa, Artificial Sequence
  Description of Artificial Sequence: Synthetic peptide
DEEEIRTTNPVATEQYGSVSTNLQSGNH

SEQ ID NO: 2515 - protein, 29 aa, Artificial Sequence
  Description of Artificial Sequence: Synthetic peptide
DEEEIRTTNPVATEQYGSVSTNLQSGNDR

SEQ ID NO: 2516 - protein, 29 aa, Artificial Sequence
  Description of Artificial Sequence: Synthetic peptide
DEEEIRTTNPVATEQYGSVSTPNDQRGNR

SEQ ID NO: 2517 - protein, 28 aa, Artificial Sequence
  Description of Artificial Sequence: Synthetic peptide
DEEEIRTTNPVATEQYGSVSTALCRGNR

SEQ ID NO: 2518 - protein, 29 aa, Artificial Sequence
  Description of Artificial Sequence: Synthetic peptide
DEEEIRTTNPVATEQYGSVSTNLQSGANR

SEQ ID NO: 2519 - protein, 30 aa, Artificial Sequence
  Description of Artificial Sequence: Synthetic polypeptide
DEEEIRTTNPVATEQYGSTVSTNLQRGNRV

SEQ ID NO: 2520 - protein, 29 aa, Artificial Sequence
  Description of Artificial Sequence: Synthetic peptide
DEEEIRTTNPVATEQYGSCVETNLQRGNR

SEQ ID NO: 2521 - protein, 29 aa, Artificial Sequence
  Description of Artificial Sequence: Synthetic peptide
DEEEIRTTNPVATEQYGSCVSTNLQFGNR

SEQ ID NO: 2522 - protein, 30 aa, Artificial Sequence
  Description of Artificial Sequence: Synthetic polypeptide
DEEEIRTTNPVATEQYGSCVSTNLQRFGNR

SEQ ID NO: 2523 - protein, 30 aa, Artificial Sequence
  Description of Artificial Sequence: Synthetic polypeptide
DEEEIRTTNPVATEQYGSCVSTNLQRGENR

SEQ ID NO: 2524 - protein, 28 aa, Artificial Sequence
  Description of Artificial Sequence: Synthetic peptide
DEEEIRTTNPVATEQYGSESNNLQRGNR

SEQ ID NO: 2525 - protein, 30 aa, Artificial Sequence
  Description of Artificial Sequence: Synthetic polypeptide
DEEEIRTTNPVATEQYGSDVSTNLQRGNIR

SEQ ID NO: 2526 - protein, 30 aa, Artificial Sequence
  Description of Artificial Sequence: Synthetic polypeptide
DEEEIRTTNPVATEQYGSVSTNLQSRGNRV

SEQ ID NO: 2527 - protein, 30 aa, Artificial Sequence
  Description of Artificial Sequence: Synthetic polypeptide
DEEEIRTTNPVATEQYGSVSTNLQSRGNRP

SEQ ID NO: 2528 - protein, 29 aa, Artificial Sequence
  Description of Artificial Sequence: Synthetic peptide
DEEEIRTTNPVATEQYGSDVSTNLQFGNR

SEQ ID NO: 2529 - protein, 28 aa, Artificial Sequence
  Description of Artificial Sequence: Synthetic peptide
DEEEIRTTNPVATEQYGSDSTNLQRGNV

SEQ ID NO: 2530 - protein, 29 aa, Artificial Sequence
  Description of Artificial Sequence: Synthetic peptide
DESEIRTTNPVATEQYGSVSTNLQRGQNR

SEQ ID NO: 2531 - protein, 29 aa, Artificial Sequence
  Description of Artificial Sequence: Synthetic peptide
DESEIRTTNPVATEQYGSVSTNLQRGNRL

SEQ ID NO: 2532 - protein, 28 aa, Artificial Sequence
  Description of Artificial Sequence: Synthetic peptide
DESEIRTTNPVATEQYGSVSTNLQRGNH

SEQ ID NO: 2533 - protein, 28 aa, Artificial Sequence
  Description of Artificial Sequence: Synthetic peptide
DEEEIRTTNPVATEQYGSDSTNLQRGNE

SEQ ID NO: 2534 - protein, 28 aa, Artificial Sequence
  Description of Artificial Sequence: Synthetic peptide
DEEEIRTTNPVATEQYGSDSTNLQKGNR

SEQ ID NO: 2535 - protein, 28 aa, Artificial Sequence
  Description of Artificial Sequence: Synthetic peptide
DESEIRTTNPVATEQYGSVSTNLQRANR

SEQ ID NO: 2536 - protein, 28 aa, Artificial Sequence
  Description of Artificial Sequence: Synthetic peptide
DEEEIRTTNPVATEQYGSDSTNLQFGNR

SEQ ID NO: 2537 - protein, 28 aa, Artificial Sequence
  Description of Artificial Sequence: Synthetic peptide
DEEEIRTTNPVATEQYGSDSTNLQEGNR

SEQ ID NO: 2538 - protein, 29 aa, Artificial Sequence
  Description of Artificial Sequence: Synthetic peptide
DEEEIRTTNPVATEQYGSVSTNLQSRGNI

SEQ ID NO: 2539 - protein, 29 aa, Artificial Sequence
  Description of Artificial Sequence: Synthetic peptide
DEEEIRTTNPVATEQYGSVSTNLQSRGNF

SEQ ID NO: 2540 - protein, 29 aa, Artificial Sequence
  Description of Artificial Sequence: Synthetic peptide
DEEEIRTTNPVATEQYGSVSTNLQSRGNA

SEQ ID NO: 2541 - protein, 29 aa, Artificial Sequence
  Description of Artificial Sequence: Synthetic peptide
DEEEIRTTNPVATEQYGSCVSTNLQSGNR

SEQ ID NO: 2542 - protein, 29 aa, Artificial Sequence
  Description of Artificial Sequence: Synthetic peptide
DEEEIRTTNPVATEQYGSCVSTNLQRGND

SEQ ID NO: 2543 - protein, 28 aa, Artificial Sequence
  Description of Artificial Sequence: Synthetic peptide
DEEEICTTNPVATEQYGSVSTNLWRGNR

SEQ ID NO: 2544 - protein, 29 aa, Artificial Sequence
  Description of Artificial Sequence: Synthetic peptide
DEEEIRTTNPVATEQYGSESTCNLQRGNR

SEQ ID NO: 2545 - protein, 29 aa, Artificial Sequence
  Description of Artificial Sequence: Synthetic peptide
DEEEIRTTNPVAFEQYGSVSGTNLQRGNR

SEQ ID NO: 2546 - protein, 29 aa, Artificial Sequence
  Description of Artificial Sequence: Synthetic peptide
DEEEIRATNPVATEQYGSVDSTNLQRGNR

SEQ ID NO: 2547 - protein, 29 aa, Artificial Sequence
  Description of Artificial Sequence: Synthetic peptide
DEEEIRTTNPVATEQYGSVSLNLQRLGNR

SEQ ID NO: 2548 - protein, 29 aa, Artificial Sequence
  Description of Artificial Sequence: Synthetic peptide
DEEEIRTTNPVATEQYGSVSSVNLQRGNR

SEQ ID NO: 2549 - protein, 29 aa, Artificial Sequence
  Description of Artificial Sequence: Synthetic peptide
DEEEIRTTNPVATEQYGSVSTNLQRYANR

SEQ ID NO: 2550 - protein, 29 aa, Artificial Sequence
  Description of Artificial Sequence: Synthetic peptide
DEEEIRTTNPVATEQYGSVSTNLQRWNER

SEQ ID NO: 2551 - protein, 28 aa, Artificial Sequence
  Description of Artificial Sequence: Synthetic peptide
DESEIRTTNPVATEQYGQVSTNLQRGNR

SEQ ID NO: 2552 - protein, 28 aa, Artificial Sequence
  Description of Artificial Sequence: Synthetic peptide
DESEIRTTNPVATEQYGNVSTNLQRGNR

SEQ ID NO: 2553 - protein, 29 aa, Artificial Sequence
  Description of Artificial Sequence: Synthetic peptide
DEEEIRTTNPVATEQYGSVSTNLQRWGNI

SEQ ID NO: 2554 - protein, 29 aa, Artificial Sequence
  Description of Artificial Sequence: Synthetic peptide
DEEEIRTTNPVATEQYGSVSTNLQRWENR

SEQ ID NO: 2555 - protein, 29 aa, Artificial Sequence
  Description of Artificial Sequence: Synthetic peptide
DEEEIRTTNPVATEQYGSVSLNLQRGVNR

SEQ ID NO: 2556 - protein, 29 aa, Artificial Sequence
  Description of Artificial Sequence: Synthetic peptide
DEEEIRTTNPVATEQYGSVSTNLQRVNRQ

SEQ ID NO: 2557 - protein, 29 aa, Artificial Sequence
  Description of Artificial Sequence: Synthetic peptide
DEEEIRTTNPVATEQYGSVSTNLQRVNRL

SEQ ID NO: 2558 - protein, 29 aa, Artificial Sequence
  Description of Artificial Sequence: Synthetic peptide
DESEIRTTNPVATEQYGISVSTNLQRGNR

SEQ ID NO: 2559 - protein, 28 aa, Artificial Sequence
  Description of Artificial Sequence: Synthetic peptide
DESEIRTTNPVATEQYGFVSTNLQRGNR

SEQ ID NO: 2560 - protein, 28 aa, Artificial Sequence
  Description of Artificial Sequence: Synthetic peptide
DEEEIRTTNPVATEQYGSVSTNLQRVNQ

SEQ ID NO: 2561 - protein, 29 aa, Artificial Sequence
  Description of Artificial Sequence: Synthetic peptide
DEEEIRTTNPVATEQYGSVSTNLQRVINR

SEQ ID NO: 2562 - protein, 28 aa, Artificial Sequence
  Description of Artificial Sequence: Synthetic peptide
DEEEIRTTNPVATEQYGCVQTNLQRGNR

SEQ ID NO: 2563 - protein, 29 aa, Artificial Sequence
  Description of Artificial Sequence: Synthetic peptide
DEEEIRTTNPVATEQYGSVSLNLQRTGNR

SEQ ID NO: 2564 - protein, 30 aa, Artificial Sequence
  Description of Artificial Sequence: Synthetic polypeptide
DEEEIRTTNPVATEQYGSVSTNLQRVGANR

SEQ ID NO: 2565 - protein, 28 aa, Artificial Sequence
  Description of Artificial Sequence: Synthetic peptide
DEEEIRTTNPVATEQYGSCSTTLQRGNR

SEQ ID NO: 2566 - protein, 30 aa, Artificial Sequence
  Description of Artificial Sequence: Synthetic polypeptide
DEEEIRTTNPVATEQYGSVSTNLQRYGLNR

SEQ ID NO: 2567 - protein, 28 aa, Artificial Sequence
  Description of Artificial Sequence: Synthetic peptide
SEEEIYTTNPVATEQYGSVSTNLQRGNR

SEQ ID NO: 2568 - protein, 29 aa, Artificial Sequence
  Description of Artificial Sequence: Synthetic peptide
DESEIRTTNPVATEQYGSVISTNLQRGNR

SEQ ID NO: 2569 - protein, 28 aa, Artificial Sequence
  Description of Artificial Sequence: Synthetic peptide
DEEEIRTTNPVATEQYGSVSTELNRGNR

SEQ ID NO: 2570 - protein, 29 aa, Artificial Sequence
  Description of Artificial Sequence: Synthetic peptide
DEEEIRATNPVATEQYGSVESTNLQRGNR

SEQ ID NO: 2571 - protein, 28 aa, Artificial Sequence
  Description of Artificial Sequence: Synthetic peptide
DEEEICTTNPVATEQYGSVSTNLQSGNR

SEQ ID NO: 2572 - protein, 29 aa, Artificial Sequence
  Description of Artificial Sequence: Synthetic peptide
DEEEICTTNPVATEQYGSVSTNLQRGNFR

SEQ ID NO: 2573 - protein, 29 aa, Artificial Sequence
  Description of Artificial Sequence: Synthetic peptide
DEEEICTTNPVATEQYGSVSTNLQRGINR

SEQ ID NO: 2574 - protein, 28 aa, Artificial Sequence
  Description of Artificial Sequence: Synthetic peptide
DEEEIRTTNPVAFEQYGSVSTNLQNGNR

SEQ ID NO: 2575 - protein, 28 aa, Artificial Sequence
  Description of Artificial Sequence: Synthetic peptide
DEEEIRTTNPVATEQYGSVSLNLQRGNL

SEQ ID NO: 2576 - protein, 28 aa, Artificial Sequence
  Description of Artificial Sequence: Synthetic peptide
DEEEIRTTNPVAFEQYGSVSTNLQPGNR

SEQ ID NO: 2577 - protein, 29 aa, Artificial Sequence
  Description of Artificial Sequence: Synthetic peptide
DEEEIRTTNPVAFEQYGSVSTNLQQRGNR

SEQ ID NO: 2578 - protein, 29 aa, Artificial Sequence
  Description of Artificial Sequence: Synthetic peptide
DEEEIRTTNPVATEQYGSVSTNLQSAGNR

SEQ ID NO: 2579 - protein, 28 aa, Artificial Sequence
  Description of Artificial Sequence: Synthetic peptide
DEEEIRTTNPVAFEQYGSVSTNLQRGND

SEQ ID NO: 2580 - protein, 29 aa, Artificial Sequence
  Description of Artificial Sequence: Synthetic peptide
DEEEIRTTNPVAFEQYGSVSTNNLQRGNR

SEQ ID NO: 2581 - protein, 29 aa, Artificial Sequence
  Description of Artificial Sequence: Synthetic peptide
DEEEIRTTNPVAFEQYGSVSTNPLQRGNR

SEQ ID NO: 2582 - protein, 28 aa, Artificial Sequence
  Description of Artificial Sequence: Synthetic peptide
DEEEIRTTNPVATEQYGSVSTNLQRYNV

SEQ ID NO: 2583 - protein, 28 aa, Artificial Sequence
  Description of Artificial Sequence: Synthetic peptide
DEEEIRTTNPVATEQYGSVSTNLQRYNQ

SEQ ID NO: 2584 - protein, 29 aa, Artificial Sequence
  Description of Artificial Sequence: Synthetic peptide
DEEEIRTTNPVATEQYGSVSTNLQRYLNR

SEQ ID NO: 2585 - protein, 28 aa, Artificial Sequence
  Description of Artificial Sequence: Synthetic peptide
DESEIRTTNPVATEQYGSVITNLQRGNR

SEQ ID NO: 2586 - protein, 29 aa, Artificial Sequence
  Description of Artificial Sequence: Synthetic peptide
DEEEIRTTNPVATEQYGSVSLNLQRGNRA

SEQ ID NO: 2587 - protein, 28 aa, Artificial Sequence
  Description of Artificial Sequence: Synthetic peptide
DEEEICTTNPVATEQYGSVSTNLQIGNR

SEQ ID NO: 2588 - protein, 29 aa, Artificial Sequence
  Description of Artificial Sequence: Synthetic peptide
DEEEIRTTNPVATEQYGSVSTNLQSEGNR

SEQ ID NO: 2589 - protein, 29 aa, Artificial Sequence
  Description of Artificial Sequence: Synthetic peptide
DPEEIRTTNPVATEQYGSVSTNPLQRGNR

SEQ ID NO: 2590 - protein, 28 aa, Artificial Sequence
  Description of Artificial Sequence: Synthetic peptide
DEEEIRTTNPVATEQYGSESTNDQRGNR

SEQ ID NO: 2591 - protein, 28 aa, Artificial Sequence
  Description of Artificial Sequence: Synthetic peptide
DEEEIRTTNPVATEQYGSESTNLGRGNR

SEQ ID NO: 2592 - protein, 29 aa, Artificial Sequence
  Description of Artificial Sequence: Synthetic peptide
DEEEIRTTNPVATEQYGSVSTNLQTRGVR

SEQ ID NO: 2593 - protein, 29 aa, Artificial Sequence
  Description of Artificial Sequence: Synthetic peptide
DEEEIRTTNPVATEQYGSVSTNLQTRGSR

SEQ ID NO: 2594 - protein, 30 aa, Artificial Sequence
  Description of Artificial Sequence: Synthetic polypeptide
DEEEIRTTNPVATEQYGSVSTNLQTRGNRP

SEQ ID NO: 2595 - protein, 30 aa, Artificial Sequence
  Description of Artificial Sequence: Synthetic polypeptide
DEEEIRTTNPVATEQYGSVSTNLQTRGNRE

SEQ ID NO: 2596 - protein, 28 aa, Artificial Sequence
  Description of Artificial Sequence: Synthetic peptide
AEEEIRTTNPVATEQYGSVSTNQQRGNR

SEQ ID NO: 2597 - protein, 28 aa, Artificial Sequence
  Description of Artificial Sequence: Synthetic peptide
DEEEIRTTNPVATEQYGSVSTNLQTPNR

SEQ ID NO: 2598 - protein, 28 aa, Artificial Sequence
  Description of Artificial Sequence: Synthetic peptide
DEECIRTTNPRATEQYGSVSTNLQRGNR

SEQ ID NO: 2599 - protein, 29 aa, Artificial Sequence
  Description of Artificial Sequence: Synthetic peptide
DEEEIRTTNPVATEQYGSVSTNLQTNGNR

SEQ ID NO: 2600 - protein, 28 aa, Artificial Sequence
  Description of Artificial Sequence: Synthetic peptide
DEEEIRTTNPVATEQYGSVSTNLQTVNR

SEQ ID NO: 2601 - protein, 28 aa, Artificial Sequence
  Description of Artificial Sequence: Synthetic peptide
DEEEIRTTNPVATEQYGSVSTPLQRFNR

SEQ ID NO: 2602 - protein, 29 aa, Artificial Sequence
  Description of Artificial Sequence: Synthetic peptide
DEEEIRTTNPVATEQYGSVSTPLQRGNAR

SEQ ID NO: 2603 - protein, 29 aa, Artificial Sequence
  Description of Artificial Sequence: Synthetic peptide
DEEEIRTTNPVATEQYGSVSTNLQTGNRK

SEQ ID NO: 2604 - protein, 28 aa, Artificial Sequence
  Description of Artificial Sequence: Synthetic peptide
DEEEIRTTNPVATEQYGSVSTALQVGNR

SEQ ID NO: 2605 - protein, 28 aa, Artificial Sequence
  Description of Artificial Sequence: Synthetic peptide
DEEEIRTTNPVATEQYGSVSTPLQRGNQ

SEQ ID NO: 2606 - protein, 29 aa, Artificial Sequence
  Description of Artificial Sequence: Synthetic peptide
DEEEIRTTNPVATEQYGSVSTPLQRGNQR

SEQ ID NO: 2607 - protein, 28 aa, Artificial Sequence
  Description of Artificial Sequence: Synthetic peptide
DEEEIRTTNPVATEQYGSVSTPLQRGNT

SEQ ID NO: 2608 - protein, 29 aa, Artificial Sequence
  Description of Artificial Sequence: Synthetic peptide
DEEEIRTTNPVATEQYGSVSTALQRGPNR

SEQ ID NO: 2609 - protein, 29 aa, Artificial Sequence
  Description of Artificial Sequence: Synthetic peptide
DEEEIRTTNPVATEQYGSVSTPLQRGNTR

SEQ ID NO: 2610 - protein, 28 aa, Artificial Sequence
  Description of Artificial Sequence: Synthetic peptide
DEEEIRTTNPIATEQYGMVSTNLQRGNR

SEQ ID NO: 2611 - protein, 29 aa, Artificial Sequence
  Description of Artificial Sequence: Synthetic peptide
DEEEIRTTNPVATEQYGSVSITNVQRGNR

SEQ ID NO: 2612 - protein, 28 aa, Artificial Sequence
  Description of Artificial Sequence: Synthetic peptide
DEEEICTTNPVATTQYGSVSTNLQRGNR

SEQ ID NO: 2613 - protein, 29 aa, Artificial Sequence
  Description of Artificial Sequence: Synthetic peptide
DEEEIRTTNPVATEQYGSVSTNLQTYGNR

SEQ ID NO: 2614 - protein, 28 aa, Artificial Sequence
  Description of Artificial Sequence: Synthetic peptide
DEEEIRTTNPVAEEQYGSVSTNLQRLNR

SEQ ID NO: 2615 - protein, 28 aa, Artificial Sequence
  Description of Artificial Sequence: Synthetic peptide
DEEEIRTTNPVAEEQYGSVSVNLQRGNR

SEQ ID NO: 2616 - protein, 29 aa, Artificial Sequence
  Description of Artificial Sequence: Synthetic peptide
DEEEIRTTNPVATEQYGSVSTANLQCGNR

SEQ ID NO: 2617 - protein, 28 aa, Artificial Sequence
  Description of Artificial Sequence: Synthetic peptide
DEEEIRTTNPVAEHQYGSVSTNLQRGNR

SEQ ID NO: 2618 - protein, 28 aa, Artificial Sequence
  Description of Artificial Sequence: Synthetic peptide
DEEEIRTTNPVATEQYGSFSTNLQRGMR

SEQ ID NO: 2619 - protein, 28 aa, Artificial Sequence
  Description of Artificial Sequence: Synthetic peptide
DEEEIRTTNPVATEQYGSVSTPLGRGNR

SEQ ID NO: 2620 - protein, 29 aa, Artificial Sequence
  Description of Artificial Sequence: Synthetic peptide
DEEEIRTTNPVATEQYGSVSTANLIRGNR

SEQ ID NO: 2621 - protein, 28 aa, Artificial Sequence
  Description of Artificial Sequence: Synthetic peptide
DEEEIRTTNPIATEQYGSVQTNLQRGNR

SEQ ID NO: 2622 - protein, 28 aa, Artificial Sequence
  Description of Artificial Sequence: Synthetic peptide
DEEEIRTTNPVATEQYGSVSTPLIRGNR

SEQ ID NO: 2623 - protein, 28 aa, Artificial Sequence
  Description of Artificial Sequence: Synthetic peptide
DEEEIRTTNPVATEQYGSVSTPLPRGNR

SEQ ID NO: 2624 - protein, 28 aa, Artificial Sequence
  Description of Artificial Sequence: Synthetic peptide
DEEEIRTTNPIATEQYGSVGTNLQRGNR

SEQ ID NO: 2625 - protein, 29 aa, Artificial Sequence
  Description of Artificial Sequence: Synthetic peptide
DEEEIRTTNPVATEQYGSVSTNLQVGVNR

SEQ ID NO: 2626 - protein, 30 aa, Artificial Sequence
  Description of Artificial Sequence: Synthetic polypeptide
DEEEIRTTNPVATEQYGSVSTANLDQRGNR

SEQ ID NO: 2627 - protein, 28 aa, Artificial Sequence
  Description of Artificial Sequence: Synthetic peptide
DEEEIRTTNPVATEQYGSVSTNLQVGNS

SEQ ID NO: 2628 - protein, 29 aa, Artificial Sequence
  Description of Artificial Sequence: Synthetic peptide
DEEEIRTTNPVATEQYGSVSTNLQVGNRL

SEQ ID NO: 2629 - protein, 29 aa, Artificial Sequence
  Description of Artificial Sequence: Synthetic peptide
DEEEIRTTNPVATEQYGSVSTNLQVGNRK

SEQ ID NO: 2630 - protein, 28 aa, Artificial Sequence
  Description of Artificial Sequence: Synthetic peptide
DEEEIRTTNPVATEQYGSVSTPLQDGNR

SEQ ID NO: 2631 - protein, 28 aa, Artificial Sequence
  Description of Artificial Sequence: Synthetic peptide
DEEEIRTTNPVATEQYGSVSTNLQVGNM

SEQ ID NO: 2632 - protein, 28 aa, Artificial Sequence
  Description of Artificial Sequence: Synthetic peptide
DEEEIRTTNPVATEQYGSFSNNLQRGNR

SEQ ID NO: 2633 - protein, 28 aa, Artificial Sequence
  Description of Artificial Sequence: Synthetic peptide
DEEEIRTTNPVATEQYGSVSTPLQRGQR

SEQ ID NO: 2634 - protein, 29 aa, Artificial Sequence
  Description of Artificial Sequence: Synthetic peptide
DEEEIRTTNPVATEQYGSVSTNLQSRGSR

SEQ ID NO: 2635 - protein, 28 aa, Artificial Sequence
  Description of Artificial Sequence: Synthetic peptide
DEEEIRTTNPVATEQYGSVSTNLQTGNM

SEQ ID NO: 2636 - protein, 28 aa, Artificial Sequence
  Description of Artificial Sequence: Synthetic peptide
DEEEIRTTNPVATEQYGSVSTNLQTGNF

SEQ ID NO: 2637 - protein, 29 aa, Artificial Sequence
  Description of Artificial Sequence: Synthetic peptide
DEEEIRTTNPVATEQYGSFMSTNLQRGNR

SEQ ID NO: 2638 - protein, 29 aa, Artificial Sequence
  Description of Artificial Sequence: Synthetic peptide
DEEEIRTTNPVATEQYGSEVSTNLQRGNW

SEQ ID NO: 2639 - protein, 29 aa, Artificial Sequence
  Description of Artificial Sequence: Synthetic peptide
DEEEIRTTNPVATEQYGSEVSTNLQRGNG

SEQ ID NO: 2640 - protein, 30 aa, Artificial Sequence
  Description of Artificial Sequence: Synthetic polypeptide
DEEEIRTTNPVATEQYGSEVSSTNLQRGNR

SEQ ID NO: 2641 - protein, 28 aa, Artificial Sequence
  Description of Artificial Sequence: Synthetic peptide
DEEEIRTTNPVATEQYGSVSTALQQGNR

SEQ ID NO: 2642 - protein, 28 aa, Artificial Sequence
  Description of Artificial Sequence: Synthetic peptide
DEEEIRTTNPVATEQYGSESTVLQRGNR

SEQ ID NO: 2643 - protein, 29 aa, Artificial Sequence
  Description of Artificial Sequence: Synthetic peptide
DEEEIRTTNPVATEQYGSVSTNLQTDGNR

SEQ ID NO: 2644 - protein, 28 aa, Artificial Sequence
  Description of Artificial Sequence: Synthetic peptide
DEEEIRTTNPVATEQYGSVSTNLQTCNR

SEQ ID NO: 2645 - protein, 30 aa, Artificial Sequence
  Description of Artificial Sequence: Synthetic polypeptide
DEEEIRTTNPVATEQYGSTVSTNLQRGNRQ

SEQ ID NO: 2646 - protein, 29 aa, Artificial Sequence
  Description of Artificial Sequence: Synthetic peptide
DEEEIRTTNPVATEQYGSESTTNLQRGNR

SEQ ID NO: 2647 - protein, 29 aa, Artificial Sequence
  Description of Artificial Sequence: Synthetic peptide
DEEEIRTTNPVATEQYGSESTQNLQRGNR

SEQ ID NO: 2648 - protein, 29 aa, Artificial Sequence
  Description of Artificial Sequence: Synthetic peptide
DEEEIRTTNPVATEQYGSESTNLQRGNRD

SEQ ID NO: 2649 - protein, 29 aa, Artificial Sequence
  Description of Artificial Sequence: Synthetic peptide
DEEEIRTTNPVATEQYGSESTNLQRGNPR

SEQ ID NO: 2650 - protein, 29 aa, Artificial Sequence
  Description of Artificial Sequence: Synthetic peptide
DEEEIRTTNPVATEQYGSESTNLQRGNAR

SEQ ID NO: 2651 - protein, 28 aa, Artificial Sequence
  Description of Artificial Sequence: Synthetic peptide
DEEEIRTTNPVATEQYGSESTNLQRGNA

SEQ ID NO: 2652 - protein, 28 aa, Artificial Sequence
  Description of Artificial Sequence: Synthetic peptide
DEEEIRTTNPVATEQYGSESTNLQRGER

SEQ ID NO: 2653 - protein, 29 aa, Artificial Sequence
  Description of Artificial Sequence: Synthetic peptide
DEEEIRTTNPVATEQYGSESTNLQREGNR

SEQ ID NO: 2654 - protein, 28 aa, Artificial Sequence
  Description of Artificial Sequence: Synthetic peptide
DEEEIRTTNPVATEQYGSESTNLQHGNR

SEQ ID NO: 2655 - protein, 28 aa, Artificial Sequence
  Description of Artificial Sequence: Synthetic peptide
DEEEIRTTNPVATEQYGSESTTLQRGNR

SEQ ID NO: 2656 - protein, 29 aa, Artificial Sequence
  Description of Artificial Sequence: Synthetic peptide
DEEEIRTTNPVATEQYGSTVSTNLQRGNF

SEQ ID NO: 2657 - protein, 29 aa, Artificial Sequence
  Description of Artificial Sequence: Synthetic peptide
DEEEIRTTNPVATEQYGSTVSTNLQRGNA

SEQ ID NO: 2658 - protein, 28 aa, Artificial Sequence
  Description of Artificial Sequence: Synthetic peptide
DEEEIRTTNPVATEQYGSVSTPLQWGNR

SEQ ID NO: 2659 - protein, 29 aa, Artificial Sequence
  Description of Artificial Sequence: Synthetic peptide
DEEEIRTTNPVATEQYGSVSTNLQTGGNR

SEQ ID NO: 2660 - protein, 28 aa, Artificial Sequence
  Description of Artificial Sequence: Synthetic peptide
DEEEICTTNPVATEQYGYVSTNLQRGNR

SEQ ID NO: 2661 - protein, 28 aa, Artificial Sequence
  Description of Artificial Sequence: Synthetic peptide
DQEEIRTTNPVATEQYGSVSENLQRGNR

SEQ ID NO: 2662 - protein, 29 aa, Artificial Sequence
  Description of Artificial Sequence: Synthetic peptide
DQEEIRTTNPVATEQYGSVSTNLQQRGNR

SEQ ID NO: 2663 - protein, 29 aa, Artificial Sequence
  Description of Artificial Sequence: Synthetic peptide
DQEEIRTTNPVATEQYGSVSTNLQRGENR

SEQ ID NO: 2664 - protein, 29 aa, Artificial Sequence
  Description of Artificial Sequence: Synthetic peptide
DEEEIRTTNPVATEQYGSVSTPLQRPGNR

SEQ ID NO: 2665 - protein, 29 aa, Artificial Sequence
  Description of Artificial Sequence: Synthetic peptide
DQEEIRTTNPVATEQYGSVSTNLQRGNFR

SEQ ID NO: 2666 - protein, 28 aa, Artificial Sequence
  Description of Artificial Sequence: Synthetic peptide
DQEEIRTTNPVATEQYGSVSTNLQRGNM

SEQ ID NO: 2667 - protein, 29 aa, Artificial Sequence
  Description of Artificial Sequence: Synthetic peptide
DQEEIRTTNPVATEQYGSVSTNLQRGNQR

SEQ ID NO: 2668 - protein, 29 aa, Artificial Sequence
  Description of Artificial Sequence: Synthetic peptide
DQEEIRTTNPVATEQYGSVSTNLQRGNRL

SEQ ID NO: 2669 - protein, 28 aa, Artificial Sequence
  Description of Artificial Sequence: Synthetic peptide
DEEEIRTTNPVATEQYGSVSTPLQRQNR

SEQ ID NO: 2670 - protein, 29 aa, Artificial Sequence
  Description of Artificial Sequence: Synthetic peptide
DQEEIRTTNPVATEQYGSVSTNLQRGNRV

SEQ ID NO: 2671 - protein, 28 aa, Artificial Sequence
  Description of Artificial Sequence: Synthetic peptide
DQEEIRTTNPVATEQYGSVSTNLQRGNS

SEQ ID NO: 2672 - protein, 30 aa, Artificial Sequence
  Description of Artificial Sequence: Synthetic polypeptide
DEEEIRTTNPVATEQYGSTVSTNLQRDGNR

SEQ ID NO: 2673 - protein, 29 aa, Artificial Sequence
  Description of Artificial Sequence: Synthetic peptide
DQEEIRTTNPVATEQYGSVSTNLQRGVNR

SEQ ID NO: 2674 - protein, 29 aa, Artificial Sequence
  Description of Artificial Sequence: Synthetic peptide
DEEEIRTTNPVATEQYGSVSTALQRDGNR

SEQ ID NO: 2675 - protein, 28 aa, Artificial Sequence
  Description of Artificial Sequence: Synthetic peptide
DQEEIRTTNPVATEQYGSVSTNLQSGNR

SEQ ID NO: 2676 - protein, 29 aa, Artificial Sequence
  Description of Artificial Sequence: Synthetic peptide
DQEEIRTTNPVATEQYGSVSTQNLQRGNR

SEQ ID NO: 2677 - protein, 30 aa, Artificial Sequence
  Description of Artificial Sequence: Synthetic polypeptide
DEEEIRTTNPVATEQYGSTVSTNLQRGGNR

SEQ ID NO: 2678 - protein, 28 aa, Artificial Sequence
  Description of Artificial Sequence: Synthetic peptide
DEEEIRTTNPVATEQYGSVSTALQRGNV

SEQ ID NO: 2679 - protein, 29 aa, Artificial Sequence
  Description of Artificial Sequence: Synthetic peptide
DEEEIRTTNPVATEQYGSVSTNLMRGNNR

SEQ ID NO: 2680 - protein, 28 aa, Artificial Sequence
  Description of Artificial Sequence: Synthetic peptide
DEEEIRTTNPVATEQYGSVSTWLQMGNR

SEQ ID NO: 2681 - protein, 28 aa, Artificial Sequence
  Description of Artificial Sequence: Synthetic peptide
DEEEIRTTNPVATEQYGSVSTNLMRGMR

SEQ ID NO: 2682 - protein, 28 aa, Artificial Sequence
  Description of Artificial Sequence: Synthetic peptide
DEEEIRTTNPVATEQHGSVSTNLQVGNR

SEQ ID NO: 2683 - protein, 29 aa, Artificial Sequence
  Description of Artificial Sequence: Synthetic peptide
DEEEIRTTNPVATEQYGSVSTNLARGGNR

SEQ ID NO: 2684 - protein, 28 aa, Artificial Sequence
  Description of Artificial Sequence: Synthetic peptide
DEEEIRTTNPVATEQHGSVSTNLQRGDR

SEQ ID NO: 2685 - protein, 29 aa, Artificial Sequence
  Description of Artificial Sequence: Synthetic peptide
DEEEIRTTNPVATEQHGSVSTNLQRAGNR

SEQ ID NO: 2686 - protein, 29 aa, Artificial Sequence
  Description of Artificial Sequence: Synthetic peptide
DEEEIRTTNPVATEQHGSVSTNLQLRGNR

SEQ ID NO: 2687 - protein, 28 aa, Artificial Sequence
  Description of Artificial Sequence: Synthetic peptide
DEEEIRTTNPVATEQHGSVSTCLQRGNR

SEQ ID NO: 2688 - protein, 29 aa, Artificial Sequence
  Description of Artificial Sequence: Synthetic peptide
DEEEIRTTNPVATEQYGKSVSTNLQPGNR

SEQ ID NO: 2689 - protein, 28 aa, Artificial Sequence
  Description of Artificial Sequence: Synthetic peptide
DEEEIRTTNPVATEQHGSCSTNLQRGNR

SEQ ID NO: 2690 - protein, 29 aa, Artificial Sequence
  Description of Artificial Sequence: Synthetic peptide
DEEEIRTTNPVATEQIGSVSTNLQGRGNR

SEQ ID NO: 2691 - protein, 28 aa, Artificial Sequence
  Description of Artificial Sequence: Synthetic peptide
DEEEIRTTNPVATEQGGSVSTNLQVGNR

SEQ ID NO: 2692 - protein, 28 aa, Artificial Sequence
  Description of Artificial Sequence: Synthetic peptide
WEEEINTTNPVATEQYGSVSTNLQRGNR

SEQ ID NO: 2693 - protein, 30 aa, Artificial Sequence
  Description of Artificial Sequence: Synthetic polypeptide
DEEEIRTTNPVATEQYGSVSTNLAQTRGNR

SEQ ID NO: 2694 - protein, 29 aa, Artificial Sequence
  Description of Artificial Sequence: Synthetic peptide
DEEEIRTTNPVATEQYGIVSVTNLQRGNR

SEQ ID NO: 2695 - protein, 28 aa, Artificial Sequence
  Description of Artificial Sequence: Synthetic peptide
DEEEIRTTNPVATEQYGIVSTNLQRGTR

SEQ ID NO: 2696 - protein, 30 aa, Artificial Sequence
  Description of Artificial Sequence: Synthetic polypeptide
DEEEIRTTNPVATEQYGSVISWTNLQRGNR

SEQ ID NO: 2697 - protein, 28 aa, Artificial Sequence
  Description of Artificial Sequence: Synthetic peptide
DEEEIRTTNPVATEQYGIVSTNLQRGNW

SEQ ID NO: 2698 - protein, 28 aa, Artificial Sequence
  Description of Artificial Sequence: Synthetic peptide
WEEEIRTTNPVATAQYGSVSTNLQRGNR

SEQ ID NO: 2699 - protein, 29 aa, Artificial Sequence
  Description of Artificial Sequence: Synthetic peptide
DEEEIRTTNPVATEQYGIVSTNLQRGNRE

SEQ ID NO: 2700 - protein, 29 aa, Artificial Sequence
  Description of Artificial Sequence: Synthetic peptide
DEEEIRTTNPVATEQYGKSVSTNLERGNR

SEQ ID NO: 2701 - protein, 28 aa, Artificial Sequence
  Description of Artificial Sequence: Synthetic peptide
DEEEIRTTNPVATEQIGSVSTNLQRGER

SEQ ID NO: 2702 - protein, 28 aa, Artificial Sequence
  Description of Artificial Sequence: Synthetic peptide
DEEEIRTTNPVATEQIGSVSTNLQRGNM

SEQ ID NO: 2703 - protein, 28 aa, Artificial Sequence
  Description of Artificial Sequence: Synthetic peptide
DEEEIRTTNPVATEQIGSVSTNLQWGNR

SEQ ID NO: 2704 - protein, 29 aa, Artificial Sequence
  Description of Artificial Sequence: Synthetic peptide
DEEEIRTTNPVATEQYGSVSTNLARGNAR

SEQ ID NO: 2705 - protein, 28 aa, Artificial Sequence
  Description of Artificial Sequence: Synthetic peptide
DEEEIRTTNPVATEQYGSVSTNLARGNA

SEQ ID NO: 2706 - protein, 28 aa, Artificial Sequence
  Description of Artificial Sequence: Synthetic peptide
VEEEVRTTNPVATEQYGSVSTNLQRGNR

SEQ ID NO: 2707 - protein, 29 aa, Artificial Sequence
  Description of Artificial Sequence: Synthetic peptide
DEEEIRTTNPVATEQYGSVISTNLQRGFR

SEQ ID NO: 2708 - protein, 29 aa, Artificial Sequence
  Description of Artificial Sequence: Synthetic peptide
DEEEIRTTNPVATEQYGSVISTNLQRINR

SEQ ID NO: 2709 - protein, 28 aa, Artificial Sequence
  Description of Artificial Sequence: Synthetic peptide
DEEEIRTTNPVATEQQGSVSTNLQWGNR

SEQ ID NO: 2710 - protein, 28 aa, Artificial Sequence
  Description of Artificial Sequence: Synthetic peptide
DEEEIRTTNPVATEQQGSVSTNLQRGNA

SEQ ID NO: 2711 - protein, 29 aa, Artificial Sequence
  Description of Artificial Sequence: Synthetic peptide
DEEEIRTTNPVATEQPYGSVSTNLQRGSR

SEQ ID NO: 2712 - protein, 28 aa, Artificial Sequence
  Description of Artificial Sequence: Synthetic peptide
DEEEIRTTNPVAYEQYGCVSTNLQRGNR

SEQ ID NO: 2713 - protein, 28 aa, Artificial Sequence
  Description of Artificial Sequence: Synthetic peptide
DEAEIRTTNPVATEQCGSVSTNLQRGNR

SEQ ID NO: 2714 - protein, 28 aa, Artificial Sequence
  Description of Artificial Sequence: Synthetic peptide
DEEEIRTTNPVATEQPGSVSTNLQRGNL

SEQ ID NO: 2715 - protein, 29 aa, Artificial Sequence
  Description of Artificial Sequence: Synthetic peptide
DEEEIRTTNPVATEQNGSVSTNLQRTGNR

SEQ ID NO: 2716 - protein, 28 aa, Artificial Sequence
  Description of Artificial Sequence: Synthetic peptide
DEEEIATTNPVATEQWGSVSTNLQRGNR

SEQ ID NO: 2717 - protein, 30 aa, Artificial Sequence
  Description of Artificial Sequence: Synthetic polypeptide
DEEEIRTTNPVATEQYGSVSGTINLQRGNR

SEQ ID NO: 2718 - protein, 28 aa, Artificial Sequence
  Description of Artificial Sequence: Synthetic peptide
DEEEIRTTNPVATEQMGSVSTNLQRGNF

SEQ ID NO: 2719 - protein, 29 aa, Artificial Sequence
  Description of Artificial Sequence: Synthetic peptide
DEEEIRTTNPVATEQMGSVSTNLQRGNER

SEQ ID NO: 2720 - protein, 29 aa, Artificial Sequence
  Description of Artificial Sequence: Synthetic peptide
DEEEIRTTNPVATEQMGSVSTNLQDRGNR

SEQ ID NO: 2721 - protein, 28 aa, Artificial Sequence
  Description of Artificial Sequence: Synthetic peptide
DEEEIRTTNPVATEQLGSVSTNLQQGNR

SEQ ID NO: 2722 - protein, 28 aa, Artificial Sequence
  Description of Artificial Sequence: Synthetic peptide
DEEEIRTTNPVATEQLGSVSTNLQMGNR

SEQ ID NO: 2723 - protein, 29 aa, Artificial Sequence
  Description of Artificial Sequence: Synthetic peptide
DEEEIRTTNPVATEQYGIVSTNLQRGNRA

SEQ ID NO: 2724 - protein, 30 aa, Artificial Sequence
  Description of Artificial Sequence: Synthetic polypeptide
DEEEIRTTNPVATEQYGSVQSMTNLQRGNR

SEQ ID NO: 2725 - protein, 29 aa, Artificial Sequence
  Description of Artificial Sequence: Synthetic peptide
DEEEIRTTNPVATEQYGSVITFNLQRGNR

SEQ ID NO: 2726 - protein, 29 aa, Artificial Sequence
  Description of Artificial Sequence: Synthetic peptide
DEEEIRTTNPVATEQYGIVSTNILQRGNR

SEQ ID NO: 2727 - protein, 28 aa, Artificial Sequence
  Description of Artificial Sequence: Synthetic peptide
DEEEIRTTNPVATEQYGIVPTNLQRGNR

SEQ ID NO: 2728 - protein, 30 aa, Artificial Sequence
  Description of Artificial Sequence: Synthetic polypeptide
DEEEIRTTNPVATEQYGSVVSPTNLQRGNR

SEQ ID NO: 2729 - protein, 28 aa, Artificial Sequence
  Description of Artificial Sequence: Synthetic peptide
DEEEIRTTNPVATEQYGSVSTNLADGNR

SEQ ID NO: 2730 - protein, 29 aa, Artificial Sequence
  Description of Artificial Sequence: Synthetic peptide
DEEEIRTTNPVATEQYGSVITNLQRGDNR

SEQ ID NO: 2731 - protein, 28 aa, Artificial Sequence
  Description of Artificial Sequence: Synthetic peptide
DEEEIRTTNPVATEQYGIVDTNLQRGNR

SEQ ID NO: 2732 - protein, 29 aa, Artificial Sequence
  Description of Artificial Sequence: Synthetic peptide
WEEEIRTTNPVATEQYGSVSTYNLQRGNR

SEQ ID NO: 2733 - protein, 28 aa, Artificial Sequence
  Description of Artificial Sequence: Synthetic peptide
DEEEIRTTNPVATEQYGSVSTNKQYGNR

SEQ ID NO: 2734 - protein, 28 aa, Artificial Sequence
  Description of Artificial Sequence: Synthetic peptide
DEEEIRTTNPVATEQYGSVSTNKQRGNL

SEQ ID NO: 2735 - protein, 29 aa, Artificial Sequence
  Description of Artificial Sequence: Synthetic peptide
DEEEIRTTNPVATEQYGSVSTNLAFRGNR

SEQ ID NO: 2736 - protein, 29 aa, Artificial Sequence
  Description of Artificial Sequence: Synthetic peptide
WEEEIRTTNPVATEQYGTSVSTNLQRGNR

SEQ ID NO: 2737 - protein, 28 aa, Artificial Sequence
  Description of Artificial Sequence: Synthetic peptide
WEEEIRTTNPVATEQYGYVSTNLQRGNR

SEQ ID NO: 2738 - protein, 29 aa, Artificial Sequence
  Description of Artificial Sequence: Synthetic peptide
DEEEIRTTNPVATEQYGSVSTNKLQAGNR

SEQ ID NO: 2739 - protein, 30 aa, Artificial Sequence
  Description of Artificial Sequence: Synthetic polypeptide
DEEEIRTTNPVATEQYGISVSTNYLQRGNR

SEQ ID NO: 2740 - protein, 29 aa, Artificial Sequence
  Description of Artificial Sequence: Synthetic peptide
DEEEIRTTNPVATEQYGSVITNLQRGNIR

SEQ ID NO: 2741 - protein, 29 aa, Artificial Sequence
  Description of Artificial Sequence: Synthetic peptide
DEEEIRTTNPVATEQYGSVITNLQRGNMR

SEQ ID NO: 2742 - protein, 29 aa, Artificial Sequence
  Description of Artificial Sequence: Synthetic peptide
DEEEIRTTNPVATEQYGISVSTNLQRGNP

SEQ ID NO: 2743 - protein, 29 aa, Artificial Sequence
  Description of Artificial Sequence: Synthetic peptide
DEEEIRTTNPVATEQYGSVITNLQRGPNR

SEQ ID NO: 2744 - protein, 30 aa, Artificial Sequence
  Description of Artificial Sequence: Synthetic polypeptide
DEEEIRTTNPVATEQYGISVSTNLQRGNNR

SEQ ID NO: 2745 - protein, 30 aa, Artificial Sequence
  Description of Artificial Sequence: Synthetic polypeptide
DEEEIRTTNPVATEQYGSVSTNKLQERGNR

SEQ ID NO: 2746 - protein, 28 aa, Artificial Sequence
  Description of Artificial Sequence: Synthetic peptide
WEEEIRTTNPVATEQYGSVSTNLTRGNR

SEQ ID NO: 2747 - protein, 28 aa, Artificial Sequence
  Description of Artificial Sequence: Synthetic peptide
WEEEIRTTNPVATEQYGSVSTNLQWGNR

SEQ ID NO: 2748 - protein, 29 aa, Artificial Sequence
  Description of Artificial Sequence: Synthetic peptide
WEEEIRTTNPVATEQYGSVSTNLQRNGNR

SEQ ID NO: 2749 - protein, 29 aa, Artificial Sequence
  Description of Artificial Sequence: Synthetic peptide
DEEEIRTTNPVATEQYGIVSTCNLQRGNR

SEQ ID NO: 2750 - protein, 29 aa, Artificial Sequence
  Description of Artificial Sequence: Synthetic peptide
DEEEIRTTNPVATEQYGIVSTANLQRGNR

SEQ ID NO: 2751 - protein, 30 aa, Artificial Sequence
  Description of Artificial Sequence: Synthetic polypeptide
DEEEIRTTNPVATEQYGSVSTNLAQRGSNR

SEQ ID NO: 2752 - protein, 29 aa, Artificial Sequence
  Description of Artificial Sequence: Synthetic peptide
DEEEIRTTNPVATEQYGSVITNELQRGNR

SEQ ID NO: 2753 - protein, 30 aa, Artificial Sequence
  Description of Artificial Sequence: Synthetic polypeptide
DEEEIRTTNPVATEQYGSVSTNLAQRGNMR

SEQ ID NO: 2754 - protein, 29 aa, Artificial Sequence
  Description of Artificial Sequence: Synthetic peptide
DEEEIRTTNPVATEQYGIVSQTNLQRGNR

SEQ ID NO: 2755 - protein, 29 aa, Artificial Sequence
  Description of Artificial Sequence: Synthetic peptide
DEEEIRTTNPVATEQYGSVITNFLQRGNR

SEQ ID NO: 2756 - protein, 28 aa, Artificial Sequence
  Description of Artificial Sequence: Synthetic peptide
WEEEIRTTNPVATEQYGSVSENLQRGNR

SEQ ID NO: 2757 - protein, 29 aa, Artificial Sequence
  Description of Artificial Sequence: Synthetic peptide
DEEEIRTTNPVATEQYGSVVSPNLQRGNR

SEQ ID NO: 2758 - protein, 28 aa, Artificial Sequence
  Description of Artificial Sequence: Synthetic peptide
WEEEIRTTNPVATEQYGSVSGNLQRGNR

SEQ ID NO: 2759 - protein, 28 aa, Artificial Sequence
  Description of Artificial Sequence: Synthetic peptide
DEAEIRTTNPVATEIYGSVSTNLQRGNR

SEQ ID NO: 2760 - protein, 30 aa, Artificial Sequence
  Description of Artificial Sequence: Synthetic polypeptide
DEEEIRTTNPVATEQYGSVSTNLAQRGNDR

SEQ ID NO: 2761 - protein, 29 aa, Artificial Sequence
  Description of Artificial Sequence: Synthetic peptide
DEEEIRTTNPVATEQYGSVSTNLAQRFNR

SEQ ID NO: 2762 - protein, 29 aa, Artificial Sequence
  Description of Artificial Sequence: Synthetic peptide
WEEEIRTTNPVATEQYGSVSTNGLQRGNR

SEQ ID NO: 2763 - protein, 28 aa, Artificial Sequence
  Description of Artificial Sequence: Synthetic peptide
WEEEIRTTNPVATEQYGSVSTNLIRGNR

SEQ ID NO: 2764 - protein, 28 aa, Artificial Sequence
  Description of Artificial Sequence: Synthetic peptide
WEEEIRTTNPVATEQYGSVSTNLNRGNR

SEQ ID NO: 2765 - protein, 28 aa, Artificial Sequence
  Description of Artificial Sequence: Synthetic peptide
WEEEIRTTNPVATEQYGSVSTNLQIGNR

SEQ ID NO: 2766 - protein, 29 aa, Artificial Sequence
  Description of Artificial Sequence: Synthetic peptide
WEEEIRTTNPVATEQYGSVSTNLQRGANR

SEQ ID NO: 2767 - protein, 28 aa, Artificial Sequence
  Description of Artificial Sequence: Synthetic peptide
WEEEIRTTNPVATEQYGSVSTNLQRGSR

SEQ ID NO: 2768 - protein, 28 aa, Artificial Sequence
  Description of Artificial Sequence: Synthetic peptide
DEEEIRTTNPVATEQYGCVSWNLQRGNR

SEQ ID NO: 2769 - protein, 30 aa, Artificial Sequence
  Description of Artificial Sequence: Synthetic polypeptide
DEEEIRTTNPVATEQYGSVISTNLQDRGNR

SEQ ID NO: 2770 - protein, 28 aa, Artificial Sequence
  Description of Artificial Sequence: Synthetic peptide
DEEEIRTTNPVATEEYGSVSTNVQRGNR

SEQ ID NO: 2771 - protein, 29 aa, Artificial Sequence
  Description of Artificial Sequence: Synthetic peptide
DEEEIRTTNPVATEEYGSVSTNLQRGSNR

SEQ ID NO: 2772 - protein, 28 aa, Artificial Sequence
  Description of Artificial Sequence: Synthetic peptide
DEEEIRTTNPVATEQYGKVSTNLQGGNR

SEQ ID NO: 2773 - protein, 28 aa, Artificial Sequence
  Description of Artificial Sequence: Synthetic peptide
DEEEIRTTNPAATEQYGSVSLNLQRGNR

SEQ ID NO: 2774 - protein, 30 aa, Artificial Sequence
  Description of Artificial Sequence: Synthetic polypeptide
DEEEIRTTNPVATEQYGSVQSTNLQRGNDR

SEQ ID NO: 2775 - protein, 28 aa, Artificial Sequence
  Description of Artificial Sequence: Synthetic peptide
DEEEIRTTNPAATEQYGSVSMNLQRGNR

SEQ ID NO: 2776 - protein, 28 aa, Artificial Sequence
  Description of Artificial Sequence: Synthetic peptide
DECEIRTTNPVATEQYGSVSTNLQCGNR

SEQ ID NO: 2777 - protein, 30 aa, Artificial Sequence
  Description of Artificial Sequence: Synthetic polypeptide
DEEEIRTTNPVATEQYGSVQSTNLQRDGNR

SEQ ID NO: 2778 - protein, 28 aa, Artificial Sequence
  Description of Artificial Sequence: Synthetic peptide
DEEEIRTTNPVATEQYGKVSTNLQEGNR

SEQ ID NO: 2779 - protein, 28 aa, Artificial Sequence
  Description of Artificial Sequence: Synthetic peptide
DEEEIRTTNPVATEQVGTVSTNLQRGNR

SEQ ID NO: 2780 - protein, 29 aa, Artificial Sequence
  Description of Artificial Sequence: Synthetic peptide
DEEEIRTTNPVATEQYGSVQSTNLQRGNK

SEQ ID NO: 2781 - protein, 29 aa, Artificial Sequence
  Description of Artificial Sequence: Synthetic peptide
VEEEIRTTNPVATEQYGSVSTNLQRGGNR

SEQ ID NO: 2782 - protein, 29 aa, Artificial Sequence
  Description of Artificial Sequence: Synthetic peptide
VEEEIRTTNPVATEQYGSVSTNLQRGNRY

SEQ ID NO: 2783 - protein, 28 aa, Artificial Sequence
  Description of Artificial Sequence: Synthetic peptide
DEEEIRTTNPVATEQYGKVSTNLQDGNR

SEQ ID NO: 2784 - protein, 28 aa, Artificial Sequence
  Description of Artificial Sequence: Synthetic peptide
DEEEIRTTNPVATEQYGKVSTNLDRGNR

SEQ ID NO: 2785 - protein, 29 aa, Artificial Sequence
  Description of Artificial Sequence: Synthetic peptide
DEEEIRTTNPVATEQYGSVQSTNLQKGNR

SEQ ID NO: 2786 - protein, 29 aa, Artificial Sequence
  Description of Artificial Sequence: Synthetic peptide
VEEEIRTTNPVATEQYGSVSTNLVQRGNR

SEQ ID NO: 2787 - protein, 28 aa, Artificial Sequence
  Description of Artificial Sequence: Synthetic peptide
DEEEIRTTNPVATEQVGSVSTNLQDGNR

SEQ ID NO: 2788 - protein, 28 aa, Artificial Sequence
  Description of Artificial Sequence: Synthetic peptide
DEEEIRTTNPVATEQVGSVSLNLQRGNR

SEQ ID NO: 2789 - protein, 29 aa, Artificial Sequence
  Description of Artificial Sequence: Synthetic peptide
DEEEIRTTNPVATEQYGSVQSTNLNRGNR

SEQ ID NO: 2790 - protein, 28 aa, Artificial Sequence
  Description of Artificial Sequence: Synthetic peptide
VEEEIRTTNPVATEQYGSVSTNLQRGND

SEQ ID NO: 2791 - protein, 28 aa, Artificial Sequence
  Description of Artificial Sequence: Synthetic peptide
DEEEIRTTNPVATEEYGIVSTNLQRGNR

SEQ ID NO: 2792 - protein, 28 aa, Artificial Sequence
  Description of Artificial Sequence: Synthetic peptide
DEEEIRTTNPVATEQYGKVSTNLQNGNR

SEQ ID NO: 2793 - protein, 30 aa, Artificial Sequence
  Description of Artificial Sequence: Synthetic polypeptide
DEEEIRTTNPVATEQYGSVQSTNLQRGNNR

SEQ ID NO: 2794 - protein, 28 aa, Artificial Sequence
  Description of Artificial Sequence: Synthetic peptide
DEEEIRTTNPVATEQYGSVSTNLCIGNR

SEQ ID NO: 2795 - protein, 29 aa, Artificial Sequence
  Description of Artificial Sequence: Synthetic peptide
DEEEIRTTNPVATEQYGSVSTMNLQRDNR

SEQ ID NO: 2796 - protein, 29 aa, Artificial Sequence
  Description of Artificial Sequence: Synthetic peptide
DECEIRTTNPVATEQYGSVSTFNLQRGNR

SEQ ID NO: 2797 - protein, 29 aa, Artificial Sequence
  Description of Artificial Sequence: Synthetic peptide
DECEIRTTNPVATEQYGSVSTMNLQRGNR

SEQ ID NO: 2798 - protein, 30 aa, Artificial Sequence
  Description of Artificial Sequence: Synthetic polypeptide
DEEEIRTTNPVATEQYGSVSTMNLQRGLNR

SEQ ID NO: 2799 - protein, 28 aa, Artificial Sequence
  Description of Artificial Sequence: Synthetic peptide
DEEEIRTTNPAATEQYGSVSENLQRGNR

SEQ ID NO: 2800 - protein, 30 aa, Artificial Sequence
  Description of Artificial Sequence: Synthetic polypeptide
DEEEIRTTNPVATEQYGSVISDTNLQRGNR

SEQ ID NO: 2801 - protein, 29 aa, Artificial Sequence
  Description of Artificial Sequence: Synthetic peptide
DEEEIRTTNPVATEQYGSVTTNLQCRGNR

SEQ ID NO: 2802 - protein, 28 aa, Artificial Sequence
  Description of Artificial Sequence: Synthetic peptide
VEEEIRTTNPVATEQYGSVSTDLQRGNR

SEQ ID NO: 2803 - protein, 28 aa, Artificial Sequence
  Description of Artificial Sequence: Synthetic peptide
DEEEIRTTNPVATEQYGSVTTNLQQGNR

SEQ ID NO: 2804 - protein, 28 aa, Artificial Sequence
  Description of Artificial Sequence: Synthetic peptide
DEEEIRTTNPVATEQYGSVTTNLQRGNH

SEQ ID NO: 2805 - protein, 29 aa, Artificial Sequence
  Description of Artificial Sequence: Synthetic peptide
DEEEIRTTNPVATEQYGSVTTNLQRGNRG

SEQ ID NO: 2806 - protein, 30 aa, Artificial Sequence
  Description of Artificial Sequence: Synthetic polypeptide
DEEEIRTTNPVATEQYGSVQSTNLQRGNRM

SEQ ID NO: 2807 - protein, 29 aa, Artificial Sequence
  Description of Artificial Sequence: Synthetic peptide
VEEEIRTTNPVATEQYGSVSTENLQRGNR

SEQ ID NO: 2808 - protein, 28 aa, Artificial Sequence
  Description of Artificial Sequence: Synthetic peptide
VEEEIRTTNPVATEQYGSVSTFLQRGNR

SEQ ID NO: 2809 - protein, 29 aa, Artificial Sequence
  Description of Artificial Sequence: Synthetic peptide
DEEEIRTTNPVATEQYGSVTTNLQRGNSR

SEQ ID NO: 2810 - protein, 28 aa, Artificial Sequence
  Description of Artificial Sequence: Synthetic peptide
DEEEIRTTNPVATEQYGSVTTNLQRGNW

SEQ ID NO: 2811 - protein, 28 aa, Artificial Sequence
  Description of Artificial Sequence: Synthetic peptide
DECEIRTTNPVATEQYGSVSTNLERGNR

SEQ ID NO: 2812 - protein, 29 aa, Artificial Sequence
  Description of Artificial Sequence: Synthetic peptide
DEEEIRTTNPVATEQYGSVQSTNLQRGNP

SEQ ID NO: 2813 - protein, 29 aa, Artificial Sequence
  Description of Artificial Sequence: Synthetic peptide
DEEEIRTTNPAATEQYGSVSTNLQFRGNR

SEQ ID NO: 2814 - protein, 29 aa, Artificial Sequence
  Description of Artificial Sequence: Synthetic peptide
DEEEIRTTNPAATEQYGSVSTNLQNRGNR

SEQ ID NO: 2815 - protein, 29 aa, Artificial Sequence
  Description of Artificial Sequence: Synthetic peptide
DEECIRTTNPVATEQYGSVSTNLQQRGNR

SEQ ID NO: 2816 - protein, 28 aa, Artificial Sequence
  Description of Artificial Sequence: Synthetic peptide
DEECIRTTNPVATEQYGSVSTNLQRGMR

SEQ ID NO: 2817 - protein, 28 aa, Artificial Sequence
  Description of Artificial Sequence: Synthetic peptide
DECEIRTTNPVATEQYGSVSTNLQRGDR

SEQ ID NO: 2818 - protein, 28 aa, Artificial Sequence
  Description of Artificial Sequence: Synthetic peptide
DEEEIRTTNPVATEQSGSVSTNLQRGNC

SEQ ID NO: 2819 - protein, 29 aa, Artificial Sequence
  Description of Artificial Sequence: Synthetic peptide
DECEIRTTNPVATEQYGSVSTNLQRGNRN

SEQ ID NO: 2820 - protein, 28 aa, Artificial Sequence
  Description of Artificial Sequence: Synthetic peptide
DECEIRTTNPVATEQYGSVSTNLQRPNR

SEQ ID NO: 2821 - protein, 30 aa, Artificial Sequence
  Description of Artificial Sequence: Synthetic polypeptide
DEEEIRTTNPVATEQYGSVISTNFLQRGNR

SEQ ID NO: 2822 - protein, 28 aa, Artificial Sequence
  Description of Artificial Sequence: Synthetic peptide
DEEEIRTTNPVATEQSGSVSNNLQRGNR

SEQ ID NO: 2823 - protein, 28 aa, Artificial Sequence
  Description of Artificial Sequence: Synthetic peptide
DEEEIRTTNPVATEQSGSVSCNLQRGNR

SEQ ID NO: 2824 - protein, 29 aa, Artificial Sequence
  Description of Artificial Sequence: Synthetic peptide
DEEEIRTTNPVATEQYGSVSTNLARTGNR

SEQ ID NO: 2825 - protein, 28 aa, Artificial Sequence
  Description of Artificial Sequence: Synthetic peptide
DECEIRTTNPVATEQYGSVSTWLQRGNR

SEQ ID NO: 2826 - protein, 28 aa, Artificial Sequence
  Description of Artificial Sequence: Synthetic peptide
DEEEIRTTNPVATEQYGSVSTNLARLNR

SEQ ID NO: 2827 - protein, 28 aa, Artificial Sequence
  Description of Artificial Sequence: Synthetic peptide
DECEIRTTNPVATEQYGSVSWNLQRGNR

SEQ ID NO: 2828 - protein, 28 aa, Artificial Sequence
  Description of Artificial Sequence: Synthetic peptide
DEEEIRTTNPVATEQYGSVSTNLARGNS

SEQ ID NO: 2829 - protein, 29 aa, Artificial Sequence
  Description of Artificial Sequence: Synthetic peptide
DECEIRTTNPVATEQYGSWVSTNLQRGNR

SEQ ID NO: 2830 - protein, 29 aa, Artificial Sequence
  Description of Artificial Sequence: Synthetic peptide
DEEEIRTTNPVATEQQYGSVSTNLQRDNR

SEQ ID NO: 2831 - protein, 29 aa, Artificial Sequence
  Description of Artificial Sequence: Synthetic peptide
DEEEIRTTNPVATEQYGSVSTNLARGNRM

SEQ ID NO: 2832 - protein, 29 aa, Artificial Sequence
  Description of Artificial Sequence: Synthetic peptide
DEEEIRTTNPVATEEYGSVSTNLPQRGNR

SEQ ID NO: 2833 - protein, 29 aa, Artificial Sequence
  Description of Artificial Sequence: Synthetic peptide
DEEEIRTTNPVATEEYGSVSTNLQERGNR

SEQ ID NO: 2834 - protein, 29 aa, Artificial Sequence
  Description of Artificial Sequence: Synthetic peptide
DEEEIRTTNPVATEEYGSVSTNLQREGNR

SEQ ID NO: 2835 - protein, 28 aa, Artificial Sequence
  Description of Artificial Sequence: Synthetic peptide
DEEEIRTTNPVATEEYGSVSTNLQRGQR

SEQ ID NO: 2836 - protein, 28 aa, Artificial Sequence
  Description of Artificial Sequence: Synthetic peptide
DEEEIRTTNPVATEQSGSVSTNLQRQNR

SEQ ID NO: 2837 - protein, 30 aa, Artificial Sequence
  Description of Artificial Sequence: Synthetic polypeptide
DEEEIRTTNPVATEQYGISVSTNLQRGNMR

SEQ ID NO: 2838 - protein, 28 aa, Artificial Sequence
  Description of Artificial Sequence: Synthetic peptide
DECEIRTTNPVATEQYGSVSTNLQNGNR

SEQ ID NO: 2839 - protein, 28 aa, Artificial Sequence
  Description of Artificial Sequence: Synthetic peptide
DEEEIRTTNPCAEEQYGSVSTNLQRGNR

SEQ ID NO: 2840 - protein, 28 aa, Artificial Sequence
  Description of Artificial Sequence: Synthetic peptide
DEEEIRTTNPAATEQYGSVSTNLQRGDR

SEQ ID NO: 2841 - protein, 30 aa, Artificial Sequence
  Description of Artificial Sequence: Synthetic polypeptide
DEEEIRTTNPVATEQTYGSVSTNLQRGNRE

SEQ ID NO: 2842 - protein, 29 aa, Artificial Sequence
  Description of Artificial Sequence: Synthetic peptide
DEEEIRTTNPVATEQTYGSVSTNLQRGNA

SEQ ID NO: 2843 - protein, 29 aa, Artificial Sequence
  Description of Artificial Sequence: Synthetic peptide
DEEEIRTTNPAATEQYGSVSTNLQRGGNR

SEQ ID NO: 2844 - protein, 29 aa, Artificial Sequence
  Description of Artificial Sequence: Synthetic peptide
DEEEIRTTNPAATEQYGSVSTNLQRGMNR

SEQ ID NO: 2845 - protein, 29 aa, Artificial Sequence
  Description of Artificial Sequence: Synthetic peptide
DEEEIRTTNPVATEQTGSVSTNLQRKGNR

SEQ ID NO: 2846 - protein, 28 aa, Artificial Sequence
  Description of Artificial Sequence: Synthetic peptide
DEEEIRTTNPVATEQTGSVSTNLQRGNE

SEQ ID NO: 2847 - protein, 28 aa, Artificial Sequence
  Description of Artificial Sequence: Synthetic peptide
DEEEIRTTNPVATEQYGSVVANLQRGNR

SEQ ID NO: 2848 - protein, 28 aa, Artificial Sequence
  Description of Artificial Sequence: Synthetic peptide
DEEEIRTTNPCATEQYGSVPTNLQRGNR

SEQ ID NO: 2849 - protein, 29 aa, Artificial Sequence
  Description of Artificial Sequence: Synthetic peptide
DEEEIRTTNPVATEEYGSVASTNLQRGNR

SEQ ID NO: 2850 - protein, 29 aa, Artificial Sequence
  Description of Artificial Sequence: Synthetic peptide
DEEEIRTTNPVATEQYGSVQSTMLQRGNR

SEQ ID NO: 2851 - protein, 30 aa, Artificial Sequence
  Description of Artificial Sequence: Synthetic polypeptide
DEEEIRTTNPVATEQYGSVQSTLNLQRGNR

SEQ ID NO: 2852 - protein, 29 aa, Artificial Sequence
  Description of Artificial Sequence: Synthetic peptide
DEECIRTTNPVATEQYGSVSTNLQRGNLR

SEQ ID NO: 2853 - protein, 29 aa, Artificial Sequence
  Description of Artificial Sequence: Synthetic peptide
DEEEIRTTNPAATEQYGSVSTNLQRGNRT

SEQ ID NO: 2854 - protein, 28 aa, Artificial Sequence
  Description of Artificial Sequence: Synthetic peptide
DEEEIRTTNPVATEQTGSVSTNLQRGNC

SEQ ID NO: 2855 - protein, 28 aa, Artificial Sequence
  Description of Artificial Sequence: Synthetic peptide
DEEEIRTTNPAATEQYGSVSTNLQRGSR

SEQ ID NO: 2856 - protein, 28 aa, Artificial Sequence
  Description of Artificial Sequence: Synthetic peptide
DEEEIRTTNPAATEQYGSVSTNLQRYNR

SEQ ID NO: 2857 - protein, 28 aa, Artificial Sequence
  Description of Artificial Sequence: Synthetic peptide
DEEEIRTTNPVATEQTGSVSTNDQRGNR

SEQ ID NO: 2858 - protein, 28 aa, Artificial Sequence
  Description of Artificial Sequence: Synthetic peptide
DEEEIRTTNPAATEWYGSVSTNLQRGNR

SEQ ID NO: 2859 - protein, 29 aa, Artificial Sequence
  Description of Artificial Sequence: Synthetic peptide
DEECIRTTNPVATEQYGSVSTNLQRGQNR

SEQ ID NO: 2860 - protein, 29 aa, Artificial Sequence
  Description of Artificial Sequence: Synthetic peptide
DEEEIRTTNPVATEQYGSVVSTDLQRGNR

SEQ ID NO: 2861 - protein, 29 aa, Artificial Sequence
  Description of Artificial Sequence: Synthetic peptide
DEEEIRTTNPVATEQYGISVSTNLQRGNH

SEQ ID NO: 2862 - protein, 29 aa, Artificial Sequence
  Description of Artificial Sequence: Synthetic peptide
DEEEIRTTNPVATEQYGSVITNLQRIGNR

SEQ ID NO: 2863 - protein, 29 aa, Artificial Sequence
  Description of Artificial Sequence: Synthetic peptide
DEEEIRTTNPVATEQYGSVLTNLQRGNTR

SEQ ID NO: 2864 - protein, 30 aa, Artificial Sequence
  Description of Artificial Sequence: Synthetic polypeptide
DEEEIRTTNPVATEQYGSVVSTPNLQRGNR

SEQ ID NO: 2865 - protein, 28 aa, Artificial Sequence
  Description of Artificial Sequence: Synthetic peptide
DEEEIRTTNPVATEQYGSVSPNEQRGNR

SEQ ID NO: 2866 - protein, 28 aa, Artificial Sequence
  Description of Artificial Sequence: Synthetic peptide
DEEEIRTTNPVAWEQYGEVSTNLQRGNR

SEQ ID NO: 2867 - protein, 29 aa, Artificial Sequence
  Description of Artificial Sequence: Synthetic peptide
DEEEIRTTNPVATEFYGSVSTGNLQRGNR

SEQ ID NO: 2868 - protein, 28 aa, Artificial Sequence
  Description of Artificial Sequence: Synthetic peptide
DEEEIRTTNPVATEQYGSVLTNLQRTNR

SEQ ID NO: 2869 - protein, 28 aa, Artificial Sequence
  Description of Artificial Sequence: Synthetic peptide
DEEEIRTTNPVAWEIYGSVSTNLQRGNR

SEQ ID NO: 2870 - protein, 28 aa, Artificial Sequence
  Description of Artificial Sequence: Synthetic peptide
DEEEIRTTNPVAWEEYGSVSTNLQRGNR

SEQ ID NO: 2871 - protein, 29 aa, Artificial Sequence
  Description of Artificial Sequence: Synthetic peptide
DEEEIRTTNPVATEQYGSVLTNLQRGNRS

SEQ ID NO: 2872 - protein, 28 aa, Artificial Sequence
  Description of Artificial Sequence: Synthetic peptide
DEAECRTTNPVATEQYGSVSTNLQRGNR

SEQ ID NO: 2873 - protein, 28 aa, Artificial Sequence
  Description of Artificial Sequence: Synthetic peptide
DEEEIRTTNPVAVEVYGSVSTNLQRGNR

SEQ ID NO: 2874 - protein, 28 aa, Artificial Sequence
  Description of Artificial Sequence: Synthetic peptide
DEEEIRTTNPVAVEQYGWVSTNLQRGNR

SEQ ID NO: 2875 - protein, 29 aa, Artificial Sequence
  Description of Artificial Sequence: Synthetic peptide
DEEEIRTTNPVATEQYGSVLTVNLQRGNR

SEQ ID NO: 2876 - protein, 28 aa, Artificial Sequence
  Description of Artificial Sequence: Synthetic peptide
DEEEIATTNPVATEQSGSVSTNLQRGNR

SEQ ID NO: 2877 - protein, 30 aa, Artificial Sequence
  Description of Artificial Sequence: Synthetic polypeptide
DEEEIRTTNPVATEQYGSVVSTTNLQRGNR

SEQ ID NO: 2878 - protein, 29 aa, Artificial Sequence
  Description of Artificial Sequence: Synthetic peptide
DEEEIRTTNPVATEQYGSVMDTNLQRGNR

SEQ ID NO: 2879 - protein, 29 aa, Artificial Sequence
  Description of Artificial Sequence: Synthetic peptide
DEEAIRTTNPVAFTEQYGSVSTNLQRGNR

SEQ ID NO: 2880 - protein, 28 aa, Artificial Sequence
  Description of Artificial Sequence: Synthetic peptide
DEEEIRTTNPVATEQYGSVMFNLQRGNR

SEQ ID NO: 2881 - protein, 29 aa, Artificial Sequence
  Description of Artificial Sequence: Synthetic peptide
DEEAIRTTNPVAQTEQYGSVSTNLQRGNR

SEQ ID NO: 2882 - protein, 29 aa, Artificial Sequence
  Description of Artificial Sequence: Synthetic peptide
DEEEIRTTNPVAWEQYGSVDSTNLQRGNR

SEQ ID NO: 2883 - protein, 29 aa, Artificial Sequence
  Description of Artificial Sequence: Synthetic peptide
DEEEIRTTNPVAWEQYGSVPSTNLQRGNR

SEQ ID NO: 2884 - protein, 28 aa, Artificial Sequence
  Description of Artificial Sequence: Synthetic peptide
DEEEIRTTNPVAWEQYGSVSNNLQRGNR

SEQ ID NO: 2885 - protein, 29 aa, Artificial Sequence
  Description of Artificial Sequence: Synthetic peptide
DEEEIRTTNPVATEQYGSVSTNILQRTNR

SEQ ID NO: 2886 - protein, 29 aa, Artificial Sequence
  Description of Artificial Sequence: Synthetic peptide
DEEEIRTTNPVATEQYGHVSQTNLQRGNR

SEQ ID NO: 2887 - protein, 30 aa, Artificial Sequence
  Description of Artificial Sequence: Synthetic polypeptide
DEEEIRTTNPVATEQYGSVLSTNWLQRGNR

SEQ ID NO: 2888 - protein, 29 aa, Artificial Sequence
  Description of Artificial Sequence: Synthetic peptide
DEEEIRTTNPVATEQYGSVSTNILQRQNR

SEQ ID NO: 2889 - protein, 30 aa, Artificial Sequence
  Description of Artificial Sequence: Synthetic polypeptide
DEEEIRTTNPVATEQYGSVLSVTNLQRGNR

SEQ ID NO: 2890 - protein, 29 aa, Artificial Sequence
  Description of Artificial Sequence: Synthetic peptide
DEEEIRTTNPVATEQYGSVVSTNWQRGNR

SEQ ID NO: 2891 - protein, 28 aa, Artificial Sequence
  Description of Artificial Sequence: Synthetic peptide
DEEEIRTTNPVATEQYGSVLTMLQRGNR

SEQ ID NO: 2892 - protein, 30 aa, Artificial Sequence
  Description of Artificial Sequence: Synthetic polypeptide
DEEEIRTTNPVAWTEQYGSVSTNLQRGENR

SEQ ID NO: 2893 - protein, 29 aa, Artificial Sequence
  Description of Artificial Sequence: Synthetic peptide
DEEEIRTTNPVAWTEQYGSVSTNLQPGNR

SEQ ID NO: 2894 - protein, 28 aa, Artificial Sequence
  Description of Artificial Sequence: Synthetic peptide
DEEEIRTTNPVAWEVYGSVSTNLQRGNR

SEQ ID NO: 2895 - protein, 30 aa, Artificial Sequence
  Description of Artificial Sequence: Synthetic polypeptide
DEEEIRTTNPVATEQYGSVSTNILQRIGNR

SEQ ID NO: 2896 - protein, 28 aa, Artificial Sequence
  Description of Artificial Sequence: Synthetic peptide
DEEEIRTTNPVATEQYGSVLTNLLRGNR

SEQ ID NO: 2897 - protein, 28 aa, Artificial Sequence
  Description of Artificial Sequence: Synthetic peptide
DEEEIRTTNPVATEQYGSVLTNLQIGNR

SEQ ID NO: 2898 - protein, 29 aa, Artificial Sequence
  Description of Artificial Sequence: Synthetic peptide
DEEEIRTTNPVAWEQYGSVSTNLQRGDNR

SEQ ID NO: 2899 - protein, 29 aa, Artificial Sequence
  Description of Artificial Sequence: Synthetic peptide
DEEEIRTTNPVAWEQYGSVSTNLQQRGNR

SEQ ID NO: 2900 - protein, 28 aa, Artificial Sequence
  Description of Artificial Sequence: Synthetic peptide
DEEEIRTTNPVAWEQYGSVSTNLQPGNR

SEQ ID NO: 2901 - protein, 29 aa, Artificial Sequence
  Description of Artificial Sequence: Synthetic peptide
DEEEIRTTNPVAWEQYGSVSTNLQLRGNR

SEQ ID NO: 2902 - protein, 28 aa, Artificial Sequence
  Description of Artificial Sequence: Synthetic peptide
DEEEIRTTNPVATEQYGHVSFNLQRGNR

SEQ ID NO: 2903 - protein, 29 aa, Artificial Sequence
  Description of Artificial Sequence: Synthetic peptide
DEEEIRTTNPVAWEQYGSVSTCNLQRGNR

SEQ ID NO: 2904 - protein, 29 aa, Artificial Sequence
  Description of Artificial Sequence: Synthetic peptide
DEEEIRTTNPVATEQYGHSVTTNLQRGNR

SEQ ID NO: 2905 - protein, 28 aa, Artificial Sequence
  Description of Artificial Sequence: Synthetic peptide
DEEEIRTTNPVATEFYGSVSTNLQFGNR

SEQ ID NO: 2906 - protein, 28 aa, Artificial Sequence
  Description of Artificial Sequence: Synthetic peptide
DEEEIRTTNPVATEFYGSVSTNLQHGNR

SEQ ID NO: 2907 - protein, 30 aa, Artificial Sequence
  Description of Artificial Sequence: Synthetic polypeptide
DEEEIRTTNPVATEQYGHSVSTNLTQRGNR

SEQ ID NO: 2908 - protein, 28 aa, Artificial Sequence
  Description of Artificial Sequence: Synthetic peptide
DEEEIRTTNPVAVEQYGSVSSNLQRGNR

SEQ ID NO: 2909 - protein, 28 aa, Artificial Sequence
  Description of Artificial Sequence: Synthetic peptide
DEEEIRTTNPVAVEQYGSVSCNLQRGNR

SEQ ID NO: 2910 - protein, 28 aa, Artificial Sequence
  Description of Artificial Sequence: Synthetic peptide
DEEEIRTTNPVAVEQYGSASTNLQRGNR

SEQ ID NO: 2911 - protein, 28 aa, Artificial Sequence
  Description of Artificial Sequence: Synthetic peptide
DEEEIRTTNPVATEQYGSVVTILQRGNR

SEQ ID NO: 2912 - protein, 28 aa, Artificial Sequence
  Description of Artificial Sequence: Synthetic peptide
DEEEIRTTNPVAVEQFGSVSTNLQRGNR

SEQ ID NO: 2913 - protein, 28 aa, Artificial Sequence
  Description of Artificial Sequence: Synthetic peptide
DEEEIRTTNPVATYQYGSVVTNLQRGNR

SEQ ID NO: 2914 - protein, 28 aa, Artificial Sequence
  Description of Artificial Sequence: Synthetic peptide
DEEEIRTTNPVATYQYGSVSTTLQRGNR

SEQ ID NO: 2915 - protein, 28 aa, Artificial Sequence
  Description of Artificial Sequence: Synthetic peptide
DEEEIRTTNPVATYQYGSVSTNNQRGNR

SEQ ID NO: 2916 - protein, 28 aa, Artificial Sequence
  Description of Artificial Sequence: Synthetic peptide
DEEEIRTTNPVATEFYGSVSVNLQRGNR

SEQ ID NO: 2917 - protein, 29 aa, Artificial Sequence
  Description of Artificial Sequence: Synthetic peptide
DEEEIRTTNPVATYQYGSVSTNLQWRGNR

SEQ ID NO: 2918 - protein, 28 aa, Artificial Sequence
  Description of Artificial Sequence: Synthetic peptide
DEEEIRTTNPVATYQYGSVSTNLQRGNW

SEQ ID NO: 2919 - protein, 28 aa, Artificial Sequence
  Description of Artificial Sequence: Synthetic peptide
DEEEIRTTNPVATYQYGSVSTNLQRGNQ

SEQ ID NO: 2920 - protein, 28 aa, Artificial Sequence
  Description of Artificial Sequence: Synthetic peptide
DEEEIRTTNPVATYQYGSVSTNLQRGNL

SEQ ID NO: 2921 - protein, 28 aa, Artificial Sequence
  Description of Artificial Sequence: Synthetic peptide
DEEEIRTTNPVATYQYGSVSTNLQRGND

SEQ ID NO: 2922 - protein, 28 aa, Artificial Sequence
  Description of Artificial Sequence: Synthetic peptide
DEEEIRTTNPVATYQYGSVSTNLQRGNA

SEQ ID NO: 2923 - protein, 28 aa, Artificial Sequence
  Description of Artificial Sequence: Synthetic peptide
DEEEIRTTNPVATYQYGSVSTNLQRGAR

SEQ ID NO: 2924 - protein, 28 aa, Artificial Sequence
  Description of Artificial Sequence: Synthetic peptide
DEEEIRTTNPVATYQYGSVSTNLQGGNR

SEQ ID NO: 2925 - protein, 28 aa, Artificial Sequence
  Description of Artificial Sequence: Synthetic peptide
DEEEIRTTNPVATYQYGPVSTNLQRGNR

SEQ ID NO: 2926 - protein, 28 aa, Artificial Sequence
  Description of Artificial Sequence: Synthetic peptide
DEEEIRTTNPVATYQYGFVSTNLQRGNR

SEQ ID NO: 2927 - protein, 29 aa, Artificial Sequence
  Description of Artificial Sequence: Synthetic peptide
DEEEIRTTNPVATEPYGSVSTVNLQRGNR

SEQ ID NO: 2928 - protein, 28 aa, Artificial Sequence
  Description of Artificial Sequence: Synthetic peptide
DEEEIRTTNPVATEQYGHVSTALQRGNR

SEQ ID NO: 2929 - protein, 29 aa, Artificial Sequence
  Description of Artificial Sequence: Synthetic peptide
DEEEIRTTNPVAVEQYGSVSTNLIQRGNR

SEQ ID NO: 2930 - protein, 28 aa, Artificial Sequence
  Description of Artificial Sequence: Synthetic peptide
DEEEIRTTNPVAVEQYGSVSTNLQRFNR

SEQ ID NO: 2931 - protein, 29 aa, Artificial Sequence
  Description of Artificial Sequence: Synthetic peptide
DEEEIRTTNPVATEQYGHSVSTNLQYGNR

SEQ ID NO: 2932 - protein, 29 aa, Artificial Sequence
  Description of Artificial Sequence: Synthetic peptide
DEEEIRTTNPVATEFYGSVSTNLQRGVNR

SEQ ID NO: 2933 - protein, 29 aa, Artificial Sequence
  Description of Artificial Sequence: Synthetic peptide
DEEEIRTTNPVATEFYGSVSTNLQRPGNR

SEQ ID NO: 2934 - protein, 30 aa, Artificial Sequence
  Description of Artificial Sequence: Synthetic polypeptide
DEEEIRTTNPVATEQYGHSVSTNLQRGNSR

SEQ ID NO: 2935 - protein, 30 aa, Artificial Sequence
  Description of Artificial Sequence: Synthetic polypeptide
DEEEIRTTNPVATEQYGHSVSTNLQRGNRS

SEQ ID NO: 2936 - protein, 28 aa, Artificial Sequence
  Description of Artificial Sequence: Synthetic peptide
DEEEIRTTNPVATEFYGSVSTNLQWGNR

SEQ ID NO: 2937 - protein, 28 aa, Artificial Sequence
  Description of Artificial Sequence: Synthetic peptide
DEEEIRTTNPVATEFYGSVSTNLSRGNR

SEQ ID NO: 2938 - protein, 29 aa, Artificial Sequence
  Description of Artificial Sequence: Synthetic peptide
DEEEIRTTNPVATEQYGHSVSTNLQRENR

SEQ ID NO: 2939 - protein, 29 aa, Artificial Sequence
  Description of Artificial Sequence: Synthetic peptide
DEEAIRTTNPSVATEQYGSVSTNLQRGNR

SEQ ID NO: 2940 - protein, 29 aa, Artificial Sequence
  Description of Artificial Sequence: Synthetic peptide
DEEAIRTTNPPVATEQYGSVSTNLQRGNR

SEQ ID NO: 2941 - protein, 29 aa, Artificial Sequence
  Description of Artificial Sequence: Synthetic peptide
DEEEIRTTNPVATEQYGSVVTCNLQRGNR

SEQ ID NO: 2942 - protein, 30 aa, Artificial Sequence
  Description of Artificial Sequence: Synthetic polypeptide
DEEEIRTTNPVATEQYGHSVSTDNLQRGNR

SEQ ID NO: 2943 - protein, 29 aa, Artificial Sequence
  Description of Artificial Sequence: Synthetic peptide
DEEEIRTTNPVATEQYGHSVSTCLQRGNR

SEQ ID NO: 2944 - protein, 30 aa, Artificial Sequence
  Description of Artificial Sequence: Synthetic polypeptide
DEEEIRTTNPVATEQYGSVMSITNLQRGNR

SEQ ID NO: 2945 - protein, 30 aa, Artificial Sequence
  Description of Artificial Sequence: Synthetic polypeptide
DEEEIRTTNPVATEQYGHSVSMTNLQRGNR

SEQ ID NO: 2946 - protein, 30 aa, Artificial Sequence
  Description of Artificial Sequence: Synthetic polypeptide
DEEEIRTTNPVATEQYGHSVESTNLQRGNR

SEQ ID NO: 2947 - protein, 30 aa, Artificial Sequence
  Description of Artificial Sequence: Synthetic polypeptide
DEEEIRTTNPVATEQYGSVMSTMNLQRGNR

SEQ ID NO: 2948 - protein, 29 aa, Artificial Sequence
  Description of Artificial Sequence: Synthetic peptide
DEEEIRTTNPVATEQYGSVMSTNAQRGNR

SEQ ID NO: 2949 - protein, 29 aa, Artificial Sequence
  Description of Artificial Sequence: Synthetic peptide
DEEEIRTTNPVAVEQYGSVSTNLQRGNMR

SEQ ID NO: 2950 - protein, 28 aa, Artificial Sequence
  Description of Artificial Sequence: Synthetic peptide
DEEEIRTTNPVAVEQYGSVSTNLQGGNR

SEQ ID NO: 2951 - protein, 29 aa, Artificial Sequence
  Description of Artificial Sequence: Synthetic peptide
DEEEIRTTNPVATEQYGSVSPTCLQRGNR

SEQ ID NO: 2952 - protein, 29 aa, Artificial Sequence
  Description of Artificial Sequence: Synthetic peptide
DEEEIRTTNPVATEQYGSVLSTNLQVGNR

SEQ ID NO: 2953 - protein, 28 aa, Artificial Sequence
  Description of Artificial Sequence: Synthetic peptide
DEEEIRTTNPVATEQYGSVSPNLQGGNR

SEQ ID NO: 2954 - protein, 28 aa, Artificial Sequence
  Description of Artificial Sequence: Synthetic peptide
DEEEIRTTNPVATEQYGHVSTNLQRGNV

SEQ ID NO: 2955 - protein, 29 aa, Artificial Sequence
  Description of Artificial Sequence: Synthetic peptide
DEEEIRTTNPVATEQYGSVQLTNLQRGNR

SEQ ID NO: 2956 - protein, 29 aa, Artificial Sequence
  Description of Artificial Sequence: Synthetic peptide
DEEEIRTTNPVATEQYGSVKSTNLQRGNL

SEQ ID NO: 2957 - protein, 29 aa, Artificial Sequence
  Description of Artificial Sequence: Synthetic peptide
DEEEIRTTNPVATEQYGSVKSTNLQRGNQ

SEQ ID NO: 2958 - protein, 29 aa, Artificial Sequence
  Description of Artificial Sequence: Synthetic peptide
DEEEIRTTNPVATEQYGSVSPNLQRGNTR

SEQ ID NO: 2959 - protein, 30 aa, Artificial Sequence
  Description of Artificial Sequence: Synthetic polypeptide
DEEEIRTTNPVATEQYGSVKSTNLQVRGNR

SEQ ID NO: 2960 - protein, 29 aa, Artificial Sequence
  Description of Artificial Sequence: Synthetic peptide
DEEEIRTTNPVATEQYGSVVSTNLMRGNR

SEQ ID NO: 2961 - protein, 28 aa, Artificial Sequence
  Description of Artificial Sequence: Synthetic peptide
DEEEIRTTNPVATEQYGSVSPNLQRGNL

SEQ ID NO: 2962 - protein, 29 aa, Artificial Sequence
  Description of Artificial Sequence: Synthetic peptide
DEEEIRTTNPVATEQYGHVSTNLQRGSNR

SEQ ID NO: 2963 - protein, 28 aa, Artificial Sequence
  Description of Artificial Sequence: Synthetic peptide
DEEEIRTTNPVATEQYGSVSPNLQRGNC

SEQ ID NO: 2964 - protein, 28 aa, Artificial Sequence
  Description of Artificial Sequence: Synthetic peptide
DEEEIRTTNPVATEQFGSVTTNLQRGNR

SEQ ID NO: 2965 - protein, 29 aa, Artificial Sequence
  Description of Artificial Sequence: Synthetic peptide
DEEEIRTTNPVATEQFGSVTSTNLQRGNR

SEQ ID NO: 2966 - protein, 29 aa, Artificial Sequence
  Description of Artificial Sequence: Synthetic peptide
DEEEIRTTNPVATEQFGSVSTNLQYRGNR

SEQ ID NO: 2967 - protein, 28 aa, Artificial Sequence
  Description of Artificial Sequence: Synthetic peptide
DEEEIRTTNPVATEQYGSVSPNLQRANR

SEQ ID NO: 2968 - protein, 29 aa, Artificial Sequence
  Description of Artificial Sequence: Synthetic peptide
DEEEIRTTNPVATEQFGSVSTNLQRVGNR

SEQ ID NO: 2969 - protein, 29 aa, Artificial Sequence
  Description of Artificial Sequence: Synthetic peptide
DEEEIRTTNPVATEQFGSVSTNLQRGNVR

SEQ ID NO: 2970 - protein, 29 aa, Artificial Sequence
  Description of Artificial Sequence: Synthetic peptide
DEEEIRTTNPVATEQFGSVSTNLQRGNRN

SEQ ID NO: 2971 - protein, 29 aa, Artificial Sequence
  Description of Artificial Sequence: Synthetic peptide
DEEEIRTTNPVATEQFGSVSTNLQRGNRF

SEQ ID NO: 2972 - protein, 28 aa, Artificial Sequence
  Description of Artificial Sequence: Synthetic peptide
DEEEIRTTNPVATEQYGSVSPNLQRGLR

SEQ ID NO: 2973 - protein, 29 aa, Artificial Sequence
  Description of Artificial Sequence: Synthetic peptide
DEEEIRTTNPVATEQYGSVSTNIQPRGNR

SEQ ID NO: 2974 - protein, 28 aa, Artificial Sequence
  Description of Artificial Sequence: Synthetic peptide
DEAEIRTTNPVATECYGSVSTNLQRGNR

SEQ ID NO: 2975 - protein, 29 aa, Artificial Sequence
  Description of Artificial Sequence: Synthetic peptide
DEEEIRTTNPVATEQYGSVSTNIQRGGNR

SEQ ID NO: 2976 - protein, 29 aa, Artificial Sequence
  Description of Artificial Sequence: Synthetic peptide
DEEEIRTTNPVATEQYGISVSTNLQNGNR

SEQ ID NO: 2977 - protein, 29 aa, Artificial Sequence
  Description of Artificial Sequence: Synthetic peptide
DEEEIRTTNPVATEQYGSVVSTELQRGNR

SEQ ID NO: 2978 - protein, 30 aa, Artificial Sequence
  Description of Artificial Sequence: Synthetic polypeptide
DEEEIRTTNPVATEQYGISVSCTNLQRGNR

SEQ ID NO: 2979 - protein, 29 aa, Artificial Sequence
  Description of Artificial Sequence: Synthetic peptide
DEEEIRTTNPVATEQYGISVSCNLQRGNR

SEQ ID NO: 2980 - protein, 28 aa, Artificial Sequence
  Description of Artificial Sequence: Synthetic peptide
DEEEIRTTNPVATEQYGSVSTNISRGNR

SEQ ID NO: 2981 - protein, 29 aa, Artificial Sequence
  Description of Artificial Sequence: Synthetic peptide
DEEEIRTTNPVATEQYGSVSTNISQRGNR

SEQ ID NO: 2982 - protein, 30 aa, Artificial Sequence
  Description of Artificial Sequence: Synthetic polypeptide
DEEEIRTTNPVATEQYGISTVSTNLQRGNR

SEQ ID NO: 2983 - protein, 28 aa, Artificial Sequence
  Description of Artificial Sequence: Synthetic peptide
DEEEIRTTNPVATEQYGSVSTNIQRGNY

SEQ ID NO: 2984 - protein, 29 aa, Artificial Sequence
  Description of Artificial Sequence: Synthetic peptide
DEEEIRTTNPVATEQYGSVSTNIQRGNRN

SEQ ID NO: 2985 - protein, 28 aa, Artificial Sequence
  Description of Artificial Sequence: Synthetic peptide
DEEEIRTTNPVAYEGYGSVSTNLQRGNR

SEQ ID NO: 2986 - protein, 30 aa, Artificial Sequence
  Description of Artificial Sequence: Synthetic polypeptide
DEEEIRTTNPVATEQYGSVSGTNLQRGNRG

SEQ ID NO: 2987 - protein, 29 aa, Artificial Sequence
  Description of Artificial Sequence: Synthetic peptide
DEEEIRTTNPVATEQYGSVSGTNLQRGGR

SEQ ID NO: 2988 - protein, 30 aa, Artificial Sequence
  Description of Artificial Sequence: Synthetic polypeptide
DEEEIRTTNPVATEQYGSVSGTNLQRGFNR

SEQ ID NO: 2989 - protein, 28 aa, Artificial Sequence
  Description of Artificial Sequence: Synthetic peptide
DEEEIRTTNPVATEQYGSVSTNIQRGNM

SEQ ID NO: 2990 - protein, 30 aa, Artificial Sequence
  Description of Artificial Sequence: Synthetic polypeptide
DEEEIRTTNPVATEQYGSVVSTNGLQRGNR

SEQ ID NO: 2991 - protein, 29 aa, Artificial Sequence
  Description of Artificial Sequence: Synthetic peptide
DEEEIRTTNPVATEQYGSVSTNIQRGNLR

SEQ ID NO: 2992 - protein, 29 aa, Artificial Sequence
  Description of Artificial Sequence: Synthetic peptide
DEEEIRTTNPVATEQYGHVSTNPLQRGNR

SEQ ID NO: 2993 - protein, 29 aa, Artificial Sequence
  Description of Artificial Sequence: Synthetic peptide
DEEEIRTTNPVATEQYGHVSTNLQRGWNR

SEQ ID NO: 2994 - protein, 28 aa, Artificial Sequence
  Description of Artificial Sequence: Synthetic peptide
DEEEIRTTNPVATEQYGSVSPNLQRTNR

SEQ ID NO: 2995 - protein, 28 aa, Artificial Sequence
  Description of Artificial Sequence: Synthetic peptide
DEEEIRTTNPVATEQFGSVSTNLQRGNH

SEQ ID NO: 2996 - protein, 29 aa, Artificial Sequence
  Description of Artificial Sequence: Synthetic peptide
DEEEIRTTNPVATEQFGSVSTNLQRGENR

SEQ ID NO: 2997 - protein, 28 aa, Artificial Sequence
  Description of Artificial Sequence: Synthetic peptide
DEEEIRTTNPVATEQFGSVSTNLQRENR

SEQ ID NO: 2998 - protein, 29 aa, Artificial Sequence
  Description of Artificial Sequence: Synthetic peptide
DEEEIRTTNPVATEQYGHVSTNLQRGNRT

SEQ ID NO: 2999 - protein, 29 aa, Artificial Sequence
  Description of Artificial Sequence: Synthetic peptide
DEEEIRTTNPVATEQCYGSVSTNLQMGNR

SEQ ID NO: 3000 - protein, 29 aa, Artificial Sequence
  Description of Artificial Sequence: Synthetic peptide
DEEEIRTTNPVATEQCGSVSTNLQRQGNR

SEQ ID NO: 3001 - protein, 28 aa, Artificial Sequence
  Description of Artificial Sequence: Synthetic peptide
DEEEIRTTNPVATEQCGSVSTNLQRLNR

SEQ ID NO: 3002 - protein, 28 aa, Artificial Sequence
  Description of Artificial Sequence: Synthetic peptide
DEEEIRTTNPVATEQCGSVSTNLQRGNL

SEQ ID NO: 3003 - protein, 28 aa, Artificial Sequence
  Description of Artificial Sequence: Synthetic peptide
DEEEIRTTNPVATEQCGSVSTNLQRGDR

SEQ ID NO: 3004 - protein, 29 aa, Artificial Sequence
  Description of Artificial Sequence: Synthetic peptide
DEEEIRTTNPVATEQCGSVSTNLQERGNR

SEQ ID NO: 3005 - protein, 28 aa, Artificial Sequence
  Description of Artificial Sequence: Synthetic peptide
DEEEIRTTNPVATEQCGSVSTNAQRGNR

SEQ ID NO: 3006 - protein, 29 aa, Artificial Sequence
  Description of Artificial Sequence: Synthetic peptide
DEEEIRTTNPVATEQAYGSVSTNLQPGNR

SEQ ID NO: 3007 - protein, 28 aa, Artificial Sequence
  Description of Artificial Sequence: Synthetic peptide
DEEEIRTTNPVATEQAGSVSTNQQRGNR

SEQ ID NO: 3008 - protein, 28 aa, Artificial Sequence
  Description of Artificial Sequence: Synthetic peptide
DEEEIRTTNPVATEQAGSVSTNNQRGNR

SEQ ID NO: 3009 - protein, 28 aa, Artificial Sequence
  Description of Artificial Sequence: Synthetic peptide
DEEEIRTTNPVATEQAGSVSTNLQDGNR

SEQ ID NO: 3010 - protein, 29 aa, Artificial Sequence
  Description of Artificial Sequence: Synthetic peptide
DEEEIRTTNPVATEQAGSVSTNHLQRGNR

SEQ ID NO: 3011 - protein, 29 aa, Artificial Sequence
  Description of Artificial Sequence: Synthetic peptide
DEEEIRTTNPVATEQYGSVLSTNLQDGNR

SEQ ID NO: 3012 - protein, 29 aa, Artificial Sequence
  Description of Artificial Sequence: Synthetic peptide
DEEEIRTTNPVATEQYGSVLSTNLQNGNR

SEQ ID NO: 3013 - protein, 28 aa, Artificial Sequence
  Description of Artificial Sequence: Synthetic peptide
DEEEIRTTNPVATEQYGSVSTNILRGNR

SEQ ID NO: 3014 - protein, 29 aa, Artificial Sequence
  Description of Artificial Sequence: Synthetic peptide
DEEEIRTTNPVATEQYGSVLSTNLQRGDR

SEQ ID NO: 3015 - protein, 30 aa, Artificial Sequence
  Description of Artificial Sequence: Synthetic polypeptide
DEEEIRTTNPVATEQYGSVLSTNLQRGNCR

SEQ ID NO: 3016 - protein, 30 aa, Artificial Sequence
  Description of Artificial Sequence: Synthetic polypeptide
DEEEIRTTNPVATEQYGSVLSTNLQRVGNR

SEQ ID NO: 3017 - protein, 29 aa, Artificial Sequence
  Description of Artificial Sequence: Synthetic peptide
DEEEIRTTNPVATEFYGSVSATNLQRGNR

SEQ ID NO: 3018 - protein, 28 aa, Artificial Sequence
  Description of Artificial Sequence: Synthetic peptide
DEEEIRTTNPVATEQYGHVSTNLQIGNR

SEQ ID NO: 3019 - protein, 29 aa, Artificial Sequence
  Description of Artificial Sequence: Synthetic peptide
DEEEIRTTNPVATEQYGHVSTMNLQRGNR

SEQ ID NO: 3020 - protein, 29 aa, Artificial Sequence
  Description of Artificial Sequence: Synthetic peptide
DEEEIRTTNPVATEQYGSVLSTNEQRGNR

SEQ ID NO: 3021 - protein, 28 aa, Artificial Sequence
  Description of Artificial Sequence: Synthetic peptide
QEFEIRTTNPVATEQYGSVSTNLQRGNR

SEQ ID NO: 3022 - protein, 28 aa, Artificial Sequence
  Description of Artificial Sequence: Synthetic peptide
DEEEIRTTNPVATEQFGSVSTNLQLGNR

SEQ ID NO: 3023 - protein, 29 aa, Artificial Sequence
  Description of Artificial Sequence: Synthetic peptide
DEEEIRTTNPVATEQYGHVSTNLQRGNRC

SEQ ID NO: 3024 - protein, 30 aa, Artificial Sequence
  Description of Artificial Sequence: Synthetic polypeptide
DEEEIRTTNPVATEQYGSVVSTNLQFRGNR

SEQ ID NO: 3025 - protein, 28 aa, Artificial Sequence
  Description of Artificial Sequence: Synthetic peptide
DEEEIRTTNPVATEQFGSVSTNLERGNR

SEQ ID NO: 3026 - protein, 29 aa, Artificial Sequence
  Description of Artificial Sequence: Synthetic peptide
DEEEIRTTNPVATEQFGSVSTNGLQRGNR

SEQ ID NO: 3027 - protein, 28 aa, Artificial Sequence
  Description of Artificial Sequence: Synthetic peptide
DEEEIRTTNPVATEQFGSVSTNEQRGNR

SEQ ID NO: 3028 - protein, 28 aa, Artificial Sequence
  Description of Artificial Sequence: Synthetic peptide
DEEEIRTTNPVATEQFGSVSDNLQRGNR

SEQ ID NO: 3029 - protein, 29 aa, Artificial Sequence
  Description of Artificial Sequence: Synthetic peptide
DEEEIRTTNPVATEQFGSVCSTNLQRGNR

SEQ ID NO: 3030 - protein, 30 aa, Artificial Sequence
  Description of Artificial Sequence: Synthetic polypeptide
DEEEIRTTNPVATEQYGSVLSCTNLQRGNR

SEQ ID NO: 3031 - protein, 30 aa, Artificial Sequence
  Description of Artificial Sequence: Synthetic polypeptide
DEEEIRTTNPVATEQYGSVVSTNLQRDGNR

SEQ ID NO: 3032 - protein, 29 aa, Artificial Sequence
  Description of Artificial Sequence: Synthetic peptide
DEEEIRTTNPVATEQYGSVVSTNLQRGLR

SEQ ID NO: 3033 - protein, 29 aa, Artificial Sequence
  Description of Artificial Sequence: Synthetic peptide
DEEEIRTTNPVATEQYGSVVSTNLQRGMR

SEQ ID NO: 3034 - protein, 29 aa, Artificial Sequence
  Description of Artificial Sequence: Synthetic peptide
DEEEIRTTNPVATEQYGSVVSTNLQRGNP

SEQ ID NO: 3035 - protein, 30 aa, Artificial Sequence
  Description of Artificial Sequence: Synthetic polypeptide
DEEEIRTTNPVATEQYGSVVSTNLQRGNRD

SEQ ID NO: 3036 - protein, 29 aa, Artificial Sequence
  Description of Artificial Sequence: Synthetic peptide
DEEEIRTTNPVATEQYGSVVSTNLQRGNS

SEQ ID NO: 3037 - protein, 29 aa, Artificial Sequence
  Description of Artificial Sequence: Synthetic peptide
DEEEIRTTNPVATEQYGSVVSTNLQRGNT

SEQ ID NO: 3038 - protein, 28 aa, Artificial Sequence
  Description of Artificial Sequence: Synthetic peptide
DEEEIRTTNPVATEQFGNVSTNLQRGNR

SEQ ID NO: 3039 - protein, 28 aa, Artificial Sequence
  Description of Artificial Sequence: Synthetic peptide
DEEEIRTTNPVATEQFGGVSTNLQRGNR

SEQ ID NO: 3040 - protein, 29 aa, Artificial Sequence
  Description of Artificial Sequence: Synthetic peptide
DEEEIRTTNPVATEQYGSVLSPNLQRGNR

SEQ ID NO: 3041 - protein, 30 aa, Artificial Sequence
  Description of Artificial Sequence: Synthetic polypeptide
DEEEIRTTNPVATEQYGSVLSQTNLQRGNR

SEQ ID NO: 3042 - protein, 28 aa, Artificial Sequence
  Description of Artificial Sequence: Synthetic peptide
DEEEIRTTNPVATWQYGSVSTNMQRGNR

SEQ ID NO: 3043 - protein, 28 aa, Artificial Sequence
  Description of Artificial Sequence: Synthetic peptide
DEEEIRTTNPVATEQYGSVSTNLCKGNR

SEQ ID NO: 3044 - protein, 29 aa, Artificial Sequence
  Description of Artificial Sequence: Synthetic peptide
DEEEIRTTNPVATEQYGSVTTNALQRGNR

SEQ ID NO: 3045 - protein, 29 aa, Artificial Sequence
  Description of Artificial Sequence: Synthetic peptide
DEEEIRTTNPCATEQYGSVSVTNLQRGNR

SEQ ID NO: 3046 - protein, 29 aa, Artificial Sequence
  Description of Artificial Sequence: Synthetic peptide
DEEEIRTTNPVATEQYGSVSTMNLDRGNR

SEQ ID NO: 3047 - protein, 28 aa, Artificial Sequence
  Description of Artificial Sequence: Synthetic peptide
RECEIRTTNPVATEQYGSVSTNLQRGNR

SEQ ID NO: 3048 - protein, 29 aa, Artificial Sequence
  Description of Artificial Sequence: Synthetic peptide
DEEEIRTTNPVGTEQYGSVSTNLQRGNGR

SEQ ID NO: 3049 - protein, 29 aa, Artificial Sequence
  Description of Artificial Sequence: Synthetic peptide
DEEEIRTTNPVGTEQYGSVSTNLQHRGNR

SEQ ID NO: 3050 - protein, 28 aa, Artificial Sequence
  Description of Artificial Sequence: Synthetic peptide
DEEEIRTTNPVGTEQYGSVSTNLQAGNR

SEQ ID NO: 3051 - protein, 28 aa, Artificial Sequence
  Description of Artificial Sequence: Synthetic peptide
QREEIRTTNPVATEQYGSVSTNLQRGNR

SEQ ID NO: 3052 - protein, 28 aa, Artificial Sequence
  Description of Artificial Sequence: Synthetic peptide
DEEEIRTTNPVATEQYGSVSNNLQRDNR

SEQ ID NO: 3053 - protein, 30 aa, Artificial Sequence
  Description of Artificial Sequence: Synthetic polypeptide
DEEEIRTTNPVATEQYGSVSTNLEQCRGNR

SEQ ID NO: 3054 - protein, 28 aa, Artificial Sequence
  Description of Artificial Sequence: Synthetic peptide
DEEEIATTNPVATEQYGSLSTNLQRGNR

SEQ ID NO: 3055 - protein, 29 aa, Artificial Sequence
  Description of Artificial Sequence: Synthetic peptide
DEEEIRTTNPVATEQYGSVSTNLEGRGNR

SEQ ID NO: 3056 - protein, 28 aa, Artificial Sequence
  Description of Artificial Sequence: Synthetic peptide
DEEEIRTTNPVATECYGFVSTNLQRGNR

SEQ ID NO: 3057 - protein, 28 aa, Artificial Sequence
  Description of Artificial Sequence: Synthetic peptide
DEEEIRTTNPVGTEQYGSVSTNAQRGNR

SEQ ID NO: 3058 - protein, 30 aa, Artificial Sequence
  Description of Artificial Sequence: Synthetic polypeptide
DEEEIRTTNPVATEQYGSVGSTENLQRGNR

SEQ ID NO: 3059 - protein, 28 aa, Artificial Sequence
  Description of Artificial Sequence: Synthetic peptide
DEEEIRTTNPVATEQYGSVSNNLQRGNE

SEQ ID NO: 3060 - protein, 29 aa, Artificial Sequence
  Description of Artificial Sequence: Synthetic peptide
DEEEIRTTNPVGTEQYGSVSTANLQRGNR

SEQ ID NO: 3061 - protein, 28 aa, Artificial Sequence
  Description of Artificial Sequence: Synthetic peptide
DEEEIRTCNPVATEGYGSVSTNLQRGNR

SEQ ID NO: 3062 - protein, 29 aa, Artificial Sequence
  Description of Artificial Sequence: Synthetic peptide
DEEEIRTTNPVATEQYGSVSTNLEDRGNR

SEQ ID NO: 3063 - protein, 28 aa, Artificial Sequence
  Description of Artificial Sequence: Synthetic peptide
DEEEIRTTNPVATEQYGSVSNNLQRENR

SEQ ID NO: 3064 - protein, 28 aa, Artificial Sequence
  Description of Artificial Sequence: Synthetic peptide
DEEEIRTTNPVGTEQYGSVSTPLQRGNR

SEQ ID NO: 3065 - protein, 29 aa, Artificial Sequence
  Description of Artificial Sequence: Synthetic peptide
DEEEIATTNPVATEQYGSMVSTNLQRGNR

SEQ ID NO: 3066 - protein, 28 aa, Artificial Sequence
  Description of Artificial Sequence: Synthetic peptide
DEEEIRTTNPVGTEQYGSVSYNLQRGNR

SEQ ID NO: 3067 - protein, 29 aa, Artificial Sequence
  Description of Artificial Sequence: Synthetic peptide
DEEEIRTTNPVSTEQYGASVSTNLQRGNR

SEQ ID NO: 3068 - protein, 28 aa, Artificial Sequence
  Description of Artificial Sequence: Synthetic peptide
REEEIRTTNPVAGEQYGSVSTNLQRGNR

SEQ ID NO: 3069 - protein, 29 aa, Artificial Sequence
  Description of Artificial Sequence: Synthetic peptide
DEEEIATTNPVATEQYGSTVSTNLQRGNR

SEQ ID NO: 3070 - protein, 28 aa, Artificial Sequence
  Description of Artificial Sequence: Synthetic peptide
DEEEIRTTNPVATEQYGMVNTNLQRGNR

SEQ ID NO: 3071 - protein, 28 aa, Artificial Sequence
  Description of Artificial Sequence: Synthetic peptide
DEEEIRTTNPVSCEQYGSVSTNLQRGNR

SEQ ID NO: 3072 - protein, 29 aa, Artificial Sequence
  Description of Artificial Sequence: Synthetic peptide
DEEEIRTTNPVRTEQYGSVPSTNLQRGNR

SEQ ID NO: 3073 - protein, 28 aa, Artificial Sequence
  Description of Artificial Sequence: Synthetic peptide
DEEEIRTTNPVQTEQYGSVSTNLQRGNE

SEQ ID NO: 3074 - protein, 28 aa, Artificial Sequence
  Description of Artificial Sequence: Synthetic peptide
DEEEIRTTNPVNTEQYGSVSTNLQWGNR

SEQ ID NO: 3075 - protein, 28 aa, Artificial Sequence
  Description of Artificial Sequence: Synthetic peptide
DEEEIRTTNPVNTEQYGSVSTELQRGNR

SEQ ID NO: 3076 - protein, 28 aa, Artificial Sequence
  Description of Artificial Sequence: Synthetic peptide
DEEEIRTTNPVMTEQYGTVSTNLQRGNR

SEQ ID NO: 3077 - protein, 28 aa, Artificial Sequence
  Description of Artificial Sequence: Synthetic peptide
DEEEIRTTNPVMTEQYGSVSTNLERGNR

SEQ ID NO: 3078 - protein, 28 aa, Artificial Sequence
  Description of Artificial Sequence: Synthetic peptide
DEEEIRTTNPVLTEQYGSVSTNLQRGNT

SEQ ID NO: 3079 - protein, 28 aa, Artificial Sequence
  Description of Artificial Sequence: Synthetic peptide
DEEEIRTTNPVLTEQYGSVSTNLQMGNR

SEQ ID NO: 3080 - protein, 28 aa, Artificial Sequence
  Description of Artificial Sequence: Synthetic peptide
DEEEIRTTNPVITEQYGSVSTNLQRGNF

SEQ ID NO: 3081 - protein, 28 aa, Artificial Sequence
  Description of Artificial Sequence: Synthetic peptide
DEEEIRTTNPVITEQYGSVSTNLQLGNR

SEQ ID NO: 3082 - protein, 28 aa, Artificial Sequence
  Description of Artificial Sequence: Synthetic peptide
DEEEIRTTNPVHTEQYGSVSTNLQRGNL

SEQ ID NO: 3083 - protein, 28 aa, Artificial Sequence
  Description of Artificial Sequence: Synthetic peptide
DEEEIRSTNPVAYEQYGSVSTNLQRGNR

SEQ ID NO: 3084 - protein, 28 aa, Artificial Sequence
  Description of Artificial Sequence: Synthetic peptide
DEEEIRTTNPVGTYQYGSVSTNLQRGNR

SEQ ID NO: 3085 - protein, 28 aa, Artificial Sequence
  Description of Artificial Sequence: Synthetic peptide
REEEIDTTNPVATEQYGSVSTNLQRGNR

SEQ ID NO: 3086 - protein, 29 aa, Artificial Sequence
  Description of Artificial Sequence: Synthetic peptide
DEEEIRTTNPVATEQYGSVSNNLQRGNRA

SEQ ID NO: 3087 - protein, 29 aa, Artificial Sequence
  Description of Artificial Sequence: Synthetic peptide
DEEEIRTTNPVATEQYGSVQTPNLQRGNR

SEQ ID NO: 3088 - protein, 28 aa, Artificial Sequence
  Description of Artificial Sequence: Synthetic peptide
DEEEIRTCNPVATEQWGSVSTNLQRGNR

SEQ ID NO: 3089 - protein, 29 aa, Artificial Sequence
  Description of Artificial Sequence: Synthetic peptide
DEEEIRTTNPVATEQYGSVQTNLQRMGNR

SEQ ID NO: 3090 - protein, 29 aa, Artificial Sequence
  Description of Artificial Sequence: Synthetic peptide
DEEEIRTTNPVCTEQYGSVSTNLQRVGNR

SEQ ID NO: 3091 - protein, 28 aa, Artificial Sequence
  Description of Artificial Sequence: Synthetic peptide
DEEEIRTTNPVCTEQYGSVSTNLQRPNR

SEQ ID NO: 3092 - protein, 29 aa, Artificial Sequence
  Description of Artificial Sequence: Synthetic peptide
DEEEIRTTNPVCTEQYGSVSTNLQRMGNR

SEQ ID NO: 3093 - protein, 29 aa, Artificial Sequence
  Description of Artificial Sequence: Synthetic peptide
DEEEIRTTNPVCTEQYGSVSTNLQRHGNR

SEQ ID NO: 3094 - protein, 29 aa, Artificial Sequence
  Description of Artificial Sequence: Synthetic peptide
DEEEIRTTNPVCTEQYGSVSTNLQRGVNR

SEQ ID NO: 3095 - protein, 29 aa, Artificial Sequence
  Description of Artificial Sequence: Synthetic peptide
DEEEIRTTNPVCTEQYGSVSTNLQRGPNR

SEQ ID NO: 3096 - protein, 29 aa, Artificial Sequence
  Description of Artificial Sequence: Synthetic peptide
DEEEIRTTNPVCTEQYGSVSTNLQRGNAR

SEQ ID NO: 3097 - protein, 29 aa, Artificial Sequence
  Description of Artificial Sequence: Synthetic peptide
DEEEIRTTNPVATECYGLSVSTNLQRGNR

SEQ ID NO: 3098 - protein, 28 aa, Artificial Sequence
  Description of Artificial Sequence: Synthetic peptide
DEEEIRTTNPVCTEQYGSVSTNLQVGNR

SEQ ID NO: 3099 - protein, 28 aa, Artificial Sequence
  Description of Artificial Sequence: Synthetic peptide
DEEEIRTTNPVCTEQYGSVSTNLQRGIR

SEQ ID NO: 3100 - protein, 28 aa, Artificial Sequence
  Description of Artificial Sequence: Synthetic peptide
DEEEIRTTNPVCTEQYGSVSTNLQEGNR

SEQ ID NO: 3101 - protein, 29 aa, Artificial Sequence
  Description of Artificial Sequence: Synthetic peptide
DEEEIRTTNPVCTEQYGSVSTNLQCRGNR

SEQ ID NO: 3102 - protein, 28 aa, Artificial Sequence
  Description of Artificial Sequence: Synthetic peptide
DEEEIRTTNPVCTEQYGSVSTNLIRGNR

SEQ ID NO: 3103 - protein, 28 aa, Artificial Sequence
  Description of Artificial Sequence: Synthetic peptide
DEEEIRTTNPVCTEQYGSVSTNIQRGNR

SEQ ID NO: 3104 - protein, 28 aa, Artificial Sequence
  Description of Artificial Sequence: Synthetic peptide
DEEEIRTTNPVCTEQYGSVSTNFQRGNR

SEQ ID NO: 3105 - protein, 28 aa, Artificial Sequence
  Description of Artificial Sequence: Synthetic peptide
DEEEIRTTNPVCTEQYGSVLTNLQRGNR

SEQ ID NO: 3106 - protein, 28 aa, Artificial Sequence
  Description of Artificial Sequence: Synthetic peptide
DEEEIRTTNPVCTEQYGEVSTNLQRGNR

SEQ ID NO: 3107 - protein, 29 aa, Artificial Sequence
  Description of Artificial Sequence: Synthetic peptide
DEEEIRTTNPVATEQYGSVSTNLDRIGNR

SEQ ID NO: 3108 - protein, 28 aa, Artificial Sequence
  Description of Artificial Sequence: Synthetic peptide
DEEEIRTTNPVCTEQYGSVSTNLQRGER

SEQ ID NO: 3109 - protein, 29 aa, Artificial Sequence
  Description of Artificial Sequence: Synthetic peptide
DEEEIRTTNPVCTEQYGSVSTNPLQRGNR

SEQ ID NO: 3110 - protein, 28 aa, Artificial Sequence
  Description of Artificial Sequence: Synthetic peptide
DEEEIRTTNPVCTEQYGSVSTPLQRGNR

SEQ ID NO: 3111 - protein, 29 aa, Artificial Sequence
  Description of Artificial Sequence: Synthetic peptide
DEEEIRTTNPVCTEQYGSVSTTNLQRGNR

SEQ ID NO: 3112 - protein, 29 aa, Artificial Sequence
  Description of Artificial Sequence: Synthetic peptide
DEEEIRTTNPVATEQYGSVGSTLLQRGNR

SEQ ID NO: 3113 - protein, 28 aa, Artificial Sequence
  Description of Artificial Sequence: Synthetic peptide
DEEEIRTTNPVGTEQYGSNSTNLQRGNR

SEQ ID NO: 3114 - protein, 28 aa, Artificial Sequence
  Description of Artificial Sequence: Synthetic peptide
DEEEIRTTNPVATEQYGSVQTNLQRGNT

SEQ ID NO: 3115 - protein, 29 aa, Artificial Sequence
  Description of Artificial Sequence: Synthetic peptide
DEEEIRTTNPVATEQYGSVQTNLQRGNRL

SEQ ID NO: 3116 - protein, 30 aa, Artificial Sequence
  Description of Artificial Sequence: Synthetic polypeptide
DEEEIRTTNPVATEQYGSVGSTNDLQRGNR

SEQ ID NO: 3117 - protein, 28 aa, Artificial Sequence
  Description of Artificial Sequence: Synthetic peptide
DEEEIRTTNPVATEQYGSVQTNLQRGNP

SEQ ID NO: 3118 - protein, 30 aa, Artificial Sequence
  Description of Artificial Sequence: Synthetic polypeptide
DEEEIRTTNPVATEQYGSVGSTNELQRGNR

SEQ ID NO: 3119 - protein, 28 aa, Artificial Sequence
  Description of Artificial Sequence: Synthetic peptide
TESEIRTTNPVATEQYGSVSTNLQRGNR

SEQ ID NO: 3120 - protein, 30 aa, Artificial Sequence
  Description of Artificial Sequence: Synthetic polypeptide
DEEEIRTTNPVATEQYGSVGSTNLLQRGNR

SEQ ID NO: 3121 - protein, 29 aa, Artificial Sequence
  Description of Artificial Sequence: Synthetic peptide
DEEEIRTTNPVATEQYGSVSGNWLQRGNR

SEQ ID NO: 3122 - protein, 30 aa, Artificial Sequence
  Description of Artificial Sequence: Synthetic polypeptide
DEEEIRTTNPVGATTEQYGSVSTNLQRGNR

SEQ ID NO: 3123 - protein, 28 aa, Artificial Sequence
  Description of Artificial Sequence: Synthetic peptide
DEEEIRTTNPVFTEQYGSVSTNLQRGNE

SEQ ID NO: 3124 - protein, 28 aa, Artificial Sequence
  Description of Artificial Sequence: Synthetic peptide
DEEEIRTTNPVETEQYGSVSTNLQAGNR

SEQ ID NO: 3125 - protein, 28 aa, Artificial Sequence
  Description of Artificial Sequence: Synthetic peptide
DEEEIRTTNPVDTEQYGSVSTNLQNGNR

SEQ ID NO: 3126 - protein, 29 aa, Artificial Sequence
  Description of Artificial Sequence: Synthetic peptide
DEEEIRTTNPVATEQYGSVGSTNLQLGNR

SEQ ID NO: 3127 - protein, 29 aa, Artificial Sequence
  Description of Artificial Sequence: Synthetic peptide
DEEEIRTTNPVATEQYGSVSNNLQRGSNR

SEQ ID NO: 3128 - protein, 28 aa, Artificial Sequence
  Description of Artificial Sequence: Synthetic peptide
DEEEIATTNPVATEQYGSASTNLQRGNR

SEQ ID NO: 3129 - protein, 29 aa, Artificial Sequence
  Description of Artificial Sequence: Synthetic peptide
DEEEIRTTNPVATEQYGSVSNNLQRGVNR

SEQ ID NO: 3130 - protein, 28 aa, Artificial Sequence
  Description of Artificial Sequence: Synthetic peptide
DEEEIRTTNPVATEQYGSVSTNLDRSNR

SEQ ID NO: 3131 - protein, 29 aa, Artificial Sequence
  Description of Artificial Sequence: Synthetic peptide
DEEEIRTTNPVATEQYGSVSNNLQRGNRE

SEQ ID NO: 3132 - protein, 28 aa, Artificial Sequence
  Description of Artificial Sequence: Synthetic peptide
DEEEIRTTNPVSTEQYGSISTNLQRGNR

SEQ ID NO: 3133 - protein, 29 aa, Artificial Sequence
  Description of Artificial Sequence: Synthetic peptide
DEEEIRTTNPVATEQYGMVSPTNLQRGNR

SEQ ID NO: 3134 - protein, 29 aa, Artificial Sequence
  Description of Artificial Sequence: Synthetic peptide
DEEEIRTTNPVATEQYGMVSTANLQRGNR

SEQ ID NO: 3135 - protein, 28 aa, Artificial Sequence
  Description of Artificial Sequence: Synthetic peptide
DEEEIRTTNPYATEGYGSVSTNLQRGNR

SEQ ID NO: 3136 - protein, 29 aa, Artificial Sequence
  Description of Artificial Sequence: Synthetic peptide
DEEEIRTTNPWATEQYGSVSTNLQSRGNR

SEQ ID NO: 3137 - protein, 28 aa, Artificial Sequence
  Description of Artificial Sequence: Synthetic peptide
DEEEIRTTNPWATEQYGSVSTNLQNGNR

SEQ ID NO: 3138 - protein, 28 aa, Artificial Sequence
  Description of Artificial Sequence: Synthetic peptide
DEEEIRTTNPWATEQYGSVSTNLQLGNR

SEQ ID NO: 3139 - protein, 28 aa, Artificial Sequence
  Description of Artificial Sequence: Synthetic peptide
DEEEIRTTNPVYYEQYGSVSTNLQRGNR

SEQ ID NO: 3140 - protein, 28 aa, Artificial Sequence
  Description of Artificial Sequence: Synthetic peptide
DEEEIRTTNPVYTEQYGVVSTNLQRGNR

SEQ ID NO: 3141 - protein, 28 aa, Artificial Sequence
  Description of Artificial Sequence: Synthetic peptide
DEEEIRTTNPVYTEQYGSVSTNLQVGNR

SEQ ID NO: 3142 - protein, 29 aa, Artificial Sequence
  Description of Artificial Sequence: Synthetic peptide
DEEEIRTTNPVYTEQYGSVSTNLQSRGNR

SEQ ID NO: 3143 - protein, 29 aa, Artificial Sequence
  Description of Artificial Sequence: Synthetic peptide
DEEEIRTTNPYATEQYGSVSTNLQRGNER

SEQ ID NO: 3144 - protein, 28 aa, Artificial Sequence
  Description of Artificial Sequence: Synthetic peptide
DEEEIRTTNPVYTEQYGSVSTNLQRMNR

SEQ ID NO: 3145 - protein, 28 aa, Artificial Sequence
  Description of Artificial Sequence: Synthetic peptide
DEEEIRTTNPVYTEQYGSVSTNLQQGNR

SEQ ID NO: 3146 - protein, 28 aa, Artificial Sequence
  Description of Artificial Sequence: Synthetic peptide
DEEEIRTTNPVYTEQYGSVSTNLQIGNR

SEQ ID NO: 3147 - protein, 29 aa, Artificial Sequence
  Description of Artificial Sequence: Synthetic peptide
DEEEIRSTNPVATEQYGSVSTNLQDRGNR

SEQ ID NO: 3148 - protein, 28 aa, Artificial Sequence
  Description of Artificial Sequence: Synthetic peptide
DEEEIRTTNPVVTEQYGSVSTNLQRGNL

SEQ ID NO: 3149 - protein, 29 aa, Artificial Sequence
  Description of Artificial Sequence: Synthetic peptide
DEEEIRTTNPVVTEQYGSVSTNLQMRGNR

SEQ ID NO: 3150 - protein, 29 aa, Artificial Sequence
  Description of Artificial Sequence: Synthetic peptide
DEEEIRTTNPVVTEQYGSVSTNLQERGNR

SEQ ID NO: 3151 - protein, 28 aa, Artificial Sequence
  Description of Artificial Sequence: Synthetic peptide
DEEEIRTTNPVATEQYGSVSTNLERGMR

SEQ ID NO: 3152 - protein, 28 aa, Artificial Sequence
  Description of Artificial Sequence: Synthetic peptide
DEEEIRTTNPVVTEQYGSVSTNEQRGNR

SEQ ID NO: 3153 - protein, 28 aa, Artificial Sequence
  Description of Artificial Sequence: Synthetic peptide
DEEEIRTTNPVYTEQYGSVSTNLQRGER

SEQ ID NO: 3154 - protein, 29 aa, Artificial Sequence
  Description of Artificial Sequence: Synthetic peptide
DEEEIRTTNPYATEQYGSVSTNLQRGNRE

SEQ ID NO: 3155 - protein, 28 aa, Artificial Sequence
  Description of Artificial Sequence: Synthetic peptide
DEEEIRTTNPYATEQYGSVSTNLQRGQR

SEQ ID NO: 3156 - protein, 28 aa, Artificial Sequence
  Description of Artificial Sequence: Synthetic peptide
DEEEIRTTNQVAYEQYGSVSTNLQRGNR

SEQ ID NO: 3157 - protein, 29 aa, Artificial Sequence
  Description of Artificial Sequence: Synthetic peptide
DEEEIRTTNPVATEQYGMVSTNLEQRGNR

SEQ ID NO: 3158 - protein, 28 aa, Artificial Sequence
  Description of Artificial Sequence: Synthetic peptide
DEEEIRTTNPVATEQYGSVSTNLERGNF

SEQ ID NO: 3159 - protein, 29 aa, Artificial Sequence
  Description of Artificial Sequence: Synthetic peptide
DEEEIRTVNPVATEQYGSVPSTNLQRGNR

SEQ ID NO: 3160 - protein, 28 aa, Artificial Sequence
  Description of Artificial Sequence: Synthetic peptide
DEEEIRTVNPVATEQYGSVATNLQRGNR

SEQ ID NO: 3161 - protein, 28 aa, Artificial Sequence
  Description of Artificial Sequence: Synthetic peptide
DEEEIRTVNPVATEQYGSESTNLQRGNR

SEQ ID NO: 3162 - protein, 28 aa, Artificial Sequence
  Description of Artificial Sequence: Synthetic peptide
DEEEIRTVNPVATEQYGHVSTNLQRGNR

SEQ ID NO: 3163 - protein, 28 aa, Artificial Sequence
  Description of Artificial Sequence: Synthetic peptide
DEEEIRSTNPVATEQYGSVSTNLCRGNR

SEQ ID NO: 3164 - protein, 28 aa, Artificial Sequence
  Description of Artificial Sequence: Synthetic peptide
DEEEIRTVNPVATENYGSVSTNLQRGNR

SEQ ID NO: 3165 - protein, 29 aa, Artificial Sequence
  Description of Artificial Sequence: Synthetic peptide
DEEEIRTTTNPVSTEQYGSVSTNLQRGNR

SEQ ID NO: 3166 - protein, 28 aa, Artificial Sequence
  Description of Artificial Sequence: Synthetic peptide
DEEEIRTTNWVATEQYGDVSTNLQRGNR

SEQ ID NO: 3167 - protein, 29 aa, Artificial Sequence
  Description of Artificial Sequence: Synthetic peptide
DEEEIRTTNVVATEQYGSVSTNLQSRGNR

SEQ ID NO: 3168 - protein, 28 aa, Artificial Sequence
  Description of Artificial Sequence: Synthetic peptide
DEEEIRTTNTVATEQYGSVSTNLQRPNR

SEQ ID NO: 3169 - protein, 28 aa, Artificial Sequence
  Description of Artificial Sequence: Synthetic peptide
DEEEIRTTNTVATEQYGSVSCNLQRGNR

SEQ ID NO: 3170 - protein, 28 aa, Artificial Sequence
  Description of Artificial Sequence: Synthetic peptide
DEEEIRTTNSVAYEQYGSVSTNLQRGNR

SEQ ID NO: 3171 - protein, 28 aa, Artificial Sequence
  Description of Artificial Sequence: Synthetic peptide
DEEEIRTTNSVATEQYGVVSTNLQRGNR

SEQ ID NO: 3172 - protein, 28 aa, Artificial Sequence
  Description of Artificial Sequence: Synthetic peptide
DEEEIRTTNSVATEQYGSVSTNTQRGNR

SEQ ID NO: 3173 - protein, 29 aa, Artificial Sequence
  Description of Artificial Sequence: Synthetic peptide
DEEEIRTTNSVATEQYGSVSTNLQRGENR

SEQ ID NO: 3174 - protein, 28 aa, Artificial Sequence
  Description of Artificial Sequence: Synthetic peptide
DEEEIRTTNSVATEQYGSVSTNIQRGNR

SEQ ID NO: 3175 - protein, 28 aa, Artificial Sequence
  Description of Artificial Sequence: Synthetic peptide
DEEEIRTTNSVATEPYGSVSTNLQRGNR

SEQ ID NO: 3176 - protein, 28 aa, Artificial Sequence
  Description of Artificial Sequence: Synthetic peptide
DEEEIRTTNPVTTEQYGSVSTNLQRGNL

SEQ ID NO: 3177 - protein, 29 aa, Artificial Sequence
  Description of Artificial Sequence: Synthetic peptide
DEEEIRTTNPVTTEQYGSVSTNLQERGNR

SEQ ID NO: 3178 - protein, 29 aa, Artificial Sequence
  Description of Artificial Sequence: Synthetic peptide
DEEEIRTTNPVATEQYGSVGNTNLQRGNR

SEQ ID NO: 3179 - protein, 28 aa, Artificial Sequence
  Description of Artificial Sequence: Synthetic peptide
DEEEIRTTNPVTGEQYGSVSTNLQRGNR

SEQ ID NO: 3180 - protein, 29 aa, Artificial Sequence
  Description of Artificial Sequence: Synthetic peptide
REEEIRTTNPVATEQYGSVSTNLQRGNAR

SEQ ID NO: 3181 - protein, 28 aa, Artificial Sequence
  Description of Artificial Sequence: Synthetic peptide
REEEIRTTNPVATEQYGSVSTNLQRGNA

SEQ ID NO: 3182 - protein, 28 aa, Artificial Sequence
  Description of Artificial Sequence: Synthetic peptide
REEEIRTTNPVATEQYGSVSTNLERGNR

SEQ ID NO: 3183 - protein, 28 aa, Artificial Sequence
  Description of Artificial Sequence: Synthetic peptide
REEEIRTTNPVATEQYGSVSGNLQRGNR

SEQ ID NO: 3184 - protein, 29 aa, Artificial Sequence
  Description of Artificial Sequence: Synthetic peptide
DEEEIRTTNPVATEQYGSVSTNLEQRGGR

SEQ ID NO: 3185 - protein, 28 aa, Artificial Sequence
  Description of Artificial Sequence: Synthetic peptide
DEEEIRTTNPVSTEQYGSVSTSLQRGNR

SEQ ID NO: 3186 - protein, 29 aa, Artificial Sequence
  Description of Artificial Sequence: Synthetic peptide
DEEEIRTTNPVATEQYGSVSTNLEQRGER

SEQ ID NO: 3187 - protein, 28 aa, Artificial Sequence
  Description of Artificial Sequence: Synthetic peptide
DEEEIRTTNPVSTEQYGSVSTNLQRGNY

SEQ ID NO: 3188 - protein, 29 aa, Artificial Sequence
  Description of Artificial Sequence: Synthetic peptide
DEEEIRTTNPVSTEQYGSVSTNLQRGNRM

SEQ ID NO: 3189 - protein, 28 aa, Artificial Sequence
  Description of Artificial Sequence: Synthetic peptide
DEEEIRTTNPVSTEQYGSVSTNLQRGNG

SEQ ID NO: 3190 - protein, 28 aa, Artificial Sequence
  Description of Artificial Sequence: Synthetic peptide
DEEEIRTTNPVSTEQYGSVSTNLQGGNR

SEQ ID NO: 3191 - protein, 29 aa, Artificial Sequence
  Description of Artificial Sequence: Synthetic peptide
DEEEIRTTNPVATEQYGSVSTNLEQRFNR

SEQ ID NO: 3192 - protein, 29 aa, Artificial Sequence
  Description of Artificial Sequence: Synthetic peptide
DEEEIRTTNPVATEQYGSVSTNLEQRENR

SEQ ID NO: 3193 - protein, 28 aa, Artificial Sequence
  Description of Artificial Sequence: Synthetic peptide
DEEEIRTTNPVATEQYGMVSTDLQRGNR

SEQ ID NO: 3194 - protein, 28 aa, Artificial Sequence
  Description of Artificial Sequence: Synthetic peptide
DEEEIRTTNPVSTEQYGSVSTALQRGNR

SEQ ID NO: 3195 - protein, 29 aa, Artificial Sequence
  Description of Artificial Sequence: Synthetic peptide
DEEEIRTTNPVSTEQYGSVSATNLQRGNR

SEQ ID NO: 3196 - protein, 29 aa, Artificial Sequence
  Description of Artificial Sequence: Synthetic peptide
DEEEIRTTNPVATEQYGSVSTNLEQKGNR

SEQ ID NO: 3197 - protein, 29 aa, Artificial Sequence
  Description of Artificial Sequence: Synthetic peptide
DEEEIRTTNPVSTEQYGSVDSTNLQRGNR

SEQ ID NO: 3198 - protein, 29 aa, Artificial Sequence
  Description of Artificial Sequence: Synthetic peptide
DEEEIRTTNPVATEQYGSVSPTNEQRGNR

SEQ ID NO: 3199 - protein, 29 aa, Artificial Sequence
  Description of Artificial Sequence: Synthetic peptide
REEEIRTTNPVATEQYGSVSTNLQRGNRD

SEQ ID NO: 3200 - protein, 29 aa, Artificial Sequence
  Description of Artificial Sequence: Synthetic peptide
DEEEIRTTNPVATEQYGSVSTNLDRGNRK

SEQ ID NO: 3201 - protein, 29 aa, Artificial Sequence
  Description of Artificial Sequence: Synthetic peptide
REEEIRTTNPVATEQYGSVSTNLQRMGNR

SEQ ID NO: 3202 - protein, 28 aa, Artificial Sequence
  Description of Artificial Sequence: Synthetic peptide
DEEEIRTTNPVATEQYGSVTDNLQRGNR

SEQ ID NO: 3203 - protein, 28 aa, Artificial Sequence
  Description of Artificial Sequence: Synthetic peptide
DEEEIRTTNPVSTEYYGSVSTNLQRGNR

SEQ ID NO: 3204 - protein, 28 aa, Artificial Sequence
  Description of Artificial Sequence: Synthetic peptide
DEEEIRTTNPVATEQYGSVSNNLQFGNR

SEQ ID NO: 3205 - protein, 29 aa, Artificial Sequence
  Description of Artificial Sequence: Synthetic peptide
DEEEIRTTNPVATEQYGSVSNNLQFRGNR

SEQ ID NO: 3206 - protein, 28 aa, Artificial Sequence
  Description of Artificial Sequence: Synthetic peptide
DEEEIRSTNPVATEQYGSVSTNLQRGDR

SEQ ID NO: 3207 - protein, 29 aa, Artificial Sequence
  Description of Artificial Sequence: Synthetic peptide
DEEEIRSTNPVATEQYGSVSTNLQRGENR

SEQ ID NO: 3208 - protein, 29 aa, Artificial Sequence
  Description of Artificial Sequence: Synthetic peptide
DEEEIRSTNPVATEQYGSVSTNLQRGHNR

SEQ ID NO: 3209 - protein, 28 aa, Artificial Sequence
  Description of Artificial Sequence: Synthetic peptide
RETEIRTTNPVATEQYGSVSTNLQRGNR

SEQ ID NO: 3210 - protein, 29 aa, Artificial Sequence
  Description of Artificial Sequence: Synthetic peptide
DEEEIRTTNPVATEQYGSVSPTNGQRGNR

SEQ ID NO: 3211 - protein, 28 aa, Artificial Sequence
  Description of Artificial Sequence: Synthetic peptide
DEEEIRSTNPVATEQYGSVSTNLQRGNV

SEQ ID NO: 3212 - protein, 29 aa, Artificial Sequence
  Description of Artificial Sequence: Synthetic peptide
DEEEIRTTNPVATEQYGSVSTNLERGENR

SEQ ID NO: 3213 - protein, 30 aa, Artificial Sequence
  Description of Artificial Sequence: Synthetic polypeptide
DEEEIRTTNPVATEQYGSVSYTNLQRGENR

SEQ ID NO: 3214 - protein, 28 aa, Artificial Sequence
  Description of Artificial Sequence: Synthetic peptide
DEEEIRSTNPVATEQYGSVSTNSQRGNR

SEQ ID NO: 3215 - protein, 30 aa, Artificial Sequence
  Description of Artificial Sequence: Synthetic polypeptide
DEEEIRTTNPVATEQYGSVSTNLEQRNGNR

SEQ ID NO: 3216 - protein, 30 aa, Artificial Sequence
  Description of Artificial Sequence: Synthetic polypeptide
DEEEIRTTNPVATEQYGSVSTNLEQRGPNR

SEQ ID NO: 3217 - protein, 28 aa, Artificial Sequence
  Description of Artificial Sequence: Synthetic peptide
REEEIRTTNPVATFQYGSVSTNLQRGNR

SEQ ID NO: 3218 - protein, 30 aa, Artificial Sequence
  Description of Artificial Sequence: Synthetic polypeptide
DEEEIRTTNPVATEQYGSVSTNLEQRGNRG

SEQ ID NO: 3219 - protein, 29 aa, Artificial Sequence
  Description of Artificial Sequence: Synthetic peptide
DEEEIRTTNPVATEQYGSVSTNLEQRGNN

SEQ ID NO: 3220 - protein, 29 aa, Artificial Sequence
  Description of Artificial Sequence: Synthetic peptide
DEEEIRTTNPVATEQYGSVGSENLQRGNR

SEQ ID NO: 3221 - protein, 29 aa, Artificial Sequence
  Description of Artificial Sequence: Synthetic peptide
REEEIRTTNPVATEQYGSVSTNLVQRGNR

SEQ ID NO: 3222 - protein, 28 aa, Artificial Sequence
  Description of Artificial Sequence: Synthetic peptide
REEEIRTTNPVATEQYGSVSTNLQRQNR

SEQ ID NO: 3223 - protein, 28 aa, Artificial Sequence
  Description of Artificial Sequence: Synthetic peptide
DEEEIRTTNPVATEQYGSVSTNLDRGNP

SEQ ID NO: 3224 - protein, 29 aa, Artificial Sequence
  Description of Artificial Sequence: Synthetic peptide
DEEEIRTTNPVATEQYGSVGSTNLQQGNR

SEQ ID NO: 3225 - protein, 28 aa, Artificial Sequence
  Description of Artificial Sequence: Synthetic peptide
DECEIMTTNPVATEQYGSVSTNLQRGNR

SEQ ID NO: 3226 - protein, 29 aa, Artificial Sequence
  Description of Artificial Sequence: Synthetic peptide
DEEEIRTTNPVATEQYGSVHTNLQRGNMR

SEQ ID NO: 3227 - protein, 28 aa, Artificial Sequence
  Description of Artificial Sequence: Synthetic peptide
DEEEIRTTNGVATEQYGSVSTNIQRGNR

SEQ ID NO: 3228 - protein, 29 aa, Artificial Sequence
  Description of Artificial Sequence: Synthetic peptide
DEEEIRTTNPVATEQYGSVHTNLQRGNRD

SEQ ID NO: 3229 - protein, 28 aa, Artificial Sequence
  Description of Artificial Sequence: Synthetic peptide
DEEEIRTTNGVATEQYGSVSTNLQDGNR

SEQ ID NO: 3230 - protein, 28 aa, Artificial Sequence
  Description of Artificial Sequence: Synthetic peptide
DEEEIRTTNGVATEQYGSVSTNLQRPNR

SEQ ID NO: 3231 - protein, 28 aa, Artificial Sequence
  Description of Artificial Sequence: Synthetic peptide
DEEEIRTTNPVATEQYGSVHTNLQTGNR

SEQ ID NO: 3232 - protein, 28 aa, Artificial Sequence
  Description of Artificial Sequence: Synthetic peptide
DEEEIRTTNMVATEQYGSVSTNLQRGNQ

SEQ ID NO: 3233 - protein, 29 aa, Artificial Sequence
  Description of Artificial Sequence: Synthetic peptide
DEEEIRTTNPVATEQYGLVSTTNLQRGNR

SEQ ID NO: 3234 - protein, 30 aa, Artificial Sequence
  Description of Artificial Sequence: Synthetic polypeptide
DEEEIRTTNFPVATEQYGSVSTNLQRGNGR

SEQ ID NO: 3235 - protein, 28 aa, Artificial Sequence
  Description of Artificial Sequence: Synthetic peptide
DEEEIRTTNPVATEQYGLVSTSLQRGNR

SEQ ID NO: 3236 - protein, 29 aa, Artificial Sequence
  Description of Artificial Sequence: Synthetic peptide
DEEEIRTTNPVATEQYGLVSTNLQRVGNR

SEQ ID NO: 3237 - protein, 29 aa, Artificial Sequence
  Description of Artificial Sequence: Synthetic peptide
DEEEIRTTNPVATEQYGSVQSTWLQRGNR

SEQ ID NO: 3238 - protein, 30 aa, Artificial Sequence
  Description of Artificial Sequence: Synthetic polypeptide
DEEEIRTTNPVATEQYGSVTSTNLQCRGNR

SEQ ID NO: 3239 - protein, 29 aa, Artificial Sequence
  Description of Artificial Sequence: Synthetic peptide
DEEEIRTTNPVATEQYGLVSTNLQRGNMR

SEQ ID NO: 3240 - protein, 29 aa, Artificial Sequence
  Description of Artificial Sequence: Synthetic peptide
DEEEIRTTNPVATEQYGLVSTNLQRGLNR

SEQ ID NO: 3241 - protein, 28 aa, Artificial Sequence
  Description of Artificial Sequence: Synthetic peptide
DEEEIRTTNPAATENYGSVSTNLQRGNR

SEQ ID NO: 3242 - protein, 28 aa, Artificial Sequence
  Description of Artificial Sequence: Synthetic peptide
DEEEIRTTNPAATEQYGFVSTNLQRGNR

SEQ ID NO: 3243 - protein, 28 aa, Artificial Sequence
  Description of Artificial Sequence: Synthetic peptide
DEEEIRTTNPVATEQYGSVDTNLQGGNR

SEQ ID NO: 3244 - protein, 28 aa, Artificial Sequence
  Description of Artificial Sequence: Synthetic peptide
DECEIRTTNPVATEQLGSVSTNLQRGNR

SEQ ID NO: 3245 - protein, 30 aa, Artificial Sequence
  Description of Artificial Sequence: Synthetic polypeptide
DEEEIRTTNPVATEQYGMSNVSTNLQRGNR

SEQ ID NO: 3246 - protein, 28 aa, Artificial Sequence
  Description of Artificial Sequence: Synthetic peptide
DEEEIRTTNCVATEQYGSVSTNLQRGNT

SEQ ID NO: 3247 - protein, 29 aa, Artificial Sequence
  Description of Artificial Sequence: Synthetic peptide
DEEEIRTTNPVATEQYGSVSTMNLQDGNR

SEQ ID NO: 3248 - protein, 29 aa, Artificial Sequence
  Description of Artificial Sequence: Synthetic peptide
DEEEIRTTNPVATEQYGMSVSTNAQRGNR

SEQ ID NO: 3249 - protein, 28 aa, Artificial Sequence
  Description of Artificial Sequence: Synthetic peptide
DEEEIRTTNCVATEQYGSFSTNLQRGNR

SEQ ID NO: 3250 - protein, 28 aa, Artificial Sequence
  Description of Artificial Sequence: Synthetic peptide
DEEEIRTTNCVATEQYGSISTNLQRGNR

SEQ ID NO: 3251 - protein, 30 aa, Artificial Sequence
  Description of Artificial Sequence: Synthetic polypeptide
DEEEIRTTNPVATEQYGMSVSTGNLQRGNR

SEQ ID NO: 3252 - protein, 28 aa, Artificial Sequence
  Description of Artificial Sequence: Synthetic peptide
DEEEIRTTNCVATEQYGSVSCNLQRGNR

SEQ ID NO: 3253 - protein, 29 aa, Artificial Sequence
  Description of Artificial Sequence: Synthetic peptide
DEEEIRTTNPVATEQYGMSVSCNLQRGNR

SEQ ID NO: 3254 - protein, 29 aa, Artificial Sequence
  Description of Artificial Sequence: Synthetic peptide
DEEEIRTTNPVATEQYGMSVSANLQRGNR

SEQ ID NO: 3255 - protein, 28 aa, Artificial Sequence
  Description of Artificial Sequence: Synthetic peptide
DEEEIRTTNPCATEQYGSVSTNLQPGNR

SEQ ID NO: 3256 - protein, 28 aa, Artificial Sequence
  Description of Artificial Sequence: Synthetic peptide
DEEEIRTTNPVATEQYGSVHTNGQRGNR

SEQ ID NO: 3257 - protein, 29 aa, Artificial Sequence
  Description of Artificial Sequence: Synthetic peptide
DEEEIRTTNPVATEQYGMSTSTNLQRGNR

SEQ ID NO: 3258 - protein, 30 aa, Artificial Sequence
  Description of Artificial Sequence: Synthetic polypeptide
DEEEIRTTNPVATEQYGSVTSTMNLQRGNR

SEQ ID NO: 3259 - protein, 29 aa, Artificial Sequence
  Description of Artificial Sequence: Synthetic peptide
DEEEIRTTNCVATEQYGSVSTNLQARGNR

SEQ ID NO: 3260 - protein, 28 aa, Artificial Sequence
  Description of Artificial Sequence: Synthetic peptide
DEEEIRTTNPVATECYGSVSTNLQRGNM

SEQ ID NO: 3261 - protein, 28 aa, Artificial Sequence
  Description of Artificial Sequence: Synthetic peptide
DEEEIRTTNCVATEQYGSVSTNLQQGNR

SEQ ID NO: 3262 - protein, 29 aa, Artificial Sequence
  Description of Artificial Sequence: Synthetic peptide
DEEEIRTTNPVATECYGSVSTNLQRGNRS

SEQ ID NO: 3263 - protein, 28 aa, Artificial Sequence
  Description of Artificial Sequence: Synthetic peptide
DEEEIRTTNCVATEQYGSVSTNLQRDNR

SEQ ID NO: 3264 - protein, 28 aa, Artificial Sequence
  Description of Artificial Sequence: Synthetic peptide
DEEEIRTTNCVATEQYGSVSTNLQRGNA

SEQ ID NO: 3265 - protein, 29 aa, Artificial Sequence
  Description of Artificial Sequence: Synthetic peptide
DEEEIRTTNPVATEQYGSVSNQNLQRGNR

SEQ ID NO: 3266 - protein, 29 aa, Artificial Sequence
  Description of Artificial Sequence: Synthetic peptide
DEEEIRTTNCVATEQYGSVSTNLQRGNRD

SEQ ID NO: 3267 - protein, 30 aa, Artificial Sequence
  Description of Artificial Sequence: Synthetic polypeptide
DEEEIRTTNPVATEQYGSVTSTNLQRGGNR

SEQ ID NO: 3268 - protein, 28 aa, Artificial Sequence
  Description of Artificial Sequence: Synthetic peptide
VEEEIRTTNPVATEDYGSVSTNLQRGNR

SEQ ID NO: 3269 - protein, 30 aa, Artificial Sequence
  Description of Artificial Sequence: Synthetic polypeptide
DEEEIRTTNPVATEQYGSVTSTNLQRGNER

SEQ ID NO: 3270 - protein, 28 aa, Artificial Sequence
  Description of Artificial Sequence: Synthetic peptide
DEEEIRTTNPVATEQYGSVSTNLDHGNR

SEQ ID NO: 3271 - protein, 28 aa, Artificial Sequence
  Description of Artificial Sequence: Synthetic peptide
DEEEIRTTNPVATEDFGSVSTNLQRGNR

SEQ ID NO: 3272 - protein, 28 aa, Artificial Sequence
  Description of Artificial Sequence: Synthetic peptide
DEEEIRTTNPVATEDYGSISTNLQRGNR

SEQ ID NO: 3273 - protein, 28 aa, Artificial Sequence
  Description of Artificial Sequence: Synthetic peptide
DEEEIRTTNPVATEQYGLVSCNLQRGNR

SEQ ID NO: 3274 - protein, 28 aa, Artificial Sequence
  Description of Artificial Sequence: Synthetic peptide
DEEEIRTTNPVATEDYGSMSTNLQRGNR

SEQ ID NO: 3275 - protein, 29 aa, Artificial Sequence
  Description of Artificial Sequence: Synthetic peptide
DEEEIRTTNPVATEDYGSVSTNLQGRGNR

SEQ ID NO: 3276 - protein, 30 aa, Artificial Sequence
  Description of Artificial Sequence: Synthetic polypeptide
DEEEIRTTNPVATEQYGSVTSTYNLQRGNR

SEQ ID NO: 3277 - protein, 29 aa, Artificial Sequence
  Description of Artificial Sequence: Synthetic peptide
DEEEIRTTNPVATEQYGLVSATNLQRGNR

SEQ ID NO: 3278 - protein, 28 aa, Artificial Sequence
  Description of Artificial Sequence: Synthetic peptide
DEEEIRTTNPVATEDYGSVSTNLQRGMR

SEQ ID NO: 3279 - protein, 28 aa, Artificial Sequence
  Description of Artificial Sequence: Synthetic peptide
DEEEIRTTNPVATEDYGSVSTNLQRGNW

SEQ ID NO: 3280 - protein, 28 aa, Artificial Sequence
  Description of Artificial Sequence: Synthetic peptide
DEEEIRTTNPVATEDYGSVSTNLQRGQR

SEQ ID NO: 3281 - protein, 28 aa, Artificial Sequence
  Description of Artificial Sequence: Synthetic peptide
DEEEIRTTNPVATEDYGSVSWNLQRGNR

SEQ ID NO: 3282 - protein, 30 aa, Artificial Sequence
  Description of Artificial Sequence: Synthetic polypeptide
DEEEIRTTNPVATEEQYGSVSTNLDQRGNR

SEQ ID NO: 3283 - protein, 28 aa, Artificial Sequence
  Description of Artificial Sequence: Synthetic peptide
DEEEIRTTNPVATEQYGLVNTNLQRGNR

SEQ ID NO: 3284 - protein, 29 aa, Artificial Sequence
  Description of Artificial Sequence: Synthetic peptide
DEEEIRTTNPVATEEQYGSVSTNLQNGNR

SEQ ID NO: 3285 - protein, 30 aa, Artificial Sequence
  Description of Artificial Sequence: Synthetic polypeptide
DEEEIRTTNPVATEQYGLSVSTNLQRGNGR

SEQ ID NO: 3286 - protein, 30 aa, Artificial Sequence
  Description of Artificial Sequence: Synthetic polypeptide
DEEEIRTTNPVATEQYGSVSTNLCQRGNTR

SEQ ID NO: 3287 - protein, 30 aa, Artificial Sequence
  Description of Artificial Sequence: Synthetic polypeptide
DEEEIRTTNPVATEQYGLSVDSTNLQRGNR

SEQ ID NO: 3288 - protein, 30 aa, Artificial Sequence
  Description of Artificial Sequence: Synthetic polypeptide
DEEEIRTTNPVATEQYGSVSTNLCQDRGNR

SEQ ID NO: 3289 - protein, 28 aa, Artificial Sequence
  Description of Artificial Sequence: Synthetic peptide
DEEEIRTTNPVATEQYGSVSTNLCNGNR

SEQ ID NO: 3290 - protein, 29 aa, Artificial Sequence
  Description of Artificial Sequence: Synthetic peptide
DEEEIRTTNPVATEQYGLVSTMNLQRGNR

SEQ ID NO: 3291 - protein, 30 aa, Artificial Sequence
  Description of Artificial Sequence: Synthetic polypeptide
DEEEIRTTNPVATEQYGMSVSTNLEQRGNR

SEQ ID NO: 3292 - protein, 28 aa, Artificial Sequence
  Description of Artificial Sequence: Synthetic peptide
DEEEIRTTNPVATEQYGLVSTNCQRGNR

SEQ ID NO: 3293 - protein, 30 aa, Artificial Sequence
  Description of Artificial Sequence: Synthetic polypeptide
DEEEIRTTNPVATEQYGSVTSTTNLQRGNR

SEQ ID NO: 3294 - protein, 30 aa, Artificial Sequence
  Description of Artificial Sequence: Synthetic polypeptide
DEEEIRTTNPVATEQYGSVTSTNLQRGNPR

SEQ ID NO: 3295 - protein, 28 aa, Artificial Sequence
  Description of Artificial Sequence: Synthetic peptide
DEEEIRTTNPVATEQYGLVSTNLQRENR

SEQ ID NO: 3296 - protein, 30 aa, Artificial Sequence
  Description of Artificial Sequence: Synthetic polypeptide
DEEEIRTTNPVATEQYGSVTSTNLQRGNTR

SEQ ID NO: 3297 - protein, 30 aa, Artificial Sequence
  Description of Artificial Sequence: Synthetic polypeptide
DEEEIRTTNPVATEQYGSVTSTNLQRGNVR

SEQ ID NO: 3298 - protein, 30 aa, Artificial Sequence
  Description of Artificial Sequence: Synthetic polypeptide
DEEEIRTTNPVATEQYGSVTSTNLQRMGNR

SEQ ID NO: 3299 - protein, 30 aa, Artificial Sequence
  Description of Artificial Sequence: Synthetic polypeptide
DEEEIRTTNPVATEQYGSVTSTNLQRPGNR

SEQ ID NO: 3300 - protein, 28 aa, Artificial Sequence
  Description of Artificial Sequence: Synthetic peptide
DEEEIRTTNPVATEQYGLVSTNLQMGNR

SEQ ID NO: 3301 - protein, 30 aa, Artificial Sequence
  Description of Artificial Sequence: Synthetic polypeptide
DEEEIRTTNPVATEQYGSVTSTNLQRTGNR

SEQ ID NO: 3302 - protein, 30 aa, Artificial Sequence
  Description of Artificial Sequence: Synthetic polypeptide
DEEEIRTTNPVATEQYGSVTSTNLTQRGNR

SEQ ID NO: 3303 - protein, 28 aa, Artificial Sequence
  Description of Artificial Sequence: Synthetic peptide
DEEEIRTTNPVAYEQYGSVATNLQRGNR

SEQ ID NO: 3304 - protein, 29 aa, Artificial Sequence
  Description of Artificial Sequence: Synthetic peptide
DEEEIRTTNPVATEQYGSVTSTNPQRGNR

SEQ ID NO: 3305 - protein, 28 aa, Artificial Sequence
  Description of Artificial Sequence: Synthetic peptide
DEEEIRTTNPVATEQYGSVSTNLCVGNR

SEQ ID NO: 3306 - protein, 29 aa, Artificial Sequence
  Description of Artificial Sequence: Synthetic peptide
DEEEIRTTNPVATEQYGSVTSTQLQRGNR

SEQ ID NO: 3307 - protein, 29 aa, Artificial Sequence
  Description of Artificial Sequence: Synthetic peptide
DEEEIRTTNPVATEQYGLVSTNLGQRGNR

SEQ ID NO: 3308 - protein, 29 aa, Artificial Sequence
  Description of Artificial Sequence: Synthetic peptide
DEECIRTTNPVATEQYGSVSTLNLQRGNR

SEQ ID NO: 3309 - protein, 30 aa, Artificial Sequence
  Description of Artificial Sequence: Synthetic polypeptide
DEEEIRTTNPVATEQYGSVSGTANLQRGNR

SEQ ID NO: 3310 - protein, 28 aa, Artificial Sequence
  Description of Artificial Sequence: Synthetic peptide
DECEIRTTNPVATEQYGSVDTNLQRGNR

SEQ ID NO: 3311 - protein, 29 aa, Artificial Sequence
  Description of Artificial Sequence: Synthetic peptide
DEEEIRTTNPVATEQYGSVSTNLCRGQNR

SEQ ID NO: 3312 - protein, 29 aa, Artificial Sequence
  Description of Artificial Sequence: Synthetic peptide
DEEEIRTTNPVATEQYGSVSTNLCRGPNR

SEQ ID NO: 3313 - protein, 28 aa, Artificial Sequence
  Description of Artificial Sequence: Synthetic peptide
DEEEIRTTNPVATEQYGLVSTNLARGNR

SEQ ID NO: 3314 - protein, 28 aa, Artificial Sequence
  Description of Artificial Sequence: Synthetic peptide
DEEEIRTTNPVAYEQYGSSSTNLQRGNR

SEQ ID NO: 3315 - protein, 29 aa, Artificial Sequence
  Description of Artificial Sequence: Synthetic peptide
DEEEIRTTNPVATECYGSVSTNLQARGNR

SEQ ID NO: 3316 - protein, 28 aa, Artificial Sequence
  Description of Artificial Sequence: Synthetic peptide
DEEEIRTTNPVAYEQYGSVSTNLDRGNR

SEQ ID NO: 3317 - protein, 28 aa, Artificial Sequence
  Description of Artificial Sequence: Synthetic peptide
PEEEIRTTNPVATEQYGSVSTNLQAGNR

SEQ ID NO: 3318 - protein, 29 aa, Artificial Sequence
  Description of Artificial Sequence: Synthetic peptide
DEEEIRTTNPVATEQYGSVSTNLDQRINR

SEQ ID NO: 3319 - protein, 28 aa, Artificial Sequence
  Description of Artificial Sequence: Synthetic peptide
DEEEIRTTNPVAYEQYGVVSTNLQRGNR

SEQ ID NO: 3320 - protein, 28 aa, Artificial Sequence
  Description of Artificial Sequence: Synthetic peptide
DECEIRTTNPVAHEQYGSVSTNLQRGNR

SEQ ID NO: 3321 - protein, 30 aa, Artificial Sequence
  Description of Artificial Sequence: Synthetic polypeptide
DEEEIRTTNPVATEQYGSVGSVTNLQRGNR

SEQ ID NO: 3322 - protein, 29 aa, Artificial Sequence
  Description of Artificial Sequence: Synthetic peptide
DEEEIRTTNPVATEQYGSVGTCNLQRGNR

SEQ ID NO: 3323 - protein, 28 aa, Artificial Sequence
  Description of Artificial Sequence: Synthetic peptide
DEEEIRTTNPVATEQYGSVGTMLQRGNR

SEQ ID NO: 3324 - protein, 30 aa, Artificial Sequence
  Description of Artificial Sequence: Synthetic polypeptide
DEEEIRTTNPVATEQYGSVSTNLDQRGNDR

SEQ ID NO: 3325 - protein, 29 aa, Artificial Sequence
  Description of Artificial Sequence: Synthetic peptide
PEEEIRTTNPVATEQYGSVSTNLPQRGNR

SEQ ID NO: 3326 - protein, 30 aa, Artificial Sequence
  Description of Artificial Sequence: Synthetic polypeptide
DEEEIRTTNPVATEQYGMSVVSTNLQRGNR

SEQ ID NO: 3327 - protein, 29 aa, Artificial Sequence
  Description of Artificial Sequence: Synthetic peptide
DEEEIRTTNPVATEQYGSVGTNLQGRGNR

SEQ ID NO: 3328 - protein, 30 aa, Artificial Sequence
  Description of Artificial Sequence: Synthetic polypeptide
DEEEIRTTNPVATEQYGMSVSVTNLQRGNR

SEQ ID NO: 3329 - protein, 28 aa, Artificial Sequence
  Description of Artificial Sequence: Synthetic peptide
DEEEIRTTNPVATEQYGSVGTNLQLGNR

SEQ ID NO: 3330 - protein, 29 aa, Artificial Sequence
  Description of Artificial Sequence: Synthetic peptide
DEEEIRTTNPVATEQYGMSVSTNYQRGNR

SEQ ID NO: 3331 - protein, 30 aa, Artificial Sequence
  Description of Artificial Sequence: Synthetic polypeptide
DEEEIRTTNPVATEQYGMSVSTNLQRGNTR

SEQ ID NO: 3332 - protein, 29 aa, Artificial Sequence
  Description of Artificial Sequence: Synthetic peptide
DEEEIRTTNPVATEQYGSVGTNLQQRGNR

SEQ ID NO: 3333 - protein, 28 aa, Artificial Sequence
  Description of Artificial Sequence: Synthetic peptide
DEEEIRTTNPVATEQYGSVGTNLQRENR

SEQ ID NO: 3334 - protein, 28 aa, Artificial Sequence
  Description of Artificial Sequence: Synthetic peptide
DEEEIRTTNPVATEQYGSVGTNLQRGAR

SEQ ID NO: 3335 - protein, 28 aa, Artificial Sequence
  Description of Artificial Sequence: Synthetic peptide
DEEEIRTTNPVATEQYGSVGTNLQAGNR

SEQ ID NO: 3336 - protein, 30 aa, Artificial Sequence
  Description of Artificial Sequence: Synthetic polypeptide
DEEEIRTTNPVATEQYGSVSTNLDQRPGNR

SEQ ID NO: 3337 - protein, 29 aa, Artificial Sequence
  Description of Artificial Sequence: Synthetic peptide
DEEEIRTTNPVATEQYGSVSTMNLMRGNR

SEQ ID NO: 3338 - protein, 28 aa, Artificial Sequence
  Description of Artificial Sequence: Synthetic peptide
DEEEIRTTNPVAYETYGSVSTNLQRGNR

SEQ ID NO: 3339 - protein, 30 aa, Artificial Sequence
  Description of Artificial Sequence: Synthetic polypeptide
DEEEIRTTNPVATEQYGSVGSTNLQQRGNR

SEQ ID NO: 3340 - protein, 29 aa, Artificial Sequence
  Description of Artificial Sequence: Synthetic peptide
DEEEIRTTNPVATECYGQSVSTNLQRGNR

SEQ ID NO: 3341 - protein, 29 aa, Artificial Sequence
  Description of Artificial Sequence: Synthetic peptide
DEEEIRTTNPVATEQYGSVGSTNLQRGER

SEQ ID NO: 3342 - protein, 28 aa, Artificial Sequence
  Description of Artificial Sequence: Synthetic peptide
DEEEIRTTNPVATEQYGSVQTNLQDGNR

SEQ ID NO: 3343 - protein, 28 aa, Artificial Sequence
  Description of Artificial Sequence: Synthetic peptide
DEEEIRTTNPVATECYGSDSTNLQRGNR

SEQ ID NO: 3344 - protein, 29 aa, Artificial Sequence
  Description of Artificial Sequence: Synthetic peptide
DEEEIRTTNPVATECYGSQVSTNLQRGNR

SEQ ID NO: 3345 - protein, 30 aa, Artificial Sequence
  Description of Artificial Sequence: Synthetic polypeptide
DEEEIRTTNPVATEQYGSVGSTNLQRGNRI

SEQ ID NO: 3346 - protein, 30 aa, Artificial Sequence
  Description of Artificial Sequence: Synthetic polypeptide
DEEEIRTTNPVATEQYGSVGSTNLQRLGNR

SEQ ID NO: 3347 - protein, 29 aa, Artificial Sequence
  Description of Artificial Sequence: Synthetic peptide
DEEEIRTTNPVATEQYGSVQTNLMQRGNR

SEQ ID NO: 3348 - protein, 28 aa, Artificial Sequence
  Description of Artificial Sequence: Synthetic peptide
DEEEIRTTNPVATEQYGSVSTNLDRGNM

SEQ ID NO: 3349 - protein, 28 aa, Artificial Sequence
  Description of Artificial Sequence: Synthetic peptide
DECEIRGTNPVATEQYGSVSTNLQRGNR

SEQ ID NO: 3350 - protein, 28 aa, Artificial Sequence
  Description of Artificial Sequence: Synthetic peptide
DEEEIRTCNPVATEQYGSVSTNIQRGNR

SEQ ID NO: 3351 - protein, 29 aa, Artificial Sequence
  Description of Artificial Sequence: Synthetic peptide
DEEEIRTTNPVATEQYGSVGSTNMQRGNR

SEQ ID NO: 3352 - protein, 28 aa, Artificial Sequence
  Description of Artificial Sequence: Synthetic peptide
DEEEIRTCNPVATEQYGSVSTNLQRGNY

SEQ ID NO: 3353 - protein, 29 aa, Artificial Sequence
  Description of Artificial Sequence: Synthetic peptide
DEEEIRTCNPVATEQYGSVSTNLTQRGNR

SEQ ID NO: 3354 - protein, 30 aa, Artificial Sequence
  Description of Artificial Sequence: Synthetic polypeptide
DEEEIRTTNPVATEQYGSVGSTNWLQRGNR

SEQ ID NO: 3355 - protein, 28 aa, Artificial Sequence
  Description of Artificial Sequence: Synthetic peptide
DEEEIRTTNPVCTEAYGSVSTNLQRGNR

SEQ ID NO: 3356 - protein, 29 aa, Artificial Sequence
  Description of Artificial Sequence: Synthetic peptide
DEEEIRTTNPVATEQYGSVSTNLDRCGNR

SEQ ID NO: 3357 - protein, 30 aa, Artificial Sequence
  Description of Artificial Sequence: Synthetic polypeptide
DEEEIRTTNPVATEQYGSVSTNLDQRSGNR

SEQ ID NO: 3358 - protein, 29 aa, Artificial Sequence
  Description of Artificial Sequence: Synthetic peptide
DEEEIRTTNPVATEQYGSVGTNLQRGNPR

SEQ ID NO: 3359 - protein, 28 aa, Artificial Sequence
  Description of Artificial Sequence: Synthetic peptide
DEEEIRTTNPVATECYGSVSDNLQRGNR

SEQ ID NO: 3360 - protein, 29 aa, Artificial Sequence
  Description of Artificial Sequence: Synthetic peptide
DEEEIRTTNPVATEQYGSVGTNLQRGNSR

SEQ ID NO: 3361 - protein, 28 aa, Artificial Sequence
  Description of Artificial Sequence: Synthetic peptide
DEEEIRTTNPVATEQYGSVGTNLQRGNV

SEQ ID NO: 3362 - protein, 29 aa, Artificial Sequence
  Description of Artificial Sequence: Synthetic peptide
DEEEIRTTNPVATEQYGSVHSTNLQRGNP

SEQ ID NO: 3363 - protein, 30 aa, Artificial Sequence
  Description of Artificial Sequence: Synthetic polypeptide
DEEEIRTTNPVATEQYGSVHSTNLQRGNRL

SEQ ID NO: 3364 - protein, 29 aa, Artificial Sequence
  Description of Artificial Sequence: Synthetic peptide
DEEEIRTTNPVATEQYGSVHSTNLQRGNY

SEQ ID NO: 3365 - protein, 30 aa, Artificial Sequence
  Description of Artificial Sequence: Synthetic polypeptide
DEEEIRTTNPVATEQYGSVHSTNLQRIGNR

SEQ ID NO: 3366 - protein, 29 aa, Artificial Sequence
  Description of Artificial Sequence: Synthetic peptide
DEEEIRTTHPVATEQYGSVSTNLQIRGNR

SEQ ID NO: 3367 - protein, 28 aa, Artificial Sequence
  Description of Artificial Sequence: Synthetic peptide
DEEEIRTTNAVATEQYGSVSTNIQRGNR

SEQ ID NO: 3368 - protein, 28 aa, Artificial Sequence
  Description of Artificial Sequence: Synthetic peptide
DEEEIRTTNAVATEQYGSVSTNLQQGNR

SEQ ID NO: 3369 - protein, 30 aa, Artificial Sequence
  Description of Artificial Sequence: Synthetic polypeptide
DEEEIRTTNPVATEQYGSVHSTNLTQRGNR

SEQ ID NO: 3370 - protein, 28 aa, Artificial Sequence
  Description of Artificial Sequence: Synthetic peptide
DEEEIRTTNAVATEQYGSVSVNLQRGNR

SEQ ID NO: 3371 - protein, 28 aa, Artificial Sequence
  Description of Artificial Sequence: Synthetic peptide
DEEEIRTTNPCATEQYGSVSTNLQRGDR

SEQ ID NO: 3372 - protein, 30 aa, Artificial Sequence
  Description of Artificial Sequence: Synthetic polypeptide
DEEEIRTTNPVATEQYGMSVSTNLQRGFNR

SEQ ID NO: 3373 - protein, 28 aa, Artificial Sequence
  Description of Artificial Sequence: Synthetic peptide
DEEEIRTTNPVATEQYGSVHTCLQRGNR

SEQ ID NO: 3374 - protein, 28 aa, Artificial Sequence
  Description of Artificial Sequence: Synthetic peptide
DEEEIRTTNPVAYEQYGSVSTNLQRVNR

SEQ ID NO: 3375 - protein, 29 aa, Artificial Sequence
  Description of Artificial Sequence: Synthetic peptide
DEEEIRTTNPVAYEQYGSVSTNLQRLGNR

SEQ ID NO: 3376 - protein, 29 aa, Artificial Sequence
  Description of Artificial Sequence: Synthetic peptide
DEEEIRTTNPVAYEQYGSVSTNLQRGNRQ

SEQ ID NO: 3377 - protein, 29 aa, Artificial Sequence
  Description of Artificial Sequence: Synthetic peptide
DEEEIRTTNPVAYEQYGSVSTNLQRGNIR

SEQ ID NO: 3378 - protein, 29 aa, Artificial Sequence
  Description of Artificial Sequence: Synthetic peptide
DEEEIRTTNPVAYEQYGSVSTNLQRDGNR

SEQ ID NO: 3379 - protein, 29 aa, Artificial Sequence
  Description of Artificial Sequence: Synthetic peptide
DEEEIRTTNPVAYEQYGSVSTNLQNRGNR

SEQ ID NO: 3380 - protein, 28 aa, Artificial Sequence
  Description of Artificial Sequence: Synthetic peptide
DEEEIRTTNPVAYEQYGSVSTNLQDGNR

SEQ ID NO: 3381 - protein, 29 aa, Artificial Sequence
  Description of Artificial Sequence: Synthetic peptide
DEEEIRTTNPVATEQYGSVHSTNLQRGMR

SEQ ID NO: 3382 - protein, 30 aa, Artificial Sequence
  Description of Artificial Sequence: Synthetic polypeptide
DEEEIRTTNPVATEQYGMSVSTNLQDRGNR

SEQ ID NO: 3383 - protein, 29 aa, Artificial Sequence
  Description of Artificial Sequence: Synthetic peptide
DEEEIRTTNPVATEQYGSVHSTNEQRGNR

SEQ ID NO: 3384 - protein, 28 aa, Artificial Sequence
  Description of Artificial Sequence: Synthetic peptide
DEEEIRTTNPCATEQYGSVSTNLQRGNG

SEQ ID NO: 3385 - protein, 29 aa, Artificial Sequence
  Description of Artificial Sequence: Synthetic peptide
DEEEIRTTNPVATEQYGSVGTNLQRGSNR

SEQ ID NO: 3386 - protein, 29 aa, Artificial Sequence
  Description of Artificial Sequence: Synthetic peptide
DEEEIRTTNPVATEQYGMSVSTNLQRGNQ

SEQ ID NO: 3387 - protein, 29 aa, Artificial Sequence
  Description of Artificial Sequence: Synthetic peptide
DEEEIRTTNPVATEQYGMSVSTNLQRGNM

SEQ ID NO: 3388 - protein, 28 aa, Artificial Sequence
  Description of Artificial Sequence: Synthetic peptide
DEEEIRTTNPVAYEQYGSYSTNLQRGNR

SEQ ID NO: 3389 - protein, 29 aa, Artificial Sequence
  Description of Artificial Sequence: Synthetic peptide
DEEEIRTTNPVATEQYGMSVSTNLQRGNF

SEQ ID NO: 3390 - protein, 29 aa, Artificial Sequence
  Description of Artificial Sequence: Synthetic peptide
DEEEIRTTNPVATEQYGSVGTNTLQRGNR

SEQ ID NO: 3391 - protein, 29 aa, Artificial Sequence
  Description of Artificial Sequence: Synthetic peptide
DEEEIRTTNPVATEQYGMSVSTNLQRGND

SEQ ID NO: 3392 - protein, 29 aa, Artificial Sequence
  Description of Artificial Sequence: Synthetic peptide
DEEEIRTCTNPVATEQYGSVSTNLQRGNG

SEQ ID NO: 3393 - protein, 29 aa, Artificial Sequence
  Description of Artificial Sequence: Synthetic peptide
DEEEIRTHCNPVATEQYGSVSTNLQRGNR

SEQ ID NO: 3394 - protein, 28 aa, Artificial Sequence
  Description of Artificial Sequence: Synthetic peptide
DEEEIRTTNPVATECYGSVSPNLQRGNR

SEQ ID NO: 3395 - protein, 28 aa, Artificial Sequence
  Description of Artificial Sequence: Synthetic peptide
DEEEIRTTNPVATEQYGSVGTYLQRGNR

SEQ ID NO: 3396 - protein, 29 aa, Artificial Sequence
  Description of Artificial Sequence: Synthetic peptide
DEEEIRTKTNPVATEQYGSVSTNEQRGNR

SEQ ID NO: 3397 - protein, 28 aa, Artificial Sequence
  Description of Artificial Sequence: Synthetic peptide
DEEEIRTTNPCATEQYGSVSTNLQRGNS

SEQ ID NO: 3398 - protein, 29 aa, Artificial Sequence
  Description of Artificial Sequence: Synthetic peptide
DEEEIRTTNPVATEQYGSVGVTNLQRGNR

SEQ ID NO: 3399 - protein, 29 aa, Artificial Sequence
  Description of Artificial Sequence: Synthetic peptide
DEEEIRTTNPCATEQYGSVSTNLQRGNRA

SEQ ID NO: 3400 - protein, 28 aa, Artificial Sequence
  Description of Artificial Sequence: Synthetic peptide
DEEEIRTTNPVATECYGSVSSNLQRGNR

SEQ ID NO: 3401 - protein, 29 aa, Artificial Sequence
  Description of Artificial Sequence: Synthetic peptide
DEEEIRTTNPVATEQYGSVGYTNLQRGNR

SEQ ID NO: 3402 - protein, 28 aa, Artificial Sequence
  Description of Artificial Sequence: Synthetic peptide
DEEEIRTTNPVATEQYGSVHENLQRGNR

SEQ ID NO: 3403 - protein, 28 aa, Artificial Sequence
  Description of Artificial Sequence: Synthetic peptide
DEECIRTTNPVATEQYGSVSTALQRGNR

SEQ ID NO: 3404 - protein, 29 aa, Artificial Sequence
  Description of Artificial Sequence: Synthetic peptide
DEEEIRTTNPCATEQYGSVSTNLQRGNDR

SEQ ID NO: 3405 - protein, 28 aa, Artificial Sequence
  Description of Artificial Sequence: Synthetic peptide
DEEEIRTTNPVATWQYGSVSTNLQRGNS

SEQ ID NO: 3406 - protein, 28 aa, Artificial Sequence
  Description of Artificial Sequence: Synthetic peptide
DEEEIRTTNPVATEPYGSVSTNLQRPNR

SEQ ID NO: 3407 - protein, 28 aa, Artificial Sequence
  Description of Artificial Sequence: Synthetic peptide
DEEEIRTTNPVATEPYGSVSTNLQRNNR

SEQ ID NO: 3408 - protein, 29 aa, Artificial Sequence
  Description of Artificial Sequence: Synthetic peptide
DEEEIRTTNPVATEIYGSVASTNLQRGNR

SEQ ID NO: 3409 - protein, 28 aa, Artificial Sequence
  Description of Artificial Sequence: Synthetic peptide
DEECIRTTNPVATEQYWSVSTNLQRGNR

SEQ ID NO: 3410 - protein, 29 aa, Artificial Sequence
  Description of Artificial Sequence: Synthetic peptide
DEEEIRTTNPVATEQYGSVSTNGLARGNR

SEQ ID NO: 3411 - protein, 28 aa, Artificial Sequence
  Description of Artificial Sequence: Synthetic peptide
DEEEIRTTNPVATEIYGAVSTNLQRGNR

SEQ ID NO: 3412 - protein, 29 aa, Artificial Sequence
  Description of Artificial Sequence: Synthetic peptide
DEEEIRTTNPVATEIQYGSVSTNLQNGNR

SEQ ID NO: 3413 - protein, 28 aa, Artificial Sequence
  Description of Artificial Sequence: Synthetic peptide
DEEEIRTTNPVATEIHGSVSTNLQRGNR

SEQ ID NO: 3414 - protein, 28 aa, Artificial Sequence
  Description of Artificial Sequence: Synthetic peptide
DEEEIRTTNPVATEHYGYVSTNLQRGNR

SEQ ID NO: 3415 - protein, 29 aa, Artificial Sequence
  Description of Artificial Sequence: Synthetic peptide
DEEEIRTTNPVATEQYGSVYSTNLQQGNR

SEQ ID NO: 3416 - protein, 29 aa, Artificial Sequence
  Description of Artificial Sequence: Synthetic peptide
DEEEIRTTNPVATEIYGSVMSTNLQRGNR

SEQ ID NO: 3417 - protein, 29 aa, Artificial Sequence
  Description of Artificial Sequence: Synthetic peptide
DEEEIRTTNPVATEQYGSVYSTNLQRGER

SEQ ID NO: 3418 - protein, 30 aa, Artificial Sequence
  Description of Artificial Sequence: Synthetic polypeptide
DEEEIRTTNPVATEQYGSVYSTNLQRGNDR

SEQ ID NO: 3419 - protein, 30 aa, Artificial Sequence
  Description of Artificial Sequence: Synthetic polypeptide
DEEEIRTTNPVATEQYGSVYSTNLQRGNRD

SEQ ID NO: 3420 - protein, 30 aa, Artificial Sequence
  Description of Artificial Sequence: Synthetic polypeptide
DEEEIRTTNPVATEQYGSVYSTNLQRGNSR

SEQ ID NO: 3421 - protein, 29 aa, Artificial Sequence
  Description of Artificial Sequence: Synthetic peptide
DEEEIRTTNPVATEQYGSVYSTNLQRGVR

SEQ ID NO: 3422 - protein, 28 aa, Artificial Sequence
  Description of Artificial Sequence: Synthetic peptide
DEEEIRTTNPVATEHYGSVSTNNQRGNR

SEQ ID NO: 3423 - protein, 29 aa, Artificial Sequence
  Description of Artificial Sequence: Synthetic peptide
DEEEIRTTNPVATEHYGSVSTNLTQRGNR

SEQ ID NO: 3424 - protein, 28 aa, Artificial Sequence
  Description of Artificial Sequence: Synthetic peptide
DEEEIRTTNPVATEHYGSVSTNLQVGNR

SEQ ID NO: 3425 - protein, 29 aa, Artificial Sequence
  Description of Artificial Sequence: Synthetic peptide
DEEEIRTTNPVATEHYGSVSTNLQRSGNR

SEQ ID NO: 3426 - protein, 30 aa, Artificial Sequence
  Description of Artificial Sequence: Synthetic polypeptide
DEEEIRTTNPVATEQYGSVYSTNLQRGINR

SEQ ID NO: 3427 - protein, 29 aa, Artificial Sequence
  Description of Artificial Sequence: Synthetic peptide
DEEEIRTTNPVATEQYGSVSTNGLGRGNR

SEQ ID NO: 3428 - protein, 28 aa, Artificial Sequence
  Description of Artificial Sequence: Synthetic peptide
DEEEIRTTNPVATEIYGSVSTALQRGNR

SEQ ID NO: 3429 - protein, 29 aa, Artificial Sequence
  Description of Artificial Sequence: Synthetic peptide
DEEEIRTTNPVATEIYGSVSTNFLQRGNR

SEQ ID NO: 3430 - protein, 29 aa, Artificial Sequence
  Description of Artificial Sequence: Synthetic peptide
DEEEIRTTNPVATELYGSVSTNLQGRGNR

SEQ ID NO: 3431 - protein, 29 aa, Artificial Sequence
  Description of Artificial Sequence: Synthetic peptide
DEEEIRTTNPVATELYGSVSTNLQERGNR

SEQ ID NO: 3432 - protein, 29 aa, Artificial Sequence
  Description of Artificial Sequence: Synthetic peptide
DEEEIRTTNPVATEQYGSVSTNGLQRGDR

SEQ ID NO: 3433 - protein, 28 aa, Artificial Sequence
  Description of Artificial Sequence: Synthetic peptide
DEEEIRTTNPVATELYGSVSTNDQRGNR

SEQ ID NO: 3434 - protein, 28 aa, Artificial Sequence
  Description of Artificial Sequence: Synthetic peptide
DEEEIRTTNPVATELYGSVSNNLQRGNR

SEQ ID NO: 3435 - protein, 28 aa, Artificial Sequence
  Description of Artificial Sequence: Synthetic peptide
DEEEIRTTNPVATELYGSTSTNLQRGNR

SEQ ID NO: 3436 - protein, 28 aa, Artificial Sequence
  Description of Artificial Sequence: Synthetic peptide
DEEEIRTTNPVATELYGMVSTNLQRGNR

SEQ ID NO: 3437 - protein, 30 aa, Artificial Sequence
  Description of Artificial Sequence: Synthetic polypeptide
DEEEIRTTNPVATELQYGSVSYTNLQRGNR

SEQ ID NO: 3438 - protein, 28 aa, Artificial Sequence
  Description of Artificial Sequence: Synthetic peptide
DEEEIRTTNPVATEKYGSVSTNLQTGNR

SEQ ID NO: 3439 - protein, 28 aa, Artificial Sequence
  Description of Artificial Sequence: Synthetic peptide
DEEEIRTTNPVATEKYGSVSTNLQRGNC

SEQ ID NO: 3440 - protein, 29 aa, Artificial Sequence
  Description of Artificial Sequence: Synthetic peptide
DEEEIRTTNPVATEKYGSVSTNLQREGNR

SEQ ID NO: 3441 - protein, 29 aa, Artificial Sequence
  Description of Artificial Sequence: Synthetic peptide
DEEEIRTTNPVATEKYGSVSTNLQERGNR

SEQ ID NO: 3442 - protein, 28 aa, Artificial Sequence
  Description of Artificial Sequence: Synthetic peptide
DEEEIRTTNPVATEIYGSVSTNMQRGNR

SEQ ID NO: 3443 - protein, 29 aa, Artificial Sequence
  Description of Artificial Sequence: Synthetic peptide
DEEEIRTTNPVATEIYGSVSTNLVQRGNR

SEQ ID NO: 3444 - protein, 29 aa, Artificial Sequence
  Description of Artificial Sequence: Synthetic peptide
DEEEIRTTNPVATEIYGSVSTNLQYRGNR

SEQ ID NO: 3445 - protein, 28 aa, Artificial Sequence
  Description of Artificial Sequence: Synthetic peptide
DEEEIRTTNPVATEIYGSVSTNLQYGNR

SEQ ID NO: 3446 - protein, 29 aa, Artificial Sequence
  Description of Artificial Sequence: Synthetic peptide
DEEEIRTTNPVATEQYGSVSTNGLQCGNR

SEQ ID NO: 3447 - protein, 29 aa, Artificial Sequence
  Description of Artificial Sequence: Synthetic peptide
DEEEIRTTNPVATEIYGSVSTNLQREGNR

SEQ ID NO: 3448 - protein, 28 aa, Artificial Sequence
  Description of Artificial Sequence: Synthetic peptide
DEEEIRTTNPVATEIYGSVSTNLQLGNR

SEQ ID NO: 3449 - protein, 28 aa, Artificial Sequence
  Description of Artificial Sequence: Synthetic peptide
DEEEIRTTNPVATEHYGSVSTNLQRQNR

SEQ ID NO: 3450 - protein, 29 aa, Artificial Sequence
  Description of Artificial Sequence: Synthetic peptide
DEEEIRTTNPVATELYGSVSTNLQRDGNR

SEQ ID NO: 3451 - protein, 28 aa, Artificial Sequence
  Description of Artificial Sequence: Synthetic peptide
DEEEIRTTNPVATEHYGSVSTNLQRINR

SEQ ID NO: 3452 - protein, 29 aa, Artificial Sequence
  Description of Artificial Sequence: Synthetic peptide
DEEEIRTTNPVATEHYGSVSTNLQRGNQR

SEQ ID NO: 3453 - protein, 29 aa, Artificial Sequence
  Description of Artificial Sequence: Synthetic peptide
DEEEIRTTNPVATEQYGSVSTNFQRGNRG

SEQ ID NO: 3454 - protein, 28 aa, Artificial Sequence
  Description of Artificial Sequence: Synthetic peptide
DEEEIRTTNPVATEHYGSVATNLQRGNR

SEQ ID NO: 3455 - protein, 30 aa, Artificial Sequence
  Description of Artificial Sequence: Synthetic polypeptide
DEEEIRTTNPVATEQYGESVSTNLQRGNWR

SEQ ID NO: 3456 - protein, 30 aa, Artificial Sequence
  Description of Artificial Sequence: Synthetic polypeptide
DEEEIRTTNPVATEQYGESVSTNLQRGNRV

SEQ ID NO: 3457 - protein, 30 aa, Artificial Sequence
  Description of Artificial Sequence: Synthetic polypeptide
DEEEIRTTNPVATEQYGESVSTNLQRGNRD

SEQ ID NO: 3458 - protein, 29 aa, Artificial Sequence
  Description of Artificial Sequence: Synthetic peptide
DEEEIRTTNPVATEQYGSVSTNFQQRGNR

SEQ ID NO: 3459 - protein, 29 aa, Artificial Sequence
  Description of Artificial Sequence: Synthetic peptide
DEEEIRTTNPVATEQYGSVYTNCLQRGNR

SEQ ID NO: 3460 - protein, 30 aa, Artificial Sequence
  Description of Artificial Sequence: Synthetic polypeptide
DEEEIRTTNPVATEQYGESVSTNLQRGNGR

SEQ ID NO: 3461 - protein, 30 aa, Artificial Sequence
  Description of Artificial Sequence: Synthetic polypeptide
DEEEIRTTNPVATEQYGESVSTNLQRGQNR

SEQ ID NO: 3462 - protein, 30 aa, Artificial Sequence
  Description of Artificial Sequence: Synthetic polypeptide
DEEEIRTTNPVATEQYGESVSTNLQRGGNR

SEQ ID NO: 3463 - protein, 30 aa, Artificial Sequence
  Description of Artificial Sequence: Synthetic polypeptide
DEEEIRTTNPVATEQYGESVSTNLQIRGNR

SEQ ID NO: 3464 - protein, 29 aa, Artificial Sequence
  Description of Artificial Sequence: Synthetic peptide
DEEEIRTTNPVATEQYGESVSTNEQRGNR

SEQ ID NO: 3465 - protein, 29 aa, Artificial Sequence
  Description of Artificial Sequence: Synthetic peptide
DEEEIRTTNPVATEQYGESVSTNAQRGNR

SEQ ID NO: 3466 - protein, 28 aa, Artificial Sequence
  Description of Artificial Sequence: Synthetic peptide
DEEEIRTTNPVATEQYGSVYTNEQRGNR

SEQ ID NO: 3467 - protein, 28 aa, Artificial Sequence
  Description of Artificial Sequence: Synthetic peptide
DEEEIRTTNPVATEQYGSVSTNFQEGNR

SEQ ID NO: 3468 - protein, 29 aa, Artificial Sequence
  Description of Artificial Sequence: Synthetic peptide
DEEEIRTTNPVATEQYGESVSTGLQRGNR

SEQ ID NO: 3469 - protein, 28 aa, Artificial Sequence
  Description of Artificial Sequence: Synthetic peptide
QEEEIRTTNPVYTEQYGSVSTNLQRGNR

SEQ ID NO: 3470 - protein, 30 aa, Artificial Sequence
  Description of Artificial Sequence: Synthetic polypeptide
DEEEIRTTNPVATEQYGESVSPTNLQRGNR

SEQ ID NO: 3471 - protein, 28 aa, Artificial Sequence
  Description of Artificial Sequence: Synthetic peptide
DEEEIRTTNPVATEQYGSVSTNFQKGNR

SEQ ID NO: 3472 - protein, 28 aa, Artificial Sequence
  Description of Artificial Sequence: Synthetic peptide
DEEEIRTTNPVATEQYGSVSTNFQRGSR

SEQ ID NO: 3473 - protein, 29 aa, Artificial Sequence
  Description of Artificial Sequence: Synthetic peptide
DEEEIRTTNPVATEQYGSVPSINLQRGNR

SEQ ID NO: 3474 - protein, 29 aa, Artificial Sequence
  Description of Artificial Sequence: Synthetic peptide
DEEEIRTTNPVATEQYGESVSTNLSRGNR

SEQ ID NO: 3475 - protein, 29 aa, Artificial Sequence
  Description of Artificial Sequence: Synthetic peptide
DEEEIRTTNPVATEHYGSVSTNLQRGNAR

SEQ ID NO: 3476 - protein, 28 aa, Artificial Sequence
  Description of Artificial Sequence: Synthetic peptide
DEEEIRTTNPVATEHYGSVSTNLQRGIR

SEQ ID NO: 3477 - protein, 28 aa, Artificial Sequence
  Description of Artificial Sequence: Synthetic peptide
DEEEIRTTNPVATEHYGSVSTNLQRGDR

SEQ ID NO: 3478 - protein, 28 aa, Artificial Sequence
  Description of Artificial Sequence: Synthetic peptide
DEEEIRTTNPVATEHYGSVSTNLQRENR

SEQ ID NO: 3479 - protein, 29 aa, Artificial Sequence
  Description of Artificial Sequence: Synthetic peptide
DEEEIRTTNPVATEQYGSVSGTNLQGGNR

SEQ ID NO: 3480 - protein, 29 aa, Artificial Sequence
  Description of Artificial Sequence: Synthetic peptide
DEEEIRTTNPVATEHYGSVSTNLQFRGNR

SEQ ID NO: 3481 - protein, 28 aa, Artificial Sequence
  Description of Artificial Sequence: Synthetic peptide
DEEEIRTTNPVATEQYGSVSTNGARGNR

SEQ ID NO: 3482 - protein, 29 aa, Artificial Sequence
  Description of Artificial Sequence: Synthetic peptide
DEEEIRTTNPVATEQYGSVSTNGAQRGNR

SEQ ID NO: 3483 - protein, 30 aa, Artificial Sequence
  Description of Artificial Sequence: Synthetic polypeptide
DEEEIRTTNPVATEQYGSVYSTNSLQRGNR

SEQ ID NO: 3484 - protein, 29 aa, Artificial Sequence
  Description of Artificial Sequence: Synthetic peptide
DEEEIRTTNPVATEHYGSVSTNLIQRGNR

SEQ ID NO: 3485 - protein, 29 aa, Artificial Sequence
  Description of Artificial Sequence: Synthetic peptide
DEEEIRTTNPVATEQYGESVVTNLQRGNR

SEQ ID NO: 3486 - protein, 29 aa, Artificial Sequence
  Description of Artificial Sequence: Synthetic peptide
DEEEIRTTNPVATEHYGSVSTNLDQRGNR

SEQ ID NO: 3487 - protein, 29 aa, Artificial Sequence
  Description of Artificial Sequence: Synthetic peptide
DEEEIRTTNPVATEQYGSVSTNFQWRGNR

SEQ ID NO: 3488 - protein, 29 aa, Artificial Sequence
  Description of Artificial Sequence: Synthetic peptide
DEEEIRTTNPVATEHYGSVSTLNLQRGNR

SEQ ID NO: 3489 - protein, 28 aa, Artificial Sequence
  Description of Artificial Sequence: Synthetic peptide
DEEEIRTTNPVATEHYGSVSTLLQRGNR

SEQ ID NO: 3490 - protein, 29 aa, Artificial Sequence
  Description of Artificial Sequence: Synthetic peptide
DEEEIRTTNPVATEHYGSVSATNLQRGNR

SEQ ID NO: 3491 - protein, 28 aa, Artificial Sequence
  Description of Artificial Sequence: Synthetic peptide
DEEEIRTTNPVATEHYGSVPTNLQRGNR

SEQ ID NO: 3492 - protein, 30 aa, Artificial Sequence
  Description of Artificial Sequence: Synthetic polypeptide
DEEEIRTTNPVATEQYGESVSTVNLQRGNR

SEQ ID NO: 3493 - protein, 28 aa, Artificial Sequence
  Description of Artificial Sequence: Synthetic peptide
DEEEIRTTNPVATEQYGSVSTNFQWGNR

SEQ ID NO: 3494 - protein, 29 aa, Artificial Sequence
  Description of Artificial Sequence: Synthetic peptide
DEEEIRTTNPVATEHYGSVSTNLQRGSNR

SEQ ID NO: 3495 - protein, 28 aa, Artificial Sequence
  Description of Artificial Sequence: Synthetic peptide
DEEEIRTTNPVATELYGSVSTNLQRGLR

SEQ ID NO: 3496 - protein, 28 aa, Artificial Sequence
  Description of Artificial Sequence: Synthetic peptide
DEEEIRTTNPVATELYGSVSTNLQRGMR

SEQ ID NO: 3497 - protein, 29 aa, Artificial Sequence
  Description of Artificial Sequence: Synthetic peptide
DEEEIRTTNPVATELYGSVSTNLQRGNGR

SEQ ID NO: 3498 - protein, 29 aa, Artificial Sequence
  Description of Artificial Sequence: Synthetic peptide
DEEEIRTTNPVATEQYGSVPSTNLQYGNR

SEQ ID NO: 3499 - protein, 29 aa, Artificial Sequence
  Description of Artificial Sequence: Synthetic peptide
DEEEIRTTNPVATEGYGSVSMTNLQRGNR

SEQ ID NO: 3500 - protein, 30 aa, Artificial Sequence
  Description of Artificial Sequence: Synthetic polypeptide
DEEEIRTTNPVATEQYGSVPSTNLQRTGNR

SEQ ID NO: 3501 - protein, 29 aa, Artificial Sequence
  Description of Artificial Sequence: Synthetic peptide
DEEEIRTTNPVATEQYGSVPSTNLQRQNR

SEQ ID NO: 3502 - protein, 28 aa, Artificial Sequence
  Description of Artificial Sequence: Synthetic peptide
DEEEIRTTNPVATENYGSVSTSLQRGNR

SEQ ID NO: 3503 - protein, 28 aa, Artificial Sequence
  Description of Artificial Sequence: Synthetic peptide
DEEEIRTTNPVATENYGSVSTQLQRGNR

SEQ ID NO: 3504 - protein, 28 aa, Artificial Sequence
  Description of Artificial Sequence: Synthetic peptide
DEEEIRTTNPVATENYGSVSTNLVRGNR

SEQ ID NO: 3505 - protein, 29 aa, Artificial Sequence
  Description of Artificial Sequence: Synthetic peptide
DEEEIRTTNPVATENYGSVSTNLTQRGNR

SEQ ID NO: 3506 - protein, 29 aa, Artificial Sequence
  Description of Artificial Sequence: Synthetic peptide
DEEEIRTTNPVATEQYGSVSTNGQRGNRI

SEQ ID NO: 3507 - protein, 29 aa, Artificial Sequence
  Description of Artificial Sequence: Synthetic peptide
DEEEIRTTNPVATENYGSVSTNLQTRGNR

SEQ ID NO: 3508 - protein, 29 aa, Artificial Sequence
  Description of Artificial Sequence: Synthetic peptide
DEEEIRTTNPVATENYGSVSTNLQRGNRE

SEQ ID NO: 3509 - protein, 28 aa, Artificial Sequence
  Description of Artificial Sequence: Synthetic peptide
DEEEIRTTNPVATENYGSVSTNLQQGNR

SEQ ID NO: 3510 - protein, 29 aa, Artificial Sequence
  Description of Artificial Sequence: Synthetic peptide
DEEEIRTTNPVATEQYGSVPSTNLQRMNR

SEQ ID NO: 3511 - protein, 29 aa, Artificial Sequence
  Description of Artificial Sequence: Synthetic peptide
DEEEIRTTNPVATENYGSVSTNLNQRGNR

SEQ ID NO: 3512 - protein, 29 aa, Artificial Sequence
  Description of Artificial Sequence: Synthetic peptide
DEEEIRTTNPVATENYGSVSTANLQRGNR

SEQ ID NO: 3513 - protein, 28 aa, Artificial Sequence
  Description of Artificial Sequence: Synthetic peptide
DEEEIRTTNPVATENYGSVSMNLQRGNR

SEQ ID NO: 3514 - protein, 28 aa, Artificial Sequence
  Description of Artificial Sequence: Synthetic peptide
DEEEIRTTNPVATENYGSVSINLQRGNR

SEQ ID NO: 3515 - protein, 28 aa, Artificial Sequence
  Description of Artificial Sequence: Synthetic peptide
DEEEIRTTNPVATENYGSVSFNLQRGNR

SEQ ID NO: 3516 - protein, 29 aa, Artificial Sequence
  Description of Artificial Sequence: Synthetic peptide
DEEEIRTTNPVATENYGSVSTNLQRTGNR

SEQ ID NO: 3517 - protein, 29 aa, Artificial Sequence
  Description of Artificial Sequence: Synthetic peptide
DEEEIRTTNPVATEPQYGSVSTNLQRGNL

SEQ ID NO: 3518 - protein, 29 aa, Artificial Sequence
  Description of Artificial Sequence: Synthetic peptide
DEEEIRTTNPVATEQYGSVSTNGQRGNRV

SEQ ID NO: 3519 - protein, 29 aa, Artificial Sequence
  Description of Artificial Sequence: Synthetic peptide
DEEEIRTTNPVATEQYGSVSTNGQRPGNR

SEQ ID NO: 3520 - protein, 28 aa, Artificial Sequence
  Description of Artificial Sequence: Synthetic peptide
DEEEIRTTNPVATEPYGFVSTNLQRGNR

SEQ ID NO: 3521 - protein, 30 aa, Artificial Sequence
  Description of Artificial Sequence: Synthetic polypeptide
DEEEIRTTNPVATEQYGSVSTNCLAQRGNR

SEQ ID NO: 3522 - protein, 28 aa, Artificial Sequence
  Description of Artificial Sequence: Synthetic peptide
DEEEIRTTNPVATEQYGEVSTNLQRGND

SEQ ID NO: 3523 - protein, 30 aa, Artificial Sequence
  Description of Artificial Sequence: Synthetic polypeptide
DEEEIRTTNPVATEQYGSVSTNCLQRGDNR

SEQ ID NO: 3524 - protein, 28 aa, Artificial Sequence
  Description of Artificial Sequence: Synthetic peptide
DEEEIRTTNPVATEQYGSVPTNLARGNR

SEQ ID NO: 3525 - protein, 28 aa, Artificial Sequence
  Description of Artificial Sequence: Synthetic peptide
DEEEIRTTNPVATEQYGEVSTNLQRGMR

SEQ ID NO: 3526 - protein, 29 aa, Artificial Sequence
  Description of Artificial Sequence: Synthetic peptide
DEEEIRTTNPVATEQYGEVSTNLQRFGNR

SEQ ID NO: 3527 - protein, 29 aa, Artificial Sequence
  Description of Artificial Sequence: Synthetic peptide
DEEEIRTTNPVATEQYGSVSTNCLQRGNE

SEQ ID NO: 3528 - protein, 29 aa, Artificial Sequence
  Description of Artificial Sequence: Synthetic peptide
DEEEIRTTNPVATEQYGSVSTNCLQRGNQ

SEQ ID NO: 3529 - protein, 30 aa, Artificial Sequence
  Description of Artificial Sequence: Synthetic polypeptide
DEEEIRTTNPVATEQYGSVSTNCLQRGNRC

SEQ ID NO: 3530 - protein, 30 aa, Artificial Sequence
  Description of Artificial Sequence: Synthetic polypeptide
DEEEIRTTNPVATEQYGSVSTNCLQTRGNR

SEQ ID NO: 3531 - protein, 29 aa, Artificial Sequence
  Description of Artificial Sequence: Synthetic peptide
DEEEIRTTNPVATEQYGSVSTNCQARGNR

SEQ ID NO: 3532 - protein, 28 aa, Artificial Sequence
  Description of Artificial Sequence: Synthetic peptide
DEEEIRTTNPVATEQYGSVSTNCQRGNA

SEQ ID NO: 3533 - protein, 29 aa, Artificial Sequence
  Description of Artificial Sequence: Synthetic peptide
DEEEIRTTNPVATEQYGSVSTNCQRGNDR

SEQ ID NO: 3534 - protein, 29 aa, Artificial Sequence
  Description of Artificial Sequence: Synthetic peptide
DEEEIRTTNPVATEQYGSVSTNCQRPGNR

SEQ ID NO: 3535 - protein, 29 aa, Artificial Sequence
  Description of Artificial Sequence: Synthetic peptide
DEEEIRTTNPVATEQYGSVSTNCQRWGNR

SEQ ID NO: 3536 - protein, 29 aa, Artificial Sequence
  Description of Artificial Sequence: Synthetic peptide
DEEEIRTTNPVATEQYGSVSTNCQTRGNR

SEQ ID NO: 3537 - protein, 29 aa, Artificial Sequence
  Description of Artificial Sequence: Synthetic peptide
DEEEIRTTNPVATEQYGSVSTNCQWRGNR

SEQ ID NO: 3538 - protein, 28 aa, Artificial Sequence
  Description of Artificial Sequence: Synthetic peptide
DEEEIRTTNPVATEQYGSVSTNDARGNR

SEQ ID NO: 3539 - protein, 28 aa, Artificial Sequence
  Description of Artificial Sequence: Synthetic peptide
DEEEIRTTNPVATENYGQVSTNLQRGNR

SEQ ID NO: 3540 - protein, 30 aa, Artificial Sequence
  Description of Artificial Sequence: Synthetic polypeptide
DEEEIRTTNPVATEQYGSVPSTNLQRIGNR

SEQ ID NO: 3541 - protein, 29 aa, Artificial Sequence
  Description of Artificial Sequence: Synthetic peptide
DEEEIRTTNPVATEQYGSVSTNGQRGNPR

SEQ ID NO: 3542 - protein, 28 aa, Artificial Sequence
  Description of Artificial Sequence: Synthetic peptide
DEEEIRTTNPVATEMYGSVTTNLQRGNR

SEQ ID NO: 3543 - protein, 28 aa, Artificial Sequence
  Description of Artificial Sequence: Synthetic peptide
DEEEIRTTNPVATEMYGSVSTNLQEGNR

SEQ ID NO: 3544 - protein, 30 aa, Artificial Sequence
  Description of Artificial Sequence: Synthetic polypeptide
DEEEIRTTNPVATEQYGDSVVSTNLQRGNR

SEQ ID NO: 3545 - protein, 30 aa, Artificial Sequence
  Description of Artificial Sequence: Synthetic polypeptide
DEEEIRTTNPVATEQYGSVSTNGLTQRGNR

SEQ ID NO: 3546 - protein, 29 aa, Artificial Sequence
  Description of Artificial Sequence: Synthetic peptide
DEEEIRTTNPVATEQYGVVSTNLQRGNRQ

SEQ ID NO: 3547 - protein, 29 aa, Artificial Sequence
  Description of Artificial Sequence: Synthetic peptide
DEEEIRTTNPVATEQYGVVSTNLQRGNGR

SEQ ID NO: 3548 - protein, 30 aa, Artificial Sequence
  Description of Artificial Sequence: Synthetic polypeptide
DEEEIRTTNPVATEQYGSVSTNGLQVRGNR

SEQ ID NO: 3549 - protein, 28 aa, Artificial Sequence
  Description of Artificial Sequence: Synthetic peptide
DEEEIRTTNPVATEGYGIVSTNLQRGNR

SEQ ID NO: 3550 - protein, 28 aa, Artificial Sequence
  Description of Artificial Sequence: Synthetic peptide
DEEEIRTTNPVATEMYGSVSTHLQRGNR

SEQ ID NO: 3551 - protein, 29 aa, Artificial Sequence
  Description of Artificial Sequence: Synthetic peptide
DEEEIRTTNPVATEQYGSVSTNDEQRGNR

SEQ ID NO: 3552 - protein, 29 aa, Artificial Sequence
  Description of Artificial Sequence: Synthetic peptide
DEEEIRTTNPVATEMYGSCVSTNLQRGNR

SEQ ID NO: 3553 - protein, 29 aa, Artificial Sequence
  Description of Artificial Sequence: Synthetic peptide
DEEEIRTTNPVATEQYGSVSTNGLQRYNR

SEQ ID NO: 3554 - protein, 28 aa, Artificial Sequence
  Description of Artificial Sequence: Synthetic peptide
DEEEIRTTNPVATEMYGCVSTNLQRGNR

SEQ ID NO: 3555 - protein, 29 aa, Artificial Sequence
  Description of Artificial Sequence: Synthetic peptide
DEEEIRTTNPVATEQYGSVSTNGLQRMNR

SEQ ID NO: 3556 - protein, 29 aa, Artificial Sequence
  Description of Artificial Sequence: Synthetic peptide
DEEEIRTTNPVATELYGSVVSTNLQRGNR

SEQ ID NO: 3557 - protein, 28 aa, Artificial Sequence
  Description of Artificial Sequence: Synthetic peptide
DEEEIRTTNPVATELYGSVSTVLQRGNR

SEQ ID NO: 3558 - protein, 28 aa, Artificial Sequence
  Description of Artificial Sequence: Synthetic peptide
DEEEIRTTNPVATELYGSVSTNLQVGNR

SEQ ID NO: 3559 - protein, 29 aa, Artificial Sequence
  Description of Artificial Sequence: Synthetic peptide
DEEEIRTTNPVATELYGSVSTNLQRLGNR

SEQ ID NO: 3560 - protein, 29 aa, Artificial Sequence
  Description of Artificial Sequence: Synthetic peptide
DEEEIRTTNPVATELYGSVSTNLQRGNRL

SEQ ID NO: 3561 - protein, 29 aa, Artificial Sequence
  Description of Artificial Sequence: Synthetic peptide
DEEEIRTTNPVATELYGSVSTNLQRGNRD

SEQ ID NO: 3562 - protein, 28 aa, Artificial Sequence
  Description of Artificial Sequence: Synthetic peptide
DEEEIRTTNPVATEMYGSVSTNLQIGNR

SEQ ID NO: 3563 - protein, 30 aa, Artificial Sequence
  Description of Artificial Sequence: Synthetic polypeptide
DEEEIRTTNPVATEQYGSVSTNFLQRGNTR

SEQ ID NO: 3564 - protein, 28 aa, Artificial Sequence
  Description of Artificial Sequence: Synthetic peptide
DEEEIRTTNPVATEMYGSVSTNLQMGNR

SEQ ID NO: 3565 - protein, 29 aa, Artificial Sequence
  Description of Artificial Sequence: Synthetic peptide
DEEEIRTTNPVATEQYGDSVSTNLQRGNS

SEQ ID NO: 3566 - protein, 29 aa, Artificial Sequence
  Description of Artificial Sequence: Synthetic peptide
DEEEIRTTNPVATEQYGSVPSTNLQRGNV

SEQ ID NO: 3567 - protein, 29 aa, Artificial Sequence
  Description of Artificial Sequence: Synthetic peptide
DEEEIRTTNPVATEMYGSVSTTNLQRGNR

SEQ ID NO: 3568 - protein, 28 aa, Artificial Sequence
  Description of Artificial Sequence: Synthetic peptide
DEEEIRTTNPVATEQYGSVSTNGQRGNI

SEQ ID NO: 3569 - protein, 30 aa, Artificial Sequence
  Description of Artificial Sequence: Synthetic polypeptide
DEEEIRTTNPVATEQYGSVPSTNLQRGNTR

SEQ ID NO: 3570 - protein, 29 aa, Artificial Sequence
  Description of Artificial Sequence: Synthetic peptide
DEEEIRTTNPVATEQYGSVPSTNLQRGNF

SEQ ID NO: 3571 - protein, 29 aa, Artificial Sequence
  Description of Artificial Sequence: Synthetic peptide
DEEEIRTTNPVATEMYGSVSTNLQTRGNR

SEQ ID NO: 3572 - protein, 29 aa, Artificial Sequence
  Description of Artificial Sequence: Synthetic peptide
DEEEIRTTNPVATEQYGSVPSTNLQRGMR

SEQ ID NO: 3573 - protein, 28 aa, Artificial Sequence
  Description of Artificial Sequence: Synthetic peptide
DEEEIRTTNPVATEQYGSVSTNGQRGIR

SEQ ID NO: 3574 - protein, 28 aa, Artificial Sequence
  Description of Artificial Sequence: Synthetic peptide
DEEEIRTTNPVATEMYGSVSTNLQRGTR

SEQ ID NO: 3575 - protein, 28 aa, Artificial Sequence
  Description of Artificial Sequence: Synthetic peptide
DEEEIRTTNPVATEQYGSVSTNGQRGGR

SEQ ID NO: 3576 - protein, 29 aa, Artificial Sequence
  Description of Artificial Sequence: Synthetic peptide
DEEEIRTTNPVATEQYGSVSTNGQRFGNR

SEQ ID NO: 3577 - protein, 28 aa, Artificial Sequence
  Description of Artificial Sequence: Synthetic peptide
DEEEIRTTNPVATEMYGSVSTNLQRGQR

SEQ ID NO: 3578 - protein, 29 aa, Artificial Sequence
  Description of Artificial Sequence: Synthetic peptide
DEEEIRTTNPVATEQYGSVSTNGQQRGNR

SEQ ID NO: 3579 - protein, 29 aa, Artificial Sequence
  Description of Artificial Sequence: Synthetic peptide
DEEEIRTTNPVATEMYGSVSTNLQRGNRC

SEQ ID NO: 3580 - protein, 28 aa, Artificial Sequence
  Description of Artificial Sequence: Synthetic peptide
DEEEIRTTNPVATEMYGSVSTNLQRGIR

SEQ ID NO: 3581 - protein, 28 aa, Artificial Sequence
  Description of Artificial Sequence: Synthetic peptide
DEEEIRTTNPVATEMYGSVSTNLQRENR

SEQ ID NO: 3582 - protein, 30 aa, Artificial Sequence
  Description of Artificial Sequence: Synthetic polypeptide
DEEEIRTTNPVATEQYGDSVGSTNLQRGNR

SEQ ID NO: 3583 - protein, 29 aa, Artificial Sequence
  Description of Artificial Sequence: Synthetic peptide
DEEEIRTTNPVATEQYGDSVSTNLQRGND

SEQ ID NO: 3584 - protein, 29 aa, Artificial Sequence
  Description of Artificial Sequence: Synthetic peptide
DEEEIRTTNPVATEQYGDSVSTNLQRGNK

SEQ ID NO: 3585 - protein, 30 aa, Artificial Sequence
  Description of Artificial Sequence: Synthetic polypeptide
DEEEIRTTNPVATEQYGDSVSTNLSQRGNR

SEQ ID NO: 3586 - protein, 30 aa, Artificial Sequence
  Description of Artificial Sequence: Synthetic polypeptide
DEEEIRTTNPVATEQYGSVSTNFLQRGNRP

SEQ ID NO: 3587 - protein, 30 aa, Artificial Sequence
  Description of Artificial Sequence: Synthetic polypeptide
DEEEIRTTNPVATEQYGESVSFTNLQRGNR

SEQ ID NO: 3588 - protein, 30 aa, Artificial Sequence
  Description of Artificial Sequence: Synthetic polypeptide
DEEEIRTTNPVATEQYGESVQSTNLQRGNR

SEQ ID NO: 3589 - protein, 29 aa, Artificial Sequence
  Description of Artificial Sequence: Synthetic peptide
DEEEIRTTNPVATEQYGTSLSTNLQRGNR

SEQ ID NO: 3590 - protein, 29 aa, Artificial Sequence
  Description of Artificial Sequence: Synthetic peptide
DEEEIRTTNPVATEQYGSVSTNDQRGINR

SEQ ID NO: 3591 - protein, 29 aa, Artificial Sequence
  Description of Artificial Sequence: Synthetic peptide
DEEEIRTTNPVATEQYGSVPETNLQRGNR

SEQ ID NO: 3592 - protein, 28 aa, Artificial Sequence
  Description of Artificial Sequence: Synthetic peptide
DEEEIRTTNPVATEQYGSVSTNDQRGER

SEQ ID NO: 3593 - protein, 28 aa, Artificial Sequence
  Description of Artificial Sequence: Synthetic peptide
DEEEIRTTNPVATEQYGDVSTNYQRGNR

SEQ ID NO: 3594 - protein, 28 aa, Artificial Sequence
  Description of Artificial Sequence: Synthetic peptide
DEEEIRTTNPVATEQYGSVSTNDQRDNR

SEQ ID NO: 3595 - protein, 28 aa, Artificial Sequence
  Description of Artificial Sequence: Synthetic peptide
DEEEIRTTNPVATEQYGTHSTNLQRGNR

SEQ ID NO: 3596 - protein, 29 aa, Artificial Sequence
  Description of Artificial Sequence: Synthetic peptide
DEEEIRTTNPVATEQYGSVSTNDQRDGNR

SEQ ID NO: 3597 - protein, 30 aa, Artificial Sequence
  Description of Artificial Sequence: Synthetic polypeptide
DEEEIRTTNPVATEQYGTSSVSTNLQRGNR

SEQ ID NO: 3598 - protein, 29 aa, Artificial Sequence
  Description of Artificial Sequence: Synthetic peptide
QEEEIRTTNPVATEQYGSVESTNLQRGNR

SEQ ID NO: 3599 - protein, 28 aa, Artificial Sequence
  Description of Artificial Sequence: Synthetic peptide
DEEEIRTTNPVATEGYGSVSTHLQRGNR

SEQ ID NO: 3600 - protein, 28 aa, Artificial Sequence
  Description of Artificial Sequence: Synthetic peptide
DEEEIRTTNPVATEQYGDVSTNLQRGNC

SEQ ID NO: 3601 - protein, 28 aa, Artificial Sequence
  Description of Artificial Sequence: Synthetic peptide
DEEEIRTTNPVATEQYGDVSTNLQRGIR

SEQ ID NO: 3602 - protein, 28 aa, Artificial Sequence
  Description of Artificial Sequence: Synthetic peptide
DEEEIRTTNPVATEQYGDVSTNLQRGER

SEQ ID NO: 3603 - protein, 28 aa, Artificial Sequence
  Description of Artificial Sequence: Synthetic peptide
DEEEIRTTNPVATEQYGDVSTNLQRFNR

SEQ ID NO: 3604 - protein, 29 aa, Artificial Sequence
  Description of Artificial Sequence: Synthetic peptide
DEEEIRTTNPVATEQYGDVSTNLQRFGNR

SEQ ID NO: 3605 - protein, 29 aa, Artificial Sequence
  Description of Artificial Sequence: Synthetic peptide
DEEEIRTTNPVATEQYGSWSTNLEQRGNR

SEQ ID NO: 3606 - protein, 28 aa, Artificial Sequence
  Description of Artificial Sequence: Synthetic peptide
DEEEIRTTNPVATEQYGSVNTNLQRDNR

SEQ ID NO: 3607 - protein, 29 aa, Artificial Sequence
  Description of Artificial Sequence: Synthetic peptide
DEEEIRTTNPVATEQYGSVSTNDQNRGNR

SEQ ID NO: 3608 - protein, 29 aa, Artificial Sequence
  Description of Artificial Sequence: Synthetic peptide
QEEEIRTTNPVATEQYGSVSMTNLQRGNR

SEQ ID NO: 3609 - protein, 28 aa, Artificial Sequence
  Description of Artificial Sequence: Synthetic peptide
QEEEIRTTNPVATEQYGSVSNNLQRGNR

SEQ ID NO: 3610 - protein, 30 aa, Artificial Sequence
  Description of Artificial Sequence: Synthetic polypeptide
DEEEIRTTNPVATEQYGTSVSTANLQRGNR

SEQ ID NO: 3611 - protein, 29 aa, Artificial Sequence
  Description of Artificial Sequence: Synthetic peptide
DEEEIRTTNPVATEQYGSVSTNDQRHGNR

SEQ ID NO: 3612 - protein, 28 aa, Artificial Sequence
  Description of Artificial Sequence: Synthetic peptide
DEEEIRTTNPVATEQYGSVSTNDQRGYR

SEQ ID NO: 3613 - protein, 29 aa, Artificial Sequence
  Description of Artificial Sequence: Synthetic peptide
DEEEIRTTNPVATEQYGSVSNTNWQRGNR

SEQ ID NO: 3614 - protein, 29 aa, Artificial Sequence
  Description of Artificial Sequence: Synthetic peptide
DEEEIRTTNPVATEQYGSVNTGNLQRGNR

SEQ ID NO: 3615 - protein, 29 aa, Artificial Sequence
  Description of Artificial Sequence: Synthetic peptide
DEEEIRTTNPVATEQYGSVNTINLQRGNR

SEQ ID NO: 3616 - protein, 28 aa, Artificial Sequence
  Description of Artificial Sequence: Synthetic peptide
DEEEIRTTNPVATEQYGSWSANLQRGNR

SEQ ID NO: 3617 - protein, 28 aa, Artificial Sequence
  Description of Artificial Sequence: Synthetic peptide
DEEEIRTTNPVATEQYGSVSTNDQRGTR

SEQ ID NO: 3618 - protein, 29 aa, Artificial Sequence
  Description of Artificial Sequence: Synthetic peptide
DEEEIRTTNPVATEQYGSVSTNDLVRGNR

SEQ ID NO: 3619 - protein, 28 aa, Artificial Sequence
  Description of Artificial Sequence: Synthetic peptide
DEEEIRTTNPVATEQYGSVSTNDQRGNW

SEQ ID NO: 3620 - protein, 28 aa, Artificial Sequence
  Description of Artificial Sequence: Synthetic peptide
DEEEIRTTNPVATEQYGSVSTNDQRGNN

SEQ ID NO: 3621 - protein, 29 aa, Artificial Sequence
  Description of Artificial Sequence: Synthetic peptide
DEEEIRTTNPVATEQYGTSVTTNLQRGNR

SEQ ID NO: 3622 - protein, 30 aa, Artificial Sequence
  Description of Artificial Sequence: Synthetic polypeptide
DEEEIRTTNPVATEQYGTSVSTNTLQRGNR

SEQ ID NO: 3623 - protein, 30 aa, Artificial Sequence
  Description of Artificial Sequence: Synthetic polypeptide
DEEEIRTTNPVATEQYGTSVSTNLQRGNRN

SEQ ID NO: 3624 - protein, 29 aa, Artificial Sequence
  Description of Artificial Sequence: Synthetic peptide
DEEEIRTTNPVATEQYGTSVSTNLQRGNQ

SEQ ID NO: 3625 - protein, 29 aa, Artificial Sequence
  Description of Artificial Sequence: Synthetic peptide
DEEEIRTTNPVATEQYGTSVSTNLQRGNN

SEQ ID NO: 3626 - protein, 29 aa, Artificial Sequence
  Description of Artificial Sequence: Synthetic peptide
DEEEIRTTNPVATEQYGTSVSTNLQRGNC

SEQ ID NO: 3627 - protein, 29 aa, Artificial Sequence
  Description of Artificial Sequence: Synthetic peptide
DEEEIRTTNPVATEQYGTSVSTNLQCGNR

SEQ ID NO: 3628 - protein, 29 aa, Artificial Sequence
  Description of Artificial Sequence: Synthetic peptide
DEEEIRTTNPVATEQYGTSVSTNLERGNR

SEQ ID NO: 3629 - protein, 28 aa, Artificial Sequence
  Description of Artificial Sequence: Synthetic peptide
DEEEIRTTNPVATEQYGSVSTNDQRGNF

SEQ ID NO: 3630 - protein, 28 aa, Artificial Sequence
  Description of Artificial Sequence: Synthetic peptide
DEEEIRTTNPVATEQYGSWSTNLQGGNR

SEQ ID NO: 3631 - protein, 28 aa, Artificial Sequence
  Description of Artificial Sequence: Synthetic peptide
DEEEIRTTNPVATEQYGSWSTNLQKGNR

SEQ ID NO: 3632 - protein, 28 aa, Artificial Sequence
  Description of Artificial Sequence: Synthetic peptide
DEEEIRTTNPVATEQYGSWSTNLQMGNR

SEQ ID NO: 3633 - protein, 29 aa, Artificial Sequence
  Description of Artificial Sequence: Synthetic peptide
DEEEIRTTNPVATEQYGSWSTNLQRGINR

SEQ ID NO: 3634 - protein, 28 aa, Artificial Sequence
  Description of Artificial Sequence: Synthetic peptide
YIEEIRTTNPVATEQYGSVSTNLQRGNR

SEQ ID NO: 3635 - protein, 29 aa, Artificial Sequence
  Description of Artificial Sequence: Synthetic peptide
DEEEIRTTNPVATEQYGSWVSTNLQRGNM

SEQ ID NO: 3636 - protein, 28 aa, Artificial Sequence
  Description of Artificial Sequence: Synthetic peptide
DEEEIRTTNPVATEQYGDVSTNLGRGNR

SEQ ID NO: 3637 - protein, 29 aa, Artificial Sequence
  Description of Artificial Sequence: Synthetic peptide
DEEEIRTTNPVATEQYGSYESTNLQRGNR

SEQ ID NO: 3638 - protein, 29 aa, Artificial Sequence
  Description of Artificial Sequence: Synthetic peptide
DEEEIRTTNPVATEQYGSYSTWNLQRGNR

SEQ ID NO: 3639 - protein, 28 aa, Artificial Sequence
  Description of Artificial Sequence: Synthetic peptide
DEEEIRTTNPVATEQYGSYSTPLQRGNR

SEQ ID NO: 3640 - protein, 29 aa, Artificial Sequence
  Description of Artificial Sequence: Synthetic peptide
DEEEIRTTNPVATEQYGSYSTNLQRLGNR

SEQ ID NO: 3641 - protein, 29 aa, Artificial Sequence
  Description of Artificial Sequence: Synthetic peptide
DEEEIRTTNPVATEQYGSYSTNLQRGNYR

SEQ ID NO: 3642 - protein, 28 aa, Artificial Sequence
  Description of Artificial Sequence: Synthetic peptide
DEEEIRTTNPVATEQYGSYSTNLQRGNV

SEQ ID NO: 3643 - protein, 29 aa, Artificial Sequence
  Description of Artificial Sequence: Synthetic peptide
DEEEIRTTNPVATEQYGSYSTNLQRGNRN

SEQ ID NO: 3644 - protein, 29 aa, Artificial Sequence
  Description of Artificial Sequence: Synthetic peptide
DEEEIRTTNPVATEQYGSYSTNLQRGNLR

SEQ ID NO: 3645 - protein, 29 aa, Artificial Sequence
  Description of Artificial Sequence: Synthetic peptide
DEEEIRTTNPVATEQYGSYSTNLQRGNDR

SEQ ID NO: 3646 - protein, 30 aa, Artificial Sequence
  Description of Artificial Sequence: Synthetic polypeptide
DEEEIRTTNPVATEQYGSVSNTNLQRPGNR

SEQ ID NO: 3647 - protein, 28 aa, Artificial Sequence
  Description of Artificial Sequence: Synthetic peptide
DEEEIRTTNPVATEQYGSVSTNDQDGNR

SEQ ID NO: 3648 - protein, 29 aa, Artificial Sequence
  Description of Artificial Sequence: Synthetic peptide
DEEEIRTTNPVATEQYGSYSTLNLQRGNR

SEQ ID NO: 3649 - protein, 29 aa, Artificial Sequence
  Description of Artificial Sequence: Synthetic peptide
DEEEIRTTNPVATEQYGSVSNTNLQRGNT

SEQ ID NO: 3650 - protein, 28 aa, Artificial Sequence
  Description of Artificial Sequence: Synthetic peptide
DEEEIRTTNPVATEQYGDVSTNLQAGNR

SEQ ID NO: 3651 - protein, 30 aa, Artificial Sequence
  Description of Artificial Sequence: Synthetic polypeptide
DEEEIRTTNPVATEQYGSVSNTNLQRGNIR

SEQ ID NO: 3652 - protein, 29 aa, Artificial Sequence
  Description of Artificial Sequence: Synthetic peptide
DEEEIRTTNPVATEQYGSVSNTNLQRGND

SEQ ID NO: 3653 - protein, 30 aa, Artificial Sequence
  Description of Artificial Sequence: Synthetic polypeptide
DEEEIRTTNPVATEQYGSWVSTNLQDRGNR

SEQ ID NO: 3654 - protein, 29 aa, Artificial Sequence
  Description of Artificial Sequence: Synthetic peptide
DEEEIRTTNPVATEQYGSVSTNDQRTGNR

SEQ ID NO: 3655 - protein, 29 aa, Artificial Sequence
  Description of Artificial Sequence: Synthetic peptide
DEEEIRTTNPVATEQYGSWVSTDLQRGNR

SEQ ID NO: 3656 - protein, 29 aa, Artificial Sequence
  Description of Artificial Sequence: Synthetic peptide
DEEEIRTTNPVATEQYGSYVFTNLQRGNR

SEQ ID NO: 3657 - protein, 29 aa, Artificial Sequence
  Description of Artificial Sequence: Synthetic peptide
DEEEIRTTNPVATEQYGSVNTNLQRGNMR

SEQ ID NO: 3658 - protein, 29 aa, Artificial Sequence
  Description of Artificial Sequence: Synthetic peptide
DEEEIRTTNPVATEQYGSVNTNLQRGSNR

SEQ ID NO: 3659 - protein, 28 aa, Artificial Sequence
  Description of Artificial Sequence: Synthetic peptide
DEEEIRTTNPVATEQYGSVNTNLQRINR

SEQ ID NO: 3660 - protein, 30 aa, Artificial Sequence
  Description of Artificial Sequence: Synthetic polypeptide
DEEEIRTTNPVATEQYGSYVSTWNLQRGNR

SEQ ID NO: 3661 - protein, 30 aa, Artificial Sequence
  Description of Artificial Sequence: Synthetic polypeptide
DEEEIRTTNPVATEQYGSYVSTTNLQRGNR

SEQ ID NO: 3662 - protein, 29 aa, Artificial Sequence
  Description of Artificial Sequence: Synthetic peptide
DEEEIRTTNPVATEQYGSVNTNLQSRGNR

SEQ ID NO: 3663 - protein, 29 aa, Artificial Sequence
  Description of Artificial Sequence: Synthetic peptide
DEEEIRTTNPVATEQYGSYVSTPLQRGNR

SEQ ID NO: 3664 - protein, 28 aa, Artificial Sequence
  Description of Artificial Sequence: Synthetic peptide
QEEEIRTTNPVATEQYGSVQTNLQRGNR

SEQ ID NO: 3665 - protein, 29 aa, Artificial Sequence
  Description of Artificial Sequence: Synthetic peptide
DEEEIRTTNPVATEQYGSYVSTNNQRGNR

SEQ ID NO: 3666 - protein, 29 aa, Artificial Sequence
  Description of Artificial Sequence: Synthetic peptide
DEEEIRTTNPVATEQYGSYVSTNLTRGNR

SEQ ID NO: 3667 - protein, 30 aa, Artificial Sequence
  Description of Artificial Sequence: Synthetic polypeptide
DEEEIRTTNPVATEQYGSYVSTNLQRGNVR

SEQ ID NO: 3668 - protein, 30 aa, Artificial Sequence
  Description of Artificial Sequence: Synthetic polypeptide
DEEEIRTTNPVATEQYGSVSNTNLYQRGNR

SEQ ID NO: 3669 - protein, 30 aa, Artificial Sequence
  Description of Artificial Sequence: Synthetic polypeptide
DEEEIRTTNPVATEQYGSYVSTNLQRGNNR

SEQ ID NO: 3670 - protein, 29 aa, Artificial Sequence
  Description of Artificial Sequence: Synthetic peptide
DEEEIRTTNPVATEQYGSYVSTNLQNGNR

SEQ ID NO: 3671 - protein, 29 aa, Artificial Sequence
  Description of Artificial Sequence: Synthetic peptide
DEEEIRTTNPVATEQYGSYVSTNLQHGNR

SEQ ID NO: 3672 - protein, 29 aa, Artificial Sequence
  Description of Artificial Sequence: Synthetic peptide
DEEEIRTTNPVATEQYGSVSGTNLQEGNR

SEQ ID NO: 3673 - protein, 29 aa, Artificial Sequence
  Description of Artificial Sequence: Synthetic peptide
DEEEIRTTNPVATEQYGSVNTNLQVRGNR

SEQ ID NO: 3674 - protein, 29 aa, Artificial Sequence
  Description of Artificial Sequence: Synthetic peptide
DEEEIRTTNPVATEQYGSVNTNLWQRGNR

SEQ ID NO: 3675 - protein, 29 aa, Artificial Sequence
  Description of Artificial Sequence: Synthetic peptide
DEEEIRTTNPVATEQYGSWSTNLQRGNVR

SEQ ID NO: 3676 - protein, 29 aa, Artificial Sequence
  Description of Artificial Sequence: Synthetic peptide
DEEEIRTTNPVATEQYGSYVETNLQRGNR

SEQ ID NO: 3677 - protein, 28 aa, Artificial Sequence
  Description of Artificial Sequence: Synthetic peptide
DEEEIRTTNPVATEQYGSVSTNCGRGNR

SEQ ID NO: 3678 - protein, 29 aa, Artificial Sequence
  Description of Artificial Sequence: Synthetic peptide
DEEEIRTTNPVATEQYGDVSPTNLQRGNR

SEQ ID NO: 3679 - protein, 29 aa, Artificial Sequence
  Description of Artificial Sequence: Synthetic peptide
DEEEIRTTNPVATEQYGSVYWTNLQRGNR

SEQ ID NO: 3680 - protein, 28 aa, Artificial Sequence
  Description of Artificial Sequence: Synthetic peptide
DEEEIRTTNPVATEGYGSTSTNLQRGNR

SEQ ID NO: 3681 - protein, 29 aa, Artificial Sequence
  Description of Artificial Sequence: Synthetic peptide
DEEEIRTTNPCATEQYGSTVSTNLQRGNR

SEQ ID NO: 3682 - protein, 30 aa, Artificial Sequence
  Description of Artificial Sequence: Synthetic polypeptide
DEEEIRTTNPVATEQYGVSVSTNLQRGNNR

SEQ ID NO: 3683 - protein, 29 aa, Artificial Sequence
  Description of Artificial Sequence: Synthetic peptide
DEEEIRTTNPVATEQYGVSVSTNLQRGER

SEQ ID NO: 3684 - protein, 30 aa, Artificial Sequence
  Description of Artificial Sequence: Synthetic polypeptide
DEEEIRTTNPVATEQYGVSVSTNLDQRGNR

SEQ ID NO: 3685 - protein, 29 aa, Artificial Sequence
  Description of Artificial Sequence: Synthetic peptide
DEEEIRTTNPVATEQYGSVYTNLQRGVNR

SEQ ID NO: 3686 - protein, 29 aa, Artificial Sequence
  Description of Artificial Sequence: Synthetic peptide
DEEEIRTTNPVATEQYGVSVSCNLQRGNR

SEQ ID NO: 3687 - protein, 30 aa, Artificial Sequence
  Description of Artificial Sequence: Synthetic polypeptide
DEEEIRTTNPVATEQYGVSVISTNLQRGNR

SEQ ID NO: 3688 - protein, 30 aa, Artificial Sequence
  Description of Artificial Sequence: Synthetic polypeptide
DEEEIRTTNPVATEQYGVSVSTPNLQRGNR

SEQ ID NO: 3689 - protein, 29 aa, Artificial Sequence
  Description of Artificial Sequence: Synthetic peptide
DEEEIRTTNPVATEQYGVSVDTNLQRGNR

SEQ ID NO: 3690 - protein, 29 aa, Artificial Sequence
  Description of Artificial Sequence: Synthetic peptide
DEEEIRTTNPVATEQYGDVSCTNLQRGNR

SEQ ID NO: 3691 - protein, 29 aa, Artificial Sequence
  Description of Artificial Sequence: Synthetic peptide
DEEEIRTTNPVATEQYGSVYTNLQRIGNR

SEQ ID NO: 3692 - protein, 28 aa, Artificial Sequence
  Description of Artificial Sequence: Synthetic peptide
DEEEIRTTNPVATEQYGSVSTNEQRGNM

SEQ ID NO: 3693 - protein, 28 aa, Artificial Sequence
  Description of Artificial Sequence: Synthetic peptide
DEEEIRTTNPVATEQYGSVSTNEQRGNF

SEQ ID NO: 3694 - protein, 28 aa, Artificial Sequence
  Description of Artificial Sequence: Synthetic peptide
DEEEIRTTNPVATEQYGSVSTNEQRGNA

SEQ ID NO: 3695 - protein, 28 aa, Artificial Sequence
  Description of Artificial Sequence: Synthetic peptide
DEEEIRTTNPVATEQYGSVSTNEQRGMR

SEQ ID NO: 3696 - protein, 29 aa, Artificial Sequence
  Description of Artificial Sequence: Synthetic peptide
DEEEIRTTNPVATEQYGSVSNTNLQGGNR

SEQ ID NO: 3697 - protein, 29 aa, Artificial Sequence
  Description of Artificial Sequence: Synthetic peptide
DEEEIRTTNPVATEQYGSVNSTNLQRGNI

SEQ ID NO: 3698 - protein, 29 aa, Artificial Sequence
  Description of Artificial Sequence: Synthetic peptide
DEEEIRTTNPVATEQYGSVSTNEQRGNMR

SEQ ID NO: 3699 - protein, 30 aa, Artificial Sequence
  Description of Artificial Sequence: Synthetic polypeptide
DEEEIRTTNPVATEQYGVSVSYTNLQRGNR

SEQ ID NO: 3700 - protein, 28 aa, Artificial Sequence
  Description of Artificial Sequence: Synthetic peptide
DEEEIRTTNPVATEQYGSVYTNLQRGNM

SEQ ID NO: 3701 - protein, 29 aa, Artificial Sequence
  Description of Artificial Sequence: Synthetic peptide
DEEEIRTTNPVATEQYGSVSTNEQRGNRA

SEQ ID NO: 3702 - protein, 30 aa, Artificial Sequence
  Description of Artificial Sequence: Synthetic polypeptide
DEEEIRTTNPVATEQYGSVSTNFLQRGNRG

SEQ ID NO: 3703 - protein, 30 aa, Artificial Sequence
  Description of Artificial Sequence: Synthetic polypeptide
DEEEIRTTNPVATEQYGESVMSTNLQRGNR

SEQ ID NO: 3704 - protein, 30 aa, Artificial Sequence
  Description of Artificial Sequence: Synthetic polypeptide
DEEEIRTTNPVATEQYGSVSTNFLQRGNNR

SEQ ID NO: 3705 - protein, 30 aa, Artificial Sequence
  Description of Artificial Sequence: Synthetic polypeptide
DEEEIRTTNPVATEQYGSVSTNFLQRGNHR

SEQ ID NO: 3706 - protein, 29 aa, Artificial Sequence
  Description of Artificial Sequence: Synthetic peptide
DEEEIRTTNPVATEQYGSVSTNFLQRGER

SEQ ID NO: 3707 - protein, 30 aa, Artificial Sequence
  Description of Artificial Sequence: Synthetic polypeptide
DEEEIRTTNPVATEQYGESVLSTNLQRGNR

SEQ ID NO: 3708 - protein, 30 aa, Artificial Sequence
  Description of Artificial Sequence: Synthetic polypeptide
DEEEIRTTNPVATEQYGSVSTNFLDQRGNR

SEQ ID NO: 3709 - protein, 28 aa, Artificial Sequence
  Description of Artificial Sequence: Synthetic peptide
DEEEIRTTNPVATEHYGSSSTNLQRGNR

SEQ ID NO: 3710 - protein, 29 aa, Artificial Sequence
  Description of Artificial Sequence: Synthetic peptide
DEEEIRTTNPVATEHYGSFVSTNLQRGNR

SEQ ID NO: 3711 - protein, 30 aa, Artificial Sequence
  Description of Artificial Sequence: Synthetic polypeptide
DEEEIRTTNPVATEQYGESVASTNLQRGNR

SEQ ID NO: 3712 - protein, 29 aa, Artificial Sequence
  Description of Artificial Sequence: Synthetic peptide
DEEEIRTTNPVATEQYGSVNSTNLERGNR

SEQ ID NO: 3713 - protein, 30 aa, Artificial Sequence
  Description of Artificial Sequence: Synthetic polypeptide
DEEEIRTTNPVATEQYGSVNSTNLIQRGNR

SEQ ID NO: 3714 - protein, 28 aa, Artificial Sequence
  Description of Artificial Sequence: Synthetic peptide
DEEEIRTTNPVATEHYGHVSTNLQRGNR

SEQ ID NO: 3715 - protein, 29 aa, Artificial Sequence
  Description of Artificial Sequence: Synthetic peptide
DEEEIRTTNPVATEQYGSVNSTNLQCGNR

SEQ ID NO: 3716 - protein, 29 aa, Artificial Sequence
  Description of Artificial Sequence: Synthetic peptide
DEEEIRTTNPVATEQYGELVSTNLQRGNR

SEQ ID NO: 3717 - protein, 29 aa, Artificial Sequence
  Description of Artificial Sequence: Synthetic peptide
DEEEIRTTNPVATEQYGSVSTNDLQAGNR

SEQ ID NO: 3718 - protein, 29 aa, Artificial Sequence
  Description of Artificial Sequence: Synthetic peptide
DEEEIRTTNPVATEQYGSVYTNLQRGNGR

SEQ ID NO: 3719 - protein, 29 aa, Artificial Sequence
  Description of Artificial Sequence: Synthetic peptide
DEEEIRTTNPVATEQYGSVSTNEQRYGNR

SEQ ID NO: 3720 - protein, 29 aa, Artificial Sequence
  Description of Artificial Sequence: Synthetic peptide
DEEEIRTTNPVATEQYGSVSTNEQRGNRR

SEQ ID NO: 3721 - protein, 28 aa, Artificial Sequence
  Description of Artificial Sequence: Synthetic peptide
DEEEIRTTNPVATEQYGSVSTNEQRGHR

SEQ ID NO: 3722 - protein, 29 aa, Artificial Sequence
  Description of Artificial Sequence: Synthetic peptide
DEEEIRTTNPVATEQYGSVNSTNLQRGSR

SEQ ID NO: 3723 - protein, 29 aa, Artificial Sequence
  Description of Artificial Sequence: Synthetic peptide
DEEEIRTTNPVATEQYGSVNSTNLQRGTR

SEQ ID NO: 3724 - protein, 28 aa, Artificial Sequence
  Description of Artificial Sequence: Synthetic peptide
DEEEIRTTNPVATEQYGSVSTNEQRGFR

SEQ ID NO: 3725 - protein, 29 aa, Artificial Sequence
  Description of Artificial Sequence: Synthetic peptide
DEEEIRTTNPVATEQYGTVSTNLQPRGNR

SEQ ID NO: 3726 - protein, 28 aa, Artificial Sequence
  Description of Artificial Sequence: Synthetic peptide
DEEEIRTTNPVATEQYGTVSTNLQMGNR

SEQ ID NO: 3727 - protein, 28 aa, Artificial Sequence
  Description of Artificial Sequence: Synthetic peptide
DEEEIRTTNPVATEGYGSVSTWLQRGNR

SEQ ID NO: 3728 - protein, 28 aa, Artificial Sequence
  Description of Artificial Sequence: Synthetic peptide
DEEEIRTTNPVATEQYGTVSTNLQKGNR

SEQ ID NO: 3729 - protein, 28 aa, Artificial Sequence
  Description of Artificial Sequence: Synthetic peptide
DEEEIRTTNPVATEQYGDVSWNLQRGNR

SEQ ID NO: 3730 - protein, 29 aa, Artificial Sequence
  Description of Artificial Sequence: Synthetic peptide
DEEEIRTTNPVATEQYGDVSTTNLQRGNR

SEQ ID NO: 3731 - protein, 29 aa, Artificial Sequence
  Description of Artificial Sequence: Synthetic peptide
QEEEIRTTNPVATEQYGSVSTNLNQRGNR

SEQ ID NO: 3732 - protein, 28 aa, Artificial Sequence
  Description of Artificial Sequence: Synthetic peptide
DEEEIRTTNPVATEGYGSVSTNTQRGNR

SEQ ID NO: 3733 - protein, 29 aa, Artificial Sequence
  Description of Artificial Sequence: Synthetic peptide
DEEEIRTTNPVATEGYGSVSTNLQRTGNR

SEQ ID NO: 3734 - protein, 28 aa, Artificial Sequence
  Description of Artificial Sequence: Synthetic peptide
DEEEIRTTNPVATEGYGSVSTNLQRSNR

SEQ ID NO: 3735 - protein, 28 aa, Artificial Sequence
  Description of Artificial Sequence: Synthetic peptide
DEEEIRTTNPVATEGYGSVSTNLQRGIR

SEQ ID NO: 3736 - protein, 29 aa, Artificial Sequence
  Description of Artificial Sequence: Synthetic peptide
DEEEIRTTNPVATEGYGSVSTNLQRAGNR

SEQ ID NO: 3737 - protein, 28 aa, Artificial Sequence
  Description of Artificial Sequence: Synthetic peptide
DEEEIRTTNPVATEGYGSVSTNLQKGNR

SEQ ID NO: 3738 - protein, 28 aa, Artificial Sequence
  Description of Artificial Sequence: Synthetic peptide
DEEEIRTTNPVATEQYGTVSMNLQRGNR

SEQ ID NO: 3739 - protein, 28 aa, Artificial Sequence
  Description of Artificial Sequence: Synthetic peptide
DEEEIRTTNPVATEQYGTVETNLQRGNR

SEQ ID NO: 3740 - protein, 30 aa, Artificial Sequence
  Description of Artificial Sequence: Synthetic polypeptide
DEEEIRTTNPVATEQYGSVSTNDLQRGGNR

SEQ ID NO: 3741 - protein, 30 aa, Artificial Sequence
  Description of Artificial Sequence: Synthetic polypeptide
DEEEIRTTNPVATEQYGSVSTNDLQRGNRI

SEQ ID NO: 3742 - protein, 30 aa, Artificial Sequence
  Description of Artificial Sequence: Synthetic polypeptide
DEEEIRTTNPVATEQYGSVSTNDLQRMGNR

SEQ ID NO: 3743 - protein, 30 aa, Artificial Sequence
  Description of Artificial Sequence: Synthetic polypeptide
DEEEIRTTNPVATEQYGSVSTNDLQRSGNR

SEQ ID NO: 3744 - protein, 28 aa, Artificial Sequence
  Description of Artificial Sequence: Synthetic peptide
DEEEIRTTNPVATEQYGTVSTNLQRGIR

SEQ ID NO: 3745 - protein, 30 aa, Artificial Sequence
  Description of Artificial Sequence: Synthetic polypeptide
DEEEIRTTNPVATEQYGSVSTNDLQRVGNR

SEQ ID NO: 3746 - protein, 28 aa, Artificial Sequence
  Description of Artificial Sequence: Synthetic peptide
DEEEIRTTNPVATEQYGTVSTNLQRGLR

SEQ ID NO: 3747 - protein, 28 aa, Artificial Sequence
  Description of Artificial Sequence: Synthetic peptide
DEEEIRTTNPVATEQYGTVSTNLQRGNN

SEQ ID NO: 3748 - protein, 28 aa, Artificial Sequence
  Description of Artificial Sequence: Synthetic peptide
DEEEIRTTNPVATEQYGSVYTNLQRVNR

SEQ ID NO: 3749 - protein, 29 aa, Artificial Sequence
  Description of Artificial Sequence: Synthetic peptide
DEEEIRTTNPVATEQYGSVNSTNLQRGVR

SEQ ID NO: 3750 - protein, 28 aa, Artificial Sequence
  Description of Artificial Sequence: Synthetic peptide
DEEEIRTTNPVATEQYGSVSTNEQRGER

SEQ ID NO: 3751 - protein, 29 aa, Artificial Sequence
  Description of Artificial Sequence: Synthetic peptide
DEEEIRTTNPVATEQYGSVSTNEQERGNR

SEQ ID NO: 3752 - protein, 29 aa, Artificial Sequence
  Description of Artificial Sequence: Synthetic peptide
QEEEIRTTNPVATEQYGSVSTNLQRGNSR

SEQ ID NO: 3753 - protein, 29 aa, Artificial Sequence
  Description of Artificial Sequence: Synthetic peptide
QEEEIRTTNPVATEQYGSVSTNLQRGNRN

SEQ ID NO: 3754 - protein, 29 aa, Artificial Sequence
  Description of Artificial Sequence: Synthetic peptide
QEEEIRTTNPVATEQYGSVSTNLQRGNRL

SEQ ID NO: 3755 - protein, 28 aa, Artificial Sequence
  Description of Artificial Sequence: Synthetic peptide
QEEEIRTTNPVATEQYGSVSTNLQRGNF

SEQ ID NO: 3756 - protein, 28 aa, Artificial Sequence
  Description of Artificial Sequence: Synthetic peptide
QEEEIRTTNPVATEQYGSVSTNLQRGNA

SEQ ID NO: 3757 - protein, 29 aa, Artificial Sequence
  Description of Artificial Sequence: Synthetic peptide
DEEEIRTTNPVATEQYGSVSTNELQTGNR

SEQ ID NO: 3758 - protein, 30 aa, Artificial Sequence
  Description of Artificial Sequence: Synthetic polypeptide
DEEEIRTTNPVATEQYGSVSTNELQRGNRC

SEQ ID NO: 3759 - protein, 30 aa, Artificial Sequence
  Description of Artificial Sequence: Synthetic polypeptide
DEEEIRTTNPVATEQYGSVSTNELQRGNDR

SEQ ID NO: 3760 - protein, 29 aa, Artificial Sequence
  Description of Artificial Sequence: Synthetic peptide
QEEEIRTTNPVATEQYGSVSTNLQRGDNR

SEQ ID NO: 3761 - protein, 30 aa, Artificial Sequence
  Description of Artificial Sequence: Synthetic polypeptide
DEEEIRTTNPVATEQYGSVSTNELPQRGNR

SEQ ID NO: 3762 - protein, 29 aa, Artificial Sequence
  Description of Artificial Sequence: Synthetic peptide
DEEEIRTTNPVATEQYGTVSTTNLQRGNR

SEQ ID NO: 3763 - protein, 30 aa, Artificial Sequence
  Description of Artificial Sequence: Synthetic polypeptide
DEEEIRTTNPVATEQYGSVSNTPNLQRGNR

SEQ ID NO: 3764 - protein, 29 aa, Artificial Sequence
  Description of Artificial Sequence: Synthetic peptide
DEEEIRTTNPVATEQYGSVSTNEIQRGNR

SEQ ID NO: 3765 - protein, 28 aa, Artificial Sequence
  Description of Artificial Sequence: Synthetic peptide
QEEEIRTTNPVATEQYGSVSTNLQHGNR

SEQ ID NO: 3766 - protein, 29 aa, Artificial Sequence
  Description of Artificial Sequence: Synthetic peptide
DEEEIRTTNPVATEQYGTVSTNNLQRGNR

SEQ ID NO: 3767 - protein, 29 aa, Artificial Sequence
  Description of Artificial Sequence: Synthetic peptide
DEEEIRTTNPVATEQYGTVSTNLQRGMNR

SEQ ID NO: 3768 - protein, 28 aa, Artificial Sequence
  Description of Artificial Sequence: Synthetic peptide
DEEEIRTTNPVATEQYGEVSTNLQRGNH

SEQ ID NO: 3769 - protein, 28 aa, Artificial Sequence
  Description of Artificial Sequence: Synthetic peptide
DEEEIRTTNPVATEQYGWNSTNLQRGNR

SEQ ID NO: 3770 - protein, 29 aa, Artificial Sequence
  Description of Artificial Sequence: Synthetic peptide
DEEEIRTTNPVATEQYGWSVSENLQRGNR

SEQ ID NO: 3771 - protein, 28 aa, Artificial Sequence
  Description of Artificial Sequence: Synthetic peptide
DEEEIRTTNPVATEQYGSVVTNGQRGNR

SEQ ID NO: 3772 - protein, 29 aa, Artificial Sequence
  Description of Artificial Sequence: Synthetic peptide
DEEEIRTTNPVATEQYGGVSTNLQRGNIR

SEQ ID NO: 3773 - protein, 29 aa, Artificial Sequence
  Description of Artificial Sequence: Synthetic peptide
DEEEIRTTNPVATEQYGSVMTNGLQRGNR

SEQ ID NO: 3774 - protein, 29 aa, Artificial Sequence
  Description of Artificial Sequence: Synthetic peptide
DEEEIRTTNPVATEQYGGVSTNLQRGNHR

SEQ ID NO: 3775 - protein, 28 aa, Artificial Sequence
  Description of Artificial Sequence: Synthetic peptide
DEEEIRTTNPVATEQYGGVSTNLQRGNH

SEQ ID NO: 3776 - protein, 29 aa, Artificial Sequence
  Description of Artificial Sequence: Synthetic peptide
DEEEIRTTNPVATEQYGGVSTNLQREGNR

SEQ ID NO: 3777 - protein, 28 aa, Artificial Sequence
  Description of Artificial Sequence: Synthetic peptide
DEEEIATTNPVATENYGSVSTNLQRGNR

SEQ ID NO: 3778 - protein, 29 aa, Artificial Sequence
  Description of Artificial Sequence: Synthetic peptide
DEEEIRTTNPVATEQYGGVSTNLQDRGNR

SEQ ID NO: 3779 - protein, 28 aa, Artificial Sequence
  Description of Artificial Sequence: Synthetic peptide
DEEEIRTTNPVATEQYGGVSTNLQRGNK

SEQ ID NO: 3780 - protein, 28 aa, Artificial Sequence
  Description of Artificial Sequence: Synthetic peptide
DEEEIRTTNPVATEQYGSVMTNGQRGNR

SEQ ID NO: 3781 - protein, 29 aa, Artificial Sequence
  Description of Artificial Sequence: Synthetic peptide
DEEEIRTTNPVATEQYGGVSTNLIQRGNR

SEQ ID NO: 3782 - protein, 29 aa, Artificial Sequence
  Description of Artificial Sequence: Synthetic peptide
DEEEIRTTNPVATEQYGSVSNTILQRGNR

SEQ ID NO: 3783 - protein, 28 aa, Artificial Sequence
  Description of Artificial Sequence: Synthetic peptide
DEEEIRTTNPVATEQYGGVNTNLQRGNR

SEQ ID NO: 3784 - protein, 28 aa, Artificial Sequence
  Description of Artificial Sequence: Synthetic peptide
DEEEIRTTNPVATEWYGSVSTNLTRGNR

SEQ ID NO: 3785 - protein, 29 aa, Artificial Sequence
  Description of Artificial Sequence: Synthetic peptide
DEEEIRTTNPVATEWYGSVSTNLQRGNRS

SEQ ID NO: 3786 - protein, 29 aa, Artificial Sequence
  Description of Artificial Sequence: Synthetic peptide
DEEEIRTTNPVATEWYGSVSTNLQRGNDR

SEQ ID NO: 3787 - protein, 28 aa, Artificial Sequence
  Description of Artificial Sequence: Synthetic peptide
DEEEIRTTNPVATEWYGSVSTNLQNGNR

SEQ ID NO: 3788 - protein, 29 aa, Artificial Sequence
  Description of Artificial Sequence: Synthetic peptide
DEEEIRTTNPVATEQYGGSVSTNLQSGNR

SEQ ID NO: 3789 - protein, 29 aa, Artificial Sequence
  Description of Artificial Sequence: Synthetic peptide
DEEEIRTTNPVATEQYGSVSTNILQRGNF

SEQ ID NO: 3790 - protein, 28 aa, Artificial Sequence
  Description of Artificial Sequence: Synthetic peptide
DEEEIRTTNPVATEQYGGVSTNLQRGNN

SEQ ID NO: 3791 - protein, 28 aa, Artificial Sequence
  Description of Artificial Sequence: Synthetic peptide
DEEEIRTTNPVATEQYGGVSTNLQRLNR

SEQ ID NO: 3792 - protein, 29 aa, Artificial Sequence
  Description of Artificial Sequence: Synthetic peptide
DEEEIRTTNPVATEQYGGVSTNLQRPGNR

SEQ ID NO: 3793 - protein, 29 aa, Artificial Sequence
  Description of Artificial Sequence: Synthetic peptide
DEEEIRTTNPVATFQYGSVSTNLQRGNNR

SEQ ID NO: 3794 - protein, 28 aa, Artificial Sequence
  Description of Artificial Sequence: Synthetic peptide
DEEEIRTTNPVATFQYGSVSTNLQRGNI

SEQ ID NO: 3795 - protein, 28 aa, Artificial Sequence
  Description of Artificial Sequence: Synthetic peptide
DEEEIRTTNPVATFQYGSVSTNLQRGER

SEQ ID NO: 3796 - protein, 28 aa, Artificial Sequence
  Description of Artificial Sequence: Synthetic peptide
DEEEIRTTNPVATFQYGSVSTNLQMGNR

SEQ ID NO: 3797 - protein, 28 aa, Artificial Sequence
  Description of Artificial Sequence: Synthetic peptide
DEEEIRTTNPVATFQYGSVSPNLQRGNR

SEQ ID NO: 3798 - protein, 28 aa, Artificial Sequence
  Description of Artificial Sequence: Synthetic peptide
DEEEIRTTNPVATEQYGHGSTNLQRGNR

SEQ ID NO: 3799 - protein, 28 aa, Artificial Sequence
  Description of Artificial Sequence: Synthetic peptide
DEEEIRTTNPVATEYYGSVSTNPQRGNR

SEQ ID NO: 3800 - protein, 29 aa, Artificial Sequence
  Description of Artificial Sequence: Synthetic peptide
DEEEIRTTNPVATEYYGSVSTNLTQRGNR

SEQ ID NO: 3801 - protein, 28 aa, Artificial Sequence
  Description of Artificial Sequence: Synthetic peptide
DEEEIRTTNPVATEQYGGVSTTLQRGNR

SEQ ID NO: 3802 - protein, 29 aa, Artificial Sequence
  Description of Artificial Sequence: Synthetic peptide
DEEEIRTTNPVATEYYGSVSTNLQWRGNR

SEQ ID NO: 3803 - protein, 29 aa, Artificial Sequence
  Description of Artificial Sequence: Synthetic peptide
DEEEIRTTNPVATEYYGSVSTNLQTRGNR

SEQ ID NO: 3804 - protein, 28 aa, Artificial Sequence
  Description of Artificial Sequence: Synthetic peptide
DEEEIRTTNPVATEQYGGVSTNSQRGNR

SEQ ID NO: 3805 - protein, 29 aa, Artificial Sequence
  Description of Artificial Sequence: Synthetic peptide
DEEEIRTTNPVATEYYGSVSTNLQRGSNR

SEQ ID NO: 3806 - protein, 29 aa, Artificial Sequence
  Description of Artificial Sequence: Synthetic peptide
DEEEIRTTNPVATEYYGSVSTNLQRGNRC

SEQ ID NO: 3807 - protein, 28 aa, Artificial Sequence
  Description of Artificial Sequence: Synthetic peptide
DEEEIRTTNPVATEYYGSVSTNLQRGNM

SEQ ID NO: 3808 - protein, 28 aa, Artificial Sequence
  Description of Artificial Sequence: Synthetic peptide
DEEEIRTTNPVATEYYGSVSTNLQRGLR

SEQ ID NO: 3809 - protein, 30 aa, Artificial Sequence
  Description of Artificial Sequence: Synthetic polypeptide
DEEEIRTTNPVATEQYGSVSGTNLQIRGNR

SEQ ID NO: 3810 - protein, 30 aa, Artificial Sequence
  Description of Artificial Sequence: Synthetic polypeptide
DEEEIRTTNPVATEQYGSVSTNILQRGNRP

SEQ ID NO: 3811 - protein, 28 aa, Artificial Sequence
  Description of Artificial Sequence: Synthetic peptide
DEEEIRTTNPVATEQYGGVSTNPQRGNR

SEQ ID NO: 3812 - protein, 29 aa, Artificial Sequence
  Description of Artificial Sequence: Synthetic peptide
DEEEIRTTNPVATEWYGSVSTNLQLRGNR

SEQ ID NO: 3813 - protein, 28 aa, Artificial Sequence
  Description of Artificial Sequence: Synthetic peptide
DEEEIRTTNPVATEWYGSVSTNLDRGNR

SEQ ID NO: 3814 - protein, 29 aa, Artificial Sequence
  Description of Artificial Sequence: Synthetic peptide
DEEEIRTTNPVATEWYGSVSTNLDQRGNR

SEQ ID NO: 3815 - protein, 28 aa, Artificial Sequence
  Description of Artificial Sequence: Synthetic peptide
DEEEIRTTNPVATEWYGSVSMNLQRGNR

SEQ ID NO: 3816 - protein, 29 aa, Artificial Sequence
  Description of Artificial Sequence: Synthetic peptide
DEEEIRTTNPVATEVYGSVSTNLQGRGNR

SEQ ID NO: 3817 - protein, 29 aa, Artificial Sequence
  Description of Artificial Sequence: Synthetic peptide
DEEEIRTTNPVATEQYGGSVSTNLQKGNR

SEQ ID NO: 3818 - protein, 30 aa, Artificial Sequence
  Description of Artificial Sequence: Synthetic polypeptide
DEEEIRTTNPVATEQYGSVSTNILQRGENR

SEQ ID NO: 3819 - protein, 29 aa, Artificial Sequence
  Description of Artificial Sequence: Synthetic peptide
DEEEIRTTNPVATEQYGSVSTNADQRGNR

SEQ ID NO: 3820 - protein, 29 aa, Artificial Sequence
  Description of Artificial Sequence: Synthetic peptide
DEEEIRTTNPVATEQYGGSVSTNLQHGNR

SEQ ID NO: 3821 - protein, 29 aa, Artificial Sequence
  Description of Artificial Sequence: Synthetic peptide
DEEEIRTTNPVATEVYGSVSTNLDQRGNR

SEQ ID NO: 3822 - protein, 28 aa, Artificial Sequence
  Description of Artificial Sequence: Synthetic peptide
DEEEIRTTNPVATEQYGSVMTNLQGGNR

SEQ ID NO: 3823 - protein, 29 aa, Artificial Sequence
  Description of Artificial Sequence: Synthetic peptide
DEEEIRTTNPVATEQYGSVMTNLQRGNAR

SEQ ID NO: 3824 - protein, 29 aa, Artificial Sequence
  Description of Artificial Sequence: Synthetic peptide
DEEEIRTTNPVATEVYGSVSNTNLQRGNR

SEQ ID NO: 3825 - protein, 28 aa, Artificial Sequence
  Description of Artificial Sequence: Synthetic peptide
DEEEIRTTNPVATEQYGSVMTNLQRGNK

SEQ ID NO: 3826 - protein, 29 aa, Artificial Sequence
  Description of Artificial Sequence: Synthetic peptide
DEEEIRTTNPVATEQYGGSVSTNLQGGNR

SEQ ID NO: 3827 - protein, 28 aa, Artificial Sequence
  Description of Artificial Sequence: Synthetic peptide
DEEEIRTTNPVATEVYGSVSGNLQRGNR

SEQ ID NO: 3828 - protein, 29 aa, Artificial Sequence
  Description of Artificial Sequence: Synthetic peptide
DEEEIRTTNPVATEVYGSVSCTNLQRGNR

SEQ ID NO: 3829 - protein, 29 aa, Artificial Sequence
  Description of Artificial Sequence: Synthetic peptide
DEEEIRTTNPVATEQYGGSVSENLQRGNR

SEQ ID NO: 3830 - protein, 28 aa, Artificial Sequence
  Description of Artificial Sequence: Synthetic peptide
DEEEIRTTNPVATEVYGSVQTNLQRGNR

SEQ ID NO: 3831 - protein, 29 aa, Artificial Sequence
  Description of Artificial Sequence: Synthetic peptide
DEEEIRTTNPVATEVYGSVNSTNLQRGNR

SEQ ID NO: 3832 - protein, 28 aa, Artificial Sequence
  Description of Artificial Sequence: Synthetic peptide
DEEEIRTTNPVATEQYGSVSTNAFRGNR

SEQ ID NO: 3833 - protein, 28 aa, Artificial Sequence
  Description of Artificial Sequence: Synthetic peptide
DEEEIRTTNPVATEQYGSVVTNLQMGNR

SEQ ID NO: 3834 - protein, 29 aa, Artificial Sequence
  Description of Artificial Sequence: Synthetic peptide
DEEEIRTTNPVATEQYGSVSTNAGQRGNR

SEQ ID NO: 3835 - protein, 29 aa, Artificial Sequence
  Description of Artificial Sequence: Synthetic peptide
DEEEIRTTNPVATEVYGSVSTNLQIRGNR

SEQ ID NO: 3836 - protein, 29 aa, Artificial Sequence
  Description of Artificial Sequence: Synthetic peptide
DEEEIRTTNPVATFQYGSVSTNLQRGNRN

SEQ ID NO: 3837 - protein, 29 aa, Artificial Sequence
  Description of Artificial Sequence: Synthetic peptide
DEEEIRTTNPVATEQYGGSVSTNLQRENR

SEQ ID NO: 3838 - protein, 28 aa, Artificial Sequence
  Description of Artificial Sequence: Synthetic peptide
DEEEIRTTNPVATEVYGSVSTNLQQGNR

SEQ ID NO: 3839 - protein, 28 aa, Artificial Sequence
  Description of Artificial Sequence: Synthetic peptide
DEEEIRTTNPVATEWYGSGSTNLQRGNR

SEQ ID NO: 3840 - protein, 29 aa, Artificial Sequence
  Description of Artificial Sequence: Synthetic peptide
DEEEIRTTNPVATEWYGQSVSTNLQRGNR

SEQ ID NO: 3841 - protein, 28 aa, Artificial Sequence
  Description of Artificial Sequence: Synthetic peptide
DEEEIRTTNPVATEWYGFVSTNLQRGNR

SEQ ID NO: 3842 - protein, 29 aa, Artificial Sequence
  Description of Artificial Sequence: Synthetic peptide
DEEEIRTTNPVATEQYGSVVTNLQARGNR

SEQ ID NO: 3843 - protein, 29 aa, Artificial Sequence
  Description of Artificial Sequence: Synthetic peptide
DEEEIRTTNPVATEQYGGSVSTNLQRPNR

SEQ ID NO: 3844 - protein, 30 aa, Artificial Sequence
  Description of Artificial Sequence: Synthetic polypeptide
DEEEIRTTNPVATEQYGGSVSTNLQRGNVR

SEQ ID NO: 3845 - protein, 29 aa, Artificial Sequence
  Description of Artificial Sequence: Synthetic peptide
DEEEIRTTNPVATEQYGGSVSTNLQRGNI

SEQ ID NO: 3846 - protein, 29 aa, Artificial Sequence
  Description of Artificial Sequence: Synthetic peptide
DEEEIRTTNPVATEQYGSVVTNLQFRGNR

SEQ ID NO: 3847 - protein, 29 aa, Artificial Sequence
  Description of Artificial Sequence: Synthetic peptide
DEEEIRTTNPVATEVYGSVSTNPLQRGNR

SEQ ID NO: 3848 - protein, 29 aa, Artificial Sequence
  Description of Artificial Sequence: Synthetic peptide
DEEEIRTTNPVATEQYGSVMTNLEQRGNR

SEQ ID NO: 3849 - protein, 29 aa, Artificial Sequence
  Description of Artificial Sequence: Synthetic peptide
DEEEIRTTNPVATEVYGSVSTNLQSRGNR

SEQ ID NO: 3850 - protein, 28 aa, Artificial Sequence
  Description of Artificial Sequence: Synthetic peptide
DEEEIRTTNPVATEVYGSVSTNLQRGNV

SEQ ID NO: 3851 - protein, 29 aa, Artificial Sequence
  Description of Artificial Sequence: Synthetic peptide
DEEEIRTTNPVATEVYGSVSTNLQRGNRG

SEQ ID NO: 3852 - protein, 29 aa, Artificial Sequence
  Description of Artificial Sequence: Synthetic peptide
DEEEIRTTNPVATEVYGSVSTNLQRGNMR

SEQ ID NO: 3853 - protein, 28 aa, Artificial Sequence
  Description of Artificial Sequence: Synthetic peptide
DEEEIRTTNPVATEVYGSVSTNLQRGNL

SEQ ID NO: 3854 - protein, 28 aa, Artificial Sequence
  Description of Artificial Sequence: Synthetic peptide
DEEEIRTTNPVATEVYGSVSTNLQRGNH

SEQ ID NO: 3855 - protein, 29 aa, Artificial Sequence
  Description of Artificial Sequence: Synthetic peptide
DEEEIRTTNPVATEVYGSVSTNLQRGNGR

SEQ ID NO: 3856 - protein, 28 aa, Artificial Sequence
  Description of Artificial Sequence: Synthetic peptide
DEEEIRTTNPVATEVYGSVSTNLQRGAR

SEQ ID NO: 3857 - protein, 28 aa, Artificial Sequence
  Description of Artificial Sequence: Synthetic peptide
DEEEIRTTNPVATEVYGSVSTNLQRFNR

SEQ ID NO: 3858 - protein, 29 aa, Artificial Sequence
  Description of Artificial Sequence: Synthetic peptide
DEEEIRTTNPVATEVYGSVSTNLQMRGNR

SEQ ID NO: 3859 - protein, 28 aa, Artificial Sequence
  Description of Artificial Sequence: Synthetic peptide
DEEEIRTTNPVATETYGVVSTNLQRGNR

SEQ ID NO: 3860 - protein, 29 aa, Artificial Sequence
  Description of Artificial Sequence: Synthetic peptide
DEEEIRTTNPVATGQYGSVSETNLQRGNR

SEQ ID NO: 3861 - protein, 28 aa, Artificial Sequence
  Description of Artificial Sequence: Synthetic peptide
DEEEIRTTNPVATGQYGSVSTNLQGGNR

SEQ ID NO: 3862 - protein, 29 aa, Artificial Sequence
  Description of Artificial Sequence: Synthetic peptide
DEEEIRTTNPVATTQYGSVSTNLQRDGNR

SEQ ID NO: 3863 - protein, 28 aa, Artificial Sequence
  Description of Artificial Sequence: Synthetic peptide
DEEEIRTTNPVATTQYGSVSMNLQRGNR

SEQ ID NO: 3864 - protein, 29 aa, Artificial Sequence
  Description of Artificial Sequence: Synthetic peptide
DEEEIRTTNPVATSQYGSVSTNLQRGNRE

SEQ ID NO: 3865 - protein, 29 aa, Artificial Sequence
  Description of Artificial Sequence: Synthetic peptide
DEEEIRTTNPVATEQYGSVMSTNLQRDNR

SEQ ID NO: 3866 - protein, 29 aa, Artificial Sequence
  Description of Artificial Sequence: Synthetic peptide
DEEEIRTTNPVATSQYGSVSTNLQRGNFR

SEQ ID NO: 3867 - protein, 28 aa, Artificial Sequence
  Description of Artificial Sequence: Synthetic peptide
DEEEIRTTNPVATSQYGSVSTNLQRGDR

SEQ ID NO: 3868 - protein, 28 aa, Artificial Sequence
  Description of Artificial Sequence: Synthetic peptide
DEEEIRTTNPVATSQYGSVSTNLQNGNR

SEQ ID NO: 3869 - protein, 29 aa, Artificial Sequence
  Description of Artificial Sequence: Synthetic peptide
DEEEIRTTNPVATEQYGSVMSTNLQRGNQ

SEQ ID NO: 3870 - protein, 30 aa, Artificial Sequence
  Description of Artificial Sequence: Synthetic polypeptide
DEEEIRTTNPVATEQYGSVMSTNLIQRGNR

SEQ ID NO: 3871 - protein, 28 aa, Artificial Sequence
  Description of Artificial Sequence: Synthetic peptide
DEEEIRTTNPVATSQYGSVSTNLQLGNR

SEQ ID NO: 3872 - protein, 28 aa, Artificial Sequence
  Description of Artificial Sequence: Synthetic peptide
DEEEIRTTNPVATSQYGSVSTNLQFGNR

SEQ ID NO: 3873 - protein, 28 aa, Artificial Sequence
  Description of Artificial Sequence: Synthetic peptide
DEEEIRTTNPVATEPYGSVPTNLQRGNR

SEQ ID NO: 3874 - protein, 29 aa, Artificial Sequence
  Description of Artificial Sequence: Synthetic peptide
DEEEIRTTNPVATSQYGSVSTHNLQRGNR

SEQ ID NO: 3875 - protein, 28 aa, Artificial Sequence
  Description of Artificial Sequence: Synthetic peptide
DEEEIRTTNPVATSQYGSVATNLQRGNR

SEQ ID NO: 3876 - protein, 28 aa, Artificial Sequence
  Description of Artificial Sequence: Synthetic peptide
DEEEIRTTNPVATRQYGSVSTNLQDGNR

SEQ ID NO: 3877 - protein, 28 aa, Artificial Sequence
  Description of Artificial Sequence: Synthetic peptide
DEEEIRTTNPVATRQYGSVSTELQRGNR

SEQ ID NO: 3878 - protein, 29 aa, Artificial Sequence
  Description of Artificial Sequence: Synthetic peptide
DEEEIRTTNPVATRQYGSVSDTNLQRGNR

SEQ ID NO: 3879 - protein, 28 aa, Artificial Sequence
  Description of Artificial Sequence: Synthetic peptide
DEEEIRTTNPVATQQYGSVSTNLQRGNN

SEQ ID NO: 3880 - protein, 28 aa, Artificial Sequence
  Description of Artificial Sequence: Synthetic peptide
DEEEIRTTNPVATEPYGSVSANLQRGNR

SEQ ID NO: 3881 - protein, 28 aa, Artificial Sequence
  Description of Artificial Sequence: Synthetic peptide
DEEEIRTTNPVATTQYGSVSTNLQRGND

SEQ ID NO: 3882 - protein, 28 aa, Artificial Sequence
  Description of Artificial Sequence: Synthetic peptide
DEEEIRTTNPVATTQYGSVSTNLQRGNV

SEQ ID NO: 3883 - protein, 28 aa, Artificial Sequence
  Description of Artificial Sequence: Synthetic peptide
DEEEIRTTNPVATVQYGEVSTNLQRGNR

SEQ ID NO: 3884 - protein, 29 aa, Artificial Sequence
  Description of Artificial Sequence: Synthetic peptide
DEEEIRTTNPVATEPYGSVSTNLQRGPNR

SEQ ID NO: 3885 - protein, 29 aa, Artificial Sequence
  Description of Artificial Sequence: Synthetic peptide
DEEEIRTTNPVATEPYGSVSTNLQRGNHR

SEQ ID NO: 3886 - protein, 28 aa, Artificial Sequence
  Description of Artificial Sequence: Synthetic peptide
DEEEIRTTNPVATWQYGSVSTNIQRGNR

SEQ ID NO: 3887 - protein, 28 aa, Artificial Sequence
  Description of Artificial Sequence: Synthetic peptide
DEEEIRTTNPVATWQYGSVSTNDQRGNR

SEQ ID NO: 3888 - protein, 28 aa, Artificial Sequence
  Description of Artificial Sequence: Synthetic peptide
DEEEIRTTNPVATEPYGSVSTNLQIGNR

SEQ ID NO: 3889 - protein, 29 aa, Artificial Sequence
  Description of Artificial Sequence: Synthetic peptide
DEEEIRTTNPVATWQYGSVSGTNLQRGNR

SEQ ID NO: 3890 - protein, 29 aa, Artificial Sequence
  Description of Artificial Sequence: Synthetic peptide
DEEEIRTTNPVATWQYGSVCSTNLQRGNR

SEQ ID NO: 3891 - protein, 29 aa, Artificial Sequence
  Description of Artificial Sequence: Synthetic peptide
DEEEIRTTNPVATVQYGSVSTNLQRVGNR

SEQ ID NO: 3892 - protein, 28 aa, Artificial Sequence
  Description of Artificial Sequence: Synthetic peptide
DEEEIRTTNPVATEPYGSVSTNLDRGNR

SEQ ID NO: 3893 - protein, 29 aa, Artificial Sequence
  Description of Artificial Sequence: Synthetic peptide
DEEEIRTTNPVATVQYGSVSTNLQRGNVR

SEQ ID NO: 3894 - protein, 29 aa, Artificial Sequence
  Description of Artificial Sequence: Synthetic peptide
DEEEIRTTNPVATVQYGSVSTNLQRGNRN

SEQ ID NO: 3895 - protein, 28 aa, Artificial Sequence
  Description of Artificial Sequence: Synthetic peptide
DEEEIRTTNPVATVQYGSVSTDLQRGNR

SEQ ID NO: 3896 - protein, 28 aa, Artificial Sequence
  Description of Artificial Sequence: Synthetic peptide
DEEEIRTTNPVATVQYGSVSMNLQRGNR

SEQ ID NO: 3897 - protein, 29 aa, Artificial Sequence
  Description of Artificial Sequence: Synthetic peptide
DEEEIRTTNPVATVQYGSVSETNLQRGNR

SEQ ID NO: 3898 - protein, 28 aa, Artificial Sequence
  Description of Artificial Sequence: Synthetic peptide
DEEEIRTTNPVATVQYGSVSENLQRGNR

SEQ ID NO: 3899 - protein, 29 aa, Artificial Sequence
  Description of Artificial Sequence: Synthetic peptide
DEEEIRTTNPVATEPYGSVSTCNLQRGNR

SEQ ID NO: 3900 - protein, 29 aa, Artificial Sequence
  Description of Artificial Sequence: Synthetic peptide
DEEEIRTTNPVATEQYGSVMSTNFQRGNR

SEQ ID NO: 3901 - protein, 28 aa, Artificial Sequence
  Description of Artificial Sequence: Synthetic peptide
DEEEIRTTNPVATVQYGSVGTNLQRGNR

SEQ ID NO: 3902 - protein, 29 aa, Artificial Sequence
  Description of Artificial Sequence: Synthetic peptide
DEEEIRTTNPVATEPYGSVSPTNLQRGNR

SEQ ID NO: 3903 - protein, 28 aa, Artificial Sequence
  Description of Artificial Sequence: Synthetic peptide
DEEEIRTTNPVATQQYGSVSTNLQRGDR

SEQ ID NO: 3904 - protein, 28 aa, Artificial Sequence
  Description of Artificial Sequence: Synthetic peptide
DEEEIRTTNPVATQQYGSVSTNDQRGNR

SEQ ID NO: 3905 - protein, 29 aa, Artificial Sequence
  Description of Artificial Sequence: Synthetic peptide
DEEEIRTTNPVATEQYGSVMSTNLQRGPR

SEQ ID NO: 3906 - protein, 29 aa, Artificial Sequence
  Description of Artificial Sequence: Synthetic peptide
DEEEIRTTNPVATEQYGSVMSTNLQRRNR

SEQ ID NO: 3907 - protein, 28 aa, Artificial Sequence
  Description of Artificial Sequence: Synthetic peptide
DEEEIRTTNPVATIQYGSVSTNLQRGER

SEQ ID NO: 3908 - protein, 28 aa, Artificial Sequence
  Description of Artificial Sequence: Synthetic peptide
DEEEIRTTNPVATIQYGSVSTNLQQGNR

SEQ ID NO: 3909 - protein, 29 aa, Artificial Sequence
  Description of Artificial Sequence: Synthetic peptide
DEEEIRTTNPVATEQYGSVMSTNLQSGNR

SEQ ID NO: 3910 - protein, 28 aa, Artificial Sequence
  Description of Artificial Sequence: Synthetic peptide
DEEEIRTTNPVATHQYGSVSTNLQYGNR

SEQ ID NO: 3911 - protein, 30 aa, Artificial Sequence
  Description of Artificial Sequence: Synthetic polypeptide
DEEEIRTTNPVATEQYGHSCVSTNLQRGNR

SEQ ID NO: 3912 - protein, 28 aa, Artificial Sequence
  Description of Artificial Sequence: Synthetic peptide
DEEEIRTTNPVATHQYGSVSTNLQRGQR

SEQ ID NO: 3913 - protein, 28 aa, Artificial Sequence
  Description of Artificial Sequence: Synthetic peptide
DEEEIRTTNPVATHQYGSVSTNLQRGNS

SEQ ID NO: 3914 - protein, 28 aa, Artificial Sequence
  Description of Artificial Sequence: Synthetic peptide
DEEEIRTTNPVATHQYGSVSTNLQRGNA

SEQ ID NO: 3915 - protein, 28 aa, Artificial Sequence
  Description of Artificial Sequence: Synthetic peptide
DEEEIRTTNPVATHQYGSVSTNLQPGNR

SEQ ID NO: 3916 - protein, 28 aa, Artificial Sequence
  Description of Artificial Sequence: Synthetic peptide
DEEEIRTTNPVATHQYGSVSTNLQGGNR

SEQ ID NO: 3917 - protein, 28 aa, Artificial Sequence
  Description of Artificial Sequence: Synthetic peptide
DEEEIRTTNPVATGQYGSVSTNPQRGNR

SEQ ID NO: 3918 - protein, 29 aa, Artificial Sequence
  Description of Artificial Sequence: Synthetic peptide
DEEEIRTTNPVATGQYGSVSTNLQRSGNR

SEQ ID NO: 3919 - protein, 28 aa, Artificial Sequence
  Description of Artificial Sequence: Synthetic peptide
DEEEIRTTNPVATGQYGSVSTNLQRMNR

SEQ ID NO: 3920 - protein, 28 aa, Artificial Sequence
  Description of Artificial Sequence: Synthetic peptide
DEEEIRTTNPVATGQYGSVSTNLQRGNW

SEQ ID NO: 3921 - protein, 29 aa, Artificial Sequence
  Description of Artificial Sequence: Synthetic peptide
DEEEIRTTNPVATGQYGSVSTNLQRGNRV

SEQ ID NO: 3922 - protein, 29 aa, Artificial Sequence
  Description of Artificial Sequence: Synthetic peptide
DEEEIRTTNPVATGQYGSVSTNLQRGNDR

SEQ ID NO: 3923 - protein, 28 aa, Artificial Sequence
  Description of Artificial Sequence: Synthetic peptide
DEEEIRTTNPVATGQYGSVSTNLQRGDR

SEQ ID NO: 3924 - protein, 29 aa, Artificial Sequence
  Description of Artificial Sequence: Synthetic peptide
DEEEIRTTNPVATEGQYGSVSTNLQAGNR

SEQ ID NO: 3925 - protein, 28 aa, Artificial Sequence
  Description of Artificial Sequence: Synthetic peptide
DEEEIRTTNPVATGQYGSVSTNLQIGNR

SEQ ID NO: 3926 - protein, 28 aa, Artificial Sequence
  Description of Artificial Sequence: Synthetic peptide
DEEEIRTTNPVATIQYGSVSTNLQRGNV

SEQ ID NO: 3927 - protein, 28 aa, Artificial Sequence
  Description of Artificial Sequence: Synthetic peptide
DEEEIRTTNPVATGQYGSVSTNAQRGNR

SEQ ID NO: 3928 - protein, 28 aa, Artificial Sequence
  Description of Artificial Sequence: Synthetic peptide
DEEEIRTTNPVATIQYGSVSTNLQRPNR

SEQ ID NO: 3929 - protein, 28 aa, Artificial Sequence
  Description of Artificial Sequence: Synthetic peptide
DEEEIRTTNPVATLQYGSASTNLQRGNR

SEQ ID NO: 3930 - protein, 29 aa, Artificial Sequence
  Description of Artificial Sequence: Synthetic peptide
DEEEIRTTNPVATQQYGSVSTDNLQRGNR

SEQ ID NO: 3931 - protein, 29 aa, Artificial Sequence
  Description of Artificial Sequence: Synthetic peptide
DEEEIRTTNPVATPEQYGSESTNLQRGNR

SEQ ID NO: 3932 - protein, 30 aa, Artificial Sequence
  Description of Artificial Sequence: Synthetic polypeptide
DEEEIRTTNPVATEQYGSVMSTNLQRYGNR

SEQ ID NO: 3933 - protein, 29 aa, Artificial Sequence
  Description of Artificial Sequence: Synthetic peptide
DEEEIRTTNPVATNQYGSVSTNLQNRGNR

SEQ ID NO: 3934 - protein, 28 aa, Artificial Sequence
  Description of Artificial Sequence: Synthetic peptide
DEEEIRTTNPVATEQYGCVVTNLQRGNR

SEQ ID NO: 3935 - protein, 28 aa, Artificial Sequence
  Description of Artificial Sequence: Synthetic peptide
DEEEIRTTNPVATMQYGSVSTNNQRGNR

SEQ ID NO: 3936 - protein, 28 aa, Artificial Sequence
  Description of Artificial Sequence: Synthetic peptide
DEEEIRTTNPVATMQYGSVSTNLQRGVR

SEQ ID NO: 3937 - protein, 29 aa, Artificial Sequence
  Description of Artificial Sequence: Synthetic peptide
DEEEIRTTNPVATMQYGSVSTNLQRGPNR

SEQ ID NO: 3938 - protein, 29 aa, Artificial Sequence
  Description of Artificial Sequence: Synthetic peptide
DEEEIRTTNPVATMQYGSVSTNLQRGNRD

SEQ ID NO: 3939 - protein, 29 aa, Artificial Sequence
  Description of Artificial Sequence: Synthetic peptide
DEEEIRTTNPVATMQYGSVSTNLQRGNPR

SEQ ID NO: 3940 - protein, 28 aa, Artificial Sequence
  Description of Artificial Sequence: Synthetic peptide
DEEEIRTTNPVATMQYGSVSTNLQRGNH

SEQ ID NO: 3941 - protein, 28 aa, Artificial Sequence
  Description of Artificial Sequence: Synthetic peptide
DEEEIRTTNPVATMQYGSVSTNLQNGNR

SEQ ID NO: 3942 - protein, 28 aa, Artificial Sequence
  Description of Artificial Sequence: Synthetic peptide
DEEEIRTTNPVATMQYGSVSTGLQRGNR

SEQ ID NO: 3943 - protein, 28 aa, Artificial Sequence
  Description of Artificial Sequence: Synthetic peptide
DEEEIRTTNPVATMQYGNVSTNLQRGNR

SEQ ID NO: 3944 - protein, 28 aa, Artificial Sequence
  Description of Artificial Sequence: Synthetic peptide
DEEEIRTTNPVATMDYGSVSTNLQRGNR

SEQ ID NO: 3945 - protein, 28 aa, Artificial Sequence
  Description of Artificial Sequence: Synthetic peptide
DEEEIRTTNPVATLQYGSVSTNLQRMNR

SEQ ID NO: 3946 - protein, 28 aa, Artificial Sequence
  Description of Artificial Sequence: Synthetic peptide
DEEEIRTTNPVATLQYGSVSTNLQRLNR

SEQ ID NO: 3947 - protein, 28 aa, Artificial Sequence
  Description of Artificial Sequence: Synthetic peptide
DEEEIRTTNPVATLQYGSVSTNLQRGNM

SEQ ID NO: 3948 - protein, 28 aa, Artificial Sequence
  Description of Artificial Sequence: Synthetic peptide
DEEEIRTTNPVATLQYGSVSGNLQRGNR

SEQ ID NO: 3949 - protein, 28 aa, Artificial Sequence
  Description of Artificial Sequence: Synthetic peptide
DEEEIRTTNPVATKQYGSVSTNLQPGNR

SEQ ID NO: 3950 - protein, 28 aa, Artificial Sequence
  Description of Artificial Sequence: Synthetic peptide
DEEEIRTTNPVATEQYGSVGMNLQRGNR

SEQ ID NO: 3951 - protein, 28 aa, Artificial Sequence
  Description of Artificial Sequence: Synthetic peptide
DEEEIRTTNPVATETYGSVSTTLQRGNR

SEQ ID NO: 3952 - protein, 29 aa, Artificial Sequence
  Description of Artificial Sequence: Synthetic peptide
DEEEIRTTNPVATEQYGSVMTNLQRGVNR

SEQ ID NO: 3953 - protein, 29 aa, Artificial Sequence
  Description of Artificial Sequence: Synthetic peptide
DEEEIRTTNPVATEQYRSVSTNLQRGENR

SEQ ID NO: 3954 - protein, 30 aa, Artificial Sequence
  Description of Artificial Sequence: Synthetic polypeptide
DEEEIRTTNPVATEQYQGSVSTANLQRGNR

SEQ ID NO: 3955 - protein, 29 aa, Artificial Sequence
  Description of Artificial Sequence: Synthetic peptide
DEEEIRTTNPVATEQYLSVSTNTLQRGNR

SEQ ID NO: 3956 - protein, 29 aa, Artificial Sequence
  Description of Artificial Sequence: Synthetic peptide
DEEEIRTTNPVATEQYIGSVSTNLQRGDR

SEQ ID NO: 3957 - protein, 28 aa, Artificial Sequence
  Description of Artificial Sequence: Synthetic peptide
DEEEIRTTNPVATEQYGYVSTWLQRGNR

SEQ ID NO: 3958 - protein, 29 aa, Artificial Sequence
  Description of Artificial Sequence: Synthetic peptide
DEEEIRTTNPVATEQYGSVPTNLQRGNFR

SEQ ID NO: 3959 - protein, 29 aa, Artificial Sequence
  Description of Artificial Sequence: Synthetic peptide
DEEEIRTTNPVATEQYGSVWSTNLQPGNR

SEQ ID NO: 3960 - protein, 30 aa, Artificial Sequence
  Description of Artificial Sequence: Synthetic polypeptide
DEEEIRTTNPVATEQYGSVWSTNLQRCGNR

SEQ ID NO: 3961 - protein, 29 aa, Artificial Sequence
  Description of Artificial Sequence: Synthetic peptide
DEEEIRTTNPVATEQYSGSVSTNLQRGNH

SEQ ID NO: 3962 - protein, 30 aa, Artificial Sequence
  Description of Artificial Sequence: Synthetic polypeptide
DEEEIRTTNPVATEQYGSVWSTNLQRGENR

SEQ ID NO: 3963 - protein, 29 aa, Artificial Sequence
  Description of Artificial Sequence: Synthetic peptide
DEEEIRTTNPVATEQYGSVWSTNLQVGNR

SEQ ID NO: 3964 - protein, 29 aa, Artificial Sequence
  Description of Artificial Sequence: Synthetic peptide
DEEEIRTTNPVATEQYGSVSTNHLQRGLR

SEQ ID NO: 3965 - protein, 28 aa, Artificial Sequence
  Description of Artificial Sequence: Synthetic peptide
DEEEIRTTNPVATEQYGYVSTNLQRPNR

SEQ ID NO: 3966 - protein, 29 aa, Artificial Sequence
  Description of Artificial Sequence: Synthetic peptide
DEEEIRTTNPVATEQYGYVSTNLQRLGNR

SEQ ID NO: 3967 - protein, 29 aa, Artificial Sequence
  Description of Artificial Sequence: Synthetic peptide
DEEEIRTTNPVATEQYGYVSTNLQRGNRV

SEQ ID NO: 3968 - protein, 29 aa, Artificial Sequence
  Description of Artificial Sequence: Synthetic peptide
DEEEIRTTNPVATEQYGYVSTNLQRGNRA

SEQ ID NO: 3969 - protein, 29 aa, Artificial Sequence
  Description of Artificial Sequence: Synthetic peptide
DEEEIRTTNPVATEQYGSVSTNHLQGGNR

SEQ ID NO: 3970 - protein, 28 aa, Artificial Sequence
  Description of Artificial Sequence: Synthetic peptide
DEEEIRTTNPVATEQYGYVSTNLQHGNR

SEQ ID NO: 3971 - protein, 29 aa, Artificial Sequence
  Description of Artificial Sequence: Synthetic peptide
DEEEIRTTNPVATEQYGSVWSTNLQRGNY

SEQ ID NO: 3972 - protein, 28 aa, Artificial Sequence
  Description of Artificial Sequence: Synthetic peptide
DEEEIRTTNPVATEQYSSVSTNLQQGNR

SEQ ID NO: 3973 - protein, 28 aa, Artificial Sequence
  Description of Artificial Sequence: Synthetic peptide
DEEEIRTTNPVATEQYSSVSTNLQSGNR

SEQ ID NO: 3974 - protein, 28 aa, Artificial Sequence
  Description of Artificial Sequence: Synthetic peptide
DEEEIRTTNPVATEQYSSVSTTLQRGNR

SEQ ID NO: 3975 - protein, 30 aa, Artificial Sequence
  Description of Artificial Sequence: Synthetic polypeptide
DEEEIRTTNPVATEQYYGSVSTNLQSRGNR

SEQ ID NO: 3976 - protein, 29 aa, Artificial Sequence
  Description of Artificial Sequence: Synthetic peptide
DEEEIRTTNPVATEQYYGSVSTNLQRGNT

SEQ ID NO: 3977 - protein, 29 aa, Artificial Sequence
  Description of Artificial Sequence: Synthetic peptide
DEEEIRTTNPVATEQYYGSVSTNLQRGNE

SEQ ID NO: 3978 - protein, 29 aa, Artificial Sequence
  Description of Artificial Sequence: Synthetic peptide
DEEEIRTTNPVATEQYYGSVSTNLQRGER

SEQ ID NO: 3979 - protein, 29 aa, Artificial Sequence
  Description of Artificial Sequence: Synthetic peptide
DEEEIRTTNPVATEQYYGSVSTNLQGGNR

SEQ ID NO: 3980 - protein, 29 aa, Artificial Sequence
  Description of Artificial Sequence: Synthetic peptide
DEEEIRTTNPVATEQYGSVPTNLQRGNHR

SEQ ID NO: 3981 - protein, 29 aa, Artificial Sequence
  Description of Artificial Sequence: Synthetic peptide
DEEEIRTTNPVATEQYWSVSTNQLQRGNR

SEQ ID NO: 3982 - protein, 28 aa, Artificial Sequence
  Description of Artificial Sequence: Synthetic peptide
DEEEIRTTNPVATEQYWSVSTNNQRGNR

SEQ ID NO: 3983 - protein, 28 aa, Artificial Sequence
  Description of Artificial Sequence: Synthetic peptide
DEEEIRTTNPVATEQYGSVPTNLQRGNH

SEQ ID NO: 3984 - protein, 29 aa, Artificial Sequence
  Description of Artificial Sequence: Synthetic peptide
DEEEIRTTNPVATEQYWSVSTNLQRGSNR

SEQ ID NO: 3985 - protein, 28 aa, Artificial Sequence
  Description of Artificial Sequence: Synthetic peptide
DEEEIRTTNPVATEQYWSVSTNLQRGNK

SEQ ID NO: 3986 - protein, 28 aa, Artificial Sequence
  Description of Artificial Sequence: Synthetic peptide
DEEEIRTTNPVATEQYWSVSTNLQRGER

SEQ ID NO: 3987 - protein, 29 aa, Artificial Sequence
  Description of Artificial Sequence: Synthetic peptide
DEEEIRTTNPVATEQYWSVSTNLQRGDNR

SEQ ID NO: 3988 - protein, 28 aa, Artificial Sequence
  Description of Artificial Sequence: Synthetic peptide
DEEEIRTTNPVATEQYWSVSTNLQDGNR

SEQ ID NO: 3989 - protein, 29 aa, Artificial Sequence
  Description of Artificial Sequence: Synthetic peptide
DEEEIRTTNPVATEQYWSVSTNGLQRGNR

SEQ ID NO: 3990 - protein, 29 aa, Artificial Sequence
  Description of Artificial Sequence: Synthetic peptide
DEEEIRTTNPVATEQYWSVSTENLQRGNR

SEQ ID NO: 3991 - protein, 29 aa, Artificial Sequence
  Description of Artificial Sequence: Synthetic peptide
DEEEIRTTNPVATEQYWGSVSTNLQRGNH

SEQ ID NO: 3992 - protein, 29 aa, Artificial Sequence
  Description of Artificial Sequence: Synthetic peptide
DEEEIRTTNPVATEQYWGSVSTNLQRGDR

SEQ ID NO: 3993 - protein, 29 aa, Artificial Sequence
  Description of Artificial Sequence: Synthetic peptide
DEEEIRTTNPVATEQYWGSVSTNLQPGNR

SEQ ID NO: 3994 - protein, 29 aa, Artificial Sequence
  Description of Artificial Sequence: Synthetic peptide
DEEEIRTTNPVATEQYGYVSTNLDQRGNR

SEQ ID NO: 3995 - protein, 28 aa, Artificial Sequence
  Description of Artificial Sequence: Synthetic peptide
DEEEIRTTNPVATEQYGYVSTNLARGNR

SEQ ID NO: 3996 - protein, 29 aa, Artificial Sequence
  Description of Artificial Sequence: Synthetic peptide
DEEEIRTTNPVATEQYGYVSTMNLQRGNR

SEQ ID NO: 3997 - protein, 29 aa, Artificial Sequence
  Description of Artificial Sequence: Synthetic peptide
DEEEIRTTNPVATEQYGYVSTLNLQRGNR

SEQ ID NO: 3998 - protein, 28 aa, Artificial Sequence
  Description of Artificial Sequence: Synthetic peptide
DEEEIRTTNPVATEQYGEVSTNLQRGPR

SEQ ID NO: 3999 - protein, 28 aa, Artificial Sequence
  Description of Artificial Sequence: Synthetic peptide
DEEEIRTTNPVATEQYGSVWTNLQRGNI

SEQ ID NO: 4000 - protein, 28 aa, Artificial Sequence
  Description of Artificial Sequence: Synthetic peptide
DEEEIRTTNPVATEQYGWVSTSLQRGNR

SEQ ID NO: 4001 - protein, 29 aa, Artificial Sequence
  Description of Artificial Sequence: Synthetic peptide
DEEEIRTTNPVATEQYGWVSTNLQRYGNR

SEQ ID NO: 4002 - protein, 28 aa, Artificial Sequence
  Description of Artificial Sequence: Synthetic peptide
DEEEIRTTNPVATEQYGWVSTNLQRTNR

SEQ ID NO: 4003 - protein, 29 aa, Artificial Sequence
  Description of Artificial Sequence: Synthetic peptide
DEEEIRTTNPVATEQYGWVSTNLQRHGNR

SEQ ID NO: 4004 - protein, 28 aa, Artificial Sequence
  Description of Artificial Sequence: Synthetic peptide
DEEEIRTTNPVATEQYGWVSTNLQRGNA

SEQ ID NO: 4005 - protein, 28 aa, Artificial Sequence
  Description of Artificial Sequence: Synthetic peptide
DEEEIRTTNPVATEQYGWVSTNLQPGNR

SEQ ID NO: 4006 - protein, 28 aa, Artificial Sequence
  Description of Artificial Sequence: Synthetic peptide
DEEEIRTTNPVATEQYGWVSTNLQMGNR

SEQ ID NO: 4007 - protein, 28 aa, Artificial Sequence
  Description of Artificial Sequence: Synthetic peptide
DEEEIRTTNPVATEQYGWVSINLQRGNR

SEQ ID NO: 4008 - protein, 28 aa, Artificial Sequence
  Description of Artificial Sequence: Synthetic peptide
DEEEIRTTNPVATEQYGWVQTNLQRGNR

SEQ ID NO: 4009 - protein, 28 aa, Artificial Sequence
  Description of Artificial Sequence: Synthetic peptide
DEEEIRTTNPVATEQYGSVWTNLQRGNY

SEQ ID NO: 4010 - protein, 29 aa, Artificial Sequence
  Description of Artificial Sequence: Synthetic peptide
DEEEIRTTNPVATEQYGSVSTNAQWRGNR

SEQ ID NO: 4011 - protein, 28 aa, Artificial Sequence
  Description of Artificial Sequence: Synthetic peptide
DEEEIRTTNPVATEQYGSVWTNLQRGVR

SEQ ID NO: 4012 - protein, 28 aa, Artificial Sequence
  Description of Artificial Sequence: Synthetic peptide
DEEEIRTTNPVATEQYGSVWTNLQSGNR

SEQ ID NO: 4013 - protein, 29 aa, Artificial Sequence
  Description of Artificial Sequence: Synthetic peptide
DEEEIRTTNPVATEQYGWSVSTNLQRGNY

SEQ ID NO: 4014 - protein, 29 aa, Artificial Sequence
  Description of Artificial Sequence: Synthetic peptide
DEEEIRTTNPVATEQYGWSVSTNLQRGAR

SEQ ID NO: 4015 - protein, 29 aa, Artificial Sequence
  Description of Artificial Sequence: Synthetic peptide
DEEEIRTTNPVATEQYGWSVSTNLQDGNR

SEQ ID NO: 4016 - protein, 28 aa, Artificial Sequence
  Description of Artificial Sequence: Synthetic peptide
DEEEIRTTNPVATEQYGEVSTNLQRGNP

SEQ ID NO: 4017 - protein, 29 aa, Artificial Sequence
  Description of Artificial Sequence: Synthetic peptide
DEEEIRTTNPVATEQYGSVPTNLEQRGNR

SEQ ID NO: 4018 - protein, 28 aa, Artificial Sequence
  Description of Artificial Sequence: Synthetic peptide
DEEEIRTTNPVATEQYGSVPTNLQRGNK

SEQ ID NO: 4019 - protein, 28 aa, Artificial Sequence
  Description of Artificial Sequence: Synthetic peptide
DEEEIRTTNPVATEQYGSVWTNLQRGNF

SEQ ID NO: 4020 - protein, 28 aa, Artificial Sequence
  Description of Artificial Sequence: Synthetic peptide
AEAEIRTTNPVATEQYGSVSTNLQRGNR

SEQ ID NO: 4021 - protein, 30 aa, Artificial Sequence
  Description of Artificial Sequence: Synthetic polypeptide
DEEEIRTTNPVATEQYGSVWSYTNLQRGNR

SEQ ID NO: 4022 - protein, 28 aa, Artificial Sequence
  Description of Artificial Sequence: Synthetic peptide
DEEEIRTTNPVATEQYGYVSTELQRGNR

SEQ ID NO: 4023 - protein, 28 aa, Artificial Sequence
  Description of Artificial Sequence: Synthetic peptide
DEEEIRTTNPVATEQYGSVWTDLQRGNR

SEQ ID NO: 4024 - protein, 29 aa, Artificial Sequence
  Description of Artificial Sequence: Synthetic peptide
DEEEIRTTNPVATEQYGSVPTNLQERGNR

SEQ ID NO: 4025 - protein, 29 aa, Artificial Sequence
  Description of Artificial Sequence: Synthetic peptide
DEEEIRTTNPVATEQYGYVSTANLQRGNR

SEQ ID NO: 4026 - protein, 28 aa, Artificial Sequence
  Description of Artificial Sequence: Synthetic peptide
DEEEIRTTNPVATEQYGYVSGNLQRGNR

SEQ ID NO: 4027 - protein, 29 aa, Artificial Sequence
  Description of Artificial Sequence: Synthetic peptide
DEEEIRTTNPVATEQYGSVSTNANQRGNR

SEQ ID NO: 4028 - protein, 29 aa, Artificial Sequence
  Description of Artificial Sequence: Synthetic peptide
DEEEIRTTNPVATEQYGSVSTNGVQRGNR

SEQ ID NO: 4029 - protein, 29 aa, Artificial Sequence
  Description of Artificial Sequence: Synthetic peptide
DEEEIRTTNPVATEQYGSVSTNGTQRGNR

SEQ ID NO: 4030 - protein, 28 aa, Artificial Sequence
  Description of Artificial Sequence: Synthetic peptide
DEEEIRTTNPVATEQYGSVPTNLGRGNR

SEQ ID NO: 4031 - protein, 28 aa, Artificial Sequence
  Description of Artificial Sequence: Synthetic peptide
DEEEIRTTNPVATEQYGSVSTNAQRGND

SEQ ID NO: 4032 - protein, 30 aa, Artificial Sequence
  Description of Artificial Sequence: Synthetic polypeptide
DEEEIRTTNPVATEQYGYSVSTNLQRGQNR

SEQ ID NO: 4033 - protein, 28 aa, Artificial Sequence
  Description of Artificial Sequence: Synthetic peptide
DEEEIRTTNPVATEQYGEVSTNLQRVNR

SEQ ID NO: 4034 - protein, 28 aa, Artificial Sequence
  Description of Artificial Sequence: Synthetic peptide
DEEEIRTTNPVATEQYGSVSTNAQRGNI

SEQ ID NO: 4035 - protein, 29 aa, Artificial Sequence
  Description of Artificial Sequence: Synthetic peptide
DEEEIRTTNPVATEQYGYSVSTNDQRGNR

SEQ ID NO: 4036 - protein, 29 aa, Artificial Sequence
  Description of Artificial Sequence: Synthetic peptide
DEEEIRTTNPVATEQYGSVWTNLQDRGNR

SEQ ID NO: 4037 - protein, 30 aa, Artificial Sequence
  Description of Artificial Sequence: Synthetic polypeptide
DEEEIRTTNPVATEQYGYSVSTDNLQRGNR

SEQ ID NO: 4038 - protein, 30 aa, Artificial Sequence
  Description of Artificial Sequence: Synthetic polypeptide
DEEEIRTTNPVATEQYGYSVSGTNLQRGNR

SEQ ID NO: 4039 - protein, 30 aa, Artificial Sequence
  Description of Artificial Sequence: Synthetic polypeptide
DEEEIRTTNPVATEQYGYSVMSTNLQRGNR

SEQ ID NO: 4040 - protein, 28 aa, Artificial Sequence
  Description of Artificial Sequence: Synthetic peptide
DEEEIRTTNPVATEQYGSVWTNLQRGND

SEQ ID NO: 4041 - protein, 28 aa, Artificial Sequence
  Description of Artificial Sequence: Synthetic peptide
DEEEIRTTNPVATEQYGSVVTNLQRGNF

SEQ ID NO: 4042 - protein, 29 aa, Artificial Sequence
  Description of Artificial Sequence: Synthetic peptide
DEEEIRTTNPVATEQYGSVPTNLQRGNLR

SEQ ID NO: 4043 - protein, 29 aa, Artificial Sequence
  Description of Artificial Sequence: Synthetic peptide
DEEEIRTTNPVATEQYGSVPTNLQRGNRM

SEQ ID NO: 4044 - protein, 30 aa, Artificial Sequence
  Description of Artificial Sequence: Synthetic polypeptide
DEEEIRTTNPVATEQYGSVSTNALEQRGNR

SEQ ID NO: 4045 - protein, 28 aa, Artificial Sequence
  Description of Artificial Sequence: Synthetic peptide
DEEEIRTTNPVATETYGSVSTHLQRGNR

SEQ ID NO: 4046 - protein, 29 aa, Artificial Sequence
  Description of Artificial Sequence: Synthetic peptide
DEEEIRTTNPVATEQYGSVSTNHQVRGNR

SEQ ID NO: 4047 - protein, 28 aa, Artificial Sequence
  Description of Artificial Sequence: Synthetic peptide
DEEEIRTTNPVATEQYGSVSTNHQVGNR

SEQ ID NO: 4048 - protein, 28 aa, Artificial Sequence
  Description of Artificial Sequence: Synthetic peptide
YEEEIRTTNPVATEDYGSVSTNLQRGNR

SEQ ID NO: 4049 - protein, 29 aa, Artificial Sequence
  Description of Artificial Sequence: Synthetic peptide
DEEEIRTTNPVATETYGSVISTNLQRGNR

SEQ ID NO: 4050 - protein, 30 aa, Artificial Sequence
  Description of Artificial Sequence: Synthetic polypeptide
DEEEIRTTNPVATEQYGSVSTNALIQRGNR

SEQ ID NO: 4051 - protein, 29 aa, Artificial Sequence
  Description of Artificial Sequence: Synthetic peptide
DEEEIRTTNPVATEQYGSVSTNHQRYGNR

SEQ ID NO: 4052 - protein, 28 aa, Artificial Sequence
  Description of Artificial Sequence: Synthetic peptide
DEEEIRTTNPVATETYGSVSTNDQRGNR

SEQ ID NO: 4053 - protein, 29 aa, Artificial Sequence
  Description of Artificial Sequence: Synthetic peptide
DEEEIRTTNPVATEQYGSVSTNHQRGNRV

SEQ ID NO: 4054 - protein, 28 aa, Artificial Sequence
  Description of Artificial Sequence: Synthetic peptide
DEEEIRTTNPVATESYGSVSVNLQRGNR

SEQ ID NO: 4055 - protein, 28 aa, Artificial Sequence
  Description of Artificial Sequence: Synthetic peptide
YEEEIRTTNPVATEQYGSHSTNLQRGNR

SEQ ID NO: 4056 - protein, 28 aa, Artificial Sequence
  Description of Artificial Sequence: Synthetic peptide
DEEEIRTTNPVATESYGSVSTNYQRGNR

SEQ ID NO: 4057 - protein, 29 aa, Artificial Sequence
  Description of Artificial Sequence: Synthetic peptide
YEEEIRTTNPVATEQYGSVHSTNLQRGNR

SEQ ID NO: 4058 - protein, 29 aa, Artificial Sequence
  Description of Artificial Sequence: Synthetic peptide
DEEEIRTTNPVATESYGSVSTNLQYRGNR

SEQ ID NO: 4059 - protein, 29 aa, Artificial Sequence
  Description of Artificial Sequence: Synthetic peptide
DEEEIRTTNPVATEQYGSVSTNHQLRGNR

SEQ ID NO: 4060 - protein, 28 aa, Artificial Sequence
  Description of Artificial Sequence: Synthetic peptide
DEEEIRTTNPVATESYGSVSTNLQRGNW

SEQ ID NO: 4061 - protein, 29 aa, Artificial Sequence
  Description of Artificial Sequence: Synthetic peptide
YEEEIRTTNPVATEQYGSVSGTNLQRGNR

SEQ ID NO: 4062 - protein, 29 aa, Artificial Sequence
  Description of Artificial Sequence: Synthetic peptide
DEEEIRTTNPVATEQYGSVSTNHQRGNRQ

SEQ ID NO: 4063 - protein, 28 aa, Artificial Sequence
  Description of Artificial Sequence: Synthetic peptide
DEEEIRTTNPVATETYGSVSTNLCRGNR

SEQ ID NO: 4064 - protein, 28 aa, Artificial Sequence
  Description of Artificial Sequence: Synthetic peptide
DEEEIRTTNPVATETYGSVSTNLDRGNR

SEQ ID NO: 4065 - protein, 28 aa, Artificial Sequence
  Description of Artificial Sequence: Synthetic peptide
DEEEIRTTNPVATEQYGSVVTQLQRGNR

SEQ ID NO: 4066 - protein, 28 aa, Artificial Sequence
  Description of Artificial Sequence: Synthetic peptide
DEEEIRTTNPVATEQYGGMSTNLQRGNR

SEQ ID NO: 4067 - protein, 29 aa, Artificial Sequence
  Description of Artificial Sequence: Synthetic peptide
DEEEIRTTNPVATEQYGFVSTYNLQRGNR

SEQ ID NO: 4068 - protein, 29 aa, Artificial Sequence
  Description of Artificial Sequence: Synthetic peptide
DEEEIRTTNPVATEQYGSVVTNLQRGNWR

SEQ ID NO: 4069 - protein, 28 aa, Artificial Sequence
  Description of Artificial Sequence: Synthetic peptide
DEEEIRTTNPVATEQYGFVSTSLQRGNR

SEQ ID NO: 4070 - protein, 29 aa, Artificial Sequence
  Description of Artificial Sequence: Synthetic peptide
DEEEIRTTNPVATETYGSVSTNLQVRGNR

SEQ ID NO: 4071 - protein, 29 aa, Artificial Sequence
  Description of Artificial Sequence: Synthetic peptide
DEEEIRTTNPVATEQYGSVSTNIGQRGNR

SEQ ID NO: 4072 - protein, 28 aa, Artificial Sequence
  Description of Artificial Sequence: Synthetic peptide
DEEEIRTTNPVATETYGSVSTNLQRGNY

SEQ ID NO: 4073 - protein, 29 aa, Artificial Sequence
  Description of Artificial Sequence: Synthetic peptide
DEEEIRTTNPVATEQYGFVSTNLQYRGNR

SEQ ID NO: 4074 - protein, 29 aa, Artificial Sequence
  Description of Artificial Sequence: Synthetic peptide
DEEEIRTTNPVATETYGSVSTNLQRGNRY

SEQ ID NO: 4075 - protein, 28 aa, Artificial Sequence
  Description of Artificial Sequence: Synthetic peptide
DEEEIRTTNPVATEQYGFVSTNLQSGNR

SEQ ID NO: 4076 - protein, 29 aa, Artificial Sequence
  Description of Artificial Sequence: Synthetic peptide
DEEEIRTTNPVATEQYGFVSTNLQRYGNR

SEQ ID NO: 4077 - protein, 28 aa, Artificial Sequence
  Description of Artificial Sequence: Synthetic peptide
DEEEIRTTNPVATEQYGSVSTNIERGNR

SEQ ID NO: 4078 - protein, 28 aa, Artificial Sequence
  Description of Artificial Sequence: Synthetic peptide
DEEEIRTTNPVATEQYGFVSTNLQRGNK

SEQ ID NO: 4079 - protein, 28 aa, Artificial Sequence
  Description of Artificial Sequence: Synthetic peptide
DEEEIRTTNPVATETYGSVSTNLQRGNI

SEQ ID NO: 4080 - protein, 29 aa, Artificial Sequence
  Description of Artificial Sequence: Synthetic peptide
YEEEIRTTFNPVATEQYGSVSTNLQRGNR

SEQ ID NO: 4081 - protein, 28 aa, Artificial Sequence
  Description of Artificial Sequence: Synthetic peptide
DEEEIRTTNPVATEQYGFVSTNLQFGNR

SEQ ID NO: 4082 - protein, 28 aa, Artificial Sequence
  Description of Artificial Sequence: Synthetic peptide
DEEEIRTTNPVATEQYGFVSMNLQRGNR

SEQ ID NO: 4083 - protein, 29 aa, Artificial Sequence
  Description of Artificial Sequence: Synthetic peptide
DEEEIRTTNPVATEQYGFSVSTNLQEGNR

SEQ ID NO: 4084 - protein, 29 aa, Artificial Sequence
  Description of Artificial Sequence: Synthetic peptide
DEEEIRTTNPVATEQYGFSVSTNLDRGNR

SEQ ID NO: 4085 - protein, 29 aa, Artificial Sequence
  Description of Artificial Sequence: Synthetic peptide
DEEEIRTTNPVATEQYGSVSPDNLQRGNR

SEQ ID NO: 4086 - protein, 29 aa, Artificial Sequence
  Description of Artificial Sequence: Synthetic peptide
DEEEIRTTNPVATESYGSVSTNLQRGNRQ

SEQ ID NO: 4087 - protein, 28 aa, Artificial Sequence
  Description of Artificial Sequence: Synthetic peptide
DEEEIRTTNPVATESYGSVSTNLQRGNF

SEQ ID NO: 4088 - protein, 28 aa, Artificial Sequence
  Description of Artificial Sequence: Synthetic peptide
YEEEIRTTNPVATEQYGSVSTILQRGNR

SEQ ID NO: 4089 - protein, 28 aa, Artificial Sequence
  Description of Artificial Sequence: Synthetic peptide
DEEEIRTTNPVATEQYGSVPTQLQRGNR

SEQ ID NO: 4090 - protein, 29 aa, Artificial Sequence
  Description of Artificial Sequence: Synthetic peptide
DEEEIRTTNPVATESYGSIVSTNLQRGNR

SEQ ID NO: 4091 - protein, 28 aa, Artificial Sequence
  Description of Artificial Sequence: Synthetic peptide
DEEEIRTTNPVATESYGSESTNLQRGNR

SEQ ID NO: 4092 - protein, 30 aa, Artificial Sequence
  Description of Artificial Sequence: Synthetic polypeptide
DEEEIRTTNPVATEQYGSVSTNALQRGNRI

SEQ ID NO: 4093 - protein, 29 aa, Artificial Sequence
  Description of Artificial Sequence: Synthetic peptide
DEEEIRTTNPVATESYGLSVSTNLQRGNR

SEQ ID NO: 4094 - protein, 28 aa, Artificial Sequence
  Description of Artificial Sequence: Synthetic peptide
DEEEIRTTNPVATESYGIVSTNLQRGNR

SEQ ID NO: 4095 - protein, 30 aa, Artificial Sequence
  Description of Artificial Sequence: Synthetic polypeptide
DEEEIRTTNPVATEQYGSVSTNALQRGNRQ

SEQ ID NO: 4096 - protein, 30 aa, Artificial Sequence
  Description of Artificial Sequence: Synthetic polypeptide
DEEEIRTTNPVATEQYGSVSTNALQRGQNR

SEQ ID NO: 4097 - protein, 28 aa, Artificial Sequence
  Description of Artificial Sequence: Synthetic peptide
DEEEIRTTNPVATEQYGSVSTNHPRGNR

SEQ ID NO: 4098 - protein, 28 aa, Artificial Sequence
  Description of Artificial Sequence: Synthetic peptide
DEEEIRTTNPVATERYGSVSTNLERGNR

SEQ ID NO: 4099 - protein, 28 aa, Artificial Sequence
  Description of Artificial Sequence: Synthetic peptide
DEEEIRTTNPVATERYGSVSTNEQRGNR

SEQ ID NO: 4100 - protein, 29 aa, Artificial Sequence
  Description of Artificial Sequence: Synthetic peptide
DEEEIRTTNPVATEQYGSVSTNHLQRGNN

SEQ ID NO: 4101 - protein, 29 aa, Artificial Sequence
  Description of Artificial Sequence: Synthetic peptide
DEEEIRTTNPVATEQYGSVSTNALQRMNR

SEQ ID NO: 4102 - protein, 29 aa, Artificial Sequence
  Description of Artificial Sequence: Synthetic peptide
DEEEIRTTNPVATEQYGSVSTNALQRQNR

SEQ ID NO: 4103 - protein, 29 aa, Artificial Sequence
  Description of Artificial Sequence: Synthetic peptide
DEEEIRTTNPVATEQYGSVSTNALQRTNR

SEQ ID NO: 4104 - protein, 28 aa, Artificial Sequence
  Description of Artificial Sequence: Synthetic peptide
YEEEIRTTNPVCTEQYGSVSTNLQRGNR

SEQ ID NO: 4105 - protein, 28 aa, Artificial Sequence
  Description of Artificial Sequence: Synthetic peptide
DEEEIRTTNPVATEQYGSVPTNLQYGNR

SEQ ID NO: 4106 - protein, 28 aa, Artificial Sequence
  Description of Artificial Sequence: Synthetic peptide
YEEEIRTTNPVFTEQYGSVSTNLQRGNR

SEQ ID NO: 4107 - protein, 28 aa, Artificial Sequence
  Description of Artificial Sequence: Synthetic peptide
DEEEIRTTNPVATEQYGSVPTNLQRHNR

SEQ ID NO: 4108 - protein, 30 aa, Artificial Sequence
  Description of Artificial Sequence: Synthetic polypeptide
DEEEIRTTNPVATEQYGSVSTNALQRGNRE

SEQ ID NO: 4109 - protein, 29 aa, Artificial Sequence
  Description of Artificial Sequence: Synthetic peptide
DEEEIRTTNPVATEQYGSVPTNLQRGNRE

SEQ ID NO: 4110 - protein, 28 aa, Artificial Sequence
  Description of Artificial Sequence: Synthetic peptide
DEEEIRTTNPVATEQYGSVSTNHQEGNR

SEQ ID NO: 4111 - protein, 29 aa, Artificial Sequence
  Description of Artificial Sequence: Synthetic peptide
DEEEIRTTNPVATESYGSVGSTNLQRGNR

SEQ ID NO: 4112 - protein, 29 aa, Artificial Sequence
  Description of Artificial Sequence: Synthetic peptide
DEEEIRTTNPVATESYGSVSTNLQRGNDR

SEQ ID NO: 4113 - protein, 28 aa, Artificial Sequence
  Description of Artificial Sequence: Synthetic peptide
DEEEIRTTNPVATESYGSVSTNLQRGLR

SEQ ID NO: 4114 - protein, 29 aa, Artificial Sequence
  Description of Artificial Sequence: Synthetic peptide
DEEEIRTTNPVATESYGSVSTNLQIRGNR

SEQ ID NO: 4115 - protein, 28 aa, Artificial Sequence
  Description of Artificial Sequence: Synthetic peptide
YEEEIRTTNPVATEQYGSVSTNLQDGNR

SEQ ID NO: 4116 - protein, 29 aa, Artificial Sequence
  Description of Artificial Sequence: Synthetic peptide
YEEEIRTTNPVATEQYGSVSTNLQDRGNR

SEQ ID NO: 4117 - protein, 28 aa, Artificial Sequence
  Description of Artificial Sequence: Synthetic peptide
YEEEIRTTNPVATEQYGSVSTNLQFGNR

SEQ ID NO: 4118 - protein, 28 aa, Artificial Sequence
  Description of Artificial Sequence: Synthetic peptide
YEEEIRTTNPVATEQYGSVSTNLQMGNR

SEQ ID NO: 4119 - protein, 29 aa, Artificial Sequence
  Description of Artificial Sequence: Synthetic peptide
YEEEIRTTNPVATEQYGSVSTNLQRGANR

SEQ ID NO: 4120 - protein, 28 aa, Artificial Sequence
  Description of Artificial Sequence: Synthetic peptide
YEEEIRTTNPVATEQYGSVSTNLQRGNI

SEQ ID NO: 4121 - protein, 28 aa, Artificial Sequence
  Description of Artificial Sequence: Synthetic peptide
YEEEIRTTNPVATEQYGSVSTNLQRNNR

SEQ ID NO: 4122 - protein, 28 aa, Artificial Sequence
  Description of Artificial Sequence: Synthetic peptide
YEEEIRTTNPVATEQYGSVSTNLQRQNR

SEQ ID NO: 4123 - protein, 29 aa, Artificial Sequence
  Description of Artificial Sequence: Synthetic peptide
YEEEIRTTNPVATEQYGSVSTNLQRSGNR

SEQ ID NO: 4124 - protein, 30 aa, Artificial Sequence
  Description of Artificial Sequence: Synthetic polypeptide
DEEEIRTTNPVATEQYGSVSTNALQQRGNR

SEQ ID NO: 4125 - protein, 29 aa, Artificial Sequence
  Description of Artificial Sequence: Synthetic peptide
DEEEIRTTNPVATESYGSVSTNLQFRGNR

SEQ ID NO: 4126 - protein, 29 aa, Artificial Sequence
  Description of Artificial Sequence: Synthetic peptide
DEEEIRTTNPVATEQYGSVSTNALQRENR

SEQ ID NO: 4127 - protein, 29 aa, Artificial Sequence
  Description of Artificial Sequence: Synthetic peptide
DEEEIRTTNPVATEQYGFSSSTNLQRGNR

SEQ ID NO: 4128 - protein, 29 aa, Artificial Sequence
  Description of Artificial Sequence: Synthetic peptide
DEEEIRTTNPVATESYGSVSQTNLQRGNR

SEQ ID NO: 4129 - protein, 28 aa, Artificial Sequence
  Description of Artificial Sequence: Synthetic peptide
DEEEIRTTNPVATESYGSVSANLQRGNR

SEQ ID NO: 4130 - protein, 29 aa, Artificial Sequence
  Description of Artificial Sequence: Synthetic peptide
DEEEIRTTNPVATEQYGSVSTNALQRGER

SEQ ID NO: 4131 - protein, 30 aa, Artificial Sequence
  Description of Artificial Sequence: Synthetic polypeptide
DEEEIRTTNPVATEQYGSVSTNALQRGNNR

SEQ ID NO: 4132 - protein, 29 aa, Artificial Sequence
  Description of Artificial Sequence: Synthetic peptide
DEEEIRTTNPVATEQYGSVSTNLERGNRM

SEQ ID NO: 4133 - protein, 29 aa, Artificial Sequence
  Description of Artificial Sequence: Synthetic peptide
DEEEIRTTNPVATEQYGSVSTNLTRNGNR

SEQ ID NO: 4134 - protein, 29 aa, Artificial Sequence
  Description of Artificial Sequence: Synthetic peptide
DEEEIRTTNPVATEQYGSVSTNLLPRGNR

SEQ ID NO: 4135 - protein, 29 aa, Artificial Sequence
  Description of Artificial Sequence: Synthetic peptide
DEEEIRTTNPVATEQYGSVETNLQRGNER

SEQ ID NO: 4136 - protein, 28 aa, Artificial Sequence
  Description of Artificial Sequence: Synthetic peptide
DEEEIRTTNPVATEQWGSVSTNLQMGNR

SEQ ID NO: 4137 - protein, 29 aa, Artificial Sequence
  Description of Artificial Sequence: Synthetic peptide
DEEEIRTTNPVATEQWYGSVSTNLQRGNE

SEQ ID NO: 4138 - protein, 28 aa, Artificial Sequence
  Description of Artificial Sequence: Synthetic peptide
DEEEIVTTNPVATEQYGSVSTNLQRGNQ

SEQ ID NO: 4139 - protein, 29 aa, Artificial Sequence
  Description of Artificial Sequence: Synthetic peptide
DEEEIRTTNPVATEQYGSVETNLQRGNDR

SEQ ID NO: 4140 - protein, 29 aa, Artificial Sequence
  Description of Artificial Sequence: Synthetic peptide
DEEEIRTTNPVATEQYGMVSTNLQCRGNR

SEQ ID NO: 4141 - protein, 29 aa, Artificial Sequence
  Description of Artificial Sequence: Synthetic peptide
DEEEIRTTNPVATEQWYGSVSTNLQRENR

SEQ ID NO: 4142 - protein, 28 aa, Artificial Sequence
  Description of Artificial Sequence: Synthetic peptide
DEEEIRTTNPVATEQYGSVSTNLLIGNR

SEQ ID NO: 4143 - protein, 28 aa, Artificial Sequence
  Description of Artificial Sequence: Synthetic peptide
DEEEIRTTNPVATEQYASVSTNLQNGNR

SEQ ID NO: 4144 - protein, 29 aa, Artificial Sequence
  Description of Artificial Sequence: Synthetic peptide
DEEEIVTTNPVATEQYGSVSTNLQRGNHR

SEQ ID NO: 4145 - protein, 29 aa, Artificial Sequence
  Description of Artificial Sequence: Synthetic peptide
DEEEIVTTNPVATEQYGSVSTNLQHRGNR

SEQ ID NO: 4146 - protein, 29 aa, Artificial Sequence
  Description of Artificial Sequence: Synthetic peptide
DEEEIVTTNPVATEQYGSVSTNLQGRGNR

SEQ ID NO: 4147 - protein, 28 aa, Artificial Sequence
  Description of Artificial Sequence: Synthetic peptide
DEDEIRTTNPVATFQYGSVSTNLQRGNR

SEQ ID NO: 4148 - protein, 28 aa, Artificial Sequence
  Description of Artificial Sequence: Synthetic peptide
DEEEIVTTNPVATEQYGSVSTNLDRGNR

SEQ ID NO: 4149 - protein, 28 aa, Artificial Sequence
  Description of Artificial Sequence: Synthetic peptide
DEEEIVTTNPVATEQYGSVSTNIQRGNR

SEQ ID NO: 4150 - protein, 29 aa, Artificial Sequence
  Description of Artificial Sequence: Synthetic peptide
DEEEIRTTNPVATEQYGSVETNLQRGDNR

SEQ ID NO: 4151 - protein, 29 aa, Artificial Sequence
  Description of Artificial Sequence: Synthetic peptide
DEEDIRTTNPVATEQYGSVSTDNLQRGNR

SEQ ID NO: 4152 - protein, 28 aa, Artificial Sequence
  Description of Artificial Sequence: Synthetic peptide
DEEEIVTTNPVATEQYGSVSTLLQRGNR

SEQ ID NO: 4153 - protein, 29 aa, Artificial Sequence
  Description of Artificial Sequence: Synthetic peptide
DEEEIRTTNPVATEQWYGSVSANLQRGNR

SEQ ID NO: 4154 - protein, 30 aa, Artificial Sequence
  Description of Artificial Sequence: Synthetic polypeptide
DEEEIRTTNPVATEQYGSVESHTNLQRGNR

SEQ ID NO: 4155 - protein, 28 aa, Artificial Sequence
  Description of Artificial Sequence: Synthetic peptide
DEEEIRTTNPVATEQYCSVSTNLQRENR

SEQ ID NO: 4156 - protein, 28 aa, Artificial Sequence
  Description of Artificial Sequence: Synthetic peptide
DEEEISTTNPVATEQYGSVSTNLQRGNF

SEQ ID NO: 4157 - protein, 28 aa, Artificial Sequence
  Description of Artificial Sequence: Synthetic peptide
DEEEIRMTNPVATEQYGSVSTNLQRGNY

SEQ ID NO: 4158 - protein, 29 aa, Artificial Sequence
  Description of Artificial Sequence: Synthetic peptide
DEEDIRTTNPVATEQYGSVSTNLQERGNR

SEQ ID NO: 4159 - protein, 28 aa, Artificial Sequence
  Description of Artificial Sequence: Synthetic peptide
DEEEIRPTNPVAIEQYGSVSTNLQRGNR

SEQ ID NO: 4160 - protein, 28 aa, Artificial Sequence
  Description of Artificial Sequence: Synthetic peptide
DEEEIVTTNPVATEQYGSVSTSLQRGNR

SEQ ID NO: 4161 - protein, 29 aa, Artificial Sequence
  Description of Artificial Sequence: Synthetic peptide
DEEEIRTTNPVATEQYGSVSTNLLQEGNR

SEQ ID NO: 4162 - protein, 29 aa, Artificial Sequence
  Description of Artificial Sequence: Synthetic peptide
DEEEIRTTNPVATEQYGSVSTMLQMRGNR

SEQ ID NO: 4163 - protein, 29 aa, Artificial Sequence
  Description of Artificial Sequence: Synthetic peptide
DEEEIRTTNPVATEQYFGSVSTNLQSGNR

SEQ ID NO: 4164 - protein, 28 aa, Artificial Sequence
  Description of Artificial Sequence: Synthetic peptide
DEEEIRSTNPVATELYGSVSTNLQRGNR

SEQ ID NO: 4165 - protein, 29 aa, Artificial Sequence
  Description of Artificial Sequence: Synthetic peptide
DEEEIRTTNPVATEQYGSVETNLQRGNRI

SEQ ID NO: 4166 - protein, 29 aa, Artificial Sequence
  Description of Artificial Sequence: Synthetic peptide
DEEEIRTTNPVATEQYFGSVSTNLQRINR

SEQ ID NO: 4167 - protein, 29 aa, Artificial Sequence
  Description of Artificial Sequence: Synthetic peptide
DEEEIRTTNPVATEQYFGSVSTNLQEGNR

SEQ ID NO: 4168 - protein, 28 aa, Artificial Sequence
  Description of Artificial Sequence: Synthetic peptide
DEEEIVTTNPVATEQYGSVSTNLQWGNR

SEQ ID NO: 4169 - protein, 29 aa, Artificial Sequence
  Description of Artificial Sequence: Synthetic peptide
DEEEIRTTNPVATEQYGAVSTNLQDRGNR

SEQ ID NO: 4170 - protein, 28 aa, Artificial Sequence
  Description of Artificial Sequence: Synthetic peptide
DEEEIVTTNPVATEQYGSVSTNLQVGNR

SEQ ID NO: 4171 - protein, 28 aa, Artificial Sequence
  Description of Artificial Sequence: Synthetic peptide
DEEQIRTTNPVATEQYGSVSTNLQRMNR

SEQ ID NO: 4172 - protein, 28 aa, Artificial Sequence
  Description of Artificial Sequence: Synthetic peptide
DEEQIRTTNPVATEQYGSVSTNLQRGNP

SEQ ID NO: 4173 - protein, 28 aa, Artificial Sequence
  Description of Artificial Sequence: Synthetic peptide
DEEQIRTTNPVATEQYGSVSTNLQDGNR

SEQ ID NO: 4174 - protein, 29 aa, Artificial Sequence
  Description of Artificial Sequence: Synthetic peptide
DEEEIVTTNPVATEQYGSVSTNLQRGQNR

SEQ ID NO: 4175 - protein, 29 aa, Artificial Sequence
  Description of Artificial Sequence: Synthetic peptide
DEEEIRTTNPVATEQYEGDVSTNLQRGNR

SEQ ID NO: 4176 - protein, 29 aa, Artificial Sequence
  Description of Artificial Sequence: Synthetic peptide
DEEEIVTTNPVATEQYGSVSTENLQRGNR

SEQ ID NO: 4177 - protein, 29 aa, Artificial Sequence
  Description of Artificial Sequence: Synthetic peptide
DEEEIRTTNPVATEQYGSVSGYNLQRGNR

SEQ ID NO: 4178 - protein, 28 aa, Artificial Sequence
  Description of Artificial Sequence: Synthetic peptide
DEEEIRTTNPVATEQYGSVSTNLGRGIR

SEQ ID NO: 4179 - protein, 28 aa, Artificial Sequence
  Description of Artificial Sequence: Synthetic peptide
DEEEIVTTNPVATEQYGSVSENLQRGNR

SEQ ID NO: 4180 - protein, 29 aa, Artificial Sequence
  Description of Artificial Sequence: Synthetic peptide
DEEEIRTTNPVATEQYGSVSNLNLQRGNR

SEQ ID NO: 4181 - protein, 28 aa, Artificial Sequence
  Description of Artificial Sequence: Synthetic peptide
DEEEIRTTNPVATEQYGSVSWNLTRGNR

SEQ ID NO: 4182 - protein, 28 aa, Artificial Sequence
  Description of Artificial Sequence: Synthetic peptide
NEEEIRGTNPVATEQYGSVSTNLQRGNR

SEQ ID NO: 4183 - protein, 28 aa, Artificial Sequence
  Description of Artificial Sequence: Synthetic peptide
NEEEIRMTNPVATEQYGSVSTNLQRGNR

SEQ ID NO: 4184 - protein, 28 aa, Artificial Sequence
  Description of Artificial Sequence: Synthetic peptide
DEEAIRTTNPVATEQYGSVSTNDQRGNR

SEQ ID NO: 4185 - protein, 28 aa, Artificial Sequence
  Description of Artificial Sequence: Synthetic peptide
DEEEIRTTNPVATEQWGSVSTNLQRGIR

SEQ ID NO: 4186 - protein, 28 aa, Artificial Sequence
  Description of Artificial Sequence: Synthetic peptide
DEEEIRTTNPVATEQYGSVSTNLFMGNR

SEQ ID NO: 4187 - protein, 29 aa, Artificial Sequence
  Description of Artificial Sequence: Synthetic peptide
DEEEIRTTNPVATEQYGCVSTNNLQRGNR

SEQ ID NO: 4188 - protein, 28 aa, Artificial Sequence
  Description of Artificial Sequence: Synthetic peptide
DEEEIRTTNPVATEQYGSVSANLMRGNR

SEQ ID NO: 4189 - protein, 28 aa, Artificial Sequence
  Description of Artificial Sequence: Synthetic peptide
DEEEIVTTNPVATEQYGAVSTNLQRGNR

SEQ ID NO: 4190 - protein, 29 aa, Artificial Sequence
  Description of Artificial Sequence: Synthetic peptide
DEEEIRQTNPVATEQYGSVSTNLQRGGNR

SEQ ID NO: 4191 - protein, 29 aa, Artificial Sequence
  Description of Artificial Sequence: Synthetic peptide
DEEEIRPTNPVATEQYGSCVSTNLQRGNR

SEQ ID NO: 4192 - protein, 28 aa, Artificial Sequence
  Description of Artificial Sequence: Synthetic peptide
DEEEIVTTNPVATEIYGSVSTNLQRGNR

SEQ ID NO: 4193 - protein, 28 aa, Artificial Sequence
  Description of Artificial Sequence: Synthetic peptide
DEEEIRQTNPVATEQYGSVSTNLQDGNR

SEQ ID NO: 4194 - protein, 28 aa, Artificial Sequence
  Description of Artificial Sequence: Synthetic peptide
DEEEIRTTNPVATEQYGSVSANLFRGNR

SEQ ID NO: 4195 - protein, 28 aa, Artificial Sequence
  Description of Artificial Sequence: Synthetic peptide
DEEEIVTTNPDATEQYGSVSTNLQRGNR

SEQ ID NO: 4196 - protein, 28 aa, Artificial Sequence
  Description of Artificial Sequence: Synthetic peptide
DEEEIVCTNPVATEQYGSVSTNLQRGNR

SEQ ID NO: 4197 - protein, 28 aa, Artificial Sequence
  Description of Artificial Sequence: Synthetic peptide
NEEEIRTTNPVATENYGSVSTNLQRGNR

SEQ ID NO: 4198 - protein, 28 aa, Artificial Sequence
  Description of Artificial Sequence: Synthetic peptide
DEEEIVTTNPVATEPYGSVSTNLQRGNR

SEQ ID NO: 4199 - protein, 28 aa, Artificial Sequence
  Description of Artificial Sequence: Synthetic peptide
DEEEIRPTNPVATEQFGSVSTNLQRGNR

SEQ ID NO: 4200 - protein, 30 aa, Artificial Sequence
  Description of Artificial Sequence: Synthetic polypeptide
DEEEIRTTNPVATEQYGSVESTLNLQRGNR

SEQ ID NO: 4201 - protein, 28 aa, Artificial Sequence
  Description of Artificial Sequence: Synthetic peptide
DEEAIRTTNPVATEQYGSVSTNLQAGNR

SEQ ID NO: 4202 - protein, 28 aa, Artificial Sequence
  Description of Artificial Sequence: Synthetic peptide
DEEEIRTTNPVATEQYGSVSTNLGRENR

SEQ ID NO: 4203 - protein, 28 aa, Artificial Sequence
  Description of Artificial Sequence: Synthetic peptide
DEEAIRTTNPVATEQYGSVSTVLQRGNR

SEQ ID NO: 4204 - protein, 28 aa, Artificial Sequence
  Description of Artificial Sequence: Synthetic peptide
TEEEIRTTNPVATMQYGSVSTNLQRGNR

SEQ ID NO: 4205 - protein, 28 aa, Artificial Sequence
  Description of Artificial Sequence: Synthetic peptide
TEEEIRTTNPVATQQYGSVSTNLQRGNR

SEQ ID NO: 4206 - protein, 29 aa, Artificial Sequence
  Description of Artificial Sequence: Synthetic peptide
DEEEIRSTNPVATEQYGSVASTNLQRGNR

SEQ ID NO: 4207 - protein, 29 aa, Artificial Sequence
  Description of Artificial Sequence: Synthetic peptide
DEEEIVTTNPVATEQYGSVISTNLQRGNR

SEQ ID NO: 4208 - protein, 28 aa, Artificial Sequence
  Description of Artificial Sequence: Synthetic peptide
DEEEIVTTNPVATEQYGSVATNLQRGNR

SEQ ID NO: 4209 - protein, 29 aa, Artificial Sequence
  Description of Artificial Sequence: Synthetic peptide
DEEEIRTTNPVATEQYGSVSTMLQNRGNR

SEQ ID NO: 4210 - protein, 29 aa, Artificial Sequence
  Description of Artificial Sequence: Synthetic peptide
DEEEIRTTNPVATEQYGNVSTNGLQRGNR

SEQ ID NO: 4211 - protein, 28 aa, Artificial Sequence
  Description of Artificial Sequence: Synthetic peptide
DEEEIVTTNPVATEQYGSSSTNLQRGNR

SEQ ID NO: 4212 - protein, 28 aa, Artificial Sequence
  Description of Artificial Sequence: Synthetic peptide
DEEEIRTTNPVATEQWGSVSTNLQRDNR

SEQ ID NO: 4213 - protein, 28 aa, Artificial Sequence
  Description of Artificial Sequence: Synthetic peptide
DEEEIRQTNPVATEQYGSVSTNLQRGLR

SEQ ID NO: 4214 - protein, 29 aa, Artificial Sequence
  Description of Artificial Sequence: Synthetic peptide
DEEEIRTTNPVATEQYGMVSTVNLQRGNR

SEQ ID NO: 4215 - protein, 30 aa, Artificial Sequence
  Description of Artificial Sequence: Synthetic polypeptide
DEEEIRTTNPVATEQYGSVESTANLQRGNR

SEQ ID NO: 4216 - protein, 29 aa, Artificial Sequence
  Description of Artificial Sequence: Synthetic peptide
DEEAIRTTNPVATEQYGSVSTNLQRGNPR

SEQ ID NO: 4217 - protein, 29 aa, Artificial Sequence
  Description of Artificial Sequence: Synthetic peptide
DEEEIRTTNPVATEQYGSVESTELQRGNR

SEQ ID NO: 4218 - protein, 29 aa, Artificial Sequence
  Description of Artificial Sequence: Synthetic peptide
DEEAIRTTNPVATEQYGSVSTNLQRAGNR

SEQ ID NO: 4219 - protein, 28 aa, Artificial Sequence
  Description of Artificial Sequence: Synthetic peptide
DEEEIVTTNPVATEQYGSLSTNLQRGNR

SEQ ID NO: 4220 - protein, 29 aa, Artificial Sequence
  Description of Artificial Sequence: Synthetic peptide
DEEEIRTTNPVATEQYGSVESTLLQRGNR

SEQ ID NO: 4221 - protein, 28 aa, Artificial Sequence
  Description of Artificial Sequence: Synthetic peptide
DEEEIVTTNPVATEQYGSVSGNLQRGNR

SEQ ID NO: 4222 - protein, 28 aa, Artificial Sequence
  Description of Artificial Sequence: Synthetic peptide
DEEAIRTTNPVATEQYMSVSTNLQRGNR

SEQ ID NO: 4223 - protein, 28 aa, Artificial Sequence
  Description of Artificial Sequence: Synthetic peptide
DEEDIRTTNPVATEQYGSVSTNLQRGNI

SEQ ID NO: 4224 - protein, 28 aa, Artificial Sequence
  Description of Artificial Sequence: Synthetic peptide
DEEEIRTTNPVATEQYFSESTNLQRGNR

SEQ ID NO: 4225 - protein, 29 aa, Artificial Sequence
  Description of Artificial Sequence: Synthetic peptide
DEEEIYTTNPVATEQYGSVSTNLPQRGNR

SEQ ID NO: 4226 - protein, 28 aa, Artificial Sequence
  Description of Artificial Sequence: Synthetic peptide
DEEEIYTTNPVATEQYGSVSTGLQRGNR

SEQ ID NO: 4227 - protein, 28 aa, Artificial Sequence
  Description of Artificial Sequence: Synthetic peptide
DEEEARTTNPVATEQYGSVSTNLQRGDR

SEQ ID NO: 4228 - protein, 29 aa, Artificial Sequence
  Description of Artificial Sequence: Synthetic peptide
DEEEIYTTNPVATEQYGSVPSTNLQRGNR

SEQ ID NO: 4229 - protein, 28 aa, Artificial Sequence
  Description of Artificial Sequence: Synthetic peptide
DEELIRTTNPVATEQYGSVSTNLQRGNE

SEQ ID NO: 4230 - protein, 28 aa, Artificial Sequence
  Description of Artificial Sequence: Synthetic peptide
DEEEIRTTNPVATEQYGSVSANLQRPNR

SEQ ID NO: 4231 - protein, 29 aa, Artificial Sequence
  Description of Artificial Sequence: Synthetic peptide
DEELIRTTNPVATEQYGSVSTPNLQRGNR

SEQ ID NO: 4232 - protein, 28 aa, Artificial Sequence
  Description of Artificial Sequence: Synthetic peptide
DEEEIYTTNPVATEMYGSVSTNLQRGNR

SEQ ID NO: 4233 - protein, 28 aa, Artificial Sequence
  Description of Artificial Sequence: Synthetic peptide
DEEEIRMTNPVATEQWGSVSTNLQRGNR

SEQ ID NO: 4234 - protein, 29 aa, Artificial Sequence
  Description of Artificial Sequence: Synthetic peptide
DEEEIRTTNPVATEQYGASVSTCLQRGNR

SEQ ID NO: 4235 - protein, 28 aa, Artificial Sequence
  Description of Artificial Sequence: Synthetic peptide
DEEEIWTTNPVATEQYGVVSTNLQRGNR

SEQ ID NO: 4236 - protein, 30 aa, Artificial Sequence
  Description of Artificial Sequence: Synthetic polypeptide
DEEEIRTTNPVATEQYGASVSSTNLQRGNR

SEQ ID NO: 4237 - protein, 28 aa, Artificial Sequence
  Description of Artificial Sequence: Synthetic peptide
DEEEIWTTNPVATEQYGTVSTNLQRGNR

SEQ ID NO: 4238 - protein, 29 aa, Artificial Sequence
  Description of Artificial Sequence: Synthetic peptide
DEEEIWTTNPVATEQYGSVSTNLQRGTNR

SEQ ID NO: 4239 - protein, 29 aa, Artificial Sequence
  Description of Artificial Sequence: Synthetic peptide
DEEEIRTTNPVATEQYGSVSANLQRGNTR

SEQ ID NO: 4240 - protein, 29 aa, Artificial Sequence
  Description of Artificial Sequence: Synthetic peptide
DEEEIWTTNPVATEQYGSVSTNLQRGQNR

SEQ ID NO: 4241 - protein, 29 aa, Artificial Sequence
  Description of Artificial Sequence: Synthetic peptide
DEEEIRMTNPVATEQYGSVSTNLQRGDNR

SEQ ID NO: 4242 - protein, 29 aa, Artificial Sequence
  Description of Artificial Sequence: Synthetic peptide
DEEEIWTTNPVATEQYGSVSTNLQRGINR

SEQ ID NO: 4243 - protein, 28 aa, Artificial Sequence
  Description of Artificial Sequence: Synthetic peptide
DEEEIYTTNPVATEAYGSVSTNLQRGNR

SEQ ID NO: 4244 - protein, 28 aa, Artificial Sequence
  Description of Artificial Sequence: Synthetic peptide
DEEEIRHTNPVATEQYGSVSTNLQTGNR

SEQ ID NO: 4245 - protein, 28 aa, Artificial Sequence
  Description of Artificial Sequence: Synthetic peptide
DEEEARTTNPVATEQYGSVSTNLQRGNE

SEQ ID NO: 4246 - protein, 28 aa, Artificial Sequence
  Description of Artificial Sequence: Synthetic peptide
DEEEIYTTNPVATEQYGSVSTNLQAGNR

SEQ ID NO: 4247 - protein, 29 aa, Artificial Sequence
  Description of Artificial Sequence: Synthetic peptide
DEEEIRTTNPVATEQYGASVSTNLQRGAR

SEQ ID NO: 4248 - protein, 28 aa, Artificial Sequence
  Description of Artificial Sequence: Synthetic peptide
DEEEIYTTNPVATEQYGSVSTNLQRHNR

SEQ ID NO: 4249 - protein, 29 aa, Artificial Sequence
  Description of Artificial Sequence: Synthetic peptide
DEEEIRTTNPVATEQYGSVETNLQRGQNR

SEQ ID NO: 4250 - protein, 28 aa, Artificial Sequence
  Description of Artificial Sequence: Synthetic peptide
DEEECRTTNPVATEQYGSVSTNEQRGNR

SEQ ID NO: 4251 - protein, 29 aa, Artificial Sequence
  Description of Artificial Sequence: Synthetic peptide
DEEEIRTTNPVATEQYGSVSPTTLQRGNR

SEQ ID NO: 4252 - protein, 28 aa, Artificial Sequence
  Description of Artificial Sequence: Synthetic peptide
DEEEIRHTNPVATEQYGSVSTNLQRGNN

SEQ ID NO: 4253 - protein, 28 aa, Artificial Sequence
  Description of Artificial Sequence: Synthetic peptide
DEEEIRHTNPVATEQYGSVSTNLQRGNS

SEQ ID NO: 4254 - protein, 30 aa, Artificial Sequence
  Description of Artificial Sequence: Synthetic polypeptide
DEEEIRTTNPVATEQYGASVSTNLQRGANR

SEQ ID NO: 4255 - protein, 28 aa, Artificial Sequence
  Description of Artificial Sequence: Synthetic peptide
AEEEIRTTNCVATEQYGSVSTNLQRGNR

SEQ ID NO: 4256 - protein, 29 aa, Artificial Sequence
  Description of Artificial Sequence: Synthetic peptide
TEEEIRTTNPVATEQYGSCVSTNLQRGNR

SEQ ID NO: 4257 - protein, 29 aa, Artificial Sequence
  Description of Artificial Sequence: Synthetic peptide
DEEEIYTTNPVATEQYGSVSTNLQREGNR

SEQ ID NO: 4258 - protein, 29 aa, Artificial Sequence
  Description of Artificial Sequence: Synthetic peptide
DEEECRTTNPVATEQYGSVSTENLQRGNR

SEQ ID NO: 4259 - protein, 28 aa, Artificial Sequence
  Description of Artificial Sequence: Synthetic peptide
DEEEIRQTNPVATEQYGSVSTNLQRGMR

SEQ ID NO: 4260 - protein, 28 aa, Artificial Sequence
  Description of Artificial Sequence: Synthetic peptide
DDGEIRTTNPVATEQYGSVSTNLQRGNR

SEQ ID NO: 4261 - protein, 28 aa, Artificial Sequence
  Description of Artificial Sequence: Synthetic peptide
DEEEIYTTNPVATEQYGSVSTNLQQGNR

SEQ ID NO: 4262 - protein, 28 aa, Artificial Sequence
  Description of Artificial Sequence: Synthetic peptide
DEEEIYTTNPVATEQYGSVSTNLQMGNR

SEQ ID NO: 4263 - protein, 29 aa, Artificial Sequence
  Description of Artificial Sequence: Synthetic peptide
DEEECRTTNPVATEQYGSVSTDNLQRGNR

SEQ ID NO: 4264 - protein, 28 aa, Artificial Sequence
  Description of Artificial Sequence: Synthetic peptide
DEELIRTTNPVATEQYGSVSTNLQPGNR

SEQ ID NO: 4265 - protein, 28 aa, Artificial Sequence
  Description of Artificial Sequence: Synthetic peptide
AEEEIRSTNPVATEQYGSVSTNLQRGNR

SEQ ID NO: 4266 - protein, 28 aa, Artificial Sequence
  Description of Artificial Sequence: Synthetic peptide
DEEEIRTTNPVATEQYGSVSANLQRGNS

SEQ ID NO: 4267 - protein, 29 aa, Artificial Sequence
  Description of Artificial Sequence: Synthetic peptide
DEEMIRTTNPVATEQYGSVSITNLQRGNR

SEQ ID NO: 4268 - protein, 29 aa, Artificial Sequence
  Description of Artificial Sequence: Synthetic peptide
DEEEIRTTNPVATEQYGSVSWTNLQRGNI

SEQ ID NO: 4269 - protein, 29 aa, Artificial Sequence
  Description of Artificial Sequence: Synthetic peptide
DEEEIWTTNPVATEQYGSVSTNLQRFGNR

SEQ ID NO: 4270 - protein, 28 aa, Artificial Sequence
  Description of Artificial Sequence: Synthetic peptide
DEEMIRTTNPVATEQYGSVSTNLQVGNR

SEQ ID NO: 4271 - protein, 29 aa, Artificial Sequence
  Description of Artificial Sequence: Synthetic peptide
DEEEIRTTNPVATEQYGSVEVTNLQRGNR

SEQ ID NO: 4272 - protein, 29 aa, Artificial Sequence
  Description of Artificial Sequence: Synthetic peptide
DEEEIRTTNPVATEQYGSVSANLQRGNMR

SEQ ID NO: 4273 - protein, 29 aa, Artificial Sequence
  Description of Artificial Sequence: Synthetic peptide
DEEQIRTTNPVATFEQYGSVSTNLQRGNR

SEQ ID NO: 4274 - protein, 28 aa, Artificial Sequence
  Description of Artificial Sequence: Synthetic peptide
DEEEIRTTNPVATEQYGSVSANLQRGNL

SEQ ID NO: 4275 - protein, 28 aa, Artificial Sequence
  Description of Artificial Sequence: Synthetic peptide
DEEEIRMTNPVATEQYGSVSTNLQRGNI

SEQ ID NO: 4276 - protein, 28 aa, Artificial Sequence
  Description of Artificial Sequence: Synthetic peptide
DEEEIVTTNPVATEVYGSVSTNLQRGNR

SEQ ID NO: 4277 - protein, 28 aa, Artificial Sequence
  Description of Artificial Sequence: Synthetic peptide
DEEEIRTTNPVATEQYFSVSTNLQDGNR

SEQ ID NO: 4278 - protein, 30 aa, Artificial Sequence
  Description of Artificial Sequence: Synthetic polypeptide
DEEEIRTTNPVATEQYGSVSWTMNLQRGNR

SEQ ID NO: 4279 - protein, 29 aa, Artificial Sequence
  Description of Artificial Sequence: Synthetic peptide
DEEDIRTTNPVATEQYGSVSTNLQRNGNR

SEQ ID NO: 4280 - protein, 28 aa, Artificial Sequence
  Description of Artificial Sequence: Synthetic peptide
DEEDIRTTNPVATEQYGSVSTNLQRGQR

SEQ ID NO: 4281 - protein, 29 aa, Artificial Sequence
  Description of Artificial Sequence: Synthetic peptide
DEEMIRTTNPVATEQYGSVSTNLQVRGNR

SEQ ID NO: 4282 - protein, 29 aa, Artificial Sequence
  Description of Artificial Sequence: Synthetic peptide
DEEEIRTTNPVATEQYGSVESANLQRGNR

SEQ ID NO: 4283 - protein, 29 aa, Artificial Sequence
  Description of Artificial Sequence: Synthetic peptide
DEEEIRTTNPVATEQYGSVSTNLGRGNRG

SEQ ID NO: 4284 - protein, 29 aa, Artificial Sequence
  Description of Artificial Sequence: Synthetic peptide
DEEEIRTTNPVATEQYGSVESGNLQRGNR

SEQ ID NO: 4285 - protein, 29 aa, Artificial Sequence
  Description of Artificial Sequence: Synthetic peptide
DEEEIRTTNPVATEQYGSVSHDNLQRGNR

SEQ ID NO: 4286 - protein, 28 aa, Artificial Sequence
  Description of Artificial Sequence: Synthetic peptide
DEEEIRTTNPVATEQYGSVSHDLQRGNR

SEQ ID NO: 4287 - protein, 28 aa, Artificial Sequence
  Description of Artificial Sequence: Synthetic peptide
DEEEIRTTNPVATEQYGSVETNLQRGNY

SEQ ID NO: 4288 - protein, 28 aa, Artificial Sequence
  Description of Artificial Sequence: Synthetic peptide
DEEEIVTTNPVATEQYGSVSTWLQRGNR

SEQ ID NO: 4289 - protein, 28 aa, Artificial Sequence
  Description of Artificial Sequence: Synthetic peptide
DEEEIRTTNPVATEQYGSVSHFLQRGNR

SEQ ID NO: 4290 - protein, 30 aa, Artificial Sequence
  Description of Artificial Sequence: Synthetic polypeptide
DEEEIRTTNPVATEQYGSVSTMNDLQRGNR

SEQ ID NO: 4291 - protein, 29 aa, Artificial Sequence
  Description of Artificial Sequence: Synthetic peptide
DEEEIRTTNPVATEQYGSVSTNLGRGNRN

SEQ ID NO: 4292 - protein, 29 aa, Artificial Sequence
  Description of Artificial Sequence: Synthetic peptide
DEEEIRTTNPVATEQYGSVSANLQRGNRA

SEQ ID NO: 4293 - protein, 30 aa, Artificial Sequence
  Description of Artificial Sequence: Synthetic polypeptide
DEEEIRTTNPVATEQYGSVSWTNLQRGDNR

SEQ ID NO: 4294 - protein, 29 aa, Artificial Sequence
  Description of Artificial Sequence: Synthetic peptide
DEEEIRTTNPVATEQYGASVSLNLQRGNR

SEQ ID NO: 4295 - protein, 29 aa, Artificial Sequence
  Description of Artificial Sequence: Synthetic peptide
DEEEIWTTNPVATEQYGSVSTNLQREGNR

SEQ ID NO: 4296 - protein, 28 aa, Artificial Sequence
  Description of Artificial Sequence: Synthetic peptide
DEEEIWTTNPVATEQYGSVSTNLQRANR

SEQ ID NO: 4297 - protein, 28 aa, Artificial Sequence
  Description of Artificial Sequence: Synthetic peptide
DEEEIWTTNPVATEQYGSVSTNLQIGNR

SEQ ID NO: 4298 - protein, 30 aa, Artificial Sequence
  Description of Artificial Sequence: Synthetic polypeptide
DEEEIRTTNPVATEQYGASVFSTNLQRGNR

SEQ ID NO: 4299 - protein, 29 aa, Artificial Sequence
  Description of Artificial Sequence: Synthetic peptide
DEERIRTTNPVATEQYGSWVSTNLQRGNR

SEQ ID NO: 4300 - protein, 29 aa, Artificial Sequence
  Description of Artificial Sequence: Synthetic peptide
DEEEIWTTNPVATEQYGSVSTLNLQRGNR

SEQ ID NO: 4301 - protein, 30 aa, Artificial Sequence
  Description of Artificial Sequence: Synthetic polypeptide
DEEEIRTTNPVATEQYGSVSWTNLQREGNR

SEQ ID NO: 4302 - protein, 28 aa, Artificial Sequence
  Description of Artificial Sequence: Synthetic peptide
DEEEIRTTNPVATEQWGSVSTNLGRGNR

SEQ ID NO: 4303 - protein, 29 aa, Artificial Sequence
  Description of Artificial Sequence: Synthetic peptide
DEEEIWTTNPVATEQYGSVSDTNLQRGNR

SEQ ID NO: 4304 - protein, 28 aa, Artificial Sequence
  Description of Artificial Sequence: Synthetic peptide
DEERIRTTNPVATEQYGSVSTNLQYGNR

SEQ ID NO: 4305 - protein, 29 aa, Artificial Sequence
  Description of Artificial Sequence: Synthetic peptide
DEEMIRTTNPVATEQYGSVSTNLQRMGNR

SEQ ID NO: 4306 - protein, 28 aa, Artificial Sequence
  Description of Artificial Sequence: Synthetic peptide
DEEEARTTNPVATEQYGSVSTNLQDGNR

SEQ ID NO: 4307 - protein, 29 aa, Artificial Sequence
  Description of Artificial Sequence: Synthetic peptide
DEERIRTTNPVATEQYGSVSTNLQRDGNR

SEQ ID NO: 4308 - protein, 28 aa, Artificial Sequence
  Description of Artificial Sequence: Synthetic peptide
DEEEIWTTNPVATEQYGSCSTNLQRGNR

SEQ ID NO: 4309 - protein, 29 aa, Artificial Sequence
  Description of Artificial Sequence: Synthetic peptide
DEEMIRTTNPVATEQYGSVSTNLQRTGNR

SEQ ID NO: 4310 - protein, 28 aa, Artificial Sequence
  Description of Artificial Sequence: Synthetic peptide
DEERIRTTNPVATEQYGSVSTNLQFGNR

SEQ ID NO: 4311 - protein, 28 aa, Artificial Sequence
  Description of Artificial Sequence: Synthetic peptide
DEERIRTTNPVATEQYGSVSTNLQCGNR

SEQ ID NO: 4312 - protein, 29 aa, Artificial Sequence
  Description of Artificial Sequence: Synthetic peptide
DEEEIWTTNPVATEQAYGSVSTNLQRGNR

SEQ ID NO: 4313 - protein, 29 aa, Artificial Sequence
  Description of Artificial Sequence: Synthetic peptide
DEEEIRTTNPVATEQYGNVSTFNLQRGNR

SEQ ID NO: 4314 - protein, 29 aa, Artificial Sequence
  Description of Artificial Sequence: Synthetic peptide
DEEEIRTTNPVATEQYGSVESTMLQRGNR

SEQ ID NO: 4315 - protein, 30 aa, Artificial Sequence
  Description of Artificial Sequence: Synthetic polypeptide
DEEEIRTTNPVATEQYGSVSTNLGQRIGNR

SEQ ID NO: 4316 - protein, 28 aa, Artificial Sequence
  Description of Artificial Sequence: Synthetic peptide
DEEEIRQTNPVATEQYGSVGTNLQRGNR

SEQ ID NO: 4317 - protein, 29 aa, Artificial Sequence
  Description of Artificial Sequence: Synthetic peptide
DEEEIRTTNPVATEQYGSVSPTNLQIGNR

SEQ ID NO: 4318 - protein, 30 aa, Artificial Sequence
  Description of Artificial Sequence: Synthetic polypeptide
DEEEIRTTNPVATEQYGSVSTNLIQRGVNR

SEQ ID NO: 4319 - protein, 29 aa, Artificial Sequence
  Description of Artificial Sequence: Synthetic peptide
DEEEIRTTNPVATEQYGSVSTNLFRTGNR

SEQ ID NO: 4320 - protein, 28 aa, Artificial Sequence
  Description of Artificial Sequence: Synthetic peptide
DEEEIRQTNPVATEQYGNVSTNLQRGNR

SEQ ID NO: 4321 - protein, 28 aa, Artificial Sequence
  Description of Artificial Sequence: Synthetic peptide
DEEEIRSTNPVATEQWGSVSTNLQRGNR

SEQ ID NO: 4322 - protein, 29 aa, Artificial Sequence
  Description of Artificial Sequence: Synthetic peptide
DEEEIRPTNPVATEQYGSVSTNLQRGMNR

SEQ ID NO: 4323 - protein, 28 aa, Artificial Sequence
  Description of Artificial Sequence: Synthetic peptide
DEEEIRTTNPVATEQYGSVFTNLQYGNR

SEQ ID NO: 4324 - protein, 29 aa, Artificial Sequence
  Description of Artificial Sequence: Synthetic peptide
DEEEIRTTNPVATEQYGSVSWMNLQRGNR

SEQ ID NO: 4325 - protein, 28 aa, Artificial Sequence
  Description of Artificial Sequence: Synthetic peptide
DEEEIRTTNPVATEQYGSVSTNLFRTNR

SEQ ID NO: 4326 - protein, 28 aa, Artificial Sequence
  Description of Artificial Sequence: Synthetic peptide
DEEEIRTTNPVATEQYGSVSTNLGMGNR

SEQ ID NO: 4327 - protein, 28 aa, Artificial Sequence
  Description of Artificial Sequence: Synthetic peptide
DEEEISTTNPVAWEQYGSVSTNLQRGNR

SEQ ID NO: 4328 - protein, 30 aa, Artificial Sequence
  Description of Artificial Sequence: Synthetic polypeptide
DEEEIRTTNPVATEQYGSVSPTNLQRGNFR

SEQ ID NO: 4329 - protein, 30 aa, Artificial Sequence
  Description of Artificial Sequence: Synthetic polypeptide
DEEEIRTTNPVATEQYGSVSPTNLQRGNAR

SEQ ID NO: 4330 - protein, 29 aa, Artificial Sequence
  Description of Artificial Sequence: Synthetic peptide
DEEEIRTTNPVATEQYGSVSPTNLQRGIR

SEQ ID NO: 4331 - protein, 28 aa, Artificial Sequence
  Description of Artificial Sequence: Synthetic peptide
DEDEIRTTNPVATEQYMSVSTNLQRGNR

SEQ ID NO: 4332 - protein, 29 aa, Artificial Sequence
  Description of Artificial Sequence: Synthetic peptide
DEEEISTTNPVATEQYGSVSNTNLQRGNR

SEQ ID NO: 4333 - protein, 28 aa, Artificial Sequence
  Description of Artificial Sequence: Synthetic peptide
DEEEIRQTNPVATEQYGHVSTNLQRGNR

SEQ ID NO: 4334 - protein, 30 aa, Artificial Sequence
  Description of Artificial Sequence: Synthetic polypeptide
DEEEIRTTNPVATEQYGSVESTTNLQRGNR

SEQ ID NO: 4335 - protein, 29 aa, Artificial Sequence
  Description of Artificial Sequence: Synthetic peptide
DEEEISTTNPVATEQYGSVQSTNLQRGNR

SEQ ID NO: 4336 - protein, 30 aa, Artificial Sequence
  Description of Artificial Sequence: Synthetic polypeptide
DEEEIRTTNPVATEQYGSVFSTNLQRNGNR

SEQ ID NO: 4337 - protein, 29 aa, Artificial Sequence
  Description of Artificial Sequence: Synthetic peptide
DEEEIRTTNPVATEQYGSVFSTNLQRMNR

SEQ ID NO: 4338 - protein, 29 aa, Artificial Sequence
  Description of Artificial Sequence: Synthetic peptide
DEEEIRTTNPVATEQYGSVSVTNGQRGNR

SEQ ID NO: 4339 - protein, 28 aa, Artificial Sequence
  Description of Artificial Sequence: Synthetic peptide
DEENIRTTNPVATEQYGSVSTNLQRGNQ

SEQ ID NO: 4340 - protein, 28 aa, Artificial Sequence
  Description of Artificial Sequence: Synthetic peptide
DEENIRTTNPVATEQYGSVSTNLQWGNR

SEQ ID NO: 4341 - protein, 30 aa, Artificial Sequence
  Description of Artificial Sequence: Synthetic polypeptide
DEEEIRTTNPVATEQYGSVESTNLWQRGNR

SEQ ID NO: 4342 - protein, 28 aa, Artificial Sequence
  Description of Artificial Sequence: Synthetic peptide
DEEEIRTTNPVATEQYGSVSTNLFRGLR

SEQ ID NO: 4343 - protein, 28 aa, Artificial Sequence
  Description of Artificial Sequence: Synthetic peptide
DEEEITTTNPEATEQYGSVSTNLQRGNR

SEQ ID NO: 4344 - protein, 30 aa, Artificial Sequence
  Description of Artificial Sequence: Synthetic polypeptide
DEEEIRTTNPVATEQYGSVESTNPLQRGNR

SEQ ID NO: 4345 - protein, 29 aa, Artificial Sequence
  Description of Artificial Sequence: Synthetic peptide
DDETEIRTTNPVATEQYGSVSTNLQRGNR

SEQ ID NO: 4346 - protein, 30 aa, Artificial Sequence
  Description of Artificial Sequence: Synthetic polypeptide
DEEEIRTTNPVATEQYGSVESTNQLQRGNR

SEQ ID NO: 4347 - protein, 29 aa, Artificial Sequence
  Description of Artificial Sequence: Synthetic peptide
DEEEIRTTNPVATEQYGSVSPTNLQGGNR

SEQ ID NO: 4348 - protein, 28 aa, Artificial Sequence
  Description of Artificial Sequence: Synthetic peptide
DEEEITPTNPVATEQYGSVSTNLQRGNR

SEQ ID NO: 4349 - protein, 28 aa, Artificial Sequence
  Description of Artificial Sequence: Synthetic peptide
DEEEITCTNPVATEQYGSVSTNLQRGNR

SEQ ID NO: 4350 - protein, 29 aa, Artificial Sequence
  Description of Artificial Sequence: Synthetic peptide
DEEEIRTTNPVATEQYGSVSTNLIQRGQR

SEQ ID NO: 4351 - protein, 29 aa, Artificial Sequence
  Description of Artificial Sequence: Synthetic peptide
DEEEIRTTNPVATEQYGSVFTNQLQRGNR

SEQ ID NO: 4352 - protein, 29 aa, Artificial Sequence
  Description of Artificial Sequence: Synthetic peptide
DEEEIRPTNPVATEQYGSVSTNLQRAGNR

SEQ ID NO: 4353 - protein, 28 aa, Artificial Sequence
  Description of Artificial Sequence: Synthetic peptide
DEEEIRTTNPVATEQYGSVSTNLFRMNR

SEQ ID NO: 4354 - protein, 28 aa, Artificial Sequence
  Description of Artificial Sequence: Synthetic peptide
DEEEISTTNPVATEQYGSVDTNLQRGNR

SEQ ID NO: 4355 - protein, 30 aa, Artificial Sequence
  Description of Artificial Sequence: Synthetic polypeptide
DEEEIRTTNPVATEQYGSVFSTNLQRGNLR

SEQ ID NO: 4356 - protein, 28 aa, Artificial Sequence
  Description of Artificial Sequence: Synthetic peptide
DEEEIRTTNPVATEQYGAVSTNPQRGNR

SEQ ID NO: 4357 - protein, 29 aa, Artificial Sequence
  Description of Artificial Sequence: Synthetic peptide
DEEEIRPTNPVATEQYGSVSTNLQWRGNR

SEQ ID NO: 4358 - protein, 28 aa, Artificial Sequence
  Description of Artificial Sequence: Synthetic peptide
DEEEISTTNPVATEQYGSVSPNLQRGNR

SEQ ID NO: 4359 - protein, 29 aa, Artificial Sequence
  Description of Artificial Sequence: Synthetic peptide
DEEEIRTTNPVATEQYGSVFTNLQRTGNR

SEQ ID NO: 4360 - protein, 29 aa, Artificial Sequence
  Description of Artificial Sequence: Synthetic peptide
DEEEISTTNPVATEQYGSVSTFNLQRGNR

SEQ ID NO: 4361 - protein, 29 aa, Artificial Sequence
  Description of Artificial Sequence: Synthetic peptide
DEEEIRTTNPVATEQYGSVSTNLIRNGNR

SEQ ID NO: 4362 - protein, 29 aa, Artificial Sequence
  Description of Artificial Sequence: Synthetic peptide
DEEPIRTTNPVATEQYGSVSTNLQVRGNR

SEQ ID NO: 4363 - protein, 28 aa, Artificial Sequence
  Description of Artificial Sequence: Synthetic peptide
DEEEISTTNPVATEQYGSVSTNLQWGNR

SEQ ID NO: 4364 - protein, 29 aa, Artificial Sequence
  Description of Artificial Sequence: Synthetic peptide
DEEPIRTTNPVATEQYGSVSTNLQRGNLR

SEQ ID NO: 4365 - protein, 28 aa, Artificial Sequence
  Description of Artificial Sequence: Synthetic peptide
NEEEIRTTNPVATEQYGSVSTNLQRDNR

SEQ ID NO: 4366 - protein, 28 aa, Artificial Sequence
  Description of Artificial Sequence: Synthetic peptide
DEEEIRPTNPVATEWYGSVSTNLQRGNR

SEQ ID NO: 4367 - protein, 28 aa, Artificial Sequence
  Description of Artificial Sequence: Synthetic peptide
DEEPIRTTNPVATEQYGSVSTNLQRGND

SEQ ID NO: 4368 - protein, 28 aa, Artificial Sequence
  Description of Artificial Sequence: Synthetic peptide
DEEEIRPTNPVATETYGSVSTNLQRGNR

SEQ ID NO: 4369 - protein, 29 aa, Artificial Sequence
  Description of Artificial Sequence: Synthetic peptide
DEEEISTTNPVATEQYGSVSTNLQIRGNR

SEQ ID NO: 4370 - protein, 29 aa, Artificial Sequence
  Description of Artificial Sequence: Synthetic peptide
DEEPIRTTNPVATEQYGSVSTNLQRDGNR

SEQ ID NO: 4371 - protein, 29 aa, Artificial Sequence
  Description of Artificial Sequence: Synthetic peptide
DEEPIRTTNPVATEQYGSVQSTNLQRGNR

SEQ ID NO: 4372 - protein, 28 aa, Artificial Sequence
  Description of Artificial Sequence: Synthetic peptide
NEEEIRTTNPVATEQYGSVSTNLQRGIR

SEQ ID NO: 4373 - protein, 28 aa, Artificial Sequence
  Description of Artificial Sequence: Synthetic peptide
DEEEISTTNPVATEQYGSVSTNLQLGNR

SEQ ID NO: 4374 - protein, 28 aa, Artificial Sequence
  Description of Artificial Sequence: Synthetic peptide
NEEEIRTTNPVATEQYGSVSTNLQRGNA

SEQ ID NO: 4375 - protein, 29 aa, Artificial Sequence
  Description of Artificial Sequence: Synthetic peptide
DEEEISTTNPVATEQYGSVSTNLQRGNRN

SEQ ID NO: 4376 - protein, 28 aa, Artificial Sequence
  Description of Artificial Sequence: Synthetic peptide
DEEPIRTTNPVATEQYGSVSTNLERGNR

SEQ ID NO: 4377 - protein, 28 aa, Artificial Sequence
  Description of Artificial Sequence: Synthetic peptide
DEEPIRTTNPVATEQYGSVSTNLQNGNR

SEQ ID NO: 4378 - protein, 28 aa, Artificial Sequence
  Description of Artificial Sequence: Synthetic peptide
NEEEIRTTNPVATEQYGSVSTNLQRGNT

SEQ ID NO: 4379 - protein, 28 aa, Artificial Sequence
  Description of Artificial Sequence: Synthetic peptide
DEEEISTTNPVATEQYGSVSTNLQRGDR

SEQ ID NO: 4380 - protein, 29 aa, Artificial Sequence
  Description of Artificial Sequence: Synthetic peptide
DEEEISTTNPVATEQYGSVSTNLQYRGNR

SEQ ID NO: 4381 - protein, 28 aa, Artificial Sequence
  Description of Artificial Sequence: Synthetic peptide
DEEEITTTNPVATENYGSVSTNLQRGNR

SEQ ID NO: 4382 - protein, 28 aa, Artificial Sequence
  Description of Artificial Sequence: Synthetic peptide
DEEEISTTNPVATEQYGSVSTNLNRGNR

SEQ ID NO: 4383 - protein, 28 aa, Artificial Sequence
  Description of Artificial Sequence: Synthetic peptide
DEEEISTTNPVATEQYGSVSTNLMRGNR

SEQ ID NO: 4384 - protein, 28 aa, Artificial Sequence
  Description of Artificial Sequence: Synthetic peptide
DEEEIRPTNPVATEQYGSVSTNWQRGNR

SEQ ID NO: 4385 - protein, 28 aa, Artificial Sequence
  Description of Artificial Sequence: Synthetic peptide
DEEEIRPTNPVATEQYGSVSTYLQRGNR

SEQ ID NO: 4386 - protein, 28 aa, Artificial Sequence
  Description of Artificial Sequence: Synthetic peptide
NEEEIRTTNPVATEQYGSVSTTLQRGNR

SEQ ID NO: 4387 - protein, 29 aa, Artificial Sequence
  Description of Artificial Sequence: Synthetic peptide
DEEEIRTTNPVATEQYGSVETHNLQRGNR

SEQ ID NO: 4388 - protein, 28 aa, Artificial Sequence
  Description of Artificial Sequence: Synthetic peptide
DEEEIRQTNPVATEQYGEVSTNLQRGNR

SEQ ID NO: 4389 - protein, 28 aa, Artificial Sequence
  Description of Artificial Sequence: Synthetic peptide
DEEEISTTNPVATEQYGTVSTNLQRGNR

SEQ ID NO: 4390 - protein, 28 aa, Artificial Sequence
  Description of Artificial Sequence: Synthetic peptide
DEEPIRTTNPVATENYGSVSTNLQRGNR

SEQ ID NO: 4391 - protein, 28 aa, Artificial Sequence
  Description of Artificial Sequence: Synthetic peptide
DEEEIRPTNPVGTEQYGSVSTNLQRGNR

SEQ ID NO: 4392 - protein, 28 aa, Artificial Sequence
  Description of Artificial Sequence: Synthetic peptide
NEEEIRTTNPVATEQYGSVSTALQRGNR

SEQ ID NO: 4393 - protein, 28 aa, Artificial Sequence
  Description of Artificial Sequence: Synthetic peptide
NEEEIRTTNPVATEQYGEVSTNLQRGNR

SEQ ID NO: 4394 - protein, 28 aa, Artificial Sequence
  Description of Artificial Sequence: Synthetic peptide
DEEEIRTTNPCATEQYGTVSTNLQRGNR

SEQ ID NO: 4395 - protein, 28 aa, Artificial Sequence
  Description of Artificial Sequence: Synthetic peptide
DEEEISTTNPVATEQYGSVSTWLQRGNR

SEQ ID NO: 4396 - protein, 29 aa, Artificial Sequence
  Description of Artificial Sequence: Synthetic peptide
DEEEISTTNPVATEQYGSVSTPNLQRGNR

SEQ ID NO: 4397 - protein, 28 aa, Artificial Sequence
  Description of Artificial Sequence: Synthetic peptide
DEEEIRTTNPVATEQYGSVFTNLDRGNR

SEQ ID NO: 4398 - protein, 28 aa, Artificial Sequence
  Description of Artificial Sequence: Synthetic peptide
DEEEISTTNPVATEQYGSVSTNLERGNR

SEQ ID NO: 4399 - protein, 28 aa, Artificial Sequence
  Description of Artificial Sequence: Synthetic peptide
DEEEIRTTNPVATEQYGSVFTNLQRGNM

SEQ ID NO: 4400 - protein, 29 aa, Artificial Sequence
  Description of Artificial Sequence: Synthetic peptide
DEEEIRTTNPVATEQYGSVFTNLQRGVNR

SEQ ID NO: 4401 - protein, 28 aa, Artificial Sequence
  Description of Artificial Sequence: Synthetic peptide
NEEEIRTTNPVATEQYGSVSTNLDRGNR

SEQ ID NO: 4402 - protein, 28 aa, Artificial Sequence
  Description of Artificial Sequence: Synthetic peptide
DEEEISTTNPVATEQYGSVSTNLFRGNR

SEQ ID NO: 4403 - protein, 28 aa, Artificial Sequence
  Description of Artificial Sequence: Synthetic peptide
DEEEIRTTNPVATEQYGCVSTNMQRGNR

SEQ ID NO: 4404 - protein, 29 aa, Artificial Sequence
  Description of Artificial Sequence: Synthetic peptide
DEEEIYTTNPVATEQYGSVSTNLVQRGNR

SEQ ID NO: 4405 - protein, 30 aa, Artificial Sequence
  Description of Artificial Sequence: Synthetic polypeptide
DEEEIRTTNPVATEQYGNSVSTNLQRLGNR

SEQ ID NO: 4406 - protein, 30 aa, Artificial Sequence
  Description of Artificial Sequence: Synthetic polypeptide
DEEEIRTTNPVATEQYGNSVSTNLQRGNRD

SEQ ID NO: 4407 - protein, 29 aa, Artificial Sequence
  Description of Artificial Sequence: Synthetic peptide
DEEEIRTTNPVATEQYGNAVSTNLQRGNR

SEQ ID NO: 4408 - protein, 29 aa, Artificial Sequence
  Description of Artificial Sequence: Synthetic peptide
DEEEIRTTNPVATEQYGSVSTMLQRGLNR

SEQ ID NO: 4409 - protein, 29 aa, Artificial Sequence
  Description of Artificial Sequence: Synthetic peptide
DEEEIRTTNPVATEQYGSVSTNLIQRGNE

SEQ ID NO: 4410 - protein, 28 aa, Artificial Sequence
  Description of Artificial Sequence: Synthetic peptide
DEEEITTTNPVATEQYGVVSTNLQRGNR

SEQ ID NO: 4411 - protein, 29 aa, Artificial Sequence
  Description of Artificial Sequence: Synthetic peptide
DEEEIRTTNPVATEQYGSVESTNLQRANR

SEQ ID NO: 4412 - protein, 29 aa, Artificial Sequence
  Description of Artificial Sequence: Synthetic peptide
DEEEIRTTNPCATEQYNGSVSTNLQRGNR

SEQ ID NO: 4413 - protein, 28 aa, Artificial Sequence
  Description of Artificial Sequence: Synthetic peptide
DEEEIRTTNPVATEQYGNLSTNLQRGNR

SEQ ID NO: 4414 - protein, 29 aa, Artificial Sequence
  Description of Artificial Sequence: Synthetic peptide
DEEEIRTTNPVATEQYGSVFSTNEQRGNR

SEQ ID NO: 4415 - protein, 28 aa, Artificial Sequence
  Description of Artificial Sequence: Synthetic peptide
DEEEISTTNPVATEQYGSNSTNLQRGNR

SEQ ID NO: 4416 - protein, 30 aa, Artificial Sequence
  Description of Artificial Sequence: Synthetic polypeptide
DEEEIRTTNPVATEQYGNSVSNTNLQRGNR

SEQ ID NO: 4417 - protein, 29 aa, Artificial Sequence
  Description of Artificial Sequence: Synthetic peptide
DEEEIRTTNPVATEQWGSVSTNLQRGNRM

SEQ ID NO: 4418 - protein, 28 aa, Artificial Sequence
  Description of Artificial Sequence: Synthetic peptide
DEEEITTTNPVATEQYGSVSYNLQRGNR

SEQ ID NO: 4419 - protein, 30 aa, Artificial Sequence
  Description of Artificial Sequence: Synthetic polypeptide
DEEEIRTTNPVATEQYGNSVSTLNLQRGNR

SEQ ID NO: 4420 - protein, 30 aa, Artificial Sequence
  Description of Artificial Sequence: Synthetic polypeptide
DEEEIRTTNPVATEQYGSVSTNLFQRGNYR

SEQ ID NO: 4421 - protein, 29 aa, Artificial Sequence
  Description of Artificial Sequence: Synthetic peptide
DEEEIRTTNPVATEQYGSVSTNLFQRSNR

SEQ ID NO: 4422 - protein, 29 aa, Artificial Sequence
  Description of Artificial Sequence: Synthetic peptide
DEEEIRTTNPVATEQYGSVESTNLQRFNR

SEQ ID NO: 4423 - protein, 30 aa, Artificial Sequence
  Description of Artificial Sequence: Synthetic polypeptide
DEEEIRTTNPVATEQYGSVSTNLGQRGNSR

SEQ ID NO: 4424 - protein, 29 aa, Artificial Sequence
  Description of Artificial Sequence: Synthetic peptide
DEEEITTTNPVATEQYGSVSTQNLQRGNR

SEQ ID NO: 4425 - protein, 29 aa, Artificial Sequence
  Description of Artificial Sequence: Synthetic peptide
DEEEIRTTNPVATEQYGSVSTNLIQRGNK

SEQ ID NO: 4426 - protein, 29 aa, Artificial Sequence
  Description of Artificial Sequence: Synthetic peptide
DEEEIRQTNPVATEQYGSVSTFNLQRGNR

SEQ ID NO: 4427 - protein, 28 aa, Artificial Sequence
  Description of Artificial Sequence: Synthetic peptide
DEEEIRTTNPVATEQYGSVSTMLQRGMR

SEQ ID NO: 4428 - protein, 29 aa, Artificial Sequence
  Description of Artificial Sequence: Synthetic peptide
DEEEIRTTNPVATEQYGSVSTNLKREGNR

SEQ ID NO: 4429 - protein, 28 aa, Artificial Sequence
  Description of Artificial Sequence: Synthetic peptide
DEEEIRTTNPVATEQYGSVSWNLQRGNV

SEQ ID NO: 4430 - protein, 28 aa, Artificial Sequence
  Description of Artificial Sequence: Synthetic peptide
DEEEIRQTNPVATEQYGSVSTNLCRGNR

SEQ ID NO: 4431 - protein, 29 aa, Artificial Sequence
  Description of Artificial Sequence: Synthetic peptide
DEEEIRTTNPVATEQYGSVSPTNLQWGNR

SEQ ID NO: 4432 - protein, 29 aa, Artificial Sequence
  Description of Artificial Sequence: Synthetic peptide
DEEEIRQTNPVATEQYGSVSTNGLQRGNR

SEQ ID NO: 4433 - protein, 29 aa, Artificial Sequence
  Description of Artificial Sequence: Synthetic peptide
DEEEIRTTNPVATEQYGSVSWNLQRGINR

SEQ ID NO: 4434 - protein, 29 aa, Artificial Sequence
  Description of Artificial Sequence: Synthetic peptide
DEEEIRTTNPVATEQWGSVSTNLQRGNPR

SEQ ID NO: 4435 - protein, 29 aa, Artificial Sequence
  Description of Artificial Sequence: Synthetic peptide
DEEQIRTTNPVATEQYGSVESTNLQRGNR

SEQ ID NO: 4436 - protein, 28 aa, Artificial Sequence
  Description of Artificial Sequence: Synthetic peptide
NEEEIRTTNPVATEPYGSVSTNLQRGNR

SEQ ID NO: 4437 - protein, 30 aa, Artificial Sequence
  Description of Artificial Sequence: Synthetic polypeptide
DEEEIRTTNPVATEQYGSVESTNLEQRGNR

SEQ ID NO: 4438 - protein, 29 aa, Artificial Sequence
  Description of Artificial Sequence: Synthetic peptide
DEEEIRTTNPVATEQYGSVESTNLIRGNR

SEQ ID NO: 4439 - protein, 29 aa, Artificial Sequence
  Description of Artificial Sequence: Synthetic peptide
DEEEIRTTNPVATEQYGSVSTNLFQRGLR

SEQ ID NO: 4440 - protein, 28 aa, Artificial Sequence
  Description of Artificial Sequence: Synthetic peptide
DEEEITTVNPVATEQYGSVSTNLQRGNR

SEQ ID NO: 4441 - protein, 28 aa, Artificial Sequence
  Description of Artificial Sequence: Synthetic peptide
NEEEIRTTNPVATEQIGSVSTNLQRGNR

SEQ ID NO: 4442 - protein, 28 aa, Artificial Sequence
  Description of Artificial Sequence: Synthetic peptide
DEEEIRPTNPVATEQYGSVSGNLQRGNR

SEQ ID NO: 4443 - protein, 30 aa, Artificial Sequence
  Description of Artificial Sequence: Synthetic polypeptide
DEEEIRTTNPVATEQYGSVSTNLIQRGDNR

SEQ ID NO: 4444 - protein, 29 aa, Artificial Sequence
  Description of Artificial Sequence: Synthetic peptide
DEEEIRTTNPVATEQYGPVSTNLQGRGNR

SEQ ID NO: 4445 - protein, 28 aa, Artificial Sequence
  Description of Artificial Sequence: Synthetic peptide
DEEEIRTTNPVATEQYGSVSTMLQRGYR

SEQ ID NO: 4446 - protein, 30 aa, Artificial Sequence
  Description of Artificial Sequence: Synthetic polypeptide
DEEEIRTTNPVATEQYGSVSTNLFQRGNRD

SEQ ID NO: 4447 - protein, 28 aa, Artificial Sequence
  Description of Artificial Sequence: Synthetic peptide
DEEEISTTNPVATEQYGSGSTNLQRGNR

SEQ ID NO: 4448 - protein, 29 aa, Artificial Sequence
  Description of Artificial Sequence: Synthetic peptide
DEEEIRTTNPVATEQYGSVSTNLGQRGNA

SEQ ID NO: 4449 - protein, 29 aa, Artificial Sequence
  Description of Artificial Sequence: Synthetic peptide
DEEEIRPTNPVATEQYGSVSTLNLQRGNR

SEQ ID NO: 4450 - protein, 29 aa, Artificial Sequence
  Description of Artificial Sequence: Synthetic peptide
DEEEIRQTNPVATEQYGSVSTCNLQRGNR

SEQ ID NO: 4451 - protein, 29 aa, Artificial Sequence
  Description of Artificial Sequence: Synthetic peptide
DEEEITTTNPVATEQYGSVSTNLQRGNRG

SEQ ID NO: 4452 - protein, 29 aa, Artificial Sequence
  Description of Artificial Sequence: Synthetic peptide
DEEEIRTTNPVATEQYGNSVSTNLQPGNR

SEQ ID NO: 4453 - protein, 30 aa, Artificial Sequence
  Description of Artificial Sequence: Synthetic polypeptide
DEEEIRTTNPVATEQYGNSVSTNLQRGENR

SEQ ID NO: 4454 - protein, 29 aa, Artificial Sequence
  Description of Artificial Sequence: Synthetic peptide
DEEEIRTTNPVATEQYGSVSWNLAQRGNR

SEQ ID NO: 4455 - protein, 30 aa, Artificial Sequence
  Description of Artificial Sequence: Synthetic polypeptide
DEEEIRTTNPVATEQYGSVESTNLQRGWNR

SEQ ID NO: 4456 - protein, 29 aa, Artificial Sequence
  Description of Artificial Sequence: Synthetic peptide
DEEEITTTNPVATEQYGSVSTNLQRGNAR

SEQ ID NO: 4457 - protein, 28 aa, Artificial Sequence
  Description of Artificial Sequence: Synthetic peptide
DEENIRTTNPVATEQYGSVSTNLQEGNR

SEQ ID NO: 4458 - protein, 29 aa, Artificial Sequence
  Description of Artificial Sequence: Synthetic peptide
DEEEITTTNPVATEQYGSVSTNLQIRGNR

SEQ ID NO: 4459 - protein, 28 aa, Artificial Sequence
  Description of Artificial Sequence: Synthetic peptide
DEEEITTTNPVATEQYGSVSTNAQRGNR

SEQ ID NO: 4460 - protein, 30 aa, Artificial Sequence
  Description of Artificial Sequence: Synthetic polypeptide
DEEEIRTTNPVATEQYGSVFSTNLQRGNER

SEQ ID NO: 4461 - protein, 30 aa, Artificial Sequence
  Description of Artificial Sequence: Synthetic polypeptide
DEEEIRTTNPVATEQYGSVESTNLQVRGNR

SEQ ID NO: 4462 - protein, 30 aa, Artificial Sequence
  Description of Artificial Sequence: Synthetic polypeptide
DEEEIRTTNPVATEQYGSVSTNLGQRGGNR

SEQ ID NO: 4463 - protein, 30 aa, Artificial Sequence
  Description of Artificial Sequence: Synthetic polypeptide
DEEEIRTTNPVATEQYGSVSTNLGQRGANR

SEQ ID NO: 4464 - protein, 28 aa, Artificial Sequence
  Description of Artificial Sequence: Synthetic peptide
DEEEITTTNPVATEQYGSVSFNLQRGNR

SEQ ID NO: 4465 - protein, 30 aa, Artificial Sequence
  Description of Artificial Sequence: Synthetic polypeptide
DEEEIRTTNPVATEQYGNSVSTNLQRGMNR

SEQ ID NO: 4466 - protein, 28 aa, Artificial Sequence
  Description of Artificial Sequence: Synthetic peptide
DEEEIRTTNPVATEQYGSVSTNLFRGAR

SEQ ID NO: 4467 - protein, 29 aa, Artificial Sequence
  Description of Artificial Sequence: Synthetic peptide
DEEEITTTNPVATEQYGSVCSTNLQRGNR

SEQ ID NO: 4468 - protein, 29 aa, Artificial Sequence
  Description of Artificial Sequence: Synthetic peptide
DEEEIRTTNPVATEQYGSVSWNFLQRGNR

SEQ ID NO: 4469 - protein, 28 aa, Artificial Sequence
  Description of Artificial Sequence: Synthetic peptide
DEEEIRTTNPVATEQYGAVSTNLQYGNR

SEQ ID NO: 4470 - protein, 29 aa, Artificial Sequence
  Description of Artificial Sequence: Synthetic peptide
DEENIRTTNPVATEQYGSVSTNLQRGINR

SEQ ID NO: 4471 - protein, 28 aa, Artificial Sequence
  Description of Artificial Sequence: Synthetic peptide
DEEEITTTNPVATEQYGSVSTNLQRGNE

SEQ ID NO: 4472 - protein, 29 aa, Artificial Sequence
  Description of Artificial Sequence: Synthetic peptide
DEENIRTTNPVATEQYGSVSTNLQRGNIR

SEQ ID NO: 4473 - protein, 29 aa, Artificial Sequence
  Description of Artificial Sequence: Synthetic peptide
DEEEIRTTNPVATEQYGSVSPTNLQTGNR

SEQ ID NO: 4474 - protein, 29 aa, Artificial Sequence
  Description of Artificial Sequence: Synthetic peptide
DEEEITTTNPVATEQYGSVSTNLQRGNFR

SEQ ID NO: 4475 - protein, 28 aa, Artificial Sequence
  Description of Artificial Sequence: Synthetic peptide
DEEEIRPTNPVATEQYGSVSTNFQRGNR

SEQ ID NO: 4476 - protein, 29 aa, Artificial Sequence
  Description of Artificial Sequence: Synthetic peptide
DEEEIRTTNPVATECQYGSVSTNLQDGNR

SEQ ID NO: 4477 - protein, 29 aa, Artificial Sequence
  Description of Artificial Sequence: Synthetic peptide
DEEEIRTTNPVATEQYGAVSTNLQRGANR

SEQ ID NO: 4478 - protein, 29 aa, Artificial Sequence
  Description of Artificial Sequence: Synthetic peptide
DEEEIRTTNPVATEQYGSVFSTNLQRGNE

SEQ ID NO: 4479 - protein, 28 aa, Artificial Sequence
  Description of Artificial Sequence: Synthetic peptide
NEEEIRTTNPVATETYGSVSTNLQRGNR

SEQ ID NO: 4480 - protein, 28 aa, Artificial Sequence
  Description of Artificial Sequence: Synthetic peptide
DEEEIRTTNPVATEQWGTVSTNLQRGNR

SEQ ID NO: 4481 - protein, 30 aa, Artificial Sequence
  Description of Artificial Sequence: Synthetic polypeptide
DEEEIRTTNPVATEQYGNSVSTNCLQRGNR

SEQ ID NO: 4482 - protein, 28 aa, Artificial Sequence
  Description of Artificial Sequence: Synthetic peptide
DEENIRTTNPVATEQYGSVFTNLQRGNR

SEQ ID NO: 4483 - protein, 29 aa, Artificial Sequence
  Description of Artificial Sequence: Synthetic peptide
DEEEIRTTNPVATEQYGSVESTNLQRGND

SEQ ID NO: 4484 - protein, 28 aa, Artificial Sequence
  Description of Artificial Sequence: Synthetic peptide
DEEEIRPTNPVATEQYGSVSTNLQCGNR

SEQ ID NO: 4485 - protein, 28 aa, Artificial Sequence
  Description of Artificial Sequence: Synthetic peptide
DEEEIRPTNPVATEQYGSVSTNLQPGNR

SEQ ID NO: 4486 - protein, 28 aa, Artificial Sequence
  Description of Artificial Sequence: Synthetic peptide
DEEQIRTTNPVATELYGSVSTNLQRGNR

SEQ ID NO: 4487 - protein, 29 aa, Artificial Sequence
  Description of Artificial Sequence: Synthetic peptide
DEEEIRTTNPVATEQYGAVSTNLQRVGNR

SEQ ID NO: 4488 - protein, 29 aa, Artificial Sequence
  Description of Artificial Sequence: Synthetic peptide
DEEEITTTNPVATEQYGSVSTNLQRGNPR

SEQ ID NO: 4489 - protein, 30 aa, Artificial Sequence
  Description of Artificial Sequence: Synthetic polypeptide
DEEEIRTTNPVATEQYGSVESTNLQRGPNR

SEQ ID NO: 4490 - protein, 30 aa, Artificial Sequence
  Description of Artificial Sequence: Synthetic polypeptide
DEEEIRTTNPVATEQYGNSVSTNLDQRGNR

SEQ ID NO: 4491 - protein, 30 aa, Artificial Sequence
  Description of Artificial Sequence: Synthetic polypeptide
DEEEIRTTNPVATEQYGSVESTNLQRGQNR

SEQ ID NO: 4492 - protein, 29 aa, Artificial Sequence
  Description of Artificial Sequence: Synthetic peptide
DEEEITTTNPVATEQYGSVSTNLQRGNGR

SEQ ID NO: 4493 - protein, 29 aa, Artificial Sequence
  Description of Artificial Sequence: Synthetic peptide
DEEEIRTTNPVATEQYGSVESTNLQRGTR

SEQ ID NO: 4494 - protein, 29 aa, Artificial Sequence
  Description of Artificial Sequence: Synthetic peptide
DEEEIRTTNPVATEQYGSVETMNLQRGNR

SEQ ID NO: 4495 - protein, 28 aa, Artificial Sequence
  Description of Artificial Sequence: Synthetic peptide
DEEEIRHTNPVATEQYGSVSTNLQQGNR

SEQ ID NO: 4496 - protein, 28 aa, Artificial Sequence
  Description of Artificial Sequence: Synthetic peptide
DEEPIRTTNPVATEQYGSVSTNLQGGNR

SEQ ID NO: 4497 - protein, 29 aa, Artificial Sequence
  Description of Artificial Sequence: Synthetic peptide
DEEEIRTTNPVATEQWGSVSTGNLQRGNR

SEQ ID NO: 4498 - protein, 29 aa, Artificial Sequence
  Description of Artificial Sequence: Synthetic peptide
DEEEIRTTNPVATEQYGAVISTNLQRGNR

SEQ ID NO: 4499 - protein, 29 aa, Artificial Sequence
  Description of Artificial Sequence: Synthetic peptide
TEEEIRTTNPVATEQYGSVSTDNLQRGNR

SEQ ID NO: 4500 - protein, 28 aa, Artificial Sequence
  Description of Artificial Sequence: Synthetic peptide
DEEEVRTTNPVATEQYGSVSTTLQRGNR

SEQ ID NO: 4501 - protein, 28 aa, Artificial Sequence
  Description of Artificial Sequence: Synthetic peptide
DEEETRTTNPVATEQYGSVSTNIQRGNR

SEQ ID NO: 4502 - protein, 29 aa, Artificial Sequence
  Description of Artificial Sequence: Synthetic peptide
DEEGIRTTNPVATEQYGSVSTNLQRQGNR

SEQ ID NO: 4503 - protein, 29 aa, Artificial Sequence
  Description of Artificial Sequence: Synthetic peptide
DEEEIRTTNPVATEQYGMVSTNLQRGNRM

SEQ ID NO: 4504 - protein, 29 aa, Artificial Sequence
  Description of Artificial Sequence: Synthetic peptide
DEEEVRTTNPVATEQYGSVSTNLQRTGNR

SEQ ID NO: 4505 - protein, 29 aa, Artificial Sequence
  Description of Artificial Sequence: Synthetic peptide
DEEEIRTTNPVATEQYGSVDTNLQRGNLR

SEQ ID NO: 4506 - protein, 29 aa, Artificial Sequence
  Description of Artificial Sequence: Synthetic peptide
DEEIIRTTNPVATEQYGSVSETNLQRGNR

SEQ ID NO: 4507 - protein, 29 aa, Artificial Sequence
  Description of Artificial Sequence: Synthetic peptide
DEEEVRTTNPVATEQYGSVSTNLQRGNRL

SEQ ID NO: 4508 - protein, 28 aa, Artificial Sequence
  Description of Artificial Sequence: Synthetic peptide
AEEEIGTTNPVATEQYGSVSTNLQRGNR

SEQ ID NO: 4509 - protein, 29 aa, Artificial Sequence
  Description of Artificial Sequence: Synthetic peptide
DEEEVRTTNPVATEQYGSVSTNLQRGNAR

SEQ ID NO: 4510 - protein, 28 aa, Artificial Sequence
  Description of Artificial Sequence: Synthetic peptide
DEESIRTTNPVASEQYGSVSTNLQRGNR

SEQ ID NO: 4511 - protein, 29 aa, Artificial Sequence
  Description of Artificial Sequence: Synthetic peptide
DEEEIRTTNPVATEQYGCVSTNLQRGNRL

SEQ ID NO: 4512 - protein, 28 aa, Artificial Sequence
  Description of Artificial Sequence: Synthetic peptide
DEEEIRTVNPVATEQYGSVSTNLQRGNH

SEQ ID NO: 4513 - protein, 28 aa, Artificial Sequence
  Description of Artificial Sequence: Synthetic peptide
DEEEVRTTNPVATEQYGSVSTNLQRGER

SEQ ID NO: 4514 - protein, 28 aa, Artificial Sequence
  Description of Artificial Sequence: Synthetic peptide
DEEEIRTTNPVATEQYGSVDTNLQRGNY

SEQ ID NO: 4515 - protein, 28 aa, Artificial Sequence
  Description of Artificial Sequence: Synthetic peptide
DEEEVRTTNPVATEQYGSVSTNLFRGNR

SEQ ID NO: 4516 - protein, 28 aa, Artificial Sequence
  Description of Artificial Sequence: Synthetic peptide
DEEETRTTNPVATEQYGSVSTNLQRGNI

SEQ ID NO: 4517 - protein, 28 aa, Artificial Sequence
  Description of Artificial Sequence: Synthetic peptide
DEEEIRTTNPVATEQYGMVSTNLQRGNS

SEQ ID NO: 4518 - protein, 29 aa, Artificial Sequence
  Description of Artificial Sequence: Synthetic peptide
DEEEIRYTNPVATEQYGSVSTNLEQRGNR

SEQ ID NO: 4519 - protein, 28 aa, Artificial Sequence
  Description of Artificial Sequence: Synthetic peptide
DEEETRTTNPVATEQYGSVSTNLQRGNQ

SEQ ID NO: 4520 - protein, 29 aa, Artificial Sequence
  Description of Artificial Sequence: Synthetic peptide
DEEEVRTTNPVATEQYGSVSTNHLQRGNR

SEQ ID NO: 4521 - protein, 28 aa, Artificial Sequence
  Description of Artificial Sequence: Synthetic peptide
DEEETRTTNPVATEQYGSVSTNLQRGNT

SEQ ID NO: 4522 - protein, 29 aa, Artificial Sequence
  Description of Artificial Sequence: Synthetic peptide
DEEEIRTTNPVATEQYGSVDTNLQRIGNR

SEQ ID NO: 4523 - protein, 28 aa, Artificial Sequence
  Description of Artificial Sequence: Synthetic peptide
DEEETRTTNPVATEQYGSVSTELQRGNR

SEQ ID NO: 4524 - protein, 28 aa, Artificial Sequence
  Description of Artificial Sequence: Synthetic peptide
DEEETRTTNPVATEQYGSVSCNLQRGNR

SEQ ID NO: 4525 - protein, 29 aa, Artificial Sequence
  Description of Artificial Sequence: Synthetic peptide
DEEEIRTTNPVATEQYGMVSTNLQRGNRE

SEQ ID NO: 4526 - protein, 29 aa, Artificial Sequence
  Description of Artificial Sequence: Synthetic peptide
DEEEIRTVNPVATEQYGSVSTTNLQRGNR

SEQ ID NO: 4527 - protein, 29 aa, Artificial Sequence
  Description of Artificial Sequence: Synthetic peptide
DEEEIRTTNPVATEQYGSVRSTNLQRGNH

SEQ ID NO: 4528 - protein, 28 aa, Artificial Sequence
  Description of Artificial Sequence: Synthetic peptide
DEEEMRTTNPVATEQYGSVSTNTQRGNR

SEQ ID NO: 4529 - protein, 29 aa, Artificial Sequence
  Description of Artificial Sequence: Synthetic peptide
DEEEIRQTNPVATEQYGSVSTNLQRGNNR

SEQ ID NO: 4530 - protein, 28 aa, Artificial Sequence
  Description of Artificial Sequence: Synthetic peptide
DEEEQRTTNPVATEQYGSVSTNLQDGNR

SEQ ID NO: 4531 - protein, 28 aa, Artificial Sequence
  Description of Artificial Sequence: Synthetic peptide
DEEEIRSTNPCATEQYGSVSTNLQRGNR

SEQ ID NO: 4532 - protein, 30 aa, Artificial Sequence
  Description of Artificial Sequence: Synthetic polypeptide
DEEFEIRTTNPVATEQVYGSVSTNLQRGNR

SEQ ID NO: 4533 - protein, 29 aa, Artificial Sequence
  Description of Artificial Sequence: Synthetic peptide
DEEEIRTTNPVATEQYGSVSTNLHQQGNR

SEQ ID NO: 4534 - protein, 28 aa, Artificial Sequence
  Description of Artificial Sequence: Synthetic peptide
DEEEIRTTNPVATEQYGCVSTNLQRGNT

SEQ ID NO: 4535 - protein, 28 aa, Artificial Sequence
  Description of Artificial Sequence: Synthetic peptide
DEEESRTTNPVATEQYGSVSMNLQRGNR

SEQ ID NO: 4536 - protein, 28 aa, Artificial Sequence
  Description of Artificial Sequence: Synthetic peptide
DEEHIRTTNPMATEQYGSVSTNLQRGNR

SEQ ID NO: 4537 - protein, 29 aa, Artificial Sequence
  Description of Artificial Sequence: Synthetic peptide
DEEEIRTTNPVATEQYGSVSTNLERPGNR

SEQ ID NO: 4538 - protein, 29 aa, Artificial Sequence
  Description of Artificial Sequence: Synthetic peptide
DEEIIRTTNPVATEQYGSVSTNLQRGTNR

SEQ ID NO: 4539 - protein, 29 aa, Artificial Sequence
  Description of Artificial Sequence: Synthetic peptide
TEEEIRTTNPVATEQYGSVSTNLQRGSNR

SEQ ID NO: 4540 - protein, 28 aa, Artificial Sequence
  Description of Artificial Sequence: Synthetic peptide
DEEEIRTTNPVATEQYGNVSTQLQRGNR

SEQ ID NO: 4541 - protein, 28 aa, Artificial Sequence
  Description of Artificial Sequence: Synthetic peptide
DEEESRTTNPVATEQYGSVSTNLQWGNR

SEQ ID NO: 4542 - protein, 28 aa, Artificial Sequence
  Description of Artificial Sequence: Synthetic peptide
DEEEIRTTNPVATEQYGSVSYNLQRVNR

SEQ ID NO: 4543 - protein, 28 aa, Artificial Sequence
  Description of Artificial Sequence: Synthetic peptide
DEEEVRYTNPVATEQYGSVSTNLQRGNR

SEQ ID NO: 4544 - protein, 29 aa, Artificial Sequence
  Description of Artificial Sequence: Synthetic peptide
DEEEIRTTNPVATEQYGSVSTNLMQLGNR

SEQ ID NO: 4545 - protein, 28 aa, Artificial Sequence
  Description of Artificial Sequence: Synthetic peptide
TEEEIRTTNPVATEQYGSVSTNLQSGNR

SEQ ID NO: 4546 - protein, 28 aa, Artificial Sequence
  Description of Artificial Sequence: Synthetic peptide
DEESIRTTNPVATEQYGSVSTQLQRGNR

SEQ ID NO: 4547 - protein, 28 aa, Artificial Sequence
  Description of Artificial Sequence: Synthetic peptide
DEEETATTNPVATEQYGSVSTNLQRGNR

SEQ ID NO: 4548 - protein, 30 aa, Artificial Sequence
  Description of Artificial Sequence: Synthetic polypeptide
DEEEIRTTNPVATEQYGSVSVTNQLQRGNR

SEQ ID NO: 4549 - protein, 28 aa, Artificial Sequence
  Description of Artificial Sequence: Synthetic peptide
DEEEIRTTNPVATEQYGSVSYNLQRLNR

SEQ ID NO: 4550 - protein, 28 aa, Artificial Sequence
  Description of Artificial Sequence: Synthetic peptide
DEEIIRTTNPVATEQYGSVSTNLQRGNG

SEQ ID NO: 4551 - protein, 29 aa, Artificial Sequence
  Description of Artificial Sequence: Synthetic peptide
DEEEIRTVNPVATEQYGSVSTNLQRDGNR

SEQ ID NO: 4552 - protein, 28 aa, Artificial Sequence
  Description of Artificial Sequence: Synthetic peptide
DEEETRTTNPVATEQYGQVSTNLQRGNR

SEQ ID NO: 4553 - protein, 28 aa, Artificial Sequence
  Description of Artificial Sequence: Synthetic peptide
DEEEVVTTNPVATEQYGSVSTNLQRGNR

SEQ ID NO: 4554 - protein, 28 aa, Artificial Sequence
  Description of Artificial Sequence: Synthetic peptide
DEEEMRTTNPVATEQYGSVSTNLQRGND

SEQ ID NO: 4555 - protein, 28 aa, Artificial Sequence
  Description of Artificial Sequence: Synthetic peptide
DEEEIRTTNPVATEQYGAVSQNLQRGNR

SEQ ID NO: 4556 - protein, 28 aa, Artificial Sequence
  Description of Artificial Sequence: Synthetic peptide
DEEEIRTTNPVATEQYGSVSTNLLSGNR

SEQ ID NO: 4557 - protein, 28 aa, Artificial Sequence
  Description of Artificial Sequence: Synthetic peptide
DEEEVRTTNPVATEQYGLVSTNLQRGNR

SEQ ID NO: 4558 - protein, 29 aa, Artificial Sequence
  Description of Artificial Sequence: Synthetic peptide
DEEAIRTTNPVATHEQYGSVSTNLQRGNR

SEQ ID NO: 4559 - protein, 29 aa, Artificial Sequence
  Description of Artificial Sequence: Synthetic peptide
TEEEIRTTNPVATEQYGSVSTENLQRGNR

SEQ ID NO: 4560 - protein, 29 aa, Artificial Sequence
  Description of Artificial Sequence: Synthetic peptide
DEEEIRTTNPVATEQYGSVSVTNLQRGAR

SEQ ID NO: 4561 - protein, 28 aa, Artificial Sequence
  Description of Artificial Sequence: Synthetic peptide
DEEEIRTTNPVATEQYGSVDTNLQRTNR

SEQ ID NO: 4562 - protein, 28 aa, Artificial Sequence
  Description of Artificial Sequence: Synthetic peptide
DEEEIRQTNPVATEQYGSVSTYLQRGNR

SEQ ID NO: 4563 - protein, 28 aa, Artificial Sequence
  Description of Artificial Sequence: Synthetic peptide
DEEGIRTTNPVATEQYGSVSTNDQRGNR

SEQ ID NO: 4564 - protein, 30 aa, Artificial Sequence
  Description of Artificial Sequence: Synthetic polypeptide
DEEEIRTTNPVATEQYGSVSVTNLQRGDNR

SEQ ID NO: 4565 - protein, 29 aa, Artificial Sequence
  Description of Artificial Sequence: Synthetic peptide
DEEEIRTTNPVATEQYGMVSTNLVQRGNR

SEQ ID NO: 4566 - protein, 28 aa, Artificial Sequence
  Description of Artificial Sequence: Synthetic peptide
DEEEIRTTNPVATEQYGSVSTNLERYNR

SEQ ID NO: 4567 - protein, 28 aa, Artificial Sequence
  Description of Artificial Sequence: Synthetic peptide
DEEEIRTTNPVATEQYGSVSTMLTRGNR

SEQ ID NO: 4568 - protein, 29 aa, Artificial Sequence
  Description of Artificial Sequence: Synthetic peptide
DEEEIRTTNPVATEQYGCVSTNLQRGGNR

SEQ ID NO: 4569 - protein, 28 aa, Artificial Sequence
  Description of Artificial Sequence: Synthetic peptide
DEESIRTTNPVATEQYGSVSTNLQPGNR

SEQ ID NO: 4570 - protein, 29 aa, Artificial Sequence
  Description of Artificial Sequence: Synthetic peptide
DEEEIRSTNPVATEQYGSVSNTNLQRGNR

SEQ ID NO: 4571 - protein, 28 aa, Artificial Sequence
  Description of Artificial Sequence: Synthetic peptide
DEEEIRSTNPAATEQYGSVSTNLQRGNR

SEQ ID NO: 4572 - protein, 29 aa, Artificial Sequence
  Description of Artificial Sequence: Synthetic peptide
DEEEIRTTNPVATEQYGSVSVTNLQRGNK

SEQ ID NO: 4573 - protein, 28 aa, Artificial Sequence
  Description of Artificial Sequence: Synthetic peptide
DEEEIRSTNPVATEQYGSVSNNLQRGNR

SEQ ID NO: 4574 - protein, 28 aa, Artificial Sequence
  Description of Artificial Sequence: Synthetic peptide
DEEEIRTTNPVATEQYGSVSTNLLTGNR

SEQ ID NO: 4575 - protein, 29 aa, Artificial Sequence
  Description of Artificial Sequence: Synthetic peptide
DEEEIRTTNPVATEQYGSVSVTNLQRGNF

SEQ ID NO: 4576 - protein, 28 aa, Artificial Sequence
  Description of Artificial Sequence: Synthetic peptide
DEEEVRTTNPVATEPYGSVSTNLQRGNR

SEQ ID NO: 4577 - protein, 28 aa, Artificial Sequence
  Description of Artificial Sequence: Synthetic peptide
DEEEIRTTNPVATEQYGSVSTNLIIGNR

SEQ ID NO: 4578 - protein, 29 aa, Artificial Sequence
  Description of Artificial Sequence: Synthetic peptide
DEESIRTTNPVATEQYGSVSTNLQRGGNR

SEQ ID NO: 4579 - protein, 29 aa, Artificial Sequence
  Description of Artificial Sequence: Synthetic peptide
DEEHIRTTNPVATEQYGSVSETNLQRGNR

SEQ ID NO: 4580 - protein, 28 aa, Artificial Sequence
  Description of Artificial Sequence: Synthetic peptide
DEESIRTTNPVATEQYGSVSTNLQRGNI

SEQ ID NO: 4581 - protein, 28 aa, Artificial Sequence
  Description of Artificial Sequence: Synthetic peptide
DEEHIRTTNPVATEQYGSVSTYLQRGNR

SEQ ID NO: 4582 - protein, 29 aa, Artificial Sequence
  Description of Artificial Sequence: Synthetic peptide
DEEEIRTVNPVATEQYGSVSTNLQRGNLR

SEQ ID NO: 4583 - protein, 29 aa, Artificial Sequence
  Description of Artificial Sequence: Synthetic peptide
DEEEIRTTNPVATEQYGSVETNLQWRGNR

SEQ ID NO: 4584 - protein, 28 aa, Artificial Sequence
  Description of Artificial Sequence: Synthetic peptide
DEEEIRTVNPVATEQYGSVSTNLQRGVR

SEQ ID NO: 4585 - protein, 29 aa, Artificial Sequence
  Description of Artificial Sequence: Synthetic peptide
DEEGIRTTNPVATEQYGSVSTLNLQRGNR

SEQ ID NO: 4586 - protein, 28 aa, Artificial Sequence
  Description of Artificial Sequence: Synthetic peptide
DEEGIRTTNPVATEQYGSVSTNLQRGNY

SEQ ID NO: 4587 - protein, 28 aa, Artificial Sequence
  Description of Artificial Sequence: Synthetic peptide
DEEEIRTTNPVATEQYGSVSHNLQRENR

SEQ ID NO: 4588 - protein, 29 aa, Artificial Sequence
  Description of Artificial Sequence: Synthetic peptide
DEEEIRTTNPVATEQYGCVSTNLQRGNRC

SEQ ID NO: 4589 - protein, 28 aa, Artificial Sequence
  Description of Artificial Sequence: Synthetic peptide
DEEEIRTTNPVATEQYGAVSTILQRGNR

SEQ ID NO: 4590 - protein, 28 aa, Artificial Sequence
  Description of Artificial Sequence: Synthetic peptide
DEEETRTTNPVATEQYGSVSTNLQRGSR

SEQ ID NO: 4591 - protein, 28 aa, Artificial Sequence
  Description of Artificial Sequence: Synthetic peptide
DEESIRTTNPVATEQYGSVSDNLQRGNR

SEQ ID NO: 4592 - protein, 29 aa, Artificial Sequence
  Description of Artificial Sequence: Synthetic peptide
DEEEIRTTNPVATEQYGSVSTNLGRSGNR

SEQ ID NO: 4593 - protein, 28 aa, Artificial Sequence
  Description of Artificial Sequence: Synthetic peptide
DEEEIRTTNPVATEQYGSVDTNLQRLNR

SEQ ID NO: 4594 - protein, 29 aa, Artificial Sequence
  Description of Artificial Sequence: Synthetic peptide
DEEEIRTTNPVATEQYGSVETNPLQRGNR

SEQ ID NO: 4595 - protein, 29 aa, Artificial Sequence
  Description of Artificial Sequence: Synthetic peptide
DEEEIRYTNPVATEQYGSVSTNLQRGANR

SEQ ID NO: 4596 - protein, 28 aa, Artificial Sequence
  Description of Artificial Sequence: Synthetic peptide
DEEGIRTTNPVATEQYGSVSTNLQGGNR

SEQ ID NO: 4597 - protein, 29 aa, Artificial Sequence
  Description of Artificial Sequence: Synthetic peptide
DEEEIRQTNPVATEQYGSVSTNLQRNGNR

SEQ ID NO: 4598 - protein, 29 aa, Artificial Sequence
  Description of Artificial Sequence: Synthetic peptide
DEEEIRTTNPVATEQYGSVDTNLQRLGNR

SEQ ID NO: 4599 - protein, 28 aa, Artificial Sequence
  Description of Artificial Sequence: Synthetic peptide
DEEEIRTTNPVATEQYGSVDTNLQRNNR

SEQ ID NO: 4600 - protein, 28 aa, Artificial Sequence
  Description of Artificial Sequence: Synthetic peptide
DEEEIRYTNPVATEQYGSVSTNLQVGNR

SEQ ID NO: 4601 - protein, 29 aa, Artificial Sequence
  Description of Artificial Sequence: Synthetic peptide
DEEEIRQTNPVATEQYGSVSTNLTQRGNR

SEQ ID NO: 4602 - protein, 28 aa, Artificial Sequence
  Description of Artificial Sequence: Synthetic peptide
DEEIIRTTNPVALEQYGSVSTNLQRGNR

SEQ ID NO: 4603 - protein, 29 aa, Artificial Sequence
  Description of Artificial Sequence: Synthetic peptide
DEEEIRTTNPVATEQYGSVSVTNTQRGNR

SEQ ID NO: 4604 - protein, 28 aa, Artificial Sequence
  Description of Artificial Sequence: Synthetic peptide
DEEEIRTTNPVATEQYGCVSTNLQRGIR

SEQ ID NO: 4605 - protein, 28 aa, Artificial Sequence
  Description of Artificial Sequence: Synthetic peptide
DEEEVKTTNPVATEQYGSVSTNLQRGNR

SEQ ID NO: 4606 - protein, 29 aa, Artificial Sequence
  Description of Artificial Sequence: Synthetic peptide
DEEEIRTTNPVATEQYGMVSTNLQRVGNR

SEQ ID NO: 4607 - protein, 28 aa, Artificial Sequence
  Description of Artificial Sequence: Synthetic peptide
DEEEVRTTNPVATEQYGSVSTELQRGNR

SEQ ID NO: 4608 - protein, 29 aa, Artificial Sequence
  Description of Artificial Sequence: Synthetic peptide
DEEEIRTTNPVATEQYGSVSTNLERQGNR

SEQ ID NO: 4609 - protein, 28 aa, Artificial Sequence
  Description of Artificial Sequence: Synthetic peptide
DEESIRTTNPVATEQYGSVSTNLQFGNR

SEQ ID NO: 4610 - protein, 28 aa, Artificial Sequence
  Description of Artificial Sequence: Synthetic peptide
DEEEIRTTNPVATEQYGSVSTNLERQNR

SEQ ID NO: 4611 - protein, 28 aa, Artificial Sequence
  Description of Artificial Sequence: Synthetic peptide
DEEEIRTTNPVATEQYGSVSYNLQCGNR

SEQ ID NO: 4612 - protein, 29 aa, Artificial Sequence
  Description of Artificial Sequence: Synthetic peptide
DEEEIRQTNPVATEQYGSVSTNLQRTGNR

SEQ ID NO: 4613 - protein, 28 aa, Artificial Sequence
  Description of Artificial Sequence: Synthetic peptide
DEEEIRWTNPVATEQYGSVSTNLQRGNN

SEQ ID NO: 4614 - protein, 28 aa, Artificial Sequence
  Description of Artificial Sequence: Synthetic peptide
DEEEIRYTNPVATEQYGCVSTNLQRGNR

SEQ ID NO: 4615 - protein, 30 aa, Artificial Sequence
  Description of Artificial Sequence: Synthetic polypeptide
DEEEIRTTNPVATEQYGSVSVTNLQRAGNR

SEQ ID NO: 4616 - protein, 28 aa, Artificial Sequence
  Description of Artificial Sequence: Synthetic peptide
DEEEIRTTNPVATEQYGSVDTNLQRGAR

SEQ ID NO: 4617 - protein, 28 aa, Artificial Sequence
  Description of Artificial Sequence: Synthetic peptide
DEEKIRTTNPVATEQYGSVSTNLQRGNM

SEQ ID NO: 4618 - protein, 28 aa, Artificial Sequence
  Description of Artificial Sequence: Synthetic peptide
DEEEIRTTNPVATEQYGSVSTNLGRGVR

SEQ ID NO: 4619 - protein, 29 aa, Artificial Sequence
  Description of Artificial Sequence: Synthetic peptide
DEEEIRTTNPVATEQYGCVSTNLQRAGNR

SEQ ID NO: 4620 - protein, 28 aa, Artificial Sequence
  Description of Artificial Sequence: Synthetic peptide
DEEELRTTNPVATEQYGSVSTNIQRGNR

SEQ ID NO: 4621 - protein, 29 aa, Artificial Sequence
  Description of Artificial Sequence: Synthetic peptide
DEEELRTTNPVATEQYGSVSTNLQGRGNR

SEQ ID NO: 4622 - protein, 29 aa, Artificial Sequence
  Description of Artificial Sequence: Synthetic peptide
DEEELRTTNPVATEQYGSVSTNLQREGNR

SEQ ID NO: 4623 - protein, 29 aa, Artificial Sequence
  Description of Artificial Sequence: Synthetic peptide
DEEEIRTTNPVATEQYGSVSTNLLQQGNR

SEQ ID NO: 4624 - protein, 29 aa, Artificial Sequence
  Description of Artificial Sequence: Synthetic peptide
DEEEISTTNPVATEQYGASVSTNLQRGNR

SEQ ID NO: 4625 - protein, 29 aa, Artificial Sequence
  Description of Artificial Sequence: Synthetic peptide
DEEEIRTTNPVATEQYGNVSTNLQRGANR

SEQ ID NO: 4626 - protein, 28 aa, Artificial Sequence
  Description of Artificial Sequence: Synthetic peptide
DEEELRTTNPVATEQYGSVSTNLQRGGR

SEQ ID NO: 4627 - protein, 28 aa, Artificial Sequence
  Description of Artificial Sequence: Synthetic peptide
DEEECRTTNPVATEQYGSVSTNLQRGNM

SEQ ID NO: 4628 - protein, 29 aa, Artificial Sequence
  Description of Artificial Sequence: Synthetic peptide
DEEEIRTVNPVATEQYGSVSTYNLQRGNR

SEQ ID NO: 4629 - protein, 28 aa, Artificial Sequence
  Description of Artificial Sequence: Synthetic peptide
DEEECRTTNPVATEQYGSVSTNLQRGNC

SEQ ID NO: 4630 - protein, 29 aa, Artificial Sequence
  Description of Artificial Sequence: Synthetic peptide
DEEELRTTNPVATEQYGSVSTNLQRGNHR

SEQ ID NO: 4631 - protein, 29 aa, Artificial Sequence
  Description of Artificial Sequence: Synthetic peptide
DEEELRTTNPVATEQYGSVSTNLQTRGNR

SEQ ID NO: 4632 - protein, 28 aa, Artificial Sequence
  Description of Artificial Sequence: Synthetic peptide
DEEELRTTNPVATEQYGSVSTSLQRGNR

SEQ ID NO: 4633 - protein, 28 aa, Artificial Sequence
  Description of Artificial Sequence: Synthetic peptide
DEEEIRTVNPVATEQYGSVSTYLQRGNR

SEQ ID NO: 4634 - protein, 29 aa, Artificial Sequence
  Description of Artificial Sequence: Synthetic peptide
DEEEIRTTNPVATEQYGSVDTNLQRGNRF

SEQ ID NO: 4635 - protein, 28 aa, Artificial Sequence
  Description of Artificial Sequence: Synthetic peptide
DEEECRTTNPVATEQYGSVSTNLQRGER

SEQ ID NO: 4636 - protein, 28 aa, Artificial Sequence
  Description of Artificial Sequence: Synthetic peptide
DEEEIRTTNPVATEQYGSVSANLQFGNR

SEQ ID NO: 4637 - protein, 28 aa, Artificial Sequence
  Description of Artificial Sequence: Synthetic peptide
DEEELRTTNPVATEQYGWVSTNLQRGNR

SEQ ID NO: 4638 - protein, 28 aa, Artificial Sequence
  Description of Artificial Sequence: Synthetic peptide
DEEELRTTNPVATEQYGSVSLNLQRGNR

SEQ ID NO: 4639 - protein, 28 aa, Artificial Sequence
  Description of Artificial Sequence: Synthetic peptide
DEEELRTTNPVATEQYGSVETNLQRGNR

SEQ ID NO: 4640 - protein, 30 aa, Artificial Sequence
  Description of Artificial Sequence: Synthetic polypeptide
DEEEIRTTNPVATEQYGSVSTNLLQNRGNR

SEQ ID NO: 4641 - protein, 29 aa, Artificial Sequence
  Description of Artificial Sequence: Synthetic peptide
DEEELRTTNPVATEQYGESVSTNLQRGNR

SEQ ID NO: 4642 - protein, 28 aa, Artificial Sequence
  Description of Artificial Sequence: Synthetic peptide
DEEELRTTNPVACEQYGSVSTNLQRGNR

SEQ ID NO: 4643 - protein, 28 aa, Artificial Sequence
  Description of Artificial Sequence: Synthetic peptide
DEEELRTTNPDATEQYGSVSTNLQRGNR

SEQ ID NO: 4644 - protein, 28 aa, Artificial Sequence
  Description of Artificial Sequence: Synthetic peptide
DEEEIRTVNPVATEQYGSVSTMLQRGNR

SEQ ID NO: 4645 - protein, 28 aa, Artificial Sequence
  Description of Artificial Sequence: Synthetic peptide
DEEEIRTTNPVATEQYGSVRTNLQRGNL

SEQ ID NO: 4646 - protein, 29 aa, Artificial Sequence
  Description of Artificial Sequence: Synthetic peptide
DEEEIRTTNPVATEQYGSVSTNLERGNRQ

SEQ ID NO: 4647 - protein, 29 aa, Artificial Sequence
  Description of Artificial Sequence: Synthetic peptide
DEEEGRTTNPVATEQYGSVSTFNLQRGNR

SEQ ID NO: 4648 - protein, 29 aa, Artificial Sequence
  Description of Artificial Sequence: Synthetic peptide
NEEEIRTTNPVATEQYGSVPSTNLQRGNR

SEQ ID NO: 4649 - protein, 29 aa, Artificial Sequence
  Description of Artificial Sequence: Synthetic peptide
DEEEIRTTNPVATEQYGNVSTNLQTRGNR

SEQ ID NO: 4650 - protein, 29 aa, Artificial Sequence
  Description of Artificial Sequence: Synthetic peptide
DEEEIRTTNPVATEQYGSVDTNLQQRGNR

SEQ ID NO: 4651 - protein, 29 aa, Artificial Sequence
  Description of Artificial Sequence: Synthetic peptide
DEEEIRTTNPVATEQYGSVSTNLERGNRY

SEQ ID NO: 4652 - protein, 30 aa, Artificial Sequence
  Description of Artificial Sequence: Synthetic polypeptide
DEEEEIRTTNPVATEQYGSVSTNLDQRGNR

SEQ ID NO: 4653 - protein, 29 aa, Artificial Sequence
  Description of Artificial Sequence: Synthetic peptide
DEEKIRTTNPVATEQYGSVSTNLQRGENR

SEQ ID NO: 4654 - protein, 29 aa, Artificial Sequence
  Description of Artificial Sequence: Synthetic peptide
DEEEIRTTNPVATEQYGSVSTNLHQYGNR

SEQ ID NO: 4655 - protein, 29 aa, Artificial Sequence
  Description of Artificial Sequence: Synthetic peptide
DEEEIRTTNPVATEQYGNVSTNLQRGNRY

SEQ ID NO: 4656 - protein, 28 aa, Artificial Sequence
  Description of Artificial Sequence: Synthetic peptide
DEEEIRTTNPVATEQYGNVSTYLQRGNR

SEQ ID NO: 4657 - protein, 29 aa, Artificial Sequence
  Description of Artificial Sequence: Synthetic peptide
DEEEIRTTNPVATEQYGNVSTNLQRGTNR

SEQ ID NO: 4658 - protein, 28 aa, Artificial Sequence
  Description of Artificial Sequence: Synthetic peptide
DEEEIRTTNPVATEQYGSVRTNLQWGNR

SEQ ID NO: 4659 - protein, 28 aa, Artificial Sequence
  Description of Artificial Sequence: Synthetic peptide
DEEEIRTTNPVATEQYGNVSTNLQRGNY

SEQ ID NO: 4660 - protein, 28 aa, Artificial Sequence
  Description of Artificial Sequence: Synthetic peptide
DEEKIRTTNPVATEQYGSVSTELQRGNR

SEQ ID NO: 4661 - protein, 28 aa, Artificial Sequence
  Description of Artificial Sequence: Synthetic peptide
DEEKIRTTNPVATEQYGSVSTNLQVGNR

SEQ ID NO: 4662 - protein, 28 aa, Artificial Sequence
  Description of Artificial Sequence: Synthetic peptide
DEEEIRTTNPCATQQYGSVSTNLQRGNR

SEQ ID NO: 4663 - protein, 28 aa, Artificial Sequence
  Description of Artificial Sequence: Synthetic peptide
TEEEIRTTNPVATEQYGSVSTNLQDGNR

SEQ ID NO: 4664 - protein, 28 aa, Artificial Sequence
  Description of Artificial Sequence: Synthetic peptide
DEEEIRTTNPVATEQYGSVENNLQRGNR

SEQ ID NO: 4665 - protein, 28 aa, Artificial Sequence
  Description of Artificial Sequence: Synthetic peptide
DEEEMRTTNPVATEQYGEVSTNLQRGNR

SEQ ID NO: 4666 - protein, 30 aa, Artificial Sequence
  Description of Artificial Sequence: Synthetic polypeptide
DEEEIRTTNPVATEQYGSVSTNLLQRGFNR

SEQ ID NO: 4667 - protein, 28 aa, Artificial Sequence
  Description of Artificial Sequence: Synthetic peptide
DEEELRCTNPVATEQYGSVSTNLQRGNR

SEQ ID NO: 4668 - protein, 29 aa, Artificial Sequence
  Description of Artificial Sequence: Synthetic peptide
DEEEIRTTNPVATEQYGSVRSTNLQRGNI

SEQ ID NO: 4669 - protein, 30 aa, Artificial Sequence
  Description of Artificial Sequence: Synthetic polypeptide
DEEEIRTTNPVATEQYGASVSTNLQRGNNR

SEQ ID NO: 4670 - protein, 29 aa, Artificial Sequence
  Description of Artificial Sequence: Synthetic peptide
DEEEIRVTNPVATEQYGSVSTNLQQRGNR

SEQ ID NO: 4671 - protein, 29 aa, Artificial Sequence
  Description of Artificial Sequence: Synthetic peptide
DEEEIRTTNPVATEQYGSVEMTNLQRGNR

SEQ ID NO: 4672 - protein, 28 aa, Artificial Sequence
  Description of Artificial Sequence: Synthetic peptide
NESEIRTTNPVATEQYGSVSTNLQRGNR

SEQ ID NO: 4673 - protein, 28 aa, Artificial Sequence
  Description of Artificial Sequence: Synthetic peptide
DEEEMRTTNPVATEQWGSVSTNLQRGNR

SEQ ID NO: 4674 - protein, 28 aa, Artificial Sequence
  Description of Artificial Sequence: Synthetic peptide
DEEEIRVTNPVATEQYGSVSTNLQYGNR

SEQ ID NO: 4675 - protein, 30 aa, Artificial Sequence
  Description of Artificial Sequence: Synthetic polypeptide
DEEEIRTTNPVATEQYGSVSTNLLQRGGNR

SEQ ID NO: 4676 - protein, 29 aa, Artificial Sequence
  Description of Artificial Sequence: Synthetic peptide
DEEEIRTTNPVATEQYGCVSTNLQRVGNR

SEQ ID NO: 4677 - protein, 28 aa, Artificial Sequence
  Description of Artificial Sequence: Synthetic peptide
DEEEIRTTNPVATEQYGMVSTNLQRGNQ

SEQ ID NO: 4678 - protein, 30 aa, Artificial Sequence
  Description of Artificial Sequence: Synthetic polypeptide
DEEEIRTTNPVATEQYGSVSTNLLQRGNRA

SEQ ID NO: 4679 - protein, 28 aa, Artificial Sequence
  Description of Artificial Sequence: Synthetic peptide
DEEEIRVTNPVATEQYGSVSTNWQRGNR

SEQ ID NO: 4680 - protein, 28 aa, Artificial Sequence
  Description of Artificial Sequence: Synthetic peptide
DEEEIRVTNPVATEWYGSVSTNLQRGNR

SEQ ID NO: 4681 - protein, 29 aa, Artificial Sequence
  Description of Artificial Sequence: Synthetic peptide
DEEEIRTTNPVATEQYGNVSTNLQRGPNR

SEQ ID NO: 4682 - protein, 30 aa, Artificial Sequence
  Description of Artificial Sequence: Synthetic polypeptide
DEEEIRTTNPVATEQYGSVSTNLLQRGNRD

SEQ ID NO: 4683 - protein, 28 aa, Artificial Sequence
  Description of Artificial Sequence: Synthetic peptide
DEEEMRTTNPVATEQYGSVSTNLQRENR

SEQ ID NO: 4684 - protein, 28 aa, Artificial Sequence
  Description of Artificial Sequence: Synthetic peptide
DEEEMRTTNPVATEQYGSVSTNIQRGNR

SEQ ID NO: 4685 - protein, 29 aa, Artificial Sequence
  Description of Artificial Sequence: Synthetic peptide
DEEEIRTTNPVATEQYGASVSTNLQSGNR

SEQ ID NO: 4686 - protein, 28 aa, Artificial Sequence
  Description of Artificial Sequence: Synthetic peptide
DEEELRTTNPVATEQYGLVSTNLQRGNR

SEQ ID NO: 4687 - protein, 29 aa, Artificial Sequence
  Description of Artificial Sequence: Synthetic peptide
DEEEIRTTNPVATEQYGNVSTNLQRDGNR

SEQ ID NO: 4688 - protein, 29 aa, Artificial Sequence
  Description of Artificial Sequence: Synthetic peptide
DEEEIRTTNPVATEQYGSVSTNLGRGNSR

SEQ ID NO: 4689 - protein, 29 aa, Artificial Sequence
  Description of Artificial Sequence: Synthetic peptide
DEEEIRTTNPVATEQYGSVSPTNLDRGNR

SEQ ID NO: 4690 - protein, 28 aa, Artificial Sequence
  Description of Artificial Sequence: Synthetic peptide
DEEEISTTNPVATEPYGSVSTNLQRGNR

SEQ ID NO: 4691 - protein, 28 aa, Artificial Sequence
  Description of Artificial Sequence: Synthetic peptide
TEEEIRTTNPVATEQYGSVSTNWQRGNR

SEQ ID NO: 4692 - protein, 28 aa, Artificial Sequence
  Description of Artificial Sequence: Synthetic peptide
DEEEIRVTNPVATEQYGSVSTNLERGNR

SEQ ID NO: 4693 - protein, 28 aa, Artificial Sequence
  Description of Artificial Sequence: Synthetic peptide
DEEELTTTNPVATEQYGSVSTNLQRGNR

SEQ ID NO: 4694 - protein, 28 aa, Artificial Sequence
  Description of Artificial Sequence: Synthetic peptide
DEEEMKTTNPVATEQYGSVSTNLQRGNR

SEQ ID NO: 4695 - protein, 29 aa, Artificial Sequence
  Description of Artificial Sequence: Synthetic peptide
DEEEIRTTNPVATEQYGSVDTNLQRGINR

SEQ ID NO: 4696 - protein, 28 aa, Artificial Sequence
  Description of Artificial Sequence: Synthetic peptide
DEEEIRTTNPVATEQYGSVRTDLQRGNR

SEQ ID NO: 4697 - protein, 30 aa, Artificial Sequence
  Description of Artificial Sequence: Synthetic polypeptide
DEEEIRTTNPTATEQYGSVSTANLQREGNR

SEQ ID NO: 4698 - protein, 28 aa, Artificial Sequence
  Description of Artificial Sequence: Synthetic peptide
DEEEIRTTNPVATEIYGSVSTNLQRNAR

SEQ ID NO: 4699 - protein, 29 aa, Artificial Sequence
  Description of Artificial Sequence: Synthetic peptide
DEEEIRTTNPFATEQYGSVSTNQQRGNDR

SEQ ID NO: 4700 - protein, 29 aa, Artificial Sequence
  Description of Artificial Sequence: Synthetic peptide
DEEEIRTTNPVATEQYGSVSCENLQRGNA

SEQ ID NO: 4701 - protein, 28 aa, Artificial Sequence
  Description of Artificial Sequence: Synthetic peptide
DEEEIRTTNPVATEQYGSVSTDLEEGNR

SEQ ID NO: 4702 - protein, 28 aa, Artificial Sequence
  Description of Artificial Sequence: Synthetic peptide
DEEEIRTTNPTATEQYGSVSTNEQRGNE

SEQ ID NO: 4703 - protein, 28 aa, Artificial Sequence
  Description of Artificial Sequence: Synthetic peptide
DEEEIRTTNPVATEQYGSVSTNLQAGED

SEQ ID NO: 4704 - protein, 28 aa, Artificial Sequence
  Description of Artificial Sequence: Synthetic peptide
DEEEIRTTNPVATEQYGSVFTNPQRENR

SEQ ID NO: 4705 - protein, 30 aa, Artificial Sequence
  Description of Artificial Sequence: Synthetic polypeptide
DEEEIRTTNPTATEQYGSVSTNLQDRGDNR

SEQ ID NO: 4706 - protein, 30 aa, Artificial Sequence
  Description of Artificial Sequence: Synthetic polypeptide
DTEEIRTTNPVATEQYGSVSITNLQRGNDR

SEQ ID NO: 4707 - protein, 28 aa, Artificial Sequence
  Description of Artificial Sequence: Synthetic peptide
DEEEIVTTNPVATECYGSVSTNLQRGNH

SEQ ID NO: 4708 - protein, 29 aa, Artificial Sequence
  Description of Artificial Sequence: Synthetic peptide
DEEEIRTTNPVATEIYGSVSENLTQRGNR

SEQ ID NO: 4709 - protein, 28 aa, Artificial Sequence
  Description of Artificial Sequence: Synthetic peptide
DEEEVRTTNPVATEQYGSVAMNLQRGNR

SEQ ID NO: 4710 - protein, 28 aa, Artificial Sequence
  Description of Artificial Sequence: Synthetic peptide
DEEEIATTNPVATEQYGSVDTNLCRGNR

SEQ ID NO: 4711 - protein, 30 aa, Artificial Sequence
  Description of Artificial Sequence: Synthetic polypeptide
DEEEIRTTNPVATEQYGSVSTNLQVGDENR

SEQ ID NO: 4712 - protein, 28 aa, Artificial Sequence
  Description of Artificial Sequence: Synthetic peptide
DEEEIRTTNPVATEQYGIVSENLQFGNR

SEQ ID NO: 4713 - protein, 30 aa, Artificial Sequence
  Description of Artificial Sequence: Synthetic polypeptide
DEEEIRTTNPVATEQYGYSISTNELQRGNR

SEQ ID NO: 4714 - protein, 28 aa, Artificial Sequence
  Description of Artificial Sequence: Synthetic peptide
DEEEIRTTNPVATEQYGSVETELQFGNR

SEQ ID NO: 4715 - protein, 28 aa, Artificial Sequence
  Description of Artificial Sequence: Synthetic peptide
DEQEIRTTNPVATEQYGSVSTNLMRGNA

SEQ ID NO: 4716 - protein, 28 aa, Artificial Sequence
  Description of Artificial Sequence: Synthetic peptide
DEEEIRTTNPEATEQYGSVSTNLDRGER

SEQ ID NO: 4717 - protein, 28 aa, Artificial Sequence
  Description of Artificial Sequence: Synthetic peptide
DEEEIRTTNPVATEQYGSVDTNLQSGND

SEQ ID NO: 4718 - protein, 28 aa, Artificial Sequence
  Description of Artificial Sequence: Synthetic peptide
NEEEIRTVNPVATEQYGSVSTNLQRGNM

SEQ ID NO: 4719 - protein, 28 aa, Artificial Sequence
  Description of Artificial Sequence: Synthetic peptide
DEEEIRTTNPVATEQYGSVSENLQMGNI

SEQ ID NO: 4720 - protein, 28 aa, Artificial Sequence
  Description of Artificial Sequence: Synthetic peptide
DEEEIRTTNPVATEQYGSVSDELQRGNQ

SEQ ID NO: 4721 - protein, 28 aa, Artificial Sequence
  Description of Artificial Sequence: Synthetic peptide
DEEEIRTTNPVATEQYGSVETDDQRGNR

SEQ ID NO: 4722 - protein, 28 aa, Artificial Sequence
  Description of Artificial Sequence: Synthetic peptide
DEEEIRTTNPVATEQYGSVSYNDQRFNR

SEQ ID NO: 4723 - protein, 28 aa, Artificial Sequence
  Description of Artificial Sequence: Synthetic peptide
DEEEIRTTNPVATEQYGSYSTNLQVGNI

SEQ ID NO: 4724 - protein, 28 aa, Artificial Sequence
  Description of Artificial Sequence: Synthetic peptide
DEEEIRCTNPVSTEQYGSVSTNDQRGNR

SEQ ID NO: 4725 - protein, 30 aa, Artificial Sequence
  Description of Artificial Sequence: Synthetic polypeptide
DEEEIRTTNPVATEQYGYSCSTNELQRGNR

SEQ ID NO: 4726 - protein, 29 aa, Artificial Sequence
  Description of Artificial Sequence: Synthetic peptide
DEEEIRTTNPVATEQYGSVSCTNLQHGNC

SEQ ID NO: 4727 - protein, 28 aa, Artificial Sequence
  Description of Artificial Sequence: Synthetic peptide
DEEEIRQTNPVATEQYGSVSTNDQNGNR

SEQ ID NO: 4728 - protein, 30 aa, Artificial Sequence
  Description of Artificial Sequence: Synthetic polypeptide
DEEEIRTTNPVATEQYGSVSTMNLQRGTTR

SEQ ID NO: 4729 - protein, 29 aa, Artificial Sequence
  Description of Artificial Sequence: Synthetic peptide
DEEVIRTTNPVATEQYGSVSTNLRQNGNR

SEQ ID NO: 4730 - protein, 30 aa, Artificial Sequence
  Description of Artificial Sequence: Synthetic polypeptide
DEEEIRTTNPVATEQYGSVETNPLQRGDNR

SEQ ID NO: 4731 - protein, 28 aa, Artificial Sequence
  Description of Artificial Sequence: Synthetic peptide
DEEEIRTTNPVATEQWGSVSENLMRGNR

SEQ ID NO: 4732 - protein, 30 aa, Artificial Sequence
  Description of Artificial Sequence: Synthetic polypeptide
DEEEIRTTNPVATEQYGSVSTMNLQCRGNM

SEQ ID NO: 4733 - protein, 28 aa, Artificial Sequence
  Description of Artificial Sequence: Synthetic peptide
DEEEITTVNPVATEHYGSVSTNLQRGNR

SEQ ID NO: 4734 - protein, 28 aa, Artificial Sequence
  Description of Artificial Sequence: Synthetic peptide
DEEEIRTTNPVATEQYGEVSENLQRGGR

SEQ ID NO: 4735 - protein, 28 aa, Artificial Sequence
  Description of Artificial Sequence: Synthetic peptide
DEEEIRTTNPVATELYGSVSTNEQRGNA

SEQ ID NO: 4736 - protein, 28 aa, Artificial Sequence
  Description of Artificial Sequence: Synthetic peptide
DEEEIRTTNPVATEQYGDAGTNLQRGNR

SEQ ID NO: 4737 - protein, 28 aa, Artificial Sequence
  Description of Artificial Sequence: Synthetic peptide
DEEEIITTNPVATEQFGSVSDNLQRGNR

SEQ ID NO: 4738 - protein, 28 aa, Artificial Sequence
  Description of Artificial Sequence: Synthetic peptide
DEEEIRTTNPVATEQYGEVSTNFQHGNR

SEQ ID NO: 4739 - protein, 28 aa, Artificial Sequence
  Description of Artificial Sequence: Synthetic peptide
DEEEIRTTNPVATEVYGSVSTDLQMGNR

SEQ ID NO: 4740 - protein, 28 aa, Artificial Sequence
  Description of Artificial Sequence: Synthetic peptide
MEEEIRTTNPVATEQYGSVSTNLQNGNA

SEQ ID NO: 4741 - protein, 28 aa, Artificial Sequence
  Description of Artificial Sequence: Synthetic peptide
DEEEIRTTNPVYTEQYGSVSTNHQRGNA

SEQ ID NO: 4742 - protein, 30 aa, Artificial Sequence
  Description of Artificial Sequence: Synthetic polypeptide
DEEEIRTTNPEATEQYGSVCSTNLQPRGNR

SEQ ID NO: 4743 - protein, 28 aa, Artificial Sequence
  Description of Artificial Sequence: Synthetic peptide
SEEEIRTTNPVATEQYGSVSTNLERGND

SEQ ID NO: 4744 - protein, 28 aa, Artificial Sequence
  Description of Artificial Sequence: Synthetic peptide
DEEEVRTTNPVATEVYGSVSTNQQRGNR

SEQ ID NO: 4745 - protein, 28 aa, Artificial Sequence
  Description of Artificial Sequence: Synthetic peptide
DEEEIRTTNPVATECYGSVSTNLQVGNA

SEQ ID NO: 4746 - protein, 30 aa, Artificial Sequence
  Description of Artificial Sequence: Synthetic polypeptide
DEEEIRTTNPVATEQYGSVSTNLQRKGEPR

SEQ ID NO: 4747 - protein, 28 aa, Artificial Sequence
  Description of Artificial Sequence: Synthetic peptide
DEQEIRTTNPVATEVYGAVSTNLQRGNR

SEQ ID NO: 4748 - protein, 28 aa, Artificial Sequence
  Description of Artificial Sequence: Synthetic peptide
DEEEIRTVNPVSTEQYGSVSTNLQRGNI

SEQ ID NO: 4749 - protein, 28 aa, Artificial Sequence
  Description of Artificial Sequence: Synthetic peptide
VEQEIRTVNPVATEQYGSVSTNLQRGNR

SEQ ID NO: 4750 - protein, 28 aa, Artificial Sequence
  Description of Artificial Sequence: Synthetic peptide
DEDEIRTTNPVACEQYGSVSTNLQRGPR

SEQ ID NO: 4751 - protein, 28 aa, Artificial Sequence
  Description of Artificial Sequence: Synthetic peptide
GEEEIRTTNPVATEQYGSVGTNLQRGTR

SEQ ID NO: 4752 - protein, 29 aa, Artificial Sequence
  Description of Artificial Sequence: Synthetic peptide
DEEEIRTTNPVATECYGSVSTNLQRGEDR

SEQ ID NO: 4753 - protein, 30 aa, Artificial Sequence
  Description of Artificial Sequence: Synthetic polypeptide
DEEEIATTNPVATEQYGSVSVTCNLQRGNR

SEQ ID NO: 4754 - protein, 28 aa, Artificial Sequence
  Description of Artificial Sequence: Synthetic peptide
DEEEIATTNPVATEMYGWVSTNLQRGNR

SEQ ID NO: 4755 - protein, 28 aa, Artificial Sequence
  Description of Artificial Sequence: Synthetic peptide
DEEEIRTTNPVATEQYGSVSTNLERGEQ

SEQ ID NO: 4756 - protein, 30 aa, Artificial Sequence
  Description of Artificial Sequence: Synthetic polypeptide
DEEEIRTTNPVATEQYGDVSTNLQQCRGNR

SEQ ID NO: 4757 - protein, 29 aa, Artificial Sequence
  Description of Artificial Sequence: Synthetic peptide
DEEEIRTTNPVATEQYGSVSAINLQRGLR

SEQ ID NO: 4758 - protein, 29 aa, Artificial Sequence
  Description of Artificial Sequence: Synthetic peptide
DEEEIRATNPVATEQYGSVSTNPQRGDNR

SEQ ID NO: 4759 - protein, 28 aa, Artificial Sequence
  Description of Artificial Sequence: Synthetic peptide
DEHEIRTTNPVCTEQYGSVSTNLQNGNR

SEQ ID NO: 4760 - protein, 29 aa, Artificial Sequence
  Description of Artificial Sequence: Synthetic peptide
DEEEIRTTNPVATEQYGSVSTNLVQLGNN

SEQ ID NO: 4761 - protein, 28 aa, Artificial Sequence
  Description of Artificial Sequence: Synthetic peptide
DEEEIRTTNPIATEQYGSVSCNEQRGNR

SEQ ID NO: 4762 - protein, 28 aa, Artificial Sequence
  Description of Artificial Sequence: Synthetic peptide
DEEEIRTTNPTATEQYGSVSTNLQQGNS

SEQ ID NO: 4763 - protein, 28 aa, Artificial Sequence
  Description of Artificial Sequence: Synthetic peptide
DEQEVRCTNPVATEQYGSVSTNLQRGNR

SEQ ID NO: 4764 - protein, 28 aa, Artificial Sequence
  Description of Artificial Sequence: Synthetic peptide
DEEEIRATNPVATEQYGWVSTNLERGNR

SEQ ID NO: 4765 - protein, 28 aa, Artificial Sequence
  Description of Artificial Sequence: Synthetic peptide
DEEEIRTTNPVATEQYGSVSTPDQRGNQ

SEQ ID NO: 4766 - protein, 28 aa, Artificial Sequence
  Description of Artificial Sequence: Synthetic peptide
QEEEVRTTNPVATEQYGSVGTNLQRGNR

SEQ ID NO: 4767 - protein, 28 aa, Artificial Sequence
  Description of Artificial Sequence: Synthetic peptide
GEEEIRTTNPCATEQYGSVSENLQRGNR

SEQ ID NO: 4768 - protein, 30 aa, Artificial Sequence
  Description of Artificial Sequence: Synthetic polypeptide
DEEEIRTTNPVATEQYGSVQSTNLQRMGNQ

SEQ ID NO: 4769 - protein, 28 aa, Artificial Sequence
  Description of Artificial Sequence: Synthetic peptide
DEEEITTTNPVATEQYGSVSTNLQVGNT

SEQ ID NO: 4770 - protein, 29 aa, Artificial Sequence
  Description of Artificial Sequence: Synthetic peptide
QEEEIATTNPVATEQYGSVISTNLQRGNR

SEQ ID NO: 4771 - protein, 28 aa, Artificial Sequence
  Description of Artificial Sequence: Synthetic peptide
DEEEIRTTNPVATEQYGSVSDNLCRGNC

SEQ ID NO: 4772 - protein, 28 aa, Artificial Sequence
  Description of Artificial Sequence: Synthetic peptide
DEEEIRTTNPVATEQYGSVPTDLQRGNM

SEQ ID NO: 4773 - protein, 29 aa, Artificial Sequence
  Description of Artificial Sequence: Synthetic peptide
DEEEIRTTNPVATEQYGSVSTNLQCAGNN

SEQ ID NO: 4774 - protein, 29 aa, Artificial Sequence
  Description of Artificial Sequence: Synthetic peptide
DEEEIRTTNPVATECYGSVSTELQIRGNR

SEQ ID NO: 4775 - protein, 28 aa, Artificial Sequence
  Description of Artificial Sequence: Synthetic peptide
DEEEIATTNPVCTEQYGSVSTNLQRGNL

SEQ ID NO: 4776 - protein, 28 aa, Artificial Sequence
  Description of Artificial Sequence: Synthetic peptide
DEEEIRTTNPEATEQYGSVSTNLQRENP

SEQ ID NO: 4777 - protein, 28 aa, Artificial Sequence
  Description of Artificial Sequence: Synthetic peptide
DEEEIRTTNPVATECYGSVSTNEMRGNR

SEQ ID NO: 4778 - protein, 28 aa, Artificial Sequence
  Description of Artificial Sequence: Synthetic peptide
DENEIRTTNPVATEVYGSVSTNEQRGNR

SEQ ID NO: 4779 - protein, 29 aa, Artificial Sequence
  Description of Artificial Sequence: Synthetic peptide
DEEEIRCTNPVATEQYGSVSTENLNRGNR

SEQ ID NO: 4780 - protein, 28 aa, Artificial Sequence
  Description of Artificial Sequence: Synthetic peptide
DEQEIRTTNPVATEQYGSVSYNLQRGNF

SEQ ID NO: 4781 - protein, 28 aa, Artificial Sequence
  Description of Artificial Sequence: Synthetic peptide
DEEEIRTTNPVATECYGSVSTNEQRGNQ

SEQ ID NO: 4782 - protein, 28 aa, Artificial Sequence
  Description of Artificial Sequence: Synthetic peptide
DEEEIRTTNPVATEQYGSVSENLHRYNR

SEQ ID NO: 4783 - protein, 30 aa, Artificial Sequence
  Description of Artificial Sequence: Synthetic polypeptide
DEEEIRTTNPVATEQYGSVSTNLQRGDNTF

SEQ ID NO: 4784 - protein, 29 aa, Artificial Sequence
  Description of Artificial Sequence: Synthetic peptide
DEEEIRTTNPVATEIYGSVSTNPQRGENR

SEQ ID NO: 4785 - protein, 28 aa, Artificial Sequence
  Description of Artificial Sequence: Synthetic peptide
DEEEIRTTNPVATEQYGSVSTNLERGEL

SEQ ID NO: 4786 - protein, 28 aa, Artificial Sequence
  Description of Artificial Sequence: Synthetic peptide
DEEEIRTTNPVATEQYGSVSENLQAGNV

SEQ ID NO: 4787 - protein, 29 aa, Artificial Sequence
  Description of Artificial Sequence: Synthetic peptide
DEEEIRTTNPVATEQYGSVSATVLQRGGR

SEQ ID NO: 4788 - protein, 28 aa, Artificial Sequence
  Description of Artificial Sequence: Synthetic peptide
DEEEIRATNPVATEQYGSVSTNLQRGEY

SEQ ID NO: 4789 - protein, 29 aa, Artificial Sequence
  Description of Artificial Sequence: Synthetic peptide
DEEEIRTTNPVATECYGSVSTNLQDHGNR

SEQ ID NO: 4790 - protein, 28 aa, Artificial Sequence
  Description of Artificial Sequence: Synthetic peptide
DEEEIRTTNPVATEQYGSVSTPLEEGNR

SEQ ID NO: 4791 - protein, 29 aa, Artificial Sequence
  Description of Artificial Sequence: Synthetic peptide
DEEEISTTNPVATEQYGSVGTCNLQRGNR

SEQ ID NO: 4792 - protein, 28 aa, Artificial Sequence
  Description of Artificial Sequence: Synthetic peptide
DEEEIRTTNPVATEQYGCVSNNLQMGNR

SEQ ID NO: 4793 - protein, 29 aa, Artificial Sequence
  Description of Artificial Sequence: Synthetic peptide
DEEEIRTTNPVATEQYGSVSTNLQMQGNF

SEQ ID NO: 4794 - protein, 28 aa, Artificial Sequence
  Description of Artificial Sequence: Synthetic peptide
DEEEIRTTNPVAYEQYGSVETNLQRGND

SEQ ID NO: 4795 - protein, 28 aa, Artificial Sequence
  Description of Artificial Sequence: Synthetic peptide
DECEIRTTNPVATETYGSVSTELQRGNR

SEQ ID NO: 4796 - protein, 28 aa, Artificial Sequence
  Description of Artificial Sequence: Synthetic peptide
DEEEIRTTNPVATECYGSVSTNLQHGTR

SEQ ID NO: 4797 - protein, 28 aa, Artificial Sequence
  Description of Artificial Sequence: Synthetic peptide
DEEEIRTTNPVATEQYGSVETNDQRGDR

SEQ ID NO: 4798 - protein, 28 aa, Artificial Sequence
  Description of Artificial Sequence: Synthetic peptide
DEEEIRTTNPVATEQYGLVSENLQRGPR

SEQ ID NO: 4799 - protein, 28 aa, Artificial Sequence
  Description of Artificial Sequence: Synthetic peptide
DEEEIRTTNPVATEQYGSVSTNLQWGEQ

SEQ ID NO: 4800 - protein, 28 aa, Artificial Sequence
  Description of Artificial Sequence: Synthetic peptide
HEEEIRTTNPVATEQYGSVSTNLQRENW

SEQ ID NO: 4801 - protein, 28 aa, Artificial Sequence
  Description of Artificial Sequence: Synthetic peptide
DEEEIRTTNPTATEQYGSVSANLQGGNR

SEQ ID NO: 4802 - protein, 28 aa, Artificial Sequence
  Description of Artificial Sequence: Synthetic peptide
DEEEITTTNPVCTEQYGSVSTNEQRGNR

SEQ ID NO: 4803 - protein, 28 aa, Artificial Sequence
  Description of Artificial Sequence: Synthetic peptide
DEDEIRTTNPVATEQYGSVSTCLQRGND

SEQ ID NO: 4804 - protein, 28 aa, Artificial Sequence
  Description of Artificial Sequence: Synthetic peptide
DEEEIRTVNPVATEQYGNVSTNLQRGNE

SEQ ID NO: 4805 - protein, 28 aa, Artificial Sequence
  Description of Artificial Sequence: Synthetic peptide
DEEEIRTTNPVATEQYGSVSTNLQIGEF

SEQ ID NO: 4806 - protein, 28 aa, Artificial Sequence
  Description of Artificial Sequence: Synthetic peptide
DEEEIRCTNPVATEQYGSVSENLNRGNR

SEQ ID NO: 4807 - protein, 30 aa, Artificial Sequence
  Description of Artificial Sequence: Synthetic polypeptide
DEEEICTTNPVATEQYGSVSTNLPQRGNTR

SEQ ID NO: 4808 - protein, 29 aa, Artificial Sequence
  Description of Artificial Sequence: Synthetic peptide
DEEEIRTTNPVATEQYGSVPTNLQRGGNH

SEQ ID NO: 4809 - protein, 28 aa, Artificial Sequence
  Description of Artificial Sequence: Synthetic peptide
DEEEIRSTNPVATECYGSVSNNLQRGNR

SEQ ID NO: 4810 - protein, 28 aa, Artificial Sequence
  Description of Artificial Sequence: Synthetic peptide
DEEEIRTTNPVATQQYGSVSTNDQNGNR

SEQ ID NO: 4811 - protein, 30 aa, Artificial Sequence
  Description of Artificial Sequence: Synthetic polypeptide
DEEEIATTNPVATEQYGSVSTNLQREGNDR

SEQ ID NO: 4812 - protein, 28 aa, Artificial Sequence
  Description of Artificial Sequence: Synthetic peptide
SEEEIRTTNPVATEQYGSYSTNLQVGNR

SEQ ID NO: 4813 - protein, 29 aa, Artificial Sequence
  Description of Artificial Sequence: Synthetic peptide
DEEEIRTTNPVATEQYGSVSTDLQNGNDR

SEQ ID NO: 4814 - protein, 28 aa, Artificial Sequence
  Description of Artificial Sequence: Synthetic peptide
DEEEIRTTNPVATEQYGSVSTDLQNGNV

SEQ ID NO: 4815 - protein, 29 aa, Artificial Sequence
  Description of Artificial Sequence: Synthetic peptide
DEEEIATTNPVATEQYGSVSTNLQREGTR

SEQ ID NO: 4816 - protein, 28 aa, Artificial Sequence
  Description of Artificial Sequence: Synthetic peptide
DEEEIRTTNPVATEQYGSVSTNEQQGNV

SEQ ID NO: 4817 - protein, 28 aa, Artificial Sequence
  Description of Artificial Sequence: Synthetic peptide
DEEEIRTVNPVATEQYGSVSTNLQLGNE

SEQ ID NO: 4818 - protein, 28 aa, Artificial Sequence
  Description of Artificial Sequence: Synthetic peptide
DEEEIRTTNPVATEQYGSVSTELQGGNI

SEQ ID NO: 4819 - protein, 28 aa, Artificial Sequence
  Description of Artificial Sequence: Synthetic peptide
DEMEIRCTNPVATEQYGSVSTNLMRGNR

SEQ ID NO: 4820 - protein, 28 aa, Artificial Sequence
  Description of Artificial Sequence: Synthetic peptide
DEEEIRTTNPVATEQYGSVSTNEQEGNP

SEQ ID NO: 4821 - protein, 28 aa, Artificial Sequence
  Description of Artificial Sequence: Synthetic peptide
DEEEIVTTNPVATEQYGTVSTNLQYGNR

SEQ ID NO: 4822 - protein, 28 aa, Artificial Sequence
  Description of Artificial Sequence: Synthetic peptide
DEEEIRTTNPVSSEQYGSVSTNLQRGNQ

SEQ ID NO: 4823 - protein, 28 aa, Artificial Sequence
  Description of Artificial Sequence: Synthetic peptide
DEEEIRTTNPVATEQYGSVSTELQIGNN

SEQ ID NO: 4824 - protein, 30 aa, Artificial Sequence
  Description of Artificial Sequence: Synthetic polypeptide
DEEEIRTTNPVATEQYGSVSSTNLQREGNE

SEQ ID NO: 4825 - protein, 28 aa, Artificial Sequence
  Description of Artificial Sequence: Synthetic peptide
DEEEIATTNPVATECYGSVSTNLQRGNC

SEQ ID NO: 4826 - protein, 28 aa, Artificial Sequence
  Description of Artificial Sequence: Synthetic peptide
DEEEIRTTNPVATEQYGSVDENLQRGPR

SEQ ID NO: 4827 - protein, 28 aa, Artificial Sequence
  Description of Artificial Sequence: Synthetic peptide
SEEEIRCTNPVATEQYGSVSSNLQRGNR

SEQ ID NO: 4828 - protein, 30 aa, Artificial Sequence
  Description of Artificial Sequence: Synthetic polypeptide
DEEEIRTTNPVATEQYGSVSTNLQGGDNRK

SEQ ID NO: 4829 - protein, 28 aa, Artificial Sequence
  Description of Artificial Sequence: Synthetic peptide
SEEEIRTTNPVATEQYGSVSENLMRGNR

SEQ ID NO: 4830 - protein, 28 aa, Artificial Sequence
  Description of Artificial Sequence: Synthetic peptide
DEEEIRSTNPVATEQYGSVSTNLARGNH

SEQ ID NO: 4831 - protein, 28 aa, Artificial Sequence
  Description of Artificial Sequence: Synthetic peptide
DEEEIRTTNPVATEQYGSVSTNLQTGEL

SEQ ID NO: 4832 - protein, 28 aa, Artificial Sequence
  Description of Artificial Sequence: Synthetic peptide
DEEEIRCTNPVATEQYGSVSENLMRGNR

SEQ ID NO: 4833 - protein, 29 aa, Artificial Sequence
  Description of Artificial Sequence: Synthetic peptide
DEEEIRTTNPVSTEQYGSASTNLQSRGNR

SEQ ID NO: 4834 - protein, 28 aa, Artificial Sequence
  Description of Artificial Sequence: Synthetic peptide
DEEEIRTTNPIATEQYGSVSENLMRGNR

SEQ ID NO: 4835 - protein, 28 aa, Artificial Sequence
  Description of Artificial Sequence: Synthetic peptide
TEEEIRTTNPVATEQYGWVSTALQRGNR

SEQ ID NO: 4836 - protein, 28 aa, Artificial Sequence
  Description of Artificial Sequence: Synthetic peptide
DEEETRTTNPVATEQYGSVSTNLQNGNC

SEQ ID NO: 4837 - protein, 28 aa, Artificial Sequence
  Description of Artificial Sequence: Synthetic peptide
DEEEIRTTNPVATEQYGCVSTNYQRINR

SEQ ID NO: 4838 - protein, 28 aa, Artificial Sequence
  Description of Artificial Sequence: Synthetic peptide
DEEEIRTTNPVSTEQWGSVSTNLMRGNR

SEQ ID NO: 4839 - protein, 28 aa, Artificial Sequence
  Description of Artificial Sequence: Synthetic peptide
DESEIATTNPVATEQYGSVSTNLQRGNI

SEQ ID NO: 4840 - protein, 29 aa, Artificial Sequence
  Description of Artificial Sequence: Synthetic peptide
DEEEIAQTNPVATEQYGSVSTNLQNRGNR

SEQ ID NO: 4841 - protein, 28 aa, Artificial Sequence
  Description of Artificial Sequence: Synthetic peptide
DEEEIRTTNPVATEQYGSVSTDLQYGNE

SEQ ID NO: 4842 - protein, 28 aa, Artificial Sequence
  Description of Artificial Sequence: Synthetic peptide
DEEEIRTTNPVATEQYGSVSTDLQWGER

SEQ ID NO: 4843 - protein, 28 aa, Artificial Sequence
  Description of Artificial Sequence: Synthetic peptide
DEEEIRTTNPVATEQYGSVSTELQIGNY

SEQ ID NO: 4844 - protein, 28 aa, Artificial Sequence
  Description of Artificial Sequence: Synthetic peptide
DEEEIRTTNPVATEQYGSVSENLQVGNN

SEQ ID NO: 4845 - protein, 29 aa, Artificial Sequence
  Description of Artificial Sequence: Synthetic peptide
DEEEIRTTNPVATEQYGSVSTDDQDRGNR

SEQ ID NO: 4846 - protein, 28 aa, Artificial Sequence
  Description of Artificial Sequence: Synthetic peptide
DEEEIRTTNPVATEQYGSVSTDLQVGNA

SEQ ID NO: 4847 - protein, 28 aa, Artificial Sequence
  Description of Artificial Sequence: Synthetic peptide
DEEEIATTNPVATEQYGSVSTNLQRGPP

SEQ ID NO: 4848 - protein, 28 aa, Artificial Sequence
  Description of Artificial Sequence: Synthetic peptide
DEEEIRTTNPVATEQYGSVSENLQYGNN

SEQ ID NO: 4849 - protein, 28 aa, Artificial Sequence
  Description of Artificial Sequence: Synthetic peptide
SEEEIRTTNPVCSEQYGSVSTNLQRGNR

SEQ ID NO: 4850 - protein, 28 aa, Artificial Sequence
  Description of Artificial Sequence: Synthetic peptide
DETEIVTTNPVATEQYGSVSTNLQRLNR

SEQ ID NO: 4851 - protein, 29 aa, Artificial Sequence
  Description of Artificial Sequence: Synthetic peptide
DEEEIRTTNPVATEQYGSVSTDLQRGNDQ

SEQ ID NO: 4852 - protein, 28 aa, Artificial Sequence
  Description of Artificial Sequence: Synthetic peptide
DEEEIRTTNPVAFEQYGSVSTNLLRGPR

SEQ ID NO: 4853 - protein, 28 aa, Artificial Sequence
  Description of Artificial Sequence: Synthetic peptide
DEEEIRTTNPVATEQYGSVSTNLEGGNW

SEQ ID NO: 4854 - protein, 28 aa, Artificial Sequence
  Description of Artificial Sequence: Synthetic peptide
DEEEIRTTNPVATEQYGSVSTDDQRGER

SEQ ID NO: 4855 - protein, 28 aa, Artificial Sequence
  Description of Artificial Sequence: Synthetic peptide
HEEEIRTTNPTATEQYGSVSTNLARGNR

SEQ ID NO: 4856 - protein, 30 aa, Artificial Sequence
  Description of Artificial Sequence: Synthetic polypeptide
DEEEIRTTNPVATEQYGSVSTNGLVLRGNR

SEQ ID NO: 4857 - protein, 28 aa, Artificial Sequence
  Description of Artificial Sequence: Synthetic peptide
QESEIRTTNPVATEQYGSVSTNLQRGNM

SEQ ID NO: 4858 - protein, 28 aa, Artificial Sequence
  Description of Artificial Sequence: Synthetic peptide
DEEEIRTTNPVATEQYWSVSTNLQRGEP

SEQ ID NO: 4859 - protein, 28 aa, Artificial Sequence
  Description of Artificial Sequence: Synthetic peptide
DEEEIRTTNPVATEQYGDVSENLQRGNA

SEQ ID NO: 4860 - protein, 28 aa, Artificial Sequence
  Description of Artificial Sequence: Synthetic peptide
DEEEIRTTNPVATEQYGSVSTELEDGNR

SEQ ID NO: 4861 - protein, 28 aa, Artificial Sequence
  Description of Artificial Sequence: Synthetic peptide
DEEEIRTTNPVATEQYGSVDTNLQLGDR

SEQ ID NO: 4862 - protein, 28 aa, Artificial Sequence
  Description of Artificial Sequence: Synthetic peptide
DEEEIRTTNPVATEQYGSVSTGLEGGNR

SEQ ID NO: 4863 - protein, 28 aa, Artificial Sequence
  Description of Artificial Sequence: Synthetic peptide
DEEEIRTTNPVATEQYGSVSTNLQDGEA

SEQ ID NO: 4864 - protein, 28 aa, Artificial Sequence
  Description of Artificial Sequence: Synthetic peptide
DEEEIRTTNPVATEQYGDVSENLQRGGR

SEQ ID NO: 4865 - protein, 28 aa, Artificial Sequence
  Description of Artificial Sequence: Synthetic peptide
DEEEIRTTNPVATEQYGSVSTEKYRGNR

SEQ ID NO: 4866 - protein, 28 aa, Artificial Sequence
  Description of Artificial Sequence: Synthetic peptide
DESEIRTTNPVATEQYGSVSTNLESGNR

SEQ ID NO: 4867 - protein, 28 aa, Artificial Sequence
  Description of Artificial Sequence: Synthetic peptide
MEEEIRTTNPVATEQYGSVSTDLQRGNI

SEQ ID NO: 4868 - protein, 30 aa, Artificial Sequence
  Description of Artificial Sequence: Synthetic polypeptide
DEEEICTTNPVATEQYGSVSTNLQRNGNER

SEQ ID NO: 4869 - protein, 29 aa, Artificial Sequence
  Description of Artificial Sequence: Synthetic peptide
DEEEIATTNPVATEQYGSVSAENLQRGNR

SEQ ID NO: 4870 - protein, 30 aa, Artificial Sequence
  Description of Artificial Sequence: Synthetic polypeptide
DEEEIRTTNPVATEQYGSVSTNLEERKGNR

SEQ ID NO: 4871 - protein, 28 aa, Artificial Sequence
  Description of Artificial Sequence: Synthetic peptide
DEEEIRTTNPVATEQYGNVSTNLQMGND

SEQ ID NO: 4872 - protein, 28 aa, Artificial Sequence
  Description of Artificial Sequence: Synthetic peptide
SEEEIRCTNPVATEQYGSVSTNLQRGDR

SEQ ID NO: 4873 - protein, 28 aa, Artificial Sequence
  Description of Artificial Sequence: Synthetic peptide
SEEEIRTTNPVATEQYGSVSENLERGNR

SEQ ID NO: 4874 - protein, 29 aa, Artificial Sequence
  Description of Artificial Sequence: Synthetic peptide
DEEEIRTTNPVATEQYGSVSTDLQQAGNR

SEQ ID NO: 4875 - protein, 29 aa, Artificial Sequence
  Description of Artificial Sequence: Synthetic peptide
DEGEIRTTNPVATEYYGSVSTNLQFRGNR

SEQ ID NO: 4876 - protein, 31 aa, Artificial Sequence
  Description of Artificial Sequence: Synthetic polypeptide
DEEEIRTTNPVATEQYGSVSTDNLVQRGNDR

SEQ ID NO: 4877 - protein, 28 aa, Artificial Sequence
  Description of Artificial Sequence: Synthetic peptide
DEEEIRTTNPDATEQYGSVSTNLDRGND

SEQ ID NO: 4878 - protein, 28 aa, Artificial Sequence
  Description of Artificial Sequence: Synthetic peptide
QEEEIRTTNPVATEGYGSVPTNLQRGNR

SEQ ID NO: 4879 - protein, 28 aa, Artificial Sequence
  Description of Artificial Sequence: Synthetic peptide
DEEEIRTTNPDATEQYGSVSTNLLRGNL

SEQ ID NO: 4880 - protein, 30 aa, Artificial Sequence
  Description of Artificial Sequence: Synthetic polypeptide
DEEEIRTTNPVATEQYGSVSTNLQETGNDR

SEQ ID NO: 4881 - protein, 29 aa, Artificial Sequence
  Description of Artificial Sequence: Synthetic peptide
DEEEIRTTNPVATEQYGDSVSTNLERGER

SEQ ID NO: 4882 - protein, 30 aa, Artificial Sequence
  Description of Artificial Sequence: Synthetic polypeptide
DEEEIRTTNPVATEQYGSVSDTNDQRGENR

SEQ ID NO: 4883 - protein, 28 aa, Artificial Sequence
  Description of Artificial Sequence: Synthetic peptide
DENEIRTTNPVATELYGWVSTNLQRGNR

SEQ ID NO: 4884 - protein, 28 aa, Artificial Sequence
  Description of Artificial Sequence: Synthetic peptide
DEEEIRTTNPVATEQYGSVSTELQAGNV

SEQ ID NO: 4885 - protein, 30 aa, Artificial Sequence
  Description of Artificial Sequence: Synthetic polypeptide
DEEEIRTTNPVATEQYGSVSTNLEDRGNER

SEQ ID NO: 4886 - protein, 28 aa, Artificial Sequence
  Description of Artificial Sequence: Synthetic peptide
DEEEIRTTNPVAVEQYGSVSTDLQRGNA

SEQ ID NO: 4887 - protein, 28 aa, Artificial Sequence
  Description of Artificial Sequence: Synthetic peptide
DEEEIRTTNPVATEQYGSVSTELQAGNS

SEQ ID NO: 4888 - protein, 28 aa, Artificial Sequence
  Description of Artificial Sequence: Synthetic peptide
SEEEIRTTNPIATEQYGSVSENLQRGNR

SEQ ID NO: 4889 - protein, 29 aa, Artificial Sequence
  Description of Artificial Sequence: Synthetic peptide
DEEEIRTTNPVATEQYGTVSTNLQRNGNH

SEQ ID NO: 4890 - protein, 30 aa, Artificial Sequence
  Description of Artificial Sequence: Synthetic polypeptide
DEEEIRTTNPVATEQYGSVSDTNLERGENR

SEQ ID NO: 4891 - protein, 28 aa, Artificial Sequence
  Description of Artificial Sequence: Synthetic peptide
DEEEIRTTNPDAYEQYGSVSTNLQRGND

SEQ ID NO: 4892 - protein, 29 aa, Artificial Sequence
  Description of Artificial Sequence: Synthetic peptide
DEEEIRATNPVATEQYGSVSEMNLQRGNR

SEQ ID NO: 4893 - protein, 28 aa, Artificial Sequence
  Description of Artificial Sequence: Synthetic peptide
DEEEIRTTNPVATEQYGSVSTELQLGNC

SEQ ID NO: 4894 - protein, 29 aa, Artificial Sequence
  Description of Artificial Sequence: Synthetic peptide
DEEEIRTTNPVATEQYGSVSTELQRNGNN

SEQ ID NO: 4895 - protein, 28 aa, Artificial Sequence
  Description of Artificial Sequence: Synthetic peptide
DEAEIRTTNPVATEQYGSVSMNLQVGNR

SEQ ID NO: 4896 - protein, 28 aa, Artificial Sequence
  Description of Artificial Sequence: Synthetic peptide
DEEEIRTTNPVATEQYGSVSTNPQQGNA

SEQ ID NO: 4897 - protein, 29 aa, Artificial Sequence
  Description of Artificial Sequence: Synthetic peptide
DEEEIRCTNPVATEQYGSVSTNLMRGMNR

SEQ ID NO: 4898 - protein, 29 aa, Artificial Sequence
  Description of Artificial Sequence: Synthetic peptide
DEEEIRTTNPVATEQYGSVSTNPQERGNL

SEQ ID NO: 4899 - protein, 28 aa, Artificial Sequence
  Description of Artificial Sequence: Synthetic peptide
DEEEIRGTNPVATEQYGSVSSNLQRGNS

SEQ ID NO: 4900 - protein, 28 aa, Artificial Sequence
  Description of Artificial Sequence: Synthetic peptide
DEEEIRTTNPVATEQYGDASTNLQRGNQ

SEQ ID NO: 4901 - protein, 29 aa, Artificial Sequence
  Description of Artificial Sequence: Synthetic peptide
DEEEIRTTNPVATEQYGSVSTNLQDLGNF

SEQ ID NO: 4902 - protein, 28 aa, Artificial Sequence
  Description of Artificial Sequence: Synthetic peptide
DEEEIRTTNPVATEQYGSVSTNLQHGEM

SEQ ID NO: 4903 - protein, 28 aa, Artificial Sequence
  Description of Artificial Sequence: Synthetic peptide
DDEEIRTTNPVSTEQYGTVSTNLQRGNR

SEQ ID NO: 4904 - protein, 30 aa, Artificial Sequence
  Description of Artificial Sequence: Synthetic polypeptide
DEEEIRTTNPVATEQYGSVISTNLPQRGTR

SEQ ID NO: 4905 - protein, 30 aa, Artificial Sequence
  Description of Artificial Sequence: Synthetic polypeptide
DEEEIRTTNPVATEQYGSVDSTNLERGDNR

SEQ ID NO: 4906 - protein, 28 aa, Artificial Sequence
  Description of Artificial Sequence: Synthetic peptide
DEEEIRCTNPVATEQWGSVSTNLQRGNF

SEQ ID NO: 4907 - protein, 30 aa, Artificial Sequence
  Description of Artificial Sequence: Synthetic polypeptide
DEEEIRTTNPVATEQYGSVISTNLPQQGNR

SEQ ID NO: 4908 - protein, 28 aa, Artificial Sequence
  Description of Artificial Sequence: Synthetic peptide
DEDEIRTTNPVATEQYGSVSTNLQNGNW

SEQ ID NO: 4909 - protein, 28 aa, Artificial Sequence
  Description of Artificial Sequence: Synthetic peptide
DEEEIRTTNPVAYETYGSVSTNLCRGNR

SEQ ID NO: 4910 - protein, 30 aa, Artificial Sequence
  Description of Artificial Sequence: Synthetic polypeptide
DEEEIRTTNPVATEQYGSVCSTNLQREGNT

SEQ ID NO: 4911 - protein, 28 aa, Artificial Sequence
  Description of Artificial Sequence: Synthetic peptide
DEHEIATTNPVATEQYGDVSTNLQRGNR

SEQ ID NO: 4912 - protein, 29 aa, Artificial Sequence
  Description of Artificial Sequence: Synthetic peptide
DEEEIRTTNPVATEQYGSVCSTNLQNGER

SEQ ID NO: 4913 - protein, 30 aa, Artificial Sequence
  Description of Artificial Sequence: Synthetic polypeptide
DEEEIRTTNPVATEQYGSVSCTMNLQHGNR

SEQ ID NO: 4914 - protein, 28 aa, Artificial Sequence
  Description of Artificial Sequence: Synthetic peptide
DEQEIRTTNPVATEQYGSVSTNLQLGNL

SEQ ID NO: 4915 - protein, 28 aa, Artificial Sequence
  Description of Artificial Sequence: Synthetic peptide
DEEEIVTTNPVATEQYGFVSTNLQRGQR

SEQ ID NO: 4916 - protein, 30 aa, Artificial Sequence
  Description of Artificial Sequence: Synthetic polypeptide
DEEEIRTTNPVATEQYGSSTVETNLQRGNR

SEQ ID NO: 4917 - protein, 28 aa, Artificial Sequence
  Description of Artificial Sequence: Synthetic peptide
DEEEIVTTNPVATEMYGWVSTNLQRGNR

SEQ ID NO: 4918 - protein, 28 aa, Artificial Sequence
  Description of Artificial Sequence: Synthetic peptide
DEEEICTTNPVATEQYGDASTNLQRGNR

SEQ ID NO: 4919 - protein, 28 aa, Artificial Sequence
  Description of Artificial Sequence: Synthetic peptide
DEEEIATTNPVSTEQYGEVSTNLQRGNR

SEQ ID NO: 4920 - protein, 29 aa, Artificial Sequence
  Description of Artificial Sequence: Synthetic peptide
DEEEIRTTNPVATEQYGSVSETDLQRGER

SEQ ID NO: 4921 - protein, 29 aa, Artificial Sequence
  Description of Artificial Sequence: Synthetic peptide
DEECIRTTNPVANEQYGSVSTMNLQRGNR

SEQ ID NO: 4922 - protein, 28 aa, Artificial Sequence
  Description of Artificial Sequence: Synthetic peptide
AEEEIRTTNPVATEQYGSVSENLQRGNA

SEQ ID NO: 4923 - protein, 28 aa, Artificial Sequence
  Description of Artificial Sequence: Synthetic peptide
DENEIRTTNPVATEQYGSVSTNLQSGNV

SEQ ID NO: 4924 - protein, 28 aa, Artificial Sequence
  Description of Artificial Sequence: Synthetic peptide
DEEEIRSTNPVATEQYGTVSNNLQRGNR

SEQ ID NO: 4925 - protein, 29 aa, Artificial Sequence
  Description of Artificial Sequence: Synthetic peptide
DEQEIRTTNPVATEQYGSVDTNLQCRGNR

SEQ ID NO: 4926 - protein, 28 aa, Artificial Sequence
  Description of Artificial Sequence: Synthetic peptide
DEEEIRTTNPVATEQYGSASENLQRDNR

SEQ ID NO: 4927 - protein, 29 aa, Artificial Sequence
  Description of Artificial Sequence: Synthetic peptide
DEEEISTTNPVATEQYGSVSTINLERGNR

SEQ ID NO: 4928 - protein, 28 aa, Artificial Sequence
  Description of Artificial Sequence: Synthetic peptide
DEEEIRTTNPVSTEQYGSVSTELQRGNY

SEQ ID NO: 4929 - protein, 29 aa, Artificial Sequence
  Description of Artificial Sequence: Synthetic peptide
DEQEIRTTNPVATEQYGSVDTMNLQRGNR

SEQ ID NO: 4930 - protein, 28 aa, Artificial Sequence
  Description of Artificial Sequence: Synthetic peptide
DEEEIRTTNPVATEQFGSVSENLQMGNR

SEQ ID NO: 4931 - protein, 28 aa, Artificial Sequence
  Description of Artificial Sequence: Synthetic peptide
SEEEIRCTNPVATEQYGSVSENLQRGNR

SEQ ID NO: 4932 - protein, 28 aa, Artificial Sequence
  Description of Artificial Sequence: Synthetic peptide
DEEEIRQTNPVATEQYGSVSTVLQHGNR

SEQ ID NO: 4933 - protein, 29 aa, Artificial Sequence
  Description of Artificial Sequence: Synthetic peptide
DEEEIRTTNPVATELYGSVSTNLQNRGNF

SEQ ID NO: 4934 - protein, 28 aa, Artificial Sequence
  Description of Artificial Sequence: Synthetic peptide
KEEEIRTTNPVATEQYGSVSTNLQHGER

SEQ ID NO: 4935 - protein, 28 aa, Artificial Sequence
  Description of Artificial Sequence: Synthetic peptide
DETEIRTTNPVATEQYGSVSTNEQRGNF

SEQ ID NO: 4936 - protein, 28 aa, Artificial Sequence
  Description of Artificial Sequence: Synthetic peptide
DENEIRTTNPVATEQYGSVSTNLQGGTR

SEQ ID NO: 4937 - protein, 29 aa, Artificial Sequence
  Description of Artificial Sequence: Synthetic peptide
DEEEIRTTNPVATEQWYGDVSTNLQRGNQ

SEQ ID NO: 4938 - protein, 29 aa, Artificial Sequence
  Description of Artificial Sequence: Synthetic peptide
DEEEIRTTNPVATEQYGSVSTDLQDRGER

SEQ ID NO: 4939 - protein, 30 aa, Artificial Sequence
  Description of Artificial Sequence: Synthetic polypeptide
DEEEIRTTNPVATEQYGSVDCTMNLQRGNR

SEQ ID NO: 4940 - protein, 29 aa, Artificial Sequence
  Description of Artificial Sequence: Synthetic peptide
DEEEIRTTNPVATEQYGYVSTNHQRMGNR

SEQ ID NO: 4941 - protein, 28 aa, Artificial Sequence
  Description of Artificial Sequence: Synthetic peptide
DEEEIRTTNPVATEQYGSVSTELQWGDR

SEQ ID NO: 4942 - protein, 28 aa, Artificial Sequence
  Description of Artificial Sequence: Synthetic peptide
DEEEIRTTNPFATEQYGSVSTNLDRGER

SEQ ID NO: 4943 - protein, 28 aa, Artificial Sequence
  Description of Artificial Sequence: Synthetic peptide
DEQEIRTTNPVATEHYGWVSTNLQRGNR

SEQ ID NO: 4944 - protein, 30 aa, Artificial Sequence
  Description of Artificial Sequence: Synthetic polypeptide
DEEEIRSTNPVATEQYGSVSTNLPQRGNTR

SEQ ID NO: 4945 - protein, 28 aa, Artificial Sequence
  Description of Artificial Sequence: Synthetic peptide
DEEEIRTTNPNATEQYGAVSTNLQRGND

SEQ ID NO: 4946 - protein, 28 aa, Artificial Sequence
  Description of Artificial Sequence: Synthetic peptide
DEEEIRTTNPVATEQYGVVSTNLERGNF

SEQ ID NO: 4947 - protein, 28 aa, Artificial Sequence
  Description of Artificial Sequence: Synthetic peptide
DEEEIRTTNPVATEQYGSVSTDLYRGNA

SEQ ID NO: 4948 - protein, 30 aa, Artificial Sequence
  Description of Artificial Sequence: Synthetic polypeptide
DEEEIRTTNPVATEQYGSVSTNEQVRGDNR

SEQ ID NO: 4949 - protein, 28 aa, Artificial Sequence
  Description of Artificial Sequence: Synthetic peptide
SEEEIRTTNPVATEQYGSVSENLQRGTR

SEQ ID NO: 4950 - protein, 28 aa, Artificial Sequence
  Description of Artificial Sequence: Synthetic peptide
DEQEIRTTNPVATEQYGSASENLQRGNR

SEQ ID NO: 4951 - protein, 28 aa, Artificial Sequence
  Description of Artificial Sequence: Synthetic peptide
DEEEIRTTNPFATEQYGSVSTNLERGND

SEQ ID NO: 4952 - protein, 30 aa, Artificial Sequence
  Description of Artificial Sequence: Synthetic polypeptide
DEEEIRTTNPVATEQYGCVSATNLQRNGNR

SEQ ID NO: 4953 - protein, 28 aa, Artificial Sequence
  Description of Artificial Sequence: Synthetic peptide
NEEEIRTTNPVATEQYGSVATNLQRGNI

SEQ ID NO: 4954 - protein, 30 aa, Artificial Sequence
  Description of Artificial Sequence: Synthetic polypeptide
DEEEIRTTNPVATEQYGSVSTNPQEQGNTR

SEQ ID NO: 4955 - protein, 29 aa, Artificial Sequence
  Description of Artificial Sequence: Synthetic peptide
DEQEIRTTNPVATEQYGSVETNDQRGNDR

SEQ ID NO: 4956 - protein, 29 aa, Artificial Sequence
  Description of Artificial Sequence: Synthetic peptide
SEEEIRTTNPVATEQYGSVSSNLMQEGNR

SEQ ID NO: 4957 - protein, 29 aa, Artificial Sequence
  Description of Artificial Sequence: Synthetic peptide
DEEEIRTTNPVATEQYGVVSTNLVQQGNQ

SEQ ID NO: 4958 - protein, 29 aa, Artificial Sequence
  Description of Artificial Sequence: Synthetic peptide
DEEEIRTTNPVATEQYGSVSPDVQRGNSR

SEQ ID NO: 4959 - protein, 30 aa, Artificial Sequence
  Description of Artificial Sequence: Synthetic polypeptide
DEEEIRTTNPVATEQYGSVSVTNLQNGDNE

SEQ ID NO: 4960 - protein, 28 aa, Artificial Sequence
  Description of Artificial Sequence: Synthetic peptide
SEEEIRCTNPVATEQYGSVSCNLMRGNR

SEQ ID NO: 4961 - protein, 32 aa, Artificial Sequence
  Description of Artificial Sequence: Synthetic polypeptide
DEEEIRTTNPVATEQYGSVSPTNLQRGVENRL

SEQ ID NO: 4962 - protein, 29 aa, Artificial Sequence
  Description of Artificial Sequence: Synthetic peptide
DEEEIRTTNPVATEQYGSVSTNPVMRGND

SEQ ID NO: 4963 - protein, 29 aa, Artificial Sequence
  Description of Artificial Sequence: Synthetic peptide
AEEEIRTTNPVATEQYGSVSTNLQHGDNP

SEQ ID NO: 4964 - protein, 30 aa, Artificial Sequence
  Description of Artificial Sequence: Synthetic polypeptide
DEEEIRTTNPVATEQYGSVSFTTLERGNER

SEQ ID NO: 4965 - protein, 28 aa, Artificial Sequence
  Description of Artificial Sequence: Synthetic peptide
SEEEIRTTNPVATEQYGSVSENLQRGEK

SEQ ID NO: 4966 - protein, 29 aa, Artificial Sequence
  Description of Artificial Sequence: Synthetic peptide
DEEEIATTNPVATEQYGSVSTMNEQNGNR

SEQ ID NO: 4967 - protein, 30 aa, Artificial Sequence
  Description of Artificial Sequence: Synthetic polypeptide
DEDEIRTTNPVATEQYGSVSTNLQHAGNDR

SEQ ID NO: 4968 - protein, 29 aa, Artificial Sequence
  Description of Artificial Sequence: Synthetic peptide
DEDEIRTTNPVASEQYGSVATNLQRGNDR

SEQ ID NO: 4969 - protein, 29 aa, Artificial Sequence
  Description of Artificial Sequence: Synthetic peptide
DECEIRTTNPVATEQYGSVSTNNGQRGNL

SEQ ID NO: 4970 - protein, 32 aa, Artificial Sequence
  Description of Artificial Sequence: Synthetic polypeptide
DEEEIRTTNPVATEQYGSVSPTNLQRGEENRM

SEQ ID NO: 4971 - protein, 28 aa, Artificial Sequence
  Description of Artificial Sequence: Synthetic peptide
DEQEIRTTNPVATEQWGSVSTNLMRGNW

SEQ ID NO: 4972 - protein, 29 aa, Artificial Sequence
  Description of Artificial Sequence: Synthetic peptide
SEEEIRTTNPVATEQYGSVSENLPMRGNR

SEQ ID NO: 4973 - protein, 30 aa, Artificial Sequence
  Description of Artificial Sequence: Synthetic polypeptide
DEEEIRTTNPVATEQYGSVSTNLQDRTNEI

SEQ ID NO: 4974 - protein, 30 aa, Artificial Sequence
  Description of Artificial Sequence: Synthetic polypeptide
DEEEIRTTNPVATEQYGSVSNTDLDRGNER

SEQ ID NO: 4975 - protein, 30 aa, Artificial Sequence
  Description of Artificial Sequence: Synthetic polypeptide
DEEEIRTTNPVATEQYGSVSTNLQAGVENI

SEQ ID NO: 4976 - protein, 29 aa, Artificial Sequence
  Description of Artificial Sequence: Synthetic peptide
AEEEIRTTNPVATEQYGSVSTNLQIGSNA

SEQ ID NO: 4977 - protein, 31 aa, Artificial Sequence
  Description of Artificial Sequence: Synthetic polypeptide
DEEEIRTTNPVATEQYGSVSPTNLQQGNAPR

SEQ ID NO: 4978 - protein, 30 aa, Artificial Sequence
  Description of Artificial Sequence: Synthetic polypeptide
NEEEIRTTNPVATEQYGSVSTNLQGGENNR

SEQ ID NO: 4979 - protein, 30 aa, Artificial Sequence
  Description of Artificial Sequence: Synthetic polypeptide
DEEEIRTTNPVATEQYGSCSTNLQRGTDNN

SEQ ID NO: 4980 - protein, 28 aa, Artificial Sequence
  Description of Artificial Sequence: Synthetic peptide
DEQEIRCTNPVATEQYGSVSTNLERGNL

SEQ ID NO: 4981 - protein, 32 aa, Artificial Sequence
  Description of Artificial Sequence: Synthetic polypeptide
DEEEIRTTNPVATEQYGSVSTENLQRGMNPRE

SEQ ID NO: 4982 - protein, 30 aa, Artificial Sequence
  Description of Artificial Sequence: Synthetic polypeptide
AEEEIRTTNPVATEQYGSVSTNLQDVGNRD

SEQ ID NO: 4983 - protein, 29 aa, Artificial Sequence
  Description of Artificial Sequence: Synthetic peptide
DEEEIATTNPVATEQYGSVSTNLDFGNDR

SEQ ID NO: 4984 - protein, 31 aa, Artificial Sequence
  Description of Artificial Sequence: Synthetic polypeptide
DEEEIRTTNPVATEQYGSVSTNLQADAGNNR

SEQ ID NO: 4985 - protein, 29 aa, Artificial Sequence
  Description of Artificial Sequence: Synthetic peptide
DEEEIGTTNPVATEQYGSVAYINLQRGNR

SEQ ID NO: 4986 - protein, 28 aa, Artificial Sequence
  Description of Artificial Sequence: Synthetic peptide
DECEIRTTNPVATEQYGTVDTNLQRGNA

SEQ ID NO: 4987 - protein, 28 aa, Artificial Sequence
  Description of Artificial Sequence: Synthetic peptide
DEQEIRTTNPVATEQYGSVSTDDQRGNF

SEQ ID NO: 4988 - protein, 31 aa, Artificial Sequence
  Description of Artificial Sequence: Synthetic polypeptide
DEEEIRTTNPVATEQYGSVSPPTNLQRGDRQ

SEQ ID NO: 4989 - protein, 30 aa, Artificial Sequence
  Description of Artificial Sequence: Synthetic polypeptide
AEEEIRTTNPVATEQYGSVSTNLQNDGNRT

SEQ ID NO: 4990 - protein, 30 aa, Artificial Sequence
  Description of Artificial Sequence: Synthetic polypeptide
DEDEIRTTNPVATEQYGSVSTNLQIQGNDR

SEQ ID NO: 4991 - protein, 28 aa, Artificial Sequence
  Description of Artificial Sequence: Synthetic peptide
DEEEIATTNPVATEHYGGVATNLQRGNR

SEQ ID NO: 4992 - protein, 28 aa, Artificial Sequence
  Description of Artificial Sequence: Synthetic peptide
SEEEIRTTNPVATEQYGSVSENLERGND

SEQ ID NO: 4993 - protein, 29 aa, Artificial Sequence
  Description of Artificial Sequence: Synthetic peptide
DEEEIRTTNPVACEQYWSVHTNLQPRGNR

SEQ ID NO: 4994 - protein, 30 aa, Artificial Sequence
  Description of Artificial Sequence: Synthetic polypeptide
DEEEIRTTNPVATEQYGSVISTNLQDGNGG

SEQ ID NO: 4995 - protein, 29 aa, Artificial Sequence
  Description of Artificial Sequence: Synthetic peptide
DEEEIRTTNPVATEQYGSCSTNLVRDGHR

SEQ ID NO: 4996 - protein, 28 aa, Artificial Sequence
  Description of Artificial Sequence: Synthetic peptide
DEQEIRTTNPVATEQWGSVSTNEQRGNF

SEQ ID NO: 4997 - protein, 28 aa, Artificial Sequence
  Description of Artificial Sequence: Synthetic peptide
DEQEIRTTNPVATEQYGSVSTNDQIGER

SEQ ID NO: 4998 - protein, 30 aa, Artificial Sequence
  Description of Artificial Sequence: Synthetic polypeptide
DEEEIRTTNPVATEQYGSVSTMNDQNGNDR

SEQ ID NO: 4999 - protein, 29 aa, Artificial Sequence
  Description of Artificial Sequence: Synthetic peptide
AEEEIRTTNPVATEQYGSVATNLQVGENR

SEQ ID NO: 5000 - protein, 30 aa, Artificial Sequence
  Description of Artificial Sequence: Synthetic polypeptide
DEEEIRTTNPVATEQYGSVSTNLQDGTFND

SEQ ID NO: 5001 - protein, 28 aa, Artificial Sequence
  Description of Artificial Sequence: Synthetic peptide
DEEEIRTTNPVATEQYGSVSTPPDYGNR

SEQ ID NO: 5002 - protein, 28 aa, Artificial Sequence
  Description of Artificial Sequence: Synthetic peptide
DEEEIRTTNPIATEQYGSVSEDLMRGNR

SEQ ID NO: 5003 - protein, 30 aa, Artificial Sequence
  Description of Artificial Sequence: Synthetic polypeptide
DEEEIRTTNPVATEQYGSVSTNLQGGFNEV

SEQ ID NO: 5004 - protein, 30 aa, Artificial Sequence
  Description of Artificial Sequence: Synthetic polypeptide
DEEEIRTTNPVATEQYGSVSTNGQDRGNVM

SEQ ID NO: 5005 - protein, 28 aa, Artificial Sequence
  Description of Artificial Sequence: Synthetic peptide
QEEEIATTNPVATEQYGDVSENLQRGNR

SEQ ID NO: 5006 - protein, 30 aa, Artificial Sequence
  Description of Artificial Sequence: Synthetic polypeptide
DECEIRTTNPVATEQYGSVSTNLQHEGNER

SEQ ID NO: 5007 - protein, 32 aa, Artificial Sequence
  Description of Artificial Sequence: Synthetic polypeptide
DEEEIRTTNPVATEQYGSVSPTNLQRGELNRP

SEQ ID NO: 5008 - protein, 28 aa, Artificial Sequence
  Description of Artificial Sequence: Synthetic peptide
DEQEIRTTNPVATEQYGSVSTNLERGEG

SEQ ID NO: 5009 - protein, 29 aa, Artificial Sequence
  Description of Artificial Sequence: Synthetic peptide
DEEEIRTTNPVATETYGSVSNNLQRGNDF

SEQ ID NO: 5010 - protein, 30 aa, Artificial Sequence
  Description of Artificial Sequence: Synthetic polypeptide
DEEEIRTTNPVATEQYGSVSTMLQQGSNSR

SEQ ID NO: 5011 - protein, 28 aa, Artificial Sequence
  Description of Artificial Sequence: Synthetic peptide
DEQEIRTTNPVATEIYGSVSTNLQRGEI

SEQ ID NO: 5012 - protein, 28 aa, Artificial Sequence
  Description of Artificial Sequence: Synthetic peptide
SEEEIRCTNPVATEQYGSVSENLERGNR

SEQ ID NO: 5013 - protein, 31 aa, Artificial Sequence
  Description of Artificial Sequence: Synthetic polypeptide
DEEEIRTTNPVATEQYGSVSTPTNLQRGDRP

SEQ ID NO: 5014 - protein, 31 aa, Artificial Sequence
  Description of Artificial Sequence: Synthetic polypeptide
DEEEIRTTNPVATEQYGSVSTNLQRGQSNFQ

SEQ ID NO: 5015 - protein, 31 aa, Artificial Sequence
  Description of Artificial Sequence: Synthetic polypeptide
DEEEIRTTNPVATEQYGSVISTNLQRGINNG

SEQ ID NO: 5016 - protein, 30 aa, Artificial Sequence
  Description of Artificial Sequence: Synthetic polypeptide
YEEEIRTTNPVATDQYGSVSETNLQRGQNR

SEQ ID NO: 5017 - protein, 29 aa, Artificial Sequence
  Description of Artificial Sequence: Synthetic peptide
DEEEIRTTNPVATETYGSVSTNLQHGENE

SEQ ID NO: 5018 - protein, 30 aa, Artificial Sequence
  Description of Artificial Sequence: Synthetic polypeptide
DEEEIRTTNPVATESYGSVSTTNLTQGGNR

SEQ ID NO: 5019 - protein, 28 aa, Artificial Sequence
  Description of Artificial Sequence: Synthetic peptide
DEEEIRQTNPVATENYGSVSTCLQRGNV

SEQ ID NO: 5020 - protein, 30 aa, Artificial Sequence
  Description of Artificial Sequence: Synthetic polypeptide
AEEEIRTTNPVATEQYGSVSTNLNQRIGNV

SEQ ID NO: 5021 - protein, 30 aa, Artificial Sequence
  Description of Artificial Sequence: Synthetic polypeptide
AEEEIRTTNPVATEQYGSVSTTELQRGDNR

SEQ ID NO: 5022 - protein, 28 aa, Artificial Sequence
  Description of Artificial Sequence: Synthetic peptide
SEEEIRTTNPVATEQYGSVSENLMRGNL

SEQ ID NO: 5023 - protein, 30 aa, Artificial Sequence
  Description of Artificial Sequence: Synthetic polypeptide
DEEEIRTTNPVATEQYGSVSTNLGHRDNER

SEQ ID NO: 5024 - protein, 30 aa, Artificial Sequence
  Description of Artificial Sequence: Synthetic polypeptide
DEEEIRTTNPVATEQYGSVSTNLQADGGAR

SEQ ID NO: 5025 - protein, 30 aa, Artificial Sequence
  Description of Artificial Sequence: Synthetic polypeptide
DEGEIRTTNPVATEQYGSVSTNLQMGGENR

SEQ ID NO: 5026 - protein, 31 aa, Artificial Sequence
  Description of Artificial Sequence: Synthetic polypeptide
DEEEIRTTNPVATEQYGSVSTENLQRDMGDR

SEQ ID NO: 5027 - protein, 28 aa, Artificial Sequence
  Description of Artificial Sequence: Synthetic peptide
DEEEIRTTNPVATEQYGSFSEFEQRGNR

SEQ ID NO: 5028 - protein, 30 aa, Artificial Sequence
  Description of Artificial Sequence: Synthetic polypeptide
TEEEIRTTNPVATEQYGSVSTNLQRGSENF

SEQ ID NO: 5029 - protein, 28 aa, Artificial Sequence
  Description of Artificial Sequence: Synthetic peptide
KEEEIRTVNPVATEQYGSVGTNLERGNR

SEQ ID NO: 5030 - protein, 30 aa, Artificial Sequence
  Description of Artificial Sequence: Synthetic polypeptide
DEEEIRTTNPVATEQYGSVSTNLQFGDNFL

SEQ ID NO: 5031 - protein, 30 aa, Artificial Sequence
  Description of Artificial Sequence: Synthetic polypeptide
DEEEIRTTNPVATEQYGSVSMNLQGEGNNR

SEQ ID NO: 5032 - protein, 30 aa, Artificial Sequence
  Description of Artificial Sequence: Synthetic polypeptide
DEAEIRTTNPVATEQYGSVSTNEQREGNER

SEQ ID NO: 5033 - protein, 30 aa, Artificial Sequence
  Description of Artificial Sequence: Synthetic polypeptide
AEEEIRTTNPVATEQYGSVSVTNLQNIGNR

SEQ ID NO: 5034 - protein, 29 aa, Artificial Sequence
  Description of Artificial Sequence: Synthetic peptide
DESEIRTTNPVATECYGSVSCNLQDRGNR

SEQ ID NO: 5035 - protein, 30 aa, Artificial Sequence
  Description of Artificial Sequence: Synthetic polypeptide
AEEEIRTTNPVATEQYGSVSTNNLQQGMNR

SEQ ID NO: 5036 - protein, 28 aa, Artificial Sequence
  Description of Artificial Sequence: Synthetic peptide
DEEEIRTTNPVATEQYGSVSTELQYGEW

SEQ ID NO: 5037 - protein, 30 aa, Artificial Sequence
  Description of Artificial Sequence: Synthetic polypeptide
DEEEIRTTNPVATEAYGSVSTNHQRVGNQR

SEQ ID NO: 5038 - protein, 29 aa, Artificial Sequence
  Description of Artificial Sequence: Synthetic peptide
DEDEIRTTNPVAYEQYGSVSTNLQLGDNR

SEQ ID NO: 5039 - protein, 30 aa, Artificial Sequence
  Description of Artificial Sequence: Synthetic polypeptide
DEEEIRTTNPVAWEQYGSVSNTNLGRGNTR

SEQ ID NO: 5040 - protein, 28 aa, Artificial Sequence
  Description of Artificial Sequence: Synthetic peptide
DEEEIRTTNPVATEQYGSVSTDQERGER

SEQ ID NO: 5041 - protein, 30 aa, Artificial Sequence
  Description of Artificial Sequence: Synthetic polypeptide
TEEEIRTTNPVATEQYGSVSTNLQRNGNYD

SEQ ID NO: 5042 - protein, 28 aa, Artificial Sequence
  Description of Artificial Sequence: Synthetic peptide
DESEIRTTNPVATEQFGSVSNNLQHGNR

SEQ ID NO: 5043 - protein, 29 aa, Artificial Sequence
  Description of Artificial Sequence: Synthetic peptide
DEEEICTTNPVATEQYGSVSTNDQRGDNE

SEQ ID NO: 5044 - protein, 30 aa, Artificial Sequence
  Description of Artificial Sequence: Synthetic polypeptide
DEEEIRTTNPDATEQYGSISVTNLQRGDNR

SEQ ID NO: 5045 - protein, 28 aa, Artificial Sequence
  Description of Artificial Sequence: Synthetic peptide
DEEEIRCTNPVATEQYGTVSMNLMRGNR

SEQ ID NO: 5046 - protein, 30 aa, Artificial Sequence
  Description of Artificial Sequence: Synthetic polypeptide
DESEIRTTNPVATEQYGVVSTNELQRGNRS

SEQ ID NO: 5047 - protein, 29 aa, Artificial Sequence
  Description of Artificial Sequence: Synthetic peptide
DEEEIRCTNPVATEQYGVVSTNLQREGNE

SEQ ID NO: 5048 - protein, 30 aa, Artificial Sequence
  Description of Artificial Sequence: Synthetic polypeptide
DEEEIRTTNPVATEQYGQVSWTNLNRGENR

SEQ ID NO: 5049 - protein, 30 aa, Artificial Sequence
  Description of Artificial Sequence: Synthetic polypeptide
DEEEIRTTNPVATEQYGSVSTPLQRGNEGF

SEQ ID NO: 5050 - protein, 28 aa, Artificial Sequence
  Description of Artificial Sequence: Synthetic peptide
SEEEIRCTNPVATEQYGSVSSNLMRGNR

SEQ ID NO: 5051 - protein, 28 aa, Artificial Sequence
  Description of Artificial Sequence: Synthetic peptide
SEEEIRCTNPIATEQYGSVSTNLERGNR

SEQ ID NO: 5052 - protein, 30 aa, Artificial Sequence
  Description of Artificial Sequence: Synthetic polypeptide
DETEIRTTNPVATEQYGSVSTNLQAAGNAR

SEQ ID NO: 5053 - protein, 28 aa, Artificial Sequence
  Description of Artificial Sequence: Synthetic peptide
SEEEIRCTNPIATEQYGSVSTNLMRGNR

SEQ ID NO: 5054 - protein, 31 aa, Artificial Sequence
  Description of Artificial Sequence: Synthetic polypeptide
DEEEIRTTNPVATEQYGYTVSETNELQRGNR

SEQ ID NO: 5055 - protein, 29 aa, Artificial Sequence
  Description of Artificial Sequence: Synthetic peptide
DEEEIVTTNPVATEQYGSASTNLQCRGDR

SEQ ID NO: 5056 - protein, 31 aa, Artificial Sequence
  Description of Artificial Sequence: Synthetic polypeptide
DEEEIRTTNPVATEQYGSVCSTNLQNGIMNR

SEQ ID NO: 5057 - protein, 29 aa, Artificial Sequence
  Description of Artificial Sequence: Synthetic peptide
YEEEIRTTNPVATESYGSVSTNLQGGTNR

SEQ ID NO: 5058 - protein, 28 aa, Artificial Sequence
  Description of Artificial Sequence: Synthetic peptide
DEEEVRTTNPVASEQYGCVSTNLERGNR

SEQ ID NO: 5059 - protein, 29 aa, Artificial Sequence
  Description of Artificial Sequence: Synthetic peptide
SEEEIRTTNPVATEQYGSVSTNLQVGQNQ

SEQ ID NO: 5060 - protein, 30 aa, Artificial Sequence
  Description of Artificial Sequence: Synthetic polypeptide
DEEEIRTTNPVATEQYGSVSTNLQTGQINT

SEQ ID NO: 5061 - protein, 31 aa, Artificial Sequence
  Description of Artificial Sequence: Synthetic polypeptide
DEEEIRTTNPVATEQYGSVSTNLQRQAGLRV

SEQ ID NO: 5062 - protein, 29 aa, Artificial Sequence
  Description of Artificial Sequence: Synthetic peptide
DESEIRCTNPVATEQYGSVSCNLQDRGNR

SEQ ID NO: 5063 - protein, 28 aa, Artificial Sequence
  Description of Artificial Sequence: Synthetic peptide
YEEEIRTVNPVATEGYGNVSTNLQRGNR

SEQ ID NO: 5064 - protein, 28 aa, Artificial Sequence
  Description of Artificial Sequence: Synthetic peptide
KEEEIRATNPVATEQYGSVSTNLQTGDR

SEQ ID NO: 5065 - protein, 30 aa, Artificial Sequence
  Description of Artificial Sequence: Synthetic polypeptide
DEEEIRTTNPVATEQYGSVSTANEQRGNTV

SEQ ID NO: 5066 - protein, 30 aa, Artificial Sequence
  Description of Artificial Sequence: Synthetic polypeptide
DEEEIATTNPVATEEYGSVSTNLQRDGNQR

SEQ ID NO: 5067 - protein, 28 aa, Artificial Sequence
  Description of Artificial Sequence: Synthetic peptide
SEEEIRCTNPVATEQYGSVSMNLMRGNR

SEQ ID NO: 5068 - protein, 28 aa, Artificial Sequence
  Description of Artificial Sequence: Synthetic peptide
DEEEIRTTNPIATEQYGSVSENLERGER

SEQ ID NO: 5069 - protein, 28 aa, Artificial Sequence
  Description of Artificial Sequence: Synthetic peptide
DEEEVATTNPVCTEQYGSVSTNLERGNR

SEQ ID NO: 5070 - protein, 28 aa, Artificial Sequence
  Description of Artificial Sequence: Synthetic peptide
DEEEIRTTNPVATEQYGSVSTELWFGND

SEQ ID NO: 5071 - protein, 31 aa, Artificial Sequence
  Description of Artificial Sequence: Synthetic polypeptide
DEEEIRTTNPVATEQYGSVSTNALQRGDNDQ

SEQ ID NO: 5072 - protein, 30 aa, Artificial Sequence
  Description of Artificial Sequence: Synthetic polypeptide
AEEEIRTTNPVATEQYGSVSTNLYNQDGNR

SEQ ID NO: 5073 - protein, 28 aa, Artificial Sequence
  Description of Artificial Sequence: Synthetic peptide
DDEEIRCTNPVATEQYGCVSMNLQRGNR

SEQ ID NO: 5074 - protein, 30 aa, Artificial Sequence
  Description of Artificial Sequence: Synthetic polypeptide
DEEEIRTTNPVATEQYGHVSETNLNRGGNR

SEQ ID NO: 5075 - protein, 29 aa, Artificial Sequence
  Description of Artificial Sequence: Synthetic peptide
DESEIRTTNPVATEQYGSVSANLFRNGNR

SEQ ID NO: 5076 - protein, 31 aa, Artificial Sequence
  Description of Artificial Sequence: Synthetic polypeptide
DEEEIRTTNPVATERYGSVSCTNLQREGNRN

SEQ ID NO: 5077 - protein, 30 aa, Artificial Sequence
  Description of Artificial Sequence: Synthetic polypeptide
SEEEIRTTNPVATEQYGSVVSTNLQNGNNR

SEQ ID NO: 5078 - protein, 28 aa, Artificial Sequence
  Description of Artificial Sequence: Synthetic peptide
DEEEIRATNPVATEQYGGVSTNLERGNF

SEQ ID NO: 5079 - protein, 30 aa, Artificial Sequence
  Description of Artificial Sequence: Synthetic polypeptide
AEEEIRTTNPVATEQYGSVSVTNLQLGGNR

SEQ ID NO: 5080 - protein, 31 aa, Artificial Sequence
  Description of Artificial Sequence: Synthetic polypeptide
DEEEIRTTNPVATEQYGSVSTNALSQRGPND

SEQ ID NO: 5081 - protein, 28 aa, Artificial Sequence
  Description of Artificial Sequence: Synthetic peptide
MEEEIRTTNPVATEQYGVVSTNLQRGEA

SEQ ID NO: 5082 - protein, 28 aa, Artificial Sequence
  Description of Artificial Sequence: Synthetic peptide
DEDEIRTTNPVATECYGSVSTNLQNGNN

SEQ ID NO: 5083 - protein, 30 aa, Artificial Sequence
  Description of Artificial Sequence: Synthetic polypeptide
DESEIRTTNPVATEQYGSVSTNLQHDGNTR

SEQ ID NO: 5084 - protein, 29 aa, Artificial Sequence
  Description of Artificial Sequence: Synthetic peptide
DEEEIRTTNPVATEPYGSVSSNLEREGNR

SEQ ID NO: 5085 - protein, 31 aa, Artificial Sequence
  Description of Artificial Sequence: Synthetic polypeptide
DEEEIRTTNPVATEQYGSVSTELNLQRGDNE

SEQ ID NO: 5086 - protein, 29 aa, Artificial Sequence
  Description of Artificial Sequence: Synthetic peptide
DESEIRTTNPVATEQYGSVSTNLQGGGNV

SEQ ID NO: 5087 - protein, 30 aa, Artificial Sequence
  Description of Artificial Sequence: Synthetic polypeptide
SEEEIRTTNPVATEQYGSVTSTNLQMGNNR

SEQ ID NO: 5088 - protein, 29 aa, Artificial Sequence
  Description of Artificial Sequence: Synthetic peptide
DEEEIRTTNPVATEPYGSVSTHLQNVGNR

SEQ ID NO: 5089 - protein, 29 aa, Artificial Sequence
  Description of Artificial Sequence: Synthetic peptide
DEEEIRATNPVATELYGSVSTNLPQRGNF

SEQ ID NO: 5090 - protein, 30 aa, Artificial Sequence
  Description of Artificial Sequence: Synthetic polypeptide
DEEEIRTTNPVATEQYGSVSCTELQCRGNF

SEQ ID NO: 5091 - protein, 30 aa, Artificial Sequence
  Description of Artificial Sequence: Synthetic polypeptide
DEEEIRTTNPVATEQYGSVSTNLQDEGMND

SEQ ID NO: 5092 - protein, 31 aa, Artificial Sequence
  Description of Artificial Sequence: Synthetic polypeptide
DEEEIRTTNPVATEQYGSVSTALEQHRGNER

SEQ ID NO: 5093 - protein, 30 aa, Artificial Sequence
  Description of Artificial Sequence: Synthetic polypeptide
DEGEIRTTNPVATEQYGSVSTNLQRGGDNK

SEQ ID NO: 5094 - protein, 29 aa, Artificial Sequence
  Description of Artificial Sequence: Synthetic peptide
DEEEIRTTNPVATEQYGSVSTALNRGMNV

SEQ ID NO: 5095 - protein, 30 aa, Artificial Sequence
  Description of Artificial Sequence: Synthetic polypeptide
DEEEIRTTNPVATEQYGATISTNDLQRGNR

SEQ ID NO: 5096 - protein, 29 aa, Artificial Sequence
  Description of Artificial Sequence: Synthetic peptide
DESEIRTTNPVATEQYGTVSTNLQRVGNH

SEQ ID NO: 5097 - protein, 29 aa, Artificial Sequence
  Description of Artificial Sequence: Synthetic peptide
DEGEIRTTNPVATEQYGSVSTDLQRMENR

SEQ ID NO: 5098 - protein, 28 aa, Artificial Sequence
  Description of Artificial Sequence: Synthetic peptide
DEELITTTNPVATEQYGSVSTNLQCGER

SEQ ID NO: 5099 - protein, 28 aa, Artificial Sequence
  Description of Artificial Sequence: Synthetic peptide
DEEEIRTTNPDATEQYGSVSEELQMGNR

SEQ ID NO: 5100 - protein, 28 aa, Artificial Sequence
  Description of Artificial Sequence: Synthetic peptide
SEEEIRCTNPVATEQYGSVSTNLMRGNV

SEQ ID NO: 5101 - protein, 30 aa, Artificial Sequence
  Description of Artificial Sequence: Synthetic polypeptide
DEEEIRTTNPVATEQYGNVSTNLQMGGNNR

SEQ ID NO: 5102 - protein, 30 aa, Artificial Sequence
  Description of Artificial Sequence: Synthetic polypeptide
DEEEIRTTNPVATEQYGSVETNLQRIGNHS

SEQ ID NO: 5103 - protein, 30 aa, Artificial Sequence
  Description of Artificial Sequence: Synthetic polypeptide
DEEEIRTTNPVATEQYGSVSTNLQYIGLNQ

SEQ ID NO: 5104 - protein, 30 aa, Artificial Sequence
  Description of Artificial Sequence: Synthetic polypeptide
DEEEIRTTNPVATEQYGYVSWTNLERGMNR

SEQ ID NO: 5105 - protein, 28 aa, Artificial Sequence
  Description of Artificial Sequence: Synthetic peptide
DDEEIRCTNPVATEQYGSVSENLMRGNR

SEQ ID NO: 5106 - protein, 28 aa, Artificial Sequence
  Description of Artificial Sequence: Synthetic peptide
SEEEVRCTNPVATEQYGSVSENLQRGNR

SEQ ID NO: 5107 - protein, 30 aa, Artificial Sequence
  Description of Artificial Sequence: Synthetic polypeptide
DEEEIRTTNPVATEQYGSVSMNLQRVGNIQ

SEQ ID NO: 5108 - protein, 30 aa, Artificial Sequence
  Description of Artificial Sequence: Synthetic polypeptide
DEEEIRTTNPVATEPYGSVSGTNLTRIGNR

SEQ ID NO: 5109 - protein, 30 aa, Artificial Sequence
  Description of Artificial Sequence: Synthetic polypeptide
DEEEIRTTNPVATEFYGSVSTNLQRGELNT

SEQ ID NO: 5110 - protein, 30 aa, Artificial Sequence
  Description of Artificial Sequence: Synthetic polypeptide
AEEEIRTTNPVATEQYGSVVSTNLMQGGNR

SEQ ID NO: 5111 - protein, 28 aa, Artificial Sequence
  Description of Artificial Sequence: Synthetic peptide
DEEEIATTNPVATEQYGSVSENLQREER

SEQ ID NO: 5112 - protein, 28 aa, Artificial Sequence
  Description of Artificial Sequence: Synthetic peptide
DEEEIATTNPVATEQYGSVSENLQHGQR

SEQ ID NO: 5113 - protein, 31 aa, Artificial Sequence
  Description of Artificial Sequence: Synthetic polypeptide
DESEIRTTNPVATEQYGSVCSTDNLQRGDNR

SEQ ID NO: 5114 - protein, 28 aa, Artificial Sequence
  Description of Artificial Sequence: Synthetic peptide
DEEEIATTNPVATEQYGSVSELLQRGMR

SEQ ID NO: 5115 - protein, 30 aa, Artificial Sequence
  Description of Artificial Sequence: Synthetic polypeptide
DESEIRTTNPVATEQYGSVSTNPQRGNEER

SEQ ID NO: 5116 - protein, 29 aa, Artificial Sequence
  Description of Artificial Sequence: Synthetic peptide
AEEEIRTTNPVATEQYGSVSTNNQQGANR

SEQ ID NO: 5117 - protein, 28 aa, Artificial Sequence
  Description of Artificial Sequence: Synthetic peptide
DEEEIRTTNPVATEQYGSVSTELQEGEE

SEQ ID NO: 5118 - protein, 28 aa, Artificial Sequence
  Description of Artificial Sequence: Synthetic peptide
DDEEIRTTNPEATEQYGSVSTNIQAGNR

SEQ ID NO: 5119 - protein, 32 aa, Artificial Sequence
  Description of Artificial Sequence: Synthetic polypeptide
DEEEIRTTNPVATEQYGSVSPITNLQRGNFRN

SEQ ID NO: 5120 - protein, 30 aa, Artificial Sequence
  Description of Artificial Sequence: Synthetic polypeptide
DETEIRTTNPVATEQYGSVSTNLQADGNAR

SEQ ID NO: 5121 - protein, 30 aa, Artificial Sequence
  Description of Artificial Sequence: Synthetic polypeptide
DEEEIRTTNPVATEQYGSVPTSLQRGNIRN

SEQ ID NO: 5122 - protein, 30 aa, Artificial Sequence
  Description of Artificial Sequence: Synthetic polypeptide
DEEEIRTTNPVATEQYGSVSTNLQRPDNAA

SEQ ID NO: 5123 - protein, 29 aa, Artificial Sequence
  Description of Artificial Sequence: Synthetic peptide
DEEEIRTTNPVATEQYGSVMTNLAQRENE

SEQ ID NO: 5124 - protein, 31 aa, Artificial Sequence
  Description of Artificial Sequence: Synthetic polypeptide
DEEEIRTTNPVATEQYGSVSTNALQPGNDPR

SEQ ID NO: 5125 - protein, 28 aa, Artificial Sequence
  Description of Artificial Sequence: Synthetic peptide
DEQEIRTTNPVATEVYGVVGTNLQRGNR

SEQ ID NO: 5126 - protein, 28 aa, Artificial Sequence
  Description of Artificial Sequence: Synthetic peptide
YEEEIRTTNPVATEQYGSVNTNLQTGER

SEQ ID NO: 5127 - protein, 28 aa, Artificial Sequence
  Description of Artificial Sequence: Synthetic peptide
MEEEIRTTNPVATEQYGSADTNLIRGNR

SEQ ID NO: 5128 - protein, 28 aa, Artificial Sequence
  Description of Artificial Sequence: Synthetic peptide
DEQEIRTTNPVCTEQYGSVSTNDCRGNR

SEQ ID NO: 5129 - protein, 28 aa, Artificial Sequence
  Description of Artificial Sequence: Synthetic peptide
DEQEIRTTNPVSTEIYGSVSTNLQRGNM

SEQ ID NO: 5130 - protein, 30 aa, Artificial Sequence
  Description of Artificial Sequence: Synthetic polypeptide
AEEEIRTTNPVATENYGSVSTNLQRGTGNR

SEQ ID NO: 5131 - protein, 28 aa, Artificial Sequence
  Description of Artificial Sequence: Synthetic peptide
DEQEIVSTNPVATEQYGVVSTNLQRGNR

SEQ ID NO: 5132 - protein, 30 aa, Artificial Sequence
  Description of Artificial Sequence: Synthetic polypeptide
DEEEIRTTNPVATEQYGSVSTNLAQNFGNQ

SEQ ID NO: 5133 - protein, 28 aa, Artificial Sequence
  Description of Artificial Sequence: Synthetic peptide
DEQEIVTTNPVATENYGWVSTNLQRGNR

SEQ ID NO: 5134 - protein, 31 aa, Artificial Sequence
  Description of Artificial Sequence: Synthetic polypeptide
DEEEIRTTNPVATEQYGSVSTYLHQSRGNQR

SEQ ID NO: 5135 - protein, 30 aa, Artificial Sequence
  Description of Artificial Sequence: Synthetic polypeptide
DEEEIRTTNPVATEQYGSVVSSYLQRGGNR

SEQ ID NO: 5136 - protein, 30 aa, Artificial Sequence
  Description of Artificial Sequence: Synthetic polypeptide
DEEEIRTTNPVATEQYGSVSTNLQRIQGEG

SEQ ID NO: 5137 - protein, 30 aa, Artificial Sequence
  Description of Artificial Sequence: Synthetic polypeptide
DEEEIRCTNPVATEQYGSVSSTENLNRGNR

SEQ ID NO: 5138 - protein, 29 aa, Artificial Sequence
  Description of Artificial Sequence: Synthetic peptide
DEEEIRTTNPIATEQYGSVSCNEPQRGNR

SEQ ID NO: 5139 - protein, 30 aa, Artificial Sequence
  Description of Artificial Sequence: Synthetic polypeptide
DEEEIRCTNPVATEQYGSVSSTNLMRGMNR

SEQ ID NO: 5140 - protein, 31 aa, Artificial Sequence
  Description of Artificial Sequence: Synthetic polypeptide
DEEEIRTTNPVATEQYGSVSTNLQFGPNTRE

SEQ ID NO: 5141 - protein, 30 aa, Artificial Sequence
  Description of Artificial Sequence: Synthetic polypeptide
DEEEIRTTNPVATEQYGSVITNLQRLGERP

SEQ ID NO: 5142 - protein, 30 aa, Artificial Sequence
  Description of Artificial Sequence: Synthetic polypeptide
DEEEIRTTNPVATEQYGSVSPDNLQNGNER

SEQ ID NO: 5143 - protein, 30 aa, Artificial Sequence
  Description of Artificial Sequence: Synthetic polypeptide
DEEEIRTTNPVATEWYGSVSFTNLTRGGNR

SEQ ID NO: 5144 - protein, 31 aa, Artificial Sequence
  Description of Artificial Sequence: Synthetic polypeptide
DEEEIRTTNPVATEQYGSVSTNLQFGNSNRE

SEQ ID NO: 5145 - protein, 29 aa, Artificial Sequence
  Description of Artificial Sequence: Synthetic peptide
DEEEIRTTNPVATEQYGIVSDNLQYRGQR

SEQ ID NO: 5146 - protein, 31 aa, Artificial Sequence
  Description of Artificial Sequence: Synthetic polypeptide
DEEEIRTTNPVATEQYGSFVSTNLQERPGNQ

SEQ ID NO: 5147 - protein, 30 aa, Artificial Sequence
  Description of Artificial Sequence: Synthetic polypeptide
HEEEIRTTNPVATEQYGSVSTNLQRNGNED

SEQ ID NO: 5148 - protein, 30 aa, Artificial Sequence
  Description of Artificial Sequence: Synthetic polypeptide
HEEEIRTTNPVATEQYGSVSTNLQRNGNTY

SEQ ID NO: 5149 - protein, 30 aa, Artificial Sequence
  Description of Artificial Sequence: Synthetic polypeptide
DEEEIRTTNPTATEQYGSVSTMNEQRGDNR

SEQ ID NO: 5150 - protein, 30 aa, Artificial Sequence
  Description of Artificial Sequence: Synthetic polypeptide
DEEEIRTTNPVATEQYGSVPSTNLQSSGSR

SEQ ID NO: 5151 - protein, 28 aa, Artificial Sequence
  Description of Artificial Sequence: Synthetic peptide
SEEEIRSTNPVATEQYGVVSDNLQRGNR

SEQ ID NO: 5152 - protein, 28 aa, Artificial Sequence
  Description of Artificial Sequence: Synthetic peptide
DEHEIRTTNPVATELYGSVDTNDQRGNR

SEQ ID NO: 5153 - protein, 31 aa, Artificial Sequence
  Description of Artificial Sequence: Synthetic polypeptide
DEEEIRTTNPVATEQYGSTVNTNELQRGSNR

SEQ ID NO: 5154 - protein, 29 aa, Artificial Sequence
  Description of Artificial Sequence: Synthetic peptide
NEEEIRTTNPVATEQYGSISTALQRQGNR

SEQ ID NO: 5155 - protein, 31 aa, Artificial Sequence
  Description of Artificial Sequence: Synthetic polypeptide
DEEEIRTTNPVATEQYGSVASTNLGRGGINR

SEQ ID NO: 5156 - protein, 30 aa, Artificial Sequence
  Description of Artificial Sequence: Synthetic polypeptide
DEEEIRTTNPVATEQYGAVSITNLNRGQNR

SEQ ID NO: 5157 - protein, 28 aa, Artificial Sequence
  Description of Artificial Sequence: Synthetic peptide
DEEEIRTTNPVATEQYGSVSTNDDEGNF

SEQ ID NO: 5158 - protein, 31 aa, Artificial Sequence
  Description of Artificial Sequence: Synthetic polypeptide
DEEEIRTTNPVATEQYGSVSTPNLQRGIMNM

SEQ ID NO: 5159 - protein, 30 aa, Artificial Sequence
  Description of Artificial Sequence: Synthetic polypeptide
DEEEIRTTNPVATEQYGSVSTNLQANGNTN

SEQ ID NO: 5160 - protein, 31 aa, Artificial Sequence
  Description of Artificial Sequence: Synthetic polypeptide
SEEEIRTTNPVATEQYGSVSTGNLQERGNTR

SEQ ID NO: 5161 - protein, 28 aa, Artificial Sequence
  Description of Artificial Sequence: Synthetic peptide
SEEEIRSTNPVATEQYGSVSENLQRGNQ

SEQ ID NO: 5162 - protein, 30 aa, Artificial Sequence
  Description of Artificial Sequence: Synthetic polypeptide
DEEEIRTTNPVATEQYGSVPTDNLQRGENP

SEQ ID NO: 5163 - protein, 31 aa, Artificial Sequence
  Description of Artificial Sequence: Synthetic polypeptide
DEEEIATTNPVATEQYGSVCSTNLQRGNSNR

SEQ ID NO: 5164 - protein, 29 aa, Artificial Sequence
  Description of Artificial Sequence: Synthetic peptide
DEEEIRTTNPVATEQYGSVPTELQRGENI

SEQ ID NO: 5165 - protein, 29 aa, Artificial Sequence
  Description of Artificial Sequence: Synthetic peptide
SEEEIRTTNPVATEQYGSVSTMNEQEGNR

SEQ ID NO: 5166 - protein, 30 aa, Artificial Sequence
  Description of Artificial Sequence: Synthetic polypeptide
METEIRTTNPVATEQYGSVSTNLAQRGNMR

SEQ ID NO: 5167 - protein, 29 aa, Artificial Sequence
  Description of Artificial Sequence: Synthetic peptide
DEEEIRTTNPVATEQYGSVSTLLERDGER

SEQ ID NO: 5168 - protein, 30 aa, Artificial Sequence
  Description of Artificial Sequence: Synthetic polypeptide
DEEEIRTTNPVATEQYGNVSWTNLNRGDNR

SEQ ID NO: 5169 - protein, 30 aa, Artificial Sequence
  Description of Artificial Sequence: Synthetic polypeptide
DEEEIRTTNPVATEQYGGVSPTNLNRGMNR

SEQ ID NO: 5170 - protein, 30 aa, Artificial Sequence
  Description of Artificial Sequence: Synthetic polypeptide
DEEEIRTTNPVATEQYGCVSWTNLTRGMNR

SEQ ID NO: 5171 - protein, 31 aa, Artificial Sequence
  Description of Artificial Sequence: Synthetic polypeptide
DEEEIRTTNPVATEQYGYSISPTNELQRGNR

SEQ ID NO: 5172 - protein, 30 aa, Artificial Sequence
  Description of Artificial Sequence: Synthetic polypeptide
DEDEIRTTNPVATEQYGSVSTNLQTMGNAR

SEQ ID NO: 5173 - protein, 30 aa, Artificial Sequence
  Description of Artificial Sequence: Synthetic polypeptide
AEEEIRTTNPVATEQYGSVSTNLQVLGQNR

SEQ ID NO: 5174 - protein, 28 aa, Artificial Sequence
  Description of Artificial Sequence: Synthetic peptide
DEEEVRTTNPVATEQYGCVSANLQIGNR

SEQ ID NO: 5175 - protein, 29 aa, Artificial Sequence
  Description of Artificial Sequence: Synthetic peptide
DEEEIRTTNPVATEQFGSVSTNPQIGVNR

SEQ ID NO: 5176 - protein, 30 aa, Artificial Sequence
  Description of Artificial Sequence: Synthetic polypeptide
DETEIRTTNPVATEQYGSVSTNLQHGGNGR

SEQ ID NO: 5177 - protein, 29 aa, Artificial Sequence
  Description of Artificial Sequence: Synthetic peptide
DEEEIVCTNPVATEQYGSVSATNLQRGMR

SEQ ID NO: 5178 - protein, 28 aa, Artificial Sequence
  Description of Artificial Sequence: Synthetic peptide
DEDEIRTTNPVATEQYGSVSTNLQVGGN

SEQ ID NO: 5179 - protein, 30 aa, Artificial Sequence
  Description of Artificial Sequence: Synthetic polypeptide
DEEEIRTTNPVATEQYGSVSTNLQVGENVQ

SEQ ID NO: 5180 - protein, 29 aa, Artificial Sequence
  Description of Artificial Sequence: Synthetic peptide
DEEEIRTTNPVATEQYGSTSTLLQRGENG

SEQ ID NO: 5181 - protein, 30 aa, Artificial Sequence
  Description of Artificial Sequence: Synthetic polypeptide
DEEEIRTTNPVATEQYGSVSTNLQRNGEDL

SEQ ID NO: 5182 - protein, 31 aa, Artificial Sequence
  Description of Artificial Sequence: Synthetic polypeptide
DEEEIRTTNPVATEQYGSVSTNLQVGDDNDR

SEQ ID NO: 5183 - protein, 29 aa, Artificial Sequence
  Description of Artificial Sequence: Synthetic peptide
DEEEIRTTNPVATEQYGSVCTNLQDGENP

SEQ ID NO: 5184 - protein, 30 aa, Artificial Sequence
  Description of Artificial Sequence: Synthetic polypeptide
DEEEIRTTNPVATEQYGYTASTNVLQRGNR

SEQ ID NO: 5185 - protein, 31 aa, Artificial Sequence
  Description of Artificial Sequence: Synthetic polypeptide
DEEEIRTTNPVATEQYGSVSTNLQRNGTNTT

SEQ ID NO: 5186 - protein, 31 aa, Artificial Sequence
  Description of Artificial Sequence: Synthetic polypeptide
DEEEIRTTNPVATEQYGSVSTNLQRNGVNQT

SEQ ID NO: 5187 - protein, 30 aa, Artificial Sequence
  Description of Artificial Sequence: Synthetic polypeptide
DEEEIRTTNPVATEQYGEVSTNLVQHGTNR

SEQ ID NO: 5188 - protein, 30 aa, Artificial Sequence
  Description of Artificial Sequence: Synthetic polypeptide
AEEEIRTTNPVATEQYGSVSTNLVPQAGNR

SEQ ID NO: 5189 - protein, 30 aa, Artificial Sequence
  Description of Artificial Sequence: Synthetic polypeptide
DEEEIRTTNPVATEQFGSVSTLNLQLRGNE

SEQ ID NO: 5190 - protein, 30 aa, Artificial Sequence
  Description of Artificial Sequence: Synthetic polypeptide
DEEEIRTTNPVATEQYGSVSCTDLQRGNDD

SEQ ID NO: 5191 - protein, 31 aa, Artificial Sequence
  Description of Artificial Sequence: Synthetic polypeptide
DEEEIRTTNPVATEQYGSVVSTNLQCRENDR

SEQ ID NO: 5192 - protein, 28 aa, Artificial Sequence
  Description of Artificial Sequence: Synthetic peptide
DEEEIRTTNPEATEQYGAVSTCLIRGNR

SEQ ID NO: 5193 - protein, 28 aa, Artificial Sequence
  Description of Artificial Sequence: Synthetic peptide
SEEEIRCTNPVATEQYGSVSENLMRGNR

SEQ ID NO: 5194 - protein, 30 aa, Artificial Sequence
  Description of Artificial Sequence: Synthetic polypeptide
DETEIRTTNPVATEQYGSVSTNLQRDGENS

SEQ ID NO: 5195 - protein, 31 aa, Artificial Sequence
  Description of Artificial Sequence: Synthetic polypeptide
DEEEIRTTNPVATEQYGSVSCTNAQERGNQR

SEQ ID NO: 5196 - protein, 31 aa, Artificial Sequence
  Description of Artificial Sequence: Synthetic polypeptide
DEEEIRTTNPVATEQYGSVSTNLQFGNGNRM

SEQ ID NO: 5197 - protein, 31 aa, Artificial Sequence
  Description of Artificial Sequence: Synthetic polypeptide
DEEEIRTTNPVATEQYGSVSTNLQFGLSNRG

SEQ ID NO: 5198 - protein, 30 aa, Artificial Sequence
  Description of Artificial Sequence: Synthetic polypeptide
DEEEIRTTNPVATEQYGWVSATNLNRGMNR

SEQ ID NO: 5199 - protein, 30 aa, Artificial Sequence
  Description of Artificial Sequence: Synthetic polypeptide
DEEEIRTTNPVATEQYGHVSWTNLDRGDNR

SEQ ID NO: 5200 - protein, 29 aa, Artificial Sequence
  Description of Artificial Sequence: Synthetic peptide
DEEEIRTTNPVATEQYGWVSTDLQDQGNR

SEQ ID NO: 5201 - protein, 28 aa, Artificial Sequence
  Description of Artificial Sequence: Synthetic peptide
DEEEIRTTNPVATEQYGWVSTLLQHGGR

SEQ ID NO: 5202 - protein, 28 aa, Artificial Sequence
  Description of Artificial Sequence: Synthetic peptide
DEEEIRTTNPVATEQYGSVSTPLEEGNV

SEQ ID NO: 5203 - protein, 29 aa, Artificial Sequence
  Description of Artificial Sequence: Synthetic peptide
SEEEIRCTNPVATEQYGSVSENLMQRGNR

SEQ ID NO: 5204 - protein, 28 aa, Artificial Sequence
  Description of Artificial Sequence: Synthetic peptide
MEEEIRTTNPVATECYGAVSTNLQHGNR

SEQ ID NO: 5205 - protein, 30 aa, Artificial Sequence
  Description of Artificial Sequence: Synthetic polypeptide
DEEEIRATNPVATEQYGSVSTNLQREPGNN

SEQ ID NO: 5206 - protein, 29 aa, Artificial Sequence
  Description of Artificial Sequence: Synthetic peptide
DEEEIRTTNPVATEQYGSFSTILQRGENE

SEQ ID NO: 5207 - protein, 28 aa, Artificial Sequence
  Description of Artificial Sequence: Synthetic peptide
DEEEIRTTNPVATEQYGSVSVALQLGPR

SEQ ID NO: 5208 - protein, 30 aa, Artificial Sequence
  Description of Artificial Sequence: Synthetic polypeptide
DEEEIRTTNPVATEQYGWVSTNLQTHGNLR

SEQ ID NO: 5209 - protein, 31 aa, Artificial Sequence
  Description of Artificial Sequence: Synthetic polypeptide
DEEEIRTTNPVATEQYGSVSTNVTLQRGGNN

SEQ ID NO: 5210 - protein, 29 aa, Artificial Sequence
  Description of Artificial Sequence: Synthetic peptide
SEEEIRTTNPVATEQYGSVSTNLQLGLNY

SEQ ID NO: 5211 - protein, 29 aa, Artificial Sequence
  Description of Artificial Sequence: Synthetic peptide
SEEEIRTTNPVATEQYGSVSTNLQMGAND

SEQ ID NO: 5212 - protein, 30 aa, Artificial Sequence
  Description of Artificial Sequence: Synthetic polypeptide
DEEEIRTTNPVATEQYGYICSTNELQRGNR

SEQ ID NO: 5213 - protein, 29 aa, Artificial Sequence
  Description of Artificial Sequence: Synthetic peptide
DEEEIRTTNPVATEQYGSVSCENLWRGNL

SEQ ID NO: 5214 - protein, 28 aa, Artificial Sequence
  Description of Artificial Sequence: Synthetic peptide
DEEEIRCTNPVSTEQYGSVSNNLMRGNR

SEQ ID NO: 5215 - protein, 30 aa, Artificial Sequence
  Description of Artificial Sequence: Synthetic polypeptide
DEAEIRTTNPVATEQYGSVSTNLQEGMNER

SEQ ID NO: 5216 - protein, 31 aa, Artificial Sequence
  Description of Artificial Sequence: Synthetic polypeptide
DEEEIRTTNPVATEQYGSVSTNLQGDGDNER

SEQ ID NO: 5217 - protein, 30 aa, Artificial Sequence
  Description of Artificial Sequence: Synthetic polypeptide
DEEEIRTTNPVATEQYGSVSTEQNVQRGNG

SEQ ID NO: 5218 - protein, 29 aa, Artificial Sequence
  Description of Artificial Sequence: Synthetic peptide
MEEEIRTTNPVATEQYGSVSTDLQERGNM

SEQ ID NO: 5219 - protein, 29 aa, Artificial Sequence
  Description of Artificial Sequence: Synthetic peptide
DEEEIRTTNPVATECYGSVSTNLQDAGNA

SEQ ID NO: 5220 - protein, 30 aa, Artificial Sequence
  Description of Artificial Sequence: Synthetic polypeptide
DEETIRTTNPVATEQYGQSVSVNLQRGSNR

SEQ ID NO: 5221 - protein, 31 aa, Artificial Sequence
  Description of Artificial Sequence: Synthetic polypeptide
DEEEIRTTNPVATEQYGSVSTNLQPGNNNRP

SEQ ID NO: 5222 - protein, 30 aa, Artificial Sequence
  Description of Artificial Sequence: Synthetic polypeptide
DEEEIRTTNPVATEQYGSVSMTNDLIRGNQ

SEQ ID NO: 5223 - protein, 28 aa, Artificial Sequence
  Description of Artificial Sequence: Synthetic peptide
DEWEIRTTNPCATEQYGSVSTNSERGNR

SEQ ID NO: 5224 - protein, 29 aa, Artificial Sequence
  Description of Artificial Sequence: Synthetic peptide
DEEEIRTTNPVATEQYGSASENLQHSGNR

SEQ ID NO: 5225 - protein, 31 aa, Artificial Sequence
  Description of Artificial Sequence: Synthetic polypeptide
DEEEIRTTNPVATEQYGSVTSTGNLQRGNGA

SEQ ID NO: 5226 - protein, 28 aa, Artificial Sequence
  Description of Artificial Sequence: Synthetic peptide
QEEEIRCTNPIATEQYGSVSENLQRGNR

SEQ ID NO: 5227 - protein, 30 aa, Artificial Sequence
  Description of Artificial Sequence: Synthetic polypeptide
DEEEIRTTNPVATEQYGSVSDTDLQDGENR

SEQ ID NO: 5228 - protein, 28 aa, Artificial Sequence
  Description of Artificial Sequence: Synthetic peptide
DEEEIRATNPVCTEQYGSVSTNLQSGNA

SEQ ID NO: 5229 - protein, 30 aa, Artificial Sequence
  Description of Artificial Sequence: Synthetic polypeptide
DEEEIRTTNPVATEQYGSVSTGLQRNGNTG

SEQ ID NO: 5230 - protein, 29 aa, Artificial Sequence
  Description of Artificial Sequence: Synthetic peptide
DEEEIRTTNPVATEQYGVVSDNLPQRGNQ

SEQ ID NO: 5231 - protein, 29 aa, Artificial Sequence
  Description of Artificial Sequence: Synthetic peptide
DEEEIRTTNPVATEQYGSVSTDLERIGQR

SEQ ID NO: 5232 - protein, 28 aa, Artificial Sequence
  Description of Artificial Sequence: Synthetic peptide
DEEEISTTNPTATEQYGSVSVNLQRGNN

SEQ ID NO: 5233 - protein, 28 aa, Artificial Sequence
  Description of Artificial Sequence: Synthetic peptide
NEEEIRTTNPVATELYGSVSSNLERGNR

SEQ ID NO: 5234 - protein, 30 aa, Artificial Sequence
  Description of Artificial Sequence: Synthetic polypeptide
DEEEIRTTNPCATEQYGSVSTNLQSEGNRV

SEQ ID NO: 5235 - protein, 31 aa, Artificial Sequence
  Description of Artificial Sequence: Synthetic polypeptide
DEEEIRTTNPVATEQYGSVSTNLEQHGGNPR

SEQ ID NO: 5236 - protein, 31 aa, Artificial Sequence
  Description of Artificial Sequence: Synthetic polypeptide
DEEEIRTTNPVATEQYGSVSTTNLQHRGTDR

SEQ ID NO: 5237 - protein, 28 aa, Artificial Sequence
  Description of Artificial Sequence: Synthetic peptide
SEEEIRTTNPIATEQYGSVSCNLMRGNR

SEQ ID NO: 5238 - protein, 30 aa, Artificial Sequence
  Description of Artificial Sequence: Synthetic polypeptide
DEEEIATTNPVATEQYGSVSTNLQGDGNRN

SEQ ID NO: 5239 - protein, 31 aa, Artificial Sequence
  Description of Artificial Sequence: Synthetic polypeptide
DEEEIRTTNPVATEQYGSVSTNLQRFGNNGD

SEQ ID NO: 5240 - protein, 28 aa, Artificial Sequence
  Description of Artificial Sequence: Synthetic peptide
NEEEIVTTNPVATEQYGSVGMNLQRGNR

SEQ ID NO: 5241 - protein, 30 aa, Artificial Sequence
  Description of Artificial Sequence: Synthetic polypeptide
DEEEIRTTNPFATEQYGSVSTNLTQRGEDR

SEQ ID NO: 5242 - protein, 29 aa, Artificial Sequence
  Description of Artificial Sequence: Synthetic peptide
DEEEIRTTNPVATEQYGSVQTMLQRGINT

SEQ ID NO: 5243 - protein, 30 aa, Artificial Sequence
  Description of Artificial Sequence: Synthetic polypeptide
DEEEIRTTNPVATEQYGSVATTNDQRGNSR

SEQ ID NO: 5244 - protein, 29 aa, Artificial Sequence
  Description of Artificial Sequence: Synthetic peptide
DEEEIRTTNPVATAIYGSVNSTNLSRGNR

SEQ ID NO: 5245 - protein, 30 aa, Artificial Sequence
  Description of Artificial Sequence: Synthetic polypeptide
DEEVIATTNPVATEQYGSVSTNLQRNDGNR

SEQ ID NO: 5246 - protein, 31 aa, Artificial Sequence
  Description of Artificial Sequence: Synthetic polypeptide
DEEEIRTTNPVATEQYGSVSTNLQRFGDNIP

SEQ ID NO: 5247 - protein, 29 aa, Artificial Sequence
  Description of Artificial Sequence: Synthetic peptide
DEETIRTTNPVATEQYGENVSTNLQLGNR

SEQ ID NO: 5248 - protein, 31 aa, Artificial Sequence
  Description of Artificial Sequence: Synthetic polypeptide
DEEEIRTTNPVATEQYGSVSTNLQPGVNERD

SEQ ID NO: 5249 - protein, 30 aa, Artificial Sequence
  Description of Artificial Sequence: Synthetic polypeptide
DEEEIRTTNPVATEQYGSVSCTNGLQRGTF

SEQ ID NO: 5250 - protein, 28 aa, Artificial Sequence
  Description of Artificial Sequence: Synthetic peptide
QEEEIRCTNPVATEQYGSVSENLMRGNR

SEQ ID NO: 5251 - protein, 29 aa, Artificial Sequence
  Description of Artificial Sequence: Synthetic peptide
FEEEIRTTNPVATEQYGSVSTNLVQGGNG

SEQ ID NO: 5252 - protein, 28 aa, Artificial Sequence
  Description of Artificial Sequence: Synthetic peptide
DEEEISTTNPVATECYGDVSTNLQRGNS

SEQ ID NO: 5253 - protein, 28 aa, Artificial Sequence
  Description of Artificial Sequence: Synthetic peptide
DEEEIRTTNPVATECYGSVPTDLQRENR

SEQ ID NO: 5254 - protein, 29 aa, Artificial Sequence
  Description of Artificial Sequence: Synthetic peptide
DEEEIRTTNPVATEQYGSVSTTNLGRNNE

SEQ ID NO: 5255 - protein, 29 aa, Artificial Sequence
  Description of Artificial Sequence: Synthetic peptide
DEEEIRTTNPVATEQYGSVSTTNLLRDNE

SEQ ID NO: 5256 - protein, 30 aa, Artificial Sequence
  Description of Artificial Sequence: Synthetic polypeptide
DEEEIRTTNPVATEQYGSVSTDLQVTGINR

SEQ ID NO: 5257 - protein, 31 aa, Artificial Sequence
  Description of Artificial Sequence: Synthetic polypeptide
DEEEIRTTNPVATEQYGESVESTDLQRGENR

SEQ ID NO: 5258 - protein, 31 aa, Artificial Sequence
  Description of Artificial Sequence: Synthetic polypeptide
DEEEIRTTNPVATEQYGSVSTNLQRENGNGA

SEQ ID NO: 5259 - protein, 29 aa, Artificial Sequence
  Description of Artificial Sequence: Synthetic peptide
DEEEIRTTNPVATEQYGSCSQTELQRVNR

SEQ ID NO: 5260 - protein, 30 aa, Artificial Sequence
  Description of Artificial Sequence: Synthetic polypeptide
DEETIRTTNPVATEQYGYSVSGNLQRGDNR

SEQ ID NO: 5261 - protein, 32 aa, Artificial Sequence
  Description of Artificial Sequence: Synthetic polypeptide
DEEEIRTTNPVATEQYGSVSLTNLQRDGPNRN

SEQ ID NO: 5262 - protein, 28 aa, Artificial Sequence
  Description of Artificial Sequence: Synthetic peptide
DEEEIRTTNPVATEQYGSVSTGQDEGNR

SEQ ID NO: 5263 - protein, 28 aa, Artificial Sequence
  Description of Artificial Sequence: Synthetic peptide
DEVEIRTTNPVCTEQYGSVSANLQRGNS

SEQ ID NO: 5264 - protein, 28 aa, Artificial Sequence
  Description of Artificial Sequence: Synthetic peptide
DEEEIRTTNPVATCFYGSVSTNLQRGVP

SEQ ID NO: 5265 - protein, 30 aa, Artificial Sequence
  Description of Artificial Sequence: Synthetic polypeptide
DEEEIRTTNPVATEQYGSVSTGLQRGNPQA

SEQ ID NO: 5266 - protein, 31 aa, Artificial Sequence
  Description of Artificial Sequence: Synthetic polypeptide
DEEEIRTTNPVATEQYGSVNSTNHQERGNER

SEQ ID NO: 5267 - protein, 28 aa, Artificial Sequence
  Description of Artificial Sequence: Synthetic peptide
SEEEIRTTNPIATEQYGSVSENLERGNR

SEQ ID NO: 5268 - protein, 30 aa, Artificial Sequence
  Description of Artificial Sequence: Synthetic polypeptide
DENEIRTTNPVATEQYGSVSTNLQNEGNAR

SEQ ID NO: 5269 - protein, 28 aa, Artificial Sequence
  Description of Artificial Sequence: Synthetic peptide
DEEEIRTTNPVSTEIYGVVGTNLQRGNR

SEQ ID NO: 5270 - protein, 30 aa, Artificial Sequence
  Description of Artificial Sequence: Synthetic polypeptide
DEEEIRTTNPVATEQYGSHYSTNLQRGLNA

SEQ ID NO: 5271 - protein, 29 aa, Artificial Sequence
  Description of Artificial Sequence: Synthetic peptide
QEEEIRTTNPVSTEQYGSVSATVLQRGNR

SEQ ID NO: 5272 - protein, 28 aa, Artificial Sequence
  Description of Artificial Sequence: Synthetic peptide
DEEEIRCTNPVATEQYGSVDENLQRGLR

SEQ ID NO: 5273 - protein, 29 aa, Artificial Sequence
  Description of Artificial Sequence: Synthetic peptide
DEVEIATTNPVATEQYGSVSTNLQQGDNR

SEQ ID NO: 5274 - protein, 30 aa, Artificial Sequence
  Description of Artificial Sequence: Synthetic polypeptide
DEEEIRTTNPVATEQYGSVSTTNLQFGINP

SEQ ID NO: 5275 - protein, 31 aa, Artificial Sequence
  Description of Artificial Sequence: Synthetic polypeptide
DEEEIRTTNPVATEQYGSVEEDTNLQRGDNR

SEQ ID NO: 5276 - protein, 31 aa, Artificial Sequence
  Description of Artificial Sequence: Synthetic polypeptide
DEEEIRTTNPVATEQYGSVSTTNLQDGLTNR

SEQ ID NO: 5277 - protein, 30 aa, Artificial Sequence
  Description of Artificial Sequence: Synthetic polypeptide
DEEEIRTTNPVATEQYGSVSTNLQLDIGNT

SEQ ID NO: 5278 - protein, 30 aa, Artificial Sequence
  Description of Artificial Sequence: Synthetic polypeptide
DEEEIRTTNPVATEQYGSVATSLQRGNDRL

SEQ ID NO: 5279 - protein, 28 aa, Artificial Sequence
  Description of Artificial Sequence: Synthetic peptide
DEEEISTTNPVATEQYGNVSTNLCDGNR

SEQ ID NO: 5280 - protein, 29 aa, Artificial Sequence
  Description of Artificial Sequence: Synthetic peptide
DEEEIRTTNPVATECYGSVSTNLQLEGER

SEQ ID NO: 5281 - protein, 29 aa, Artificial Sequence
  Description of Artificial Sequence: Synthetic peptide
DEEEIRTTNPVATECYGSVSTNLQMQGNM

SEQ ID NO: 5282 - protein, 31 aa, Artificial Sequence
  Description of Artificial Sequence: Synthetic polypeptide
DEEEIRTTNPVATEQYGSVSTNGDLDRIGNR

SEQ ID NO: 5283 - protein, 29 aa, Artificial Sequence
  Description of Artificial Sequence: Synthetic peptide
DEEEIRTTNPVATECYGSVSTNLQRDGEQ

SEQ ID NO: 5284 - protein, 30 aa, Artificial Sequence
  Description of Artificial Sequence: Synthetic polypeptide
DEEEIRTTNPVAYEQYGSVSTCNLQRGNTF

SEQ ID NO: 5285 - protein, 31 aa, Artificial Sequence
  Description of Artificial Sequence: Synthetic polypeptide
DEHEIRTTNPVATEQYGSVSTNLQRDGDNRI

SEQ ID NO: 5286 - protein, 30 aa, Artificial Sequence
  Description of Artificial Sequence: Synthetic polypeptide
CETEIRTTNPVATEQYGSVSTNGLQERGNR

SEQ ID NO: 5287 - protein, 28 aa, Artificial Sequence
  Description of Artificial Sequence: Synthetic peptide
DEEEIRTTNPVATECYGSVSTNLQVGEC

SEQ ID NO: 5288 - protein, 29 aa, Artificial Sequence
  Description of Artificial Sequence: Synthetic peptide
DEEEIRTTNPVATEQYGSVATNLTRGNTE

SEQ ID NO: 5289 - protein, 28 aa, Artificial Sequence
  Description of Artificial Sequence: Synthetic peptide
DEEEIRCTNPVATEQWGSVSENLMRGNR

SEQ ID NO: 5290 - protein, 28 aa, Artificial Sequence
  Description of Artificial Sequence: Synthetic peptide
DEEEIRTTNPVATEQYGSWSTNDQCGDR

SEQ ID NO: 5291 - protein, 28 aa, Artificial Sequence
  Description of Artificial Sequence: Synthetic peptide
DEEEIKSTNPVATEQYGSVATNLQRGLR

SEQ ID NO: 5292 - protein, 31 aa, Artificial Sequence
  Description of Artificial Sequence: Synthetic polypeptide
DEHEIRTTNPVATEQYGSVSTNLQRGDDNRA

SEQ ID NO: 5293 - protein, 29 aa, Artificial Sequence
  Description of Artificial Sequence: Synthetic peptide
DEEEIRTTNPVATEQYGSVHTNLQQGDNT

SEQ ID NO: 5294 - protein, 28 aa, Artificial Sequence
  Description of Artificial Sequence: Synthetic peptide
DEEEIRTTNPVSTEQYGSVPENEQRGNR

SEQ ID NO: 5295 - protein, 28 aa, Artificial Sequence
  Description of Artificial Sequence: Synthetic peptide
DENEIRTTNPVSTEQWGSVSENLQRGNR

SEQ ID NO: 5296 - protein, 28 aa, Artificial Sequence
  Description of Artificial Sequence: Synthetic peptide
DEEEIRTTNPVATEQYGSVSTNLWDGEN

SEQ ID NO: 5297 - protein, 28 aa, Artificial Sequence
  Description of Artificial Sequence: Synthetic peptide
DEEEIRTTNPVATEQYGSWSTNEQVGNH

SEQ ID NO: 5298 - protein, 30 aa, Artificial Sequence
  Description of Artificial Sequence: Synthetic polypeptide
AEEEIRTTNPVATEQYGSVSTNELQVGNQR

SEQ ID NO: 5299 - protein, 30 aa, Artificial Sequence
  Description of Artificial Sequence: Synthetic polypeptide
DEEEIRTTNPVATEQYGSCESTNLQIGINR

SEQ ID NO: 5300 - protein, 29 aa, Artificial Sequence
  Description of Artificial Sequence: Synthetic peptide
AEEEIRTTNPVATEQYGSVSSTNLQRSNL

SEQ ID NO: 5301 - protein, 30 aa, Artificial Sequence
  Description of Artificial Sequence: Synthetic polypeptide
DEHEIRTTNPVATEQYGSVSTNLQHNGNER

SEQ ID NO: 5302 - protein, 30 aa, Artificial Sequence
  Description of Artificial Sequence: Synthetic polypeptide
DEEEIRTTNPVATEHYGSVSTNLSTRGVNR

SEQ ID NO: 5303 - protein, 30 aa, Artificial Sequence
  Description of Artificial Sequence: Synthetic polypeptide
DEEEIRTTNPVATEQYGSVSYMILQRGENR

SEQ ID NO: 5304 - protein, 29 aa, Artificial Sequence
  Description of Artificial Sequence: Synthetic peptide
DEEEIRTTNPVATEQYGSVSATPLCLGNR

SEQ ID NO: 5305 - protein, 30 aa, Artificial Sequence
  Description of Artificial Sequence: Synthetic polypeptide
DEEEIRTTNPVATEQYGSVDSTNLQDGDND

SEQ ID NO: 5306 - protein, 28 aa, Artificial Sequence
  Description of Artificial Sequence: Synthetic peptide
DEEEIRCTNPVATEQYGAASTNDQRGNR

SEQ ID NO: 5307 - protein, 31 aa, Artificial Sequence
  Description of Artificial Sequence: Synthetic polypeptide
DEEEIRTTNPVATEQYGSVSTNLEQIGSNRA

SEQ ID NO: 5308 - protein, 28 aa, Artificial Sequence
  Description of Artificial Sequence: Synthetic peptide
DEEEIRTTNPEATEQYGSVSTNDQVGER

SEQ ID NO: 5309 - protein, 31 aa, Artificial Sequence
  Description of Artificial Sequence: Synthetic polypeptide
DEHEIRTTNPVATEQYGSVSTNLQRGDINRQ

SEQ ID NO: 5310 - protein, 30 aa, Artificial Sequence
  Description of Artificial Sequence: Synthetic polypeptide
DEEEIRTTNPVATEQYGSVSVNLLTRGNDR

SEQ ID NO: 5311 - protein, 30 aa, Artificial Sequence
  Description of Artificial Sequence: Synthetic polypeptide
DEEEIRTTNPVATEQYGSVSMDLQRTGVNR

SEQ ID NO: 5312 - protein, 28 aa, Artificial Sequence
  Description of Artificial Sequence: Synthetic peptide
DEEEIRTTNPVATEQYGSVSTDLERENN

SEQ ID NO: 5313 - protein, 28 aa, Artificial Sequence
  Description of Artificial Sequence: Synthetic peptide
SEEEIRTTNPIATEQYGSVSCNEQRGNR

SEQ ID NO: 5314 - protein, 30 aa, Artificial Sequence
  Description of Artificial Sequence: Synthetic polypeptide
DEEEIRTTNPVATEQYGSVSVNLIRGENRN

SEQ ID NO: 5315 - protein, 28 aa, Artificial Sequence
  Description of Artificial Sequence: Synthetic peptide
QEEEISTTNPVATEQYGWVSTVLQRGNR

SEQ ID NO: 5316 - protein, 30 aa, Artificial Sequence
  Description of Artificial Sequence: Synthetic polypeptide
DEEEIRTTNPVATEQYGSVSVSTNLQRDNE

SEQ ID NO: 5317 - protein, 29 aa, Artificial Sequence
  Description of Artificial Sequence: Synthetic peptide
DEEEIRTTNPVATEQYGSVATNQQRVGNA

SEQ ID NO: 5318 - protein, 28 aa, Artificial Sequence
  Description of Artificial Sequence: Synthetic peptide
QEEEIVTTNPVATEQYGSVSTNLQTGNV

SEQ ID NO: 5319 - protein, 29 aa, Artificial Sequence
  Description of Artificial Sequence: Synthetic peptide
DEEEIRTTNPVATECYGSVSTDLQEHGNR

SEQ ID NO: 5320 - protein, 30 aa, Artificial Sequence
  Description of Artificial Sequence: Synthetic polypeptide
DEEEIRTTNPVAYEQYGSVSTNLQSEGNPR

SEQ ID NO: 5321 - protein, 28 aa, Artificial Sequence
  Description of Artificial Sequence: Synthetic peptide
DEEEIRTTNPVATECYGSVSTDLQRGEH

SEQ ID NO: 5322 - protein, 30 aa, Artificial Sequence
  Description of Artificial Sequence: Synthetic polypeptide
DEEEIRTTNPVATEQYGSVTISTNLQGGND

SEQ ID NO: 5323 - protein, 28 aa, Artificial Sequence
  Description of Artificial Sequence: Synthetic peptide
DEEEIRTTNPVATECYGSVSTELEDGNR

SEQ ID NO: 5324 - protein, 29 aa, Artificial Sequence
  Description of Artificial Sequence: Synthetic peptide
DEEEIRCTNPVATEQYGSVSCNLPMRGNR

SEQ ID NO: 5325 - protein, 28 aa, Artificial Sequence
  Description of Artificial Sequence: Synthetic peptide
DEEEIRTTNPVATECYGSVSTNEQIGNA

SEQ ID NO: 5326 - protein, 30 aa, Artificial Sequence
  Description of Artificial Sequence: Synthetic polypeptide
DEEEIRTTNPVAYEQYGSVSTNLQQPGNDR

SEQ ID NO: 5327 - protein, 32 aa, Artificial Sequence
  Description of Artificial Sequence: Synthetic polypeptide
DEEEIRTTNPVATEQYGSVDSTMNLQRGNEGR

SEQ ID NO: 5328 - protein, 31 aa, Artificial Sequence
  Description of Artificial Sequence: Synthetic polypeptide
DEEEIRTTNPVATEQYGSVSTQNLQTGVNER

SEQ ID NO: 5329 - protein, 28 aa, Artificial Sequence
  Description of Artificial Sequence: Synthetic peptide
DEEEIRSTNPVSTEQYGCVATNLQRGNR

SEQ ID NO: 5330 - protein, 30 aa, Artificial Sequence
  Description of Artificial Sequence: Synthetic polypeptide
DEEEIRTTNPVATEQYGSVSTQNLQTDGNT

SEQ ID NO: 5331 - protein, 28 aa, Artificial Sequence
  Description of Artificial Sequence: Synthetic peptide
SEEEIRTTNPVATEIYGSVATNLQRGNF

SEQ ID NO: 5332 - protein, 31 aa, Artificial Sequence
  Description of Artificial Sequence: Synthetic polypeptide
DEEEIRTTNPVATEQYGSVSPVTNLQRGDRL

SEQ ID NO: 5333 - protein, 29 aa, Artificial Sequence
  Description of Artificial Sequence: Synthetic peptide
DEHEIRTTNPVATEQYGSVSTNLQSGGNT

SEQ ID NO: 5334 - protein, 28 aa, Artificial Sequence
  Description of Artificial Sequence: Synthetic peptide
DEEEIRTTNPVASENYGSVCTNLERGNR

SEQ ID NO: 5335 - protein, 28 aa, Artificial Sequence
  Description of Artificial Sequence: Synthetic peptide
DEEEIRTTNPVASENYGNVSTNLQRGNQ

SEQ ID NO: 5336 - protein, 30 aa, Artificial Sequence
  Description of Artificial Sequence: Synthetic polypeptide
AEEEIRTTNPVATEQYGSVSATNLQRGNDE

SEQ ID NO: 5337 - protein, 30 aa, Artificial Sequence
  Description of Artificial Sequence: Synthetic polypeptide
DEEEIRTTNPVATEQYGSVSNTTLQRGNEI

SEQ ID NO: 5338 - protein, 31 aa, Artificial Sequence
  Description of Artificial Sequence: Synthetic polypeptide
DEEEIRTTNPVATEQYGSWSDTNLVQREGNR

SEQ ID NO: 5339 - protein, 30 aa, Artificial Sequence
  Description of Artificial Sequence: Synthetic polypeptide
AEEEIRTTNPVATEQYGSVSNTNELQRGNA

SEQ ID NO: 5340 - protein, 30 aa, Artificial Sequence
  Description of Artificial Sequence: Synthetic polypeptide
DEEEIRTTNPVATEQYGSVQTNLQRGLVNI

SEQ ID NO: 5341 - protein, 30 aa, Artificial Sequence
  Description of Artificial Sequence: Synthetic polypeptide
AEEEIRTTNPVATEQYGSVSTTNLQDGNRE

SEQ ID NO: 5342 - protein, 29 aa, Artificial Sequence
  Description of Artificial Sequence: Synthetic peptide
DEEEIRTTNPVATEQYGDVSENLQCYGNR

SEQ ID NO: 5343 - protein, 30 aa, Artificial Sequence
  Description of Artificial Sequence: Synthetic polypeptide
DEEEIRTTNPVATEQYGSVSTTESQRGSNR

SEQ ID NO: 5344 - protein, 31 aa, Artificial Sequence
  Description of Artificial Sequence: Synthetic polypeptide
DEEEIRTTNPVATEQYGSVSTTENLDREGNR

SEQ ID NO: 5345 - protein, 28 aa, Artificial Sequence
  Description of Artificial Sequence: Synthetic peptide
SESEIRCTNPVATEQYGSVSCNLQRGNR

SEQ ID NO: 5346 - protein, 30 aa, Artificial Sequence
  Description of Artificial Sequence: Synthetic polypeptide
DEEEIRTTNPVATEQYGTVSWTNLERGMNR

SEQ ID NO: 5347 - protein, 28 aa, Artificial Sequence
  Description of Artificial Sequence: Synthetic peptide
DENEIRTTNPVATEQWGSVSTNEQRGNA

SEQ ID NO: 5348 - protein, 28 aa, Artificial Sequence
  Description of Artificial Sequence: Synthetic peptide
DENEIRTTNPVATEQWGSVSTNLQQGNA

SEQ ID NO: 5349 - protein, 30 aa, Artificial Sequence
  Description of Artificial Sequence: Synthetic polypeptide
DEEEIMTTNPVATEQYGSVSTNDPQREGNR

SEQ ID NO: 5350 - protein, 30 aa, Artificial Sequence
  Description of Artificial Sequence: Synthetic polypeptide
DEEEIRTTNPVATEQWGSVSTNLQDRGENG

SEQ ID NO: 5351 - protein, 28 aa, Artificial Sequence
  Description of Artificial Sequence: Synthetic peptide
DEEEIRTTNPVATEQYGDVSENLQHGNA

SEQ ID NO: 5352 - protein, 28 aa, Artificial Sequence
  Description of Artificial Sequence: Synthetic peptide
DEEEIRTTNPVATEQYGSVSTNLEAGEQ

SEQ ID NO: 5353 - protein, 30 aa, Artificial Sequence
  Description of Artificial Sequence: Synthetic polypeptide
QEEEIRTTNPVATEQYGSVSTNLQRVGNDY

SEQ ID NO: 5354 - protein, 28 aa, Artificial Sequence
  Description of Artificial Sequence: Synthetic peptide
DEEEIRTTNPVATEQYGSVSEDLQIGNM

SEQ ID NO: 5355 - protein, 30 aa, Artificial Sequence
  Description of Artificial Sequence: Synthetic polypeptide
DEEEIRTTNPVATEQYGSVSTNEQREGNTQ

SEQ ID NO: 5356 - protein, 30 aa, Artificial Sequence
  Description of Artificial Sequence: Synthetic polypeptide
DEEEIRTTNPVATEQYGSVSTNLQQGNNNA

SEQ ID NO: 5357 - protein, 31 aa, Artificial Sequence
  Description of Artificial Sequence: Synthetic polypeptide
DEEEIRTTNPVATEQYGSVNSTTNLQRGNIN

SEQ ID NO: 5358 - protein, 30 aa, Artificial Sequence
  Description of Artificial Sequence: Synthetic polypeptide
DEEEIRTTNPVATEQYGSVSTNLQIGMNNQ

SEQ ID NO: 5359 - protein, 30 aa, Artificial Sequence
  Description of Artificial Sequence: Synthetic polypeptide
DEEEIRTTNPVATEQYGSVNSTNLQRMMNG

SEQ ID NO: 5360 - protein, 28 aa, Artificial Sequence
  Description of Artificial Sequence: Synthetic peptide
DEEEIRCTNPIATEQYGSVSENLMRGNR

SEQ ID NO: 5361 - protein, 29 aa, Artificial Sequence
  Description of Artificial Sequence: Synthetic peptide
DEEEIRTTNPEATEQYGSVSTDLQRGDNY

SEQ ID NO: 5362 - protein, 28 aa, Artificial Sequence
  Description of Artificial Sequence: Synthetic peptide
DEEEIRCTNPIATEQYGSVSENLNRGNR

SEQ ID NO: 5363 - protein, 28 aa, Artificial Sequence
  Description of Artificial Sequence: Synthetic peptide
SEEEIRTTNPIATEQYGSVSENLMRGNR

SEQ ID NO: 5364 - protein, 30 aa, Artificial Sequence
  Description of Artificial Sequence: Synthetic polypeptide
DEEEIRTTNPVATEQYGSVSATNLQFNGTR

SEQ ID NO: 5365 - protein, 31 aa, Artificial Sequence
  Description of Artificial Sequence: Synthetic polypeptide
DEEEIRTTNPVATEQYGSVSTGNLQRGNEEG

SEQ ID NO: 5366 - protein, 29 aa, Artificial Sequence
  Description of Artificial Sequence: Synthetic peptide
DEEEIRTTNPVATEQYGSVSEANLQSGNS

SEQ ID NO: 5367 - protein, 28 aa, Artificial Sequence
  Description of Artificial Sequence: Synthetic peptide
DEEEIRTTNPVATEQWGSVDTNDERGNR

SEQ ID NO: 5368 - protein, 28 aa, Artificial Sequence
  Description of Artificial Sequence: Synthetic peptide
DEEEIRTTNPVGTEQYGNVSENLQRGNA

SEQ ID NO: 5369 - protein, 28 aa, Artificial Sequence
  Description of Artificial Sequence: Synthetic peptide
DEEEIRTTNPVATEQYGDVSENLCRGNA

SEQ ID NO: 5370 - protein, 29 aa, Artificial Sequence
  Description of Artificial Sequence: Synthetic peptide
QEEEIRTTNPVATEQYGEVSADNLQRGNR

SEQ ID NO: 5371 - protein, 28 aa, Artificial Sequence
  Description of Artificial Sequence: Synthetic peptide
DEEEIRSVNPVATEQYGSVSTNLQLGGR

SEQ ID NO: 5372 - protein, 29 aa, Artificial Sequence
  Description of Artificial Sequence: Synthetic peptide
DEEEIRTTNPVATEQYGTVSTNLQGGGNP

SEQ ID NO: 5373 - protein, 30 aa, Artificial Sequence
  Description of Artificial Sequence: Synthetic polypeptide
DEEEIRTTNPVATEQYGSVSTMLQHEGMNR

SEQ ID NO: 5374 - protein, 30 aa, Artificial Sequence
  Description of Artificial Sequence: Synthetic polypeptide
DEEEIRTTNPVATEQYGSVSTNLLQNGINQ

SEQ ID NO: 5375 - protein, 30 aa, Artificial Sequence
  Description of Artificial Sequence: Synthetic polypeptide
DEEEIRTTNPVATEQYGSVSANLQTRGDNL

SEQ ID NO: 5376 - protein, 29 aa, Artificial Sequence
  Description of Artificial Sequence: Synthetic peptide
AEEEIRTTNPVATEQYGSVSTTNLNRGNY

SEQ ID NO: 5377 - protein, 30 aa, Artificial Sequence
  Description of Artificial Sequence: Synthetic polypeptide
DEEEIRTTNPVATEQYGSVYTSNLQEGNER

SEQ ID NO: 5378 - protein, 31 aa, Artificial Sequence
  Description of Artificial Sequence: Synthetic polypeptide
DEEEIRTTNPVATEQYGSVSTNLEERNGNDR

SEQ ID NO: 5379 - protein, 28 aa, Artificial Sequence
  Description of Artificial Sequence: Synthetic peptide
DEEEIRTTNPVATEQWGSVSTNEMRGNA

SEQ ID NO: 5380 - protein, 29 aa, Artificial Sequence
  Description of Artificial Sequence: Synthetic peptide
DEEEIRTTNPVATEQWGSVSTNEQIRGNS

SEQ ID NO: 5381 - protein, 29 aa, Artificial Sequence
  Description of Artificial Sequence: Synthetic peptide
DENEIRTTNPVATECYGSVSTNLQRGNDM

SEQ ID NO: 5382 - protein, 30 aa, Artificial Sequence
  Description of Artificial Sequence: Synthetic polypeptide
DEEEIRTTNPVATEQYGSVSTDLQQRAGNA

SEQ ID NO: 5383 - protein, 30 aa, Artificial Sequence
  Description of Artificial Sequence: Synthetic polypeptide
DEEEIRTTNPVATEQYGTVSTNLQRGQINE

SEQ ID NO: 5384 - protein, 29 aa, Artificial Sequence
  Description of Artificial Sequence: Synthetic peptide
DEEEIRTTNPFATEQYGSVATANLQRGNL

SEQ ID NO: 5385 - protein, 30 aa, Artificial Sequence
  Description of Artificial Sequence: Synthetic polypeptide
EEEEIRTTNPVATEQYGSVSTNLQERANLR

SEQ ID NO: 5386 - protein, 31 aa, Artificial Sequence
  Description of Artificial Sequence: Synthetic polypeptide
DEEEIRTTNPVATEQYGSVSNNLQRGNLLRI

SEQ ID NO: 5387 - protein, 29 aa, Artificial Sequence
  Description of Artificial Sequence: Synthetic peptide
SEEEIRTTNPIATEQYGSVSENLQQRGNR

SEQ ID NO: 5388 - protein, 30 aa, Artificial Sequence
  Description of Artificial Sequence: Synthetic polypeptide
DEEEIRTTNPVATEQYGTVSTNLQRNMGND

SEQ ID NO: 5389 - protein, 28 aa, Artificial Sequence
  Description of Artificial Sequence: Synthetic peptide
AEEEIRCTNPVATEQYGSVSENLMRGNR

SEQ ID NO: 5390 - protein, 31 aa, Artificial Sequence
  Description of Artificial Sequence: Synthetic polypeptide
DEEEIRTTNPVATEQYGSVCNTNLQRMGENR

SEQ ID NO: 5391 - protein, 30 aa, Artificial Sequence
  Description of Artificial Sequence: Synthetic polypeptide
DEEEIRTTNPVATEQYGDVSENLQCRGNDR

SEQ ID NO: 5392 - protein, 28 aa, Artificial Sequence
  Description of Artificial Sequence: Synthetic peptide
SDEEIRTTNPVATEQYGSVATNLQRGER

SEQ ID NO: 5393 - protein, 31 aa, Artificial Sequence
  Description of Artificial Sequence: Synthetic polypeptide
DEEEIRTTNPVATEQYGSVSTNLQIPGNTRD

SEQ ID NO: 5394 - protein, 30 aa, Artificial Sequence
  Description of Artificial Sequence: Synthetic polypeptide
DEEEIRTTNPVATEQYGSIVSTNQQRGENM

SEQ ID NO: 5395 - protein, 28 aa, Artificial Sequence
  Description of Artificial Sequence: Synthetic peptide
DEEEIRTTNPVGTEQYGSLSENLQRFNR

SEQ ID NO: 5396 - protein, 28 aa, Artificial Sequence
  Description of Artificial Sequence: Synthetic peptide
SEEEIRTTNPIATEQYGSVSENLQRGNK

SEQ ID NO: 5397 - protein, 29 aa, Artificial Sequence
  Description of Artificial Sequence: Synthetic peptide
AEEEIRTTNPVATEQYGSVSGTNLQEGNI

SEQ ID NO: 5398 - protein, 30 aa, Artificial Sequence
  Description of Artificial Sequence: Synthetic polypeptide
DEEEIRTTNPVATEQYGVAISTNELQRGNR

SEQ ID NO: 5399 - protein, 30 aa, Artificial Sequence
  Description of Artificial Sequence: Synthetic polypeptide
DEEEIATTNPVATEQYGSVSTNLQQSGDNR

SEQ ID NO: 5400 - protein, 30 aa, Artificial Sequence
  Description of Artificial Sequence: Synthetic polypeptide
QEEEIRTTNPVATEQYGSVSTANLQRGGNT

SEQ ID NO: 5401 - protein, 29 aa, Artificial Sequence
  Description of Artificial Sequence: Synthetic peptide
DEEEIRTTNPVATEQWGSVSTNLQMQGNF

SEQ ID NO: 5402 - protein, 28 aa, Artificial Sequence
  Description of Artificial Sequence: Synthetic peptide
DENEIRTTNPVATEQYGSVSTELERGNW

SEQ ID NO: 5403 - protein, 31 aa, Artificial Sequence
  Description of Artificial Sequence: Synthetic polypeptide
DEEEIRTTNPVATEQYGSVSTNDLQRGDNDV

SEQ ID NO: 5404 - protein, 31 aa, Artificial Sequence
  Description of Artificial Sequence: Synthetic polypeptide
DEEEIRTTNPVATEQYGSVSTNLNQQDGNFR

SEQ ID NO: 5405 - protein, 30 aa, Artificial Sequence
  Description of Artificial Sequence: Synthetic polypeptide
DEEEIRTTNPVATEQYGSVSNTPLQRINER

SEQ ID NO: 5406 - protein, 29 aa, Artificial Sequence
  Description of Artificial Sequence: Synthetic peptide
SEEEIRTTNPIATEQYGSVSENLMQRGNR

SEQ ID NO: 5407 - protein, 30 aa, Artificial Sequence
  Description of Artificial Sequence: Synthetic polypeptide
DEEEIRTTNPVATEQYGVTISTNTLQRGNR

SEQ ID NO: 5408 - protein, 30 aa, Artificial Sequence
  Description of Artificial Sequence: Synthetic polypeptide
NEEEICTTNPVATEQYGSVSTNLQRGENRE

SEQ ID NO: 5409 - protein, 30 aa, Artificial Sequence
  Description of Artificial Sequence: Synthetic polypeptide
DEETIRTTNPVATEQYGSVSTNLQFNGQNR

SEQ ID NO: 5410 - protein, 31 aa, Artificial Sequence
  Description of Artificial Sequence: Synthetic polypeptide
DEEEIRTTNPVATEQYGSVSTNDLQRGNNVV

SEQ ID NO: 5411 - protein, 30 aa, Artificial Sequence
  Description of Artificial Sequence: Synthetic polypeptide
DEEEIRTTNPVATEQYGSVYTNLQRGIINN

SEQ ID NO: 5412 - protein, 31 aa, Artificial Sequence
  Description of Artificial Sequence: Synthetic polypeptide
DEEEIRTTNPVATEQYGSVSTSNLQEGSNRA

SEQ ID NO: 5413 - protein, 28 aa, Artificial Sequence
  Description of Artificial Sequence: Synthetic peptide
AEEEIATTNPVATEQYGSVSTNQQRGER

SEQ ID NO: 5414 - protein, 32 aa, Artificial Sequence
  Description of Artificial Sequence: Synthetic polypeptide
DEEEIRTTNPVATEQYGSVSTTNGLQRGNMMR

SEQ ID NO: 5415 - protein, 31 aa, Artificial Sequence
  Description of Artificial Sequence: Synthetic polypeptide
DEEEIRTTNPVATEQYGSVSDTHLSQRVGNR

SEQ ID NO: 5416 - protein, 30 aa, Artificial Sequence
  Description of Artificial Sequence: Synthetic polypeptide
DEETIRTTNPVATEQYGVSVSNNLQRGDNR

SEQ ID NO: 5417 - protein, 31 aa, Artificial Sequence
  Description of Artificial Sequence: Synthetic polypeptide
DEEEIRTTNPVATEQYGSVSTNLLQRGFNDQ

SEQ ID NO: 5418 - protein, 30 aa, Artificial Sequence
  Description of Artificial Sequence: Synthetic polypeptide
DEEEIRTTNPVATEQYGTTVSTNLLQRGNE

SEQ ID NO: 5419 - protein, 28 aa, Artificial Sequence
  Description of Artificial Sequence: Synthetic peptide
DEEEISTTNPVATEMYGDVSTNLQRGNS

SEQ ID NO: 5420 - protein, 28 aa, Artificial Sequence
  Description of Artificial Sequence: Synthetic peptide
DEEEIRSTNPVATEQYGSVSESLQNGNR

SEQ ID NO: 5421 - protein, 28 aa, Artificial Sequence
  Description of Artificial Sequence: Synthetic peptide
DEVEIRTTNPVATEQYGQVSEILQRGNR

SEQ ID NO: 5422 - protein, 28 aa, Artificial Sequence
  Description of Artificial Sequence: Synthetic peptide
SEEEIATTNPVATEQYGDVSENLQRGNR

SEQ ID NO: 5423 - protein, 28 aa, Artificial Sequence
  Description of Artificial Sequence: Synthetic peptide
AEEEIRTTNPVATEQYGSVSGTNQRGNN

SEQ ID NO: 5424 - protein, 30 aa, Artificial Sequence
  Description of Artificial Sequence: Synthetic polypeptide
DEEEIRTTNPVATEQYGTTNSTNELQRGNR

SEQ ID NO: 5425 - protein, 28 aa, Artificial Sequence
  Description of Artificial Sequence: Synthetic peptide
QEEEIRCTNPVATEQYGSVSENLQRENR

SEQ ID NO: 5426 - protein, 31 aa, Artificial Sequence
  Description of Artificial Sequence: Synthetic polypeptide
DEEEIRTTNPVATEQYGSVSTNMLSQRPGNP

SEQ ID NO: 5427 - protein, 31 aa, Artificial Sequence
  Description of Artificial Sequence: Synthetic polypeptide
DEEEIRTTNPVATEQYGSVSVNNLQREGQNR

SEQ ID NO: 5428 - protein, 30 aa, Artificial Sequence
  Description of Artificial Sequence: Synthetic polypeptide
AEEEIRTTNPVATEQYGSVSTTNLQGGGNR

SEQ ID NO: 5429 - protein, 30 aa, Artificial Sequence
  Description of Artificial Sequence: Synthetic polypeptide
DEEEIRTTNPVATEQYGSVYTTNLQAGNDR

SEQ ID NO: 5430 - protein, 30 aa, Artificial Sequence
  Description of Artificial Sequence: Synthetic polypeptide
DEDEIRTTNPVATEQYGSVSTNLDRGNDSR

SEQ ID NO: 5431 - protein, 30 aa, Artificial Sequence
  Description of Artificial Sequence: Synthetic polypeptide
DEEEIRTTNPVATEQYGSVSTSNNLQRENI

SEQ ID NO: 5432 - protein, 31 aa, Artificial Sequence
  Description of Artificial Sequence: Synthetic polypeptide
DEEEIRTTNPVATEQYGSVCFTNLQARNGNR

SEQ ID NO: 5433 - protein, 31 aa, Artificial Sequence
  Description of Artificial Sequence: Synthetic polypeptide
DEEEIRTTNPVATEQYGSVSTNLQRDGNTEA

SEQ ID NO: 5434 - protein, 28 aa, Artificial Sequence
  Description of Artificial Sequence: Synthetic peptide
AEEEIRCTNPIATEQYGSVSENLQRGNR

SEQ ID NO: 5435 - protein, 28 aa, Artificial Sequence
  Description of Artificial Sequence: Synthetic peptide
DEEEIRTTNPFATEQYGSVSENLQRGED

SEQ ID NO: 5436 - protein, 30 aa, Artificial Sequence
  Description of Artificial Sequence: Synthetic polypeptide
DEEEIRCTNPEATEQYGSVISTNGLQRGNR

SEQ ID NO: 5437 - protein, 30 aa, Artificial Sequence
  Description of Artificial Sequence: Synthetic polypeptide
DEEDIRTTNPVATEQYGSVSTNLQDNGVNR

SEQ ID NO: 5438 - protein, 28 aa, Artificial Sequence
  Description of Artificial Sequence: Synthetic peptide
DENEIRTTNPVATEQYGSVSENLQQGDR

SEQ ID NO: 5439 - protein, 30 aa, Artificial Sequence
  Description of Artificial Sequence: Synthetic polypeptide
DEDEIRTTNPVATEQYGSVSTNLDRGNENR

SEQ ID NO: 5440 - protein, 30 aa, Artificial Sequence
  Description of Artificial Sequence: Synthetic polypeptide
DEEEIRTTNPVATEQYGSVSTDLQGEGNER

SEQ ID NO: 5441 - protein, 30 aa, Artificial Sequence
  Description of Artificial Sequence: Synthetic polypeptide
DEEEIRTTNPVATEQYGSVSTVLQRNGNEQ

SEQ ID NO: 5442 - protein, 30 aa, Artificial Sequence
  Description of Artificial Sequence: Synthetic polypeptide
DEEEIRTTNPVATEQYGSVSDTNLEREENR

SEQ ID NO: 5443 - protein, 28 aa, Artificial Sequence
  Description of Artificial Sequence: Synthetic peptide
QEQEISTTNPVATEQYGWVSTNLQRGNR

SEQ ID NO: 5444 - protein, 29 aa, Artificial Sequence
  Description of Artificial Sequence: Synthetic peptide
DEETIRTTNPVATEQYGTTVSTNLQMGNR

SEQ ID NO: 5445 - protein, 30 aa, Artificial Sequence
  Description of Artificial Sequence: Synthetic polypeptide
DEEEIRTTNPVATEQYGSVSTSNLQLSGNL

SEQ ID NO: 5446 - protein, 29 aa, Artificial Sequence
  Description of Artificial Sequence: Synthetic peptide
AEEEIRTTNPVATEQYGSVSTELQQGNQR

SEQ ID NO: 5447 - protein, 29 aa, Artificial Sequence
  Description of Artificial Sequence: Synthetic peptide
DEEEIRTTNPVATEQYGSVSTFNLTRNNE

SEQ ID NO: 5448 - protein, 29 aa, Artificial Sequence
  Description of Artificial Sequence: Synthetic peptide
DEEEIRTTNPVCTEHYGSVSVTNLQRGNE

SEQ ID NO: 5449 - protein, 30 aa, Artificial Sequence
  Description of Artificial Sequence: Synthetic polypeptide
DEEEIRTTNPVATEQYGTVSSTNLNRGENR

SEQ ID NO: 5450 - protein, 30 aa, Artificial Sequence
  Description of Artificial Sequence: Synthetic polypeptide
DEEEIRTTNPVATEQYGSVSTDLQRVGGNE

SEQ ID NO: 5451 - protein, 28 aa, Artificial Sequence
  Description of Artificial Sequence: Synthetic peptide
DEEEIRCTNPIATEQYGSVSNNLMRGNR

SEQ ID NO: 5452 - protein, 30 aa, Artificial Sequence
  Description of Artificial Sequence: Synthetic polypeptide
DEEEIRTTNPVATEQYGSVSTDLQENEGNR

SEQ ID NO: 5453 - protein, 28 aa, Artificial Sequence
  Description of Artificial Sequence: Synthetic peptide
DEEEIRTTNPVATEQYGDVSENQQVGNR

SEQ ID NO: 5454 - protein, 30 aa, Artificial Sequence
  Description of Artificial Sequence: Synthetic polypeptide
DEEEIATTNPVATEQYGSVSTNLQMGGENR

SEQ ID NO: 5455 - protein, 28 aa, Artificial Sequence
  Description of Artificial Sequence: Synthetic peptide
DEQEIATTNPVATEQYGSVSTNVQRGGR

SEQ ID NO: 5456 - protein, 30 aa, Artificial Sequence
  Description of Artificial Sequence: Synthetic polypeptide
DEEEIRTTNPVATEQYGSVYTNLQRGQNDV

SEQ ID NO: 5457 - protein, 29 aa, Artificial Sequence
  Description of Artificial Sequence: Synthetic peptide
DEEEIRTTNPVATEQYGSVATNLQRNGEG

SEQ ID NO: 5458 - protein, 30 aa, Artificial Sequence
  Description of Artificial Sequence: Synthetic polypeptide
DEEEIRTTNPVATEQYGSVSTTLQRDVGVR

SEQ ID NO: 5459 - protein, 31 aa, Artificial Sequence
  Description of Artificial Sequence: Synthetic polypeptide
DEEEIRTTNPVATEQYGSVTSTNLIQQAGNR

SEQ ID NO: 5460 - protein, 28 aa, Artificial Sequence
  Description of Artificial Sequence: Synthetic peptide
DEEEIRTVNPVATEQYGVMSTNLQRGDR

SEQ ID NO: 5461 - protein, 30 aa, Artificial Sequence
  Description of Artificial Sequence: Synthetic polypeptide
DEHEIRTTNPVATEQYGSVSTDNLQRGNNA

SEQ ID NO: 5462 - protein, 30 aa, Artificial Sequence
  Description of Artificial Sequence: Synthetic polypeptide
DEEEIRTTNPVATEQYGSASTTNLQRGINN

SEQ ID NO: 5463 - protein, 28 aa, Artificial Sequence
  Description of Artificial Sequence: Synthetic peptide
DEMEIRTTNPVATEQYGGVSTNLQGGNI

SEQ ID NO: 5464 - protein, 30 aa, Artificial Sequence
  Description of Artificial Sequence: Synthetic polypeptide
DEEEIRTTNPVATEQYGSVSTNLVNQGGNT

SEQ ID NO: 5465 - protein, 28 aa, Artificial Sequence
  Description of Artificial Sequence: Synthetic peptide
DEEEIRTTNPVATEQYGSVSTNLCHGDS

SEQ ID NO: 5466 - protein, 28 aa, Artificial Sequence
  Description of Artificial Sequence: Synthetic peptide
DEEEIATTNPVCTEQYGSVSTDLQRGDR

SEQ ID NO: 5467 - protein, 30 aa, Artificial Sequence
  Description of Artificial Sequence: Synthetic polypeptide
DEEEIRTTNPCATEQYGSVSATNLQRGNTA

SEQ ID NO: 5468 - protein, 30 aa, Artificial Sequence
  Description of Artificial Sequence: Synthetic polypeptide
DEEEIRTTNPVATEQYGSVATNLPEQRGQR

SEQ ID NO: 5469 - protein, 29 aa, Artificial Sequence
  Description of Artificial Sequence: Synthetic peptide
DEHEIRTTNPVATEQYGSVSTALQHGNER

SEQ ID NO: 5470 - protein, 28 aa, Artificial Sequence
  Description of Artificial Sequence: Synthetic peptide
DEQEIACTNPVATEQYGWVSTNLQRGNR

SEQ ID NO: 5471 - protein, 30 aa, Artificial Sequence
  Description of Artificial Sequence: Synthetic polypeptide
DEEEIRTTNPVATEQYGEVSNTNLNRGINR

SEQ ID NO: 5472 - protein, 32 aa, Artificial Sequence
  Description of Artificial Sequence: Synthetic polypeptide
DEEEIRTTNPVATEQYGSVSTMNLQRPVGNRQ

SEQ ID NO: 5473 - protein, 29 aa, Artificial Sequence
  Description of Artificial Sequence: Synthetic peptide
DEEEIRTTNPVATEQYGSVSTTPQRGEND

SEQ ID NO: 5474 - protein, 28 aa, Artificial Sequence
  Description of Artificial Sequence: Synthetic peptide
DEEEIRTTNPVATEQYGSVDTNEQREDR

SEQ ID NO: 5475 - protein, 31 aa, Artificial Sequence
  Description of Artificial Sequence: Synthetic polypeptide
DEEEIRTTNPVATEQYGSVSTNDGLDRGNNR

SEQ ID NO: 5476 - protein, 31 aa, Artificial Sequence
  Description of Artificial Sequence: Synthetic polypeptide
DEEEIRTTNPVATEQYGSVSTNLQRGNGNGA

SEQ ID NO: 5477 - protein, 28 aa, Artificial Sequence
  Description of Artificial Sequence: Synthetic peptide
DEEEIATTNPVSTEQYGSASTNLQHGNR

SEQ ID NO: 5478 - protein, 28 aa, Artificial Sequence
  Description of Artificial Sequence: Synthetic peptide
VEEEIRTTNPVATEQYGSVSTDLQVGNH

SEQ ID NO: 5479 - protein, 28 aa, Artificial Sequence
  Description of Artificial Sequence: Synthetic peptide
DEEEIRTTNPVATELYGSVSTNLQFGLL

SEQ ID NO: 5480 - protein, 30 aa, Artificial Sequence
  Description of Artificial Sequence: Synthetic polypeptide
DEEEIRTTNPVATEQYGSVSNADLQRGENR

SEQ ID NO: 5481 - protein, 28 aa, Artificial Sequence
  Description of Artificial Sequence: Synthetic peptide
GEEEIRTTNPVATEQYGTMSTNLQRGNN

SEQ ID NO: 5482 - protein, 28 aa, Artificial Sequence
  Description of Artificial Sequence: Synthetic peptide
DEEEIRTTNPVATELYGSVSTNLQIGDA

SEQ ID NO: 5483 - protein, 29 aa, Artificial Sequence
  Description of Artificial Sequence: Synthetic peptide
AEEEIRTTNPVATEQYGSVITNLQNGINR

SEQ ID NO: 5484 - protein, 28 aa, Artificial Sequence
  Description of Artificial Sequence: Synthetic peptide
DEIEIRTTNPVCTEQYGSVSTNLQGGND

SEQ ID NO: 5485 - protein, 29 aa, Artificial Sequence
  Description of Artificial Sequence: Synthetic peptide
DEEEIRTTNPVATEQYGSVSTNNQQTNER

SEQ ID NO: 5486 - protein, 31 aa, Artificial Sequence
  Description of Artificial Sequence: Synthetic polypeptide
DEEEIRTTNPVATEQYGSVSTNGLQDGNERF

SEQ ID NO: 5487 - protein, 28 aa, Artificial Sequence
  Description of Artificial Sequence: Synthetic peptide
DEEEIRTVNPVATEQYGVVSMNLQRGNL

SEQ ID NO: 5488 - protein, 29 aa, Artificial Sequence
  Description of Artificial Sequence: Synthetic peptide
DEEEIATTNPVATESYGSVSTNLQLGGNR

SEQ ID NO: 5489 - protein, 28 aa, Artificial Sequence
  Description of Artificial Sequence: Synthetic peptide
DEEEIRTTNPVATEQYGSVSENLQFGDI

SEQ ID NO: 5490 - protein, 30 aa, Artificial Sequence
  Description of Artificial Sequence: Synthetic polypeptide
DEEEIRTTNPVATEQYGSVSTILEQGGNNR

SEQ ID NO: 5491 - protein, 29 aa, Artificial Sequence
  Description of Artificial Sequence: Synthetic peptide
DEEEIGTTNPVGTEQYGSVSTNIQNRGNR

SEQ ID NO: 5492 - protein, 30 aa, Artificial Sequence
  Description of Artificial Sequence: Synthetic polypeptide
DEEEIRTTNPVATEQYGSVSTNLPQCRGTL

SEQ ID NO: 5493 - protein, 30 aa, Artificial Sequence
  Description of Artificial Sequence: Synthetic polypeptide
DEDEIRTTNPVATEQYGSVSTNLQDQGNLR

SEQ ID NO: 5494 - protein, 29 aa, Artificial Sequence
  Description of Artificial Sequence: Synthetic peptide
DEEEISTTNPVATEQYGSVCTNLQPGDNR

SEQ ID NO: 5495 - protein, 30 aa, Artificial Sequence
  Description of Artificial Sequence: Synthetic polypeptide
DEHEIRTTNPVATEQYGSVSTNLGQEGANR

SEQ ID NO: 5496 - protein, 30 aa, Artificial Sequence
  Description of Artificial Sequence: Synthetic polypeptide
DEEEIRTTNPVATEQYGEVSMTNLNRGMNR

SEQ ID NO: 5497 - protein, 30 aa, Artificial Sequence
  Description of Artificial Sequence: Synthetic polypeptide
DEEEIRTTNPVATEQYGLVSETNLNRGVNR

SEQ ID NO: 5498 - protein, 28 aa, Artificial Sequence
  Description of Artificial Sequence: Synthetic peptide
DEEEIRTTNPVATEQYGLVSENLQRFNS

SEQ ID NO: 5499 - protein, 30 aa, Artificial Sequence
  Description of Artificial Sequence: Synthetic polypeptide
DEEEIRTTNPVATEQYGSVSENLQRGNEIE

SEQ ID NO: 5500 - protein, 31 aa, Artificial Sequence
  Description of Artificial Sequence: Synthetic polypeptide
DEHEIRTTNPVATEQYGSVSTNLDQRGENQR

SEQ ID NO: 5501 - protein, 30 aa, Artificial Sequence
  Description of Artificial Sequence: Synthetic polypeptide
AEEEIRTTNPVATEQYGSVSTNLESQTGNR

SEQ ID NO: 5502 - protein, 29 aa, Artificial Sequence
  Description of Artificial Sequence: Synthetic peptide
DEEEIRTTNPVATEQYGLVSANLQERMNR

SEQ ID NO: 5503 - protein, 28 aa, Artificial Sequence
  Description of Artificial Sequence: Synthetic peptide
DEEEIRTVNPVCTEQYGSVSTNLQRGGM

SEQ ID NO: 5504 - protein, 30 aa, Artificial Sequence
  Description of Artificial Sequence: Synthetic polypeptide
DEPEIRTTNPVATEQYGSVSTNLQRGNIND

SEQ ID NO: 5505 - protein, 28 aa, Artificial Sequence
  Description of Artificial Sequence: Synthetic peptide
GEEEIRTTNPVATEHYGSVSTNLQRGTQ

SEQ ID NO: 5506 - protein, 28 aa, Artificial Sequence
  Description of Artificial Sequence: Synthetic peptide
DEEEIRTTNPVATEQYGSVSDNLEHGND

SEQ ID NO: 5507 - protein, 30 aa, Artificial Sequence
  Description of Artificial Sequence: Synthetic polypeptide
DEEEIRTTNPCATEQYGSVSMTNPQRSGNR

SEQ ID NO: 5508 - protein, 29 aa, Artificial Sequence
  Description of Artificial Sequence: Synthetic peptide
DEEEIRTTNPVATEQYGSYSTNTQRGENG

SEQ ID NO: 5509 - protein, 30 aa, Artificial Sequence
  Description of Artificial Sequence: Synthetic polypeptide
DEEEIRTTNPVATEQYGSVSTGNLEGGTNR

SEQ ID NO: 5510 - protein, 29 aa, Artificial Sequence
  Description of Artificial Sequence: Synthetic peptide
DEEEIRTTNPVATEQYGSVSDNIQRSLNR

SEQ ID NO: 5511 - protein, 31 aa, Artificial Sequence
  Description of Artificial Sequence: Synthetic polypeptide
DEEEIRTTNPVATEQYGSVSITNLQRGANNE

SEQ ID NO: 5512 - protein, 30 aa, Artificial Sequence
  Description of Artificial Sequence: Synthetic polypeptide
DEEEIRTTNPVATEQYGSVSDNLPQDRGNQ

SEQ ID NO: 5513 - protein, 30 aa, Artificial Sequence
  Description of Artificial Sequence: Synthetic polypeptide
AEEEIRTTNPVATEQYGSVYSTNLSQGGNR

SEQ ID NO: 5514 - protein, 28 aa, Artificial Sequence
  Description of Artificial Sequence: Synthetic peptide
DEQEIATTNPVATENYGWVSTNLQRGNR

SEQ ID NO: 5515 - protein, 30 aa, Artificial Sequence
  Description of Artificial Sequence: Synthetic polypeptide
AEEEIRTTNPVATEQYGSVISTNLQTGGNR

SEQ ID NO: 5516 - protein, 28 aa, Artificial Sequence
  Description of Artificial Sequence: Synthetic peptide
DEEEIRTTNPVATEQYGSVDTNLCNGNV

SEQ ID NO: 5517 - protein, 30 aa, Artificial Sequence
  Description of Artificial Sequence: Synthetic polypeptide
DEEEIRTTNPVATEQYGSVSTQLQFGSDNR

SEQ ID NO: 5518 - protein, 30 aa, Artificial Sequence
  Description of Artificial Sequence: Synthetic polypeptide
DEEEIRTTNPVATEQYGSVSTEPNTQRGNG

SEQ ID NO: 5519 - protein, 28 aa, Artificial Sequence
  Description of Artificial Sequence: Synthetic peptide
DEEEIRTTNPVATEMYGSVSENLQQGTR

SEQ ID NO: 5520 - protein, 30 aa, Artificial Sequence
  Description of Artificial Sequence: Synthetic polypeptide
VEEEIRTTNPVATEQYGSVSTNLVRGNVRS

SEQ ID NO: 5521 - protein, 30 aa, Artificial Sequence
  Description of Artificial Sequence: Synthetic polypeptide
DEEEIRTTNPVATEQYGSVSTNLQMGDNGV

SEQ ID NO: 5522 - protein, 29 aa, Artificial Sequence
  Description of Artificial Sequence: Synthetic peptide
DEMEIRCTNPVATEQYGSVSTNLVERGNR

SEQ ID NO: 5523 - protein, 30 aa, Artificial Sequence
  Description of Artificial Sequence: Synthetic polypeptide
SEEEIRTTNPVATEQYGSVSDATGLQRGNR

SEQ ID NO: 5524 - protein, 31 aa, Artificial Sequence
  Description of Artificial Sequence: Synthetic polypeptide
DEEEIRTTNPVATEQYGSVSSTNLQRGSNID

SEQ ID NO: 5525 - protein, 30 aa, Artificial Sequence
  Description of Artificial Sequence: Synthetic polypeptide
DEEEIRTTNPVATEQYGVVSTNLQRFGNIF

SEQ ID NO: 5526 - protein, 29 aa, Artificial Sequence
  Description of Artificial Sequence: Synthetic peptide
DEEEISTTNPVATEQYGSVSTNLQHNGNQ

SEQ ID NO: 5527 - protein, 31 aa, Artificial Sequence
  Description of Artificial Sequence: Synthetic polypeptide
DEEEIRTTNPVATEQYGSVSTNGLQSGNMRQ

SEQ ID NO: 5528 - protein, 30 aa, Artificial Sequence
  Description of Artificial Sequence: Synthetic polypeptide
DEEEIRTTNPVATEQYGSCSTNLQMGEENR

SEQ ID NO: 5529 - protein, 28 aa, Artificial Sequence
  Description of Artificial Sequence: Synthetic peptide
DEMEIRCTNPVATEQYGSVSENLERGNR

SEQ ID NO: 5530 - protein, 31 aa, Artificial Sequence
  Description of Artificial Sequence: Synthetic polypeptide
DEEEIRTVNPVATEQYGSVSTMNLQRFGENR

SEQ ID NO: 5531 - protein, 30 aa, Artificial Sequence
  Description of Artificial Sequence: Synthetic polypeptide
AEEEIRTTNPVATEQYGSVCSTNLQVGVNR

SEQ ID NO: 5532 - protein, 28 aa, Artificial Sequence
  Description of Artificial Sequence: Synthetic peptide
DEEEIRATNPVATEQYGTVSTNLQTGNC

SEQ ID NO: 5533 - protein, 30 aa, Artificial Sequence
  Description of Artificial Sequence: Synthetic polypeptide
DEEEIRTTNPVATEQYGSVSTDDQRGTNGR

SEQ ID NO: 5534 - protein, 28 aa, Artificial Sequence
  Description of Artificial Sequence: Synthetic peptide
DEEEIRATNPVATEIYGSVSTNLQHGNC

SEQ ID NO: 5535 - protein, 31 aa, Artificial Sequence
  Description of Artificial Sequence: Synthetic polypeptide
DEEEIRTTNPVATEQYGSVSKTDLQQRSGNR

SEQ ID NO: 5536 - protein, 29 aa, Artificial Sequence
  Description of Artificial Sequence: Synthetic peptide
DEEEIRTTNPVATEQYGSVSTINLQSLNL

SEQ ID NO: 5537 - protein, 28 aa, Artificial Sequence
  Description of Artificial Sequence: Synthetic peptide
DEEEIRTTNPVATEQYGSVDTNLQEGDM

SEQ ID NO: 5538 - protein, 30 aa, Artificial Sequence
  Description of Artificial Sequence: Synthetic polypeptide
DEEEIRTTNPVATEQYGSVVCTNLQRPGNQ

SEQ ID NO: 5539 - protein, 28 aa, Artificial Sequence
  Description of Artificial Sequence: Synthetic peptide
DEEEIRTTNPVATEQYGSVSENPQRGDY

SEQ ID NO: 5540 - protein, 28 aa, Artificial Sequence
  Description of Artificial Sequence: Synthetic peptide
DEMEIRCTNPVATEQYGSVSENLMRGNR

SEQ ID NO: 5541 - protein, 29 aa, Artificial Sequence
  Description of Artificial Sequence: Synthetic peptide
DEEEIRTTNPVATEQYGSVETELQRGPNE

SEQ ID NO: 5542 - protein, 30 aa, Artificial Sequence
  Description of Artificial Sequence: Synthetic polypeptide
DEEEIRTTNPVATEQYGSVSTINLQQEGND

SEQ ID NO: 5543 - protein, 29 aa, Artificial Sequence
  Description of Artificial Sequence: Synthetic peptide
DEEEIATTNPVATEQYGCVSTNLEQHGNR

SEQ ID NO: 5544 - protein, 28 aa, Artificial Sequence
  Description of Artificial Sequence: Synthetic peptide
DEEEIRTTNPVATEQYGSVDTNGQRGDP

SEQ ID NO: 5545 - protein, 28 aa, Artificial Sequence
  Description of Artificial Sequence: Synthetic peptide
GEEEIVTTNPVATEQYGSVSTNLQRNNH

SEQ ID NO: 5546 - protein, 30 aa, Artificial Sequence
  Description of Artificial Sequence: Synthetic polypeptide
DEEEIRTTNPVATEQYGSVSTTTLDRGNGR

SEQ ID NO: 5547 - protein, 29 aa, Artificial Sequence
  Description of Artificial Sequence: Synthetic peptide
DEEEIRTTNPVATEQWGSVSENLQNRGNM

SEQ ID NO: 5548 - protein, 30 aa, Artificial Sequence
  Description of Artificial Sequence: Synthetic polypeptide
DEEEIRTTNPVATEQYGSVSTQLQRGEPNE

SEQ ID NO: 5549 - protein, 28 aa, Artificial Sequence
  Description of Artificial Sequence: Synthetic peptide
DEEEIRCTNPVATEQYGSVSEILMRGNR

SEQ ID NO: 5550 - protein, 28 aa, Artificial Sequence
  Description of Artificial Sequence: Synthetic peptide
DEEEIRTTNPVATELYGSVSTNWQQGNV

SEQ ID NO: 5551 - protein, 29 aa, Artificial Sequence
  Description of Artificial Sequence: Synthetic peptide
DEEEIRTTNPVATEQYGSVSTNDFEGSNR

SEQ ID NO: 5552 - protein, 30 aa, Artificial Sequence
  Description of Artificial Sequence: Synthetic polypeptide
DEEEIRTTNPVATEQYGSVSSTNLQNTGNI

SEQ ID NO: 5553 - protein, 29 aa, Artificial Sequence
  Description of Artificial Sequence: Synthetic peptide
DEEEIRTTNPTATEQFGSVSTINLQVGNR

SEQ ID NO: 5554 - protein, 31 aa, Artificial Sequence
  Description of Artificial Sequence: Synthetic polypeptide
DEEEIRTTNPVATEQYGSVSITNLQRGVNGP

SEQ ID NO: 5555 - protein, 28 aa, Artificial Sequence
  Description of Artificial Sequence: Synthetic peptide
SEEEIRCTNPIATEQYGSVSENLQRGNR

SEQ ID NO: 5556 - protein, 31 aa, Artificial Sequence
  Description of Artificial Sequence: Synthetic polypeptide
DEEEIRTTNPVATEQYGSVSTNLPQRDGEDR

SEQ ID NO: 5557 - protein, 30 aa, Artificial Sequence
  Description of Artificial Sequence: Synthetic polypeptide
DEEEIRTTNPVATEQYGSVSTNLQGGMNIA

SEQ ID NO: 5558 - protein, 28 aa, Artificial Sequence
  Description of Artificial Sequence: Synthetic peptide
DEEEIRTTNPTATEQFGSVSTNLQRGTN

SEQ ID NO: 5559 - protein, 28 aa, Artificial Sequence
  Description of Artificial Sequence: Synthetic peptide
DEEEIATVNPVATEQYGEVSTNLQRGNL

SEQ ID NO: 5560 - protein, 32 aa, Artificial Sequence
  Description of Artificial Sequence: Synthetic polypeptide
DEEEIRTTNPVATEQYGSVSQTNLQREGQNRS

SEQ ID NO: 5561 - protein, 32 aa, Artificial Sequence
  Description of Artificial Sequence: Synthetic polypeptide
DEEEIRTTNPVATEQYGSVSCTNLSQRAGSNR

SEQ ID NO: 5562 - protein, 29 aa, Artificial Sequence
  Description of Artificial Sequence: Synthetic peptide
DEVEIRTTNPVATEQYGSVSTNLQMGGNP

SEQ ID NO: 5563 - protein, 28 aa, Artificial Sequence
  Description of Artificial Sequence: Synthetic peptide
DEEEIRTTNPVATEQYGSVSTNDETGER

SEQ ID NO: 5564 - protein, 29 aa, Artificial Sequence
  Description of Artificial Sequence: Synthetic peptide
DEEEIRTVNPVATECYGSVSTDLQRGNDR

SEQ ID NO: 5565 - protein, 30 aa, Artificial Sequence
  Description of Artificial Sequence: Synthetic polypeptide
DEEEIRTTNPVATEQYGSCSTNLQEGDMNR

SEQ ID NO: 5566 - protein, 29 aa, Artificial Sequence
  Description of Artificial Sequence: Synthetic peptide
DEEEIRTTNPVATEQYGSVSCTNWCHGNR

SEQ ID NO: 5567 - protein, 29 aa, Artificial Sequence
  Description of Artificial Sequence: Synthetic peptide
DEEEIRCTNPVATEQYGSVSENLMRGNDR

SEQ ID NO: 5568 - protein, 29 aa, Artificial Sequence
  Description of Artificial Sequence: Synthetic peptide
DEEEIRTTNPVATEQYGSASTDLQRGFDR

SEQ ID NO: 5569 - protein, 31 aa, Artificial Sequence
  Description of Artificial Sequence: Synthetic polypeptide
DEMEIRTTNPVATEQYGSVCSTLNLQRGDNR

SEQ ID NO: 5570 - protein, 29 aa, Artificial Sequence
  Description of Artificial Sequence: Synthetic peptide
AEEEIRTTNPVATEQYGSVNSTNLQRTNQ

SEQ ID NO: 5571 - protein, 30 aa, Artificial Sequence
  Description of Artificial Sequence: Synthetic polypeptide
DEEEIRTTNPVATEQYGSVSTGNLQNGVNP

SEQ ID NO: 5572 - protein, 31 aa, Artificial Sequence
  Description of Artificial Sequence: Synthetic polypeptide
DEEEIRTTNPVATEQYGSVTSTNLTRGGTNR

SEQ ID NO: 5573 - protein, 30 aa, Artificial Sequence
  Description of Artificial Sequence: Synthetic polypeptide
AEEEIRTTNPVATEQYGSVSSTNLQNGMNR

SEQ ID NO: 5574 - protein, 28 aa, Artificial Sequence
  Description of Artificial Sequence: Synthetic peptide
DEEEIRTTNPVATEIYGEVPTNLQRGNK

SEQ ID NO: 5575 - protein, 28 aa, Artificial Sequence
  Description of Artificial Sequence: Synthetic peptide
DEEEIRTTNPVATEQYGSVDTDLQYGNE

SEQ ID NO: 5576 - protein, 30 aa, Artificial Sequence
  Description of Artificial Sequence: Synthetic polypeptide
DEEEIRTTNPVATEQYGSVSTNLQNNGNNI

SEQ ID NO: 5577 - protein, 28 aa, Artificial Sequence
  Description of Artificial Sequence: Synthetic peptide
DEEEIATTNPVATEVYGDVSTNLQHGNR

SEQ ID NO: 5578 - protein, 28 aa, Artificial Sequence
  Description of Artificial Sequence: Synthetic peptide
DEEEIRTTNPVATEQYGSVSYNLMRGPI

SEQ ID NO: 5579 - protein, 28 aa, Artificial Sequence
  Description of Artificial Sequence: Synthetic peptide
QEEEIRTTNPVATEQYGSVPTVLQRGER

SEQ ID NO: 5580 - protein, 28 aa, Artificial Sequence
  Description of Artificial Sequence: Synthetic peptide
DEEEIRTTNPVATEQYGSVDTNLQWENY

SEQ ID NO: 5581 - protein, 30 aa, Artificial Sequence
  Description of Artificial Sequence: Synthetic polypeptide
DEEEIRTTNPVATEQYGSVATNLQRGEERW

SEQ ID NO: 5582 - protein, 31 aa, Artificial Sequence
  Description of Artificial Sequence: Synthetic polypeptide
DEEEIRTTNPVATEQYGSVSTMNLQGGNNRQ

SEQ ID NO: 5583 - protein, 28 aa, Artificial Sequence
  Description of Artificial Sequence: Synthetic peptide
AEEEIATTNPVATEQYGSVSTNLERGER

SEQ ID NO: 5584 - protein, 30 aa, Artificial Sequence
  Description of Artificial Sequence: Synthetic polypeptide
DEEEIRTTNPVATEQYGSVSTNLEREGNDE

SEQ ID NO: 5585 - protein, 28 aa, Artificial Sequence
  Description of Artificial Sequence: Synthetic peptide
DEEEIATTNPVATEVYGEASTNLQRGNR

SEQ ID NO: 5586 - protein, 30 aa, Artificial Sequence
  Description of Artificial Sequence: Synthetic polypeptide
DEEEIRTTNPVATEQYGSVSTNDPQRDLNR

SEQ ID NO: 5587 - protein, 30 aa, Artificial Sequence
  Description of Artificial Sequence: Synthetic polypeptide
DEEEIRTTNPVATEQYGAVSWTNLNRGTNR

SEQ ID NO: 5588 - protein, 30 aa, Artificial Sequence
  Description of Artificial Sequence: Synthetic polypeptide
DEEEIRTTNPVATEQYGSVYSTNLQGNNER

SEQ ID NO: 5589 - protein, 30 aa, Artificial Sequence
  Description of Artificial Sequence: Synthetic polypeptide
DEEEIRTTNPVATEQYGSVSTIDLERGNDR

SEQ ID NO: 5590 - protein, 31 aa, Artificial Sequence
  Description of Artificial Sequence: Synthetic polypeptide
DEECIRTTNPVATEQYWGSVESTNLQRGDNR

SEQ ID NO: 5591 - protein, 31 aa, Artificial Sequence
  Description of Artificial Sequence: Synthetic polypeptide
DEEEIRTTNPVATEQYGSVYSTNLIQEDGNR

SEQ ID NO: 5592 - protein, 28 aa, Artificial Sequence
  Description of Artificial Sequence: Synthetic peptide
VEEEIRSTNPVATEQYGSVATNLQRGNQ

SEQ ID NO: 5593 - protein, 28 aa, Artificial Sequence
  Description of Artificial Sequence: Synthetic peptide
DEEEIRTTNPVATECYGTVATNLQRGNN

SEQ ID NO: 5594 - protein, 30 aa, Artificial Sequence
  Description of Artificial Sequence: Synthetic polypeptide
DEEEIRTTNPVAYEQYGSVDCTNLQMRGNR

SEQ ID NO: 5595 - protein, 28 aa, Artificial Sequence
  Description of Artificial Sequence: Synthetic peptide
DEEEIATTNPVATEQYGLVSTNIQRGNF

SEQ ID NO: 5596 - protein, 30 aa, Artificial Sequence
  Description of Artificial Sequence: Synthetic polypeptide
DEHEIRTTNPVATEQYGSVSTNLQEGDENR

SEQ ID NO: 5597 - protein, 28 aa, Artificial Sequence
  Description of Artificial Sequence: Synthetic peptide
DEEEIRTTNPEATEQYGSVSTNEQVGDR

SEQ ID NO: 5598 - protein, 29 aa, Artificial Sequence
  Description of Artificial Sequence: Synthetic peptide
DEEEIRTTNPVATEQYGSVSTDIQLGNMR

SEQ ID NO: 5599 - protein, 29 aa, Artificial Sequence
  Description of Artificial Sequence: Synthetic peptide
AEEEIRTTNPVATEQYGSVQTNLQYGNNR

SEQ ID NO: 5600 - protein, 29 aa, Artificial Sequence
  Description of Artificial Sequence: Synthetic peptide
FEEEIRTTNPVATEQYGSVSTNLQDGNQT

SEQ ID NO: 5601 - protein, 28 aa, Artificial Sequence
  Description of Artificial Sequence: Synthetic peptide
DEESIRTTNPVAVEQYGSVSTNLQRENQ

SEQ ID NO: 5602 - protein, 28 aa, Artificial Sequence
  Description of Artificial Sequence: Synthetic peptide
DEEEIRTTNPVATEQYGSVDTELQLGNM

SEQ ID NO: 5603 - protein, 28 aa, Artificial Sequence
  Description of Artificial Sequence: Synthetic peptide
DEEEIRTTNPVATEQYGCVSSEDQRGNR

SEQ ID NO: 5604 - protein, 30 aa, Artificial Sequence
  Description of Artificial Sequence: Synthetic polypeptide
DEEEIRTTNPVATEQYGAVSVTNLIRGMNR

SEQ ID NO: 5605 - protein, 29 aa, Artificial Sequence
  Description of Artificial Sequence: Synthetic peptide
DDEEIRTTNPVATEQYGSVSTLNLQNGNG

SEQ ID NO: 5606 - protein, 30 aa, Artificial Sequence
  Description of Artificial Sequence: Synthetic polypeptide
DEEEIRTTNPVATEQYGSVGNTNLQRGNVE

SEQ ID NO: 5607 - protein, 28 aa, Artificial Sequence
  Description of Artificial Sequence: Synthetic peptide
DEEEIRTTNPCATEQYGSVSTGLQRGTD

SEQ ID NO: 5608 - protein, 32 aa, Artificial Sequence
  Description of Artificial Sequence: Synthetic polypeptide
DEEEIRTTNPVATEQYGSVSSTNLNQRGSENR

SEQ ID NO: 5609 - protein, 31 aa, Artificial Sequence
  Description of Artificial Sequence: Synthetic polypeptide
DEEEIRTTNPVATEQYGSVSSLTNLLQRENR

SEQ ID NO: 5610 - protein, 30 aa, Artificial Sequence
  Description of Artificial Sequence: Synthetic polypeptide
DEEEIRTTNPVATEQYGSVCTNSLQRNGER

SEQ ID NO: 5611 - protein, 29 aa, Artificial Sequence
  Description of Artificial Sequence: Synthetic peptide
DEEEIRTTNPVATEQYGSVSTDLCIGDNR

SEQ ID NO: 5612 - protein, 30 aa, Artificial Sequence
  Description of Artificial Sequence: Synthetic polypeptide
DEMEIRTTNPVATEQYGSVSDNLQMRGTNR

SEQ ID NO: 5613 - protein, 30 aa, Artificial Sequence
  Description of Artificial Sequence: Synthetic polypeptide
DEVEIRTTNPVATEQYGSVSTNLQMGGGNW

SEQ ID NO: 5614 - protein, 30 aa, Artificial Sequence
  Description of Artificial Sequence: Synthetic polypeptide
DEEEIRTTNPVATEQYGSISGMNMLQRDNR

SEQ ID NO: 5615 - protein, 30 aa, Artificial Sequence
  Description of Artificial Sequence: Synthetic polypeptide
AEEEIRTTNPVATEQYGSVVSTNNLQFGNI

SEQ ID NO: 5616 - protein, 29 aa, Artificial Sequence
  Description of Artificial Sequence: Synthetic peptide
NEEEIATTNPVATEQYGEVSTNLQRGPNQ

SEQ ID NO: 5617 - protein, 30 aa, Artificial Sequence
  Description of Artificial Sequence: Synthetic polypeptide
DEEEIRTTNPVATEQYGDVSTPNLQSGNQQ

SEQ ID NO: 5618 - protein, 30 aa, Artificial Sequence
  Description of Artificial Sequence: Synthetic polypeptide
AEEEIRTTNPVATEQYGSVYSTNLQAGNDG

SEQ ID NO: 5619 - protein, 29 aa, Artificial Sequence
  Description of Artificial Sequence: Synthetic peptide
NEEEIRTTNPVATEQYGSVATNLQSGDRN

SEQ ID NO: 5620 - protein, 30 aa, Artificial Sequence
  Description of Artificial Sequence: Synthetic polypeptide
MEEEIRTTNPVATSQYGSVSSGNLQRGNRG

SEQ ID NO: 5621 - protein, 30 aa, Artificial Sequence
  Description of Artificial Sequence: Synthetic polypeptide
DEEEIRTTNPVATEQYGNVSTTNLQFGNSV

SEQ ID NO: 5622 - protein, 30 aa, Artificial Sequence
  Description of Artificial Sequence: Synthetic polypeptide
DEEEIRTTNPVATEQYGSVSTNLQDGMDAS

SEQ ID NO: 5623 - protein, 30 aa, Artificial Sequence
  Description of Artificial Sequence: Synthetic polypeptide
MEEEIRTTNPVATEQYGSVSTNTQRGSENQ

SEQ ID NO: 5624 - protein, 30 aa, Artificial Sequence
  Description of Artificial Sequence: Synthetic polypeptide
AEEEIRTTNPVATEQYGSVVSTNLLRGNNE

SEQ ID NO: 5625 - protein, 29 aa, Artificial Sequence
  Description of Artificial Sequence: Synthetic peptide
AEEEIRTTNPVATEQYGSVSVTTLQVENR

SEQ ID NO: 5626 - protein, 30 aa, Artificial Sequence
  Description of Artificial Sequence: Synthetic polypeptide
MEEEIRTTNPVATMQYGSVSTSNLQGGNRQ

SEQ ID NO: 5627 - protein, 29 aa, Artificial Sequence
  Description of Artificial Sequence: Synthetic peptide
DEVEIRTTNPVATEQYGSVSTNLQNFGEQ

SEQ ID NO: 5628 - protein, 30 aa, Artificial Sequence
  Description of Artificial Sequence: Synthetic polypeptide
AEEEIRTTNPVATEQYGSVVSTNQLQMDNR

SEQ ID NO: 5629 - protein, 30 aa, Artificial Sequence
  Description of Artificial Sequence: Synthetic polypeptide
MEEEIRTTNPVATEQYGSVSTNLQGGNIIE

SEQ ID NO: 5630 - protein, 29 aa, Artificial Sequence
  Description of Artificial Sequence: Synthetic peptide
DNEEIRTTNPVATEQWGSVCSTVLQRGTR

SEQ ID NO: 5631 - protein, 28 aa, Artificial Sequence
  Description of Artificial Sequence: Synthetic peptide
QEEEIRTTNPVATEQYGSTSTLLQRAER

SEQ ID NO: 5632 - protein, 30 aa, Artificial Sequence
  Description of Artificial Sequence: Synthetic polypeptide
MEEEIRTTNPVATEYYGSVSTQNLQPGNRG

SEQ ID NO: 5633 - protein, 31 aa, Artificial Sequence
  Description of Artificial Sequence: Synthetic polypeptide
AEEEIRTTNPVATEQYGSVSVTTNLQRGNIN

SEQ ID NO: 5634 - protein, 30 aa, Artificial Sequence
  Description of Artificial Sequence: Synthetic polypeptide
AEEEIRTTNPVATEQYGSVVSTNPQNRENR

SEQ ID NO: 5635 - protein, 29 aa, Artificial Sequence
  Description of Artificial Sequence: Synthetic peptide
DEEEIRATNPVATEQFGSVSTNLQRTEDR

SEQ ID NO: 5636 - protein, 30 aa, Artificial Sequence
  Description of Artificial Sequence: Synthetic polypeptide
DEEEIRTTNPVATEQYGDVSTPNLQSGNQF

SEQ ID NO: 5637 - protein, 31 aa, Artificial Sequence
  Description of Artificial Sequence: Synthetic polypeptide
DEEEIRTTNPVATEQYGSVSTNDTRGNTNER

SEQ ID NO: 5638 - protein, 28 aa, Artificial Sequence
  Description of Artificial Sequence: Synthetic peptide
QEEEIRTTNPVATEQYGSLSTTLQRQGR

SEQ ID NO: 5639 - protein, 30 aa, Artificial Sequence
  Description of Artificial Sequence: Synthetic polypeptide
MEEEIRTTNPVATEQYGSVSTNLQLGGNIN

SEQ ID NO: 5640 - protein, 29 aa, Artificial Sequence
  Description of Artificial Sequence: Synthetic peptide
AEEEIRTTNPVATEQYGTVSDTNLQDENR

SEQ ID NO: 5641 - protein, 29 aa, Artificial Sequence
  Description of Artificial Sequence: Synthetic peptide
AEEEIRTTNPVATEQYGSVVYTNLQDENR

SEQ ID NO: 5642 - protein, 30 aa, Artificial Sequence
  Description of Artificial Sequence: Synthetic polypeptide
AEEEIRTTNPVATEQYGSVVTNLMQETGNR

SEQ ID NO: 5643 - protein, 31 aa, Artificial Sequence
  Description of Artificial Sequence: Synthetic polypeptide
DEEEIRTTNPVATEQYGSVSTNHQRSGNEQD

SEQ ID NO: 5644 - protein, 31 aa, Artificial Sequence
  Description of Artificial Sequence: Synthetic polypeptide
DEEEIRTTNPVATEQYGSVSTNHQRSGMDRA

SEQ ID NO: 5645 - protein, 30 aa, Artificial Sequence
  Description of Artificial Sequence: Synthetic polypeptide
DEEEIRTTNPVATEQYGSVSTNDQNIGNGE

SEQ ID NO: 5646 - protein, 30 aa, Artificial Sequence
  Description of Artificial Sequence: Synthetic polypeptide
DEEEIRTTNPVATEQYGSVSTNLLVIGNQQ

SEQ ID NO: 5647 - protein, 31 aa, Artificial Sequence
  Description of Artificial Sequence: Synthetic polypeptide
DEEEIRTTNPVATEQYGSVSFTNLQRVGVIM

SEQ ID NO: 5648 - protein, 30 aa, Artificial Sequence
  Description of Artificial Sequence: Synthetic polypeptide
DEEEIRTTNPVATEQYGDVSTNLQTDGANV

SEQ ID NO: 5649 - protein, 28 aa, Artificial Sequence
  Description of Artificial Sequence: Synthetic peptide
AEEEIRTTNPVATEQYGSVYSNQQGGNR

SEQ ID NO: 5650 - protein, 30 aa, Artificial Sequence
  Description of Artificial Sequence: Synthetic polypeptide
DEEEIRTTNPVATEQYGSVSGTNEGQDGNT

SEQ ID NO: 5651 - protein, 29 aa, Artificial Sequence
  Description of Artificial Sequence: Synthetic peptide
MEEEIRTTNPVATLQYGSVSTNLVRGNIV

SEQ ID NO: 5652 - protein, 28 aa, Artificial Sequence
  Description of Artificial Sequence: Synthetic peptide
DEEEIRQTNPVATEQYGSVSTNQEVGNM

SEQ ID NO: 5653 - protein, 31 aa, Artificial Sequence
  Description of Artificial Sequence: Synthetic polypeptide
DEEEIRTTNPVATEQYGSVSTNLMQQGGDRP

SEQ ID NO: 5654 - protein, 30 aa, Artificial Sequence
  Description of Artificial Sequence: Synthetic polypeptide
DEEEIRTTNPVATEQYGSVSTNLLTDSGNQ

SEQ ID NO: 5655 - protein, 31 aa, Artificial Sequence
  Description of Artificial Sequence: Synthetic polypeptide
DEEEIRTTNPVATEQYGSFVSTNDLQRAFDR

SEQ ID NO: 5656 - protein, 29 aa, Artificial Sequence
  Description of Artificial Sequence: Synthetic peptide
DEEEIRQTNPVATEQYGVVSTTNLQVGND

SEQ ID NO: 5657 - protein, 29 aa, Artificial Sequence
  Description of Artificial Sequence: Synthetic peptide
DEEEIRTTNPVATEQYGSHSTNLERINDN

SEQ ID NO: 5658 - protein, 30 aa, Artificial Sequence
  Description of Artificial Sequence: Synthetic polypeptide
DEEEIRTTNPVATEQYGDVSTNLQQTAGNE

SEQ ID NO: 5659 - protein, 32 aa, Artificial Sequence
  Description of Artificial Sequence: Synthetic polypeptide
MEEEIRTTNPVATEQYGSVSTSNLGQRGENER

SEQ ID NO: 5660 - protein, 30 aa, Artificial Sequence
  Description of Artificial Sequence: Synthetic polypeptide
DEEEIRTTNPVATEQYGSVSTNDQGTENDR

SEQ ID NO: 5661 - protein, 31 aa, Artificial Sequence
  Description of Artificial Sequence: Synthetic polypeptide
QEEEIRTTNPVATEQYGSVSATNLQQGPNPR

SEQ ID NO: 5662 - protein, 30 aa, Artificial Sequence
  Description of Artificial Sequence: Synthetic polypeptide
DEEEIRTTNPVATEQYGDVSTSNLQPFGNT

SEQ ID NO: 5663 - protein, 30 aa, Artificial Sequence
  Description of Artificial Sequence: Synthetic polypeptide
DEEEIRTTNPVATEQYGDVSTNLQQQDGND

SEQ ID NO: 5664 - protein, 31 aa, Artificial Sequence
  Description of Artificial Sequence: Synthetic polypeptide
DEEEIRTTNPVATEQYGSVSTNEHARGGNRI

SEQ ID NO: 5665 - protein, 30 aa, Artificial Sequence
  Description of Artificial Sequence: Synthetic polypeptide
DEEEIRATNPVATEQYGLVSITNLFQGGNR

SEQ ID NO: 5666 - protein, 28 aa, Artificial Sequence
  Description of Artificial Sequence: Synthetic peptide
NEEEIRTTNPVATEQYGSSSTGLQREGR

SEQ ID NO: 5667 - protein, 30 aa, Artificial Sequence
  Description of Artificial Sequence: Synthetic polypeptide
DEEEIRTTNPVATEQYGSVSTNLIDRDNED

SEQ ID NO: 5668 - protein, 30 aa, Artificial Sequence
  Description of Artificial Sequence: Synthetic polypeptide
DEEEIRTTNPVATEQYGQSVSTNVQHGGNT

SEQ ID NO: 5669 - protein, 29 aa, Artificial Sequence
  Description of Artificial Sequence: Synthetic peptide
AEEEIRTTNPVATEQYGSVVSTNNQVDNR

SEQ ID NO: 5670 - protein, 31 aa, Artificial Sequence
  Description of Artificial Sequence: Synthetic polypeptide
DEEEIRTTNPVATEQYGDVSTSNLQRGFNVG

SEQ ID NO: 5671 - protein, 31 aa, Artificial Sequence
  Description of Artificial Sequence: Synthetic polypeptide
DEEEIRTTNPVATEQYGSVSTNDQGPSGNSR

SEQ ID NO: 5672 - protein, 30 aa, Artificial Sequence
  Description of Artificial Sequence: Synthetic polypeptide
DEEEIRTTNPVATEQYGSVSTNLNGMGNTN

SEQ ID NO: 5673 - protein, 31 aa, Artificial Sequence
  Description of Artificial Sequence: Synthetic polypeptide
DEEEIRTTNPVATEQYGSVSTNLNNDGGENR

SEQ ID NO: 5674 - protein, 30 aa, Artificial Sequence
  Description of Artificial Sequence: Synthetic polypeptide
DEEEIRTTNPVATEQYGSVSTNDQGNGERR

SEQ ID NO: 5675 - protein, 28 aa, Artificial Sequence
  Description of Artificial Sequence: Synthetic peptide
AEEEIRTTNPVATEQYGSVVTNLQIFNV

SEQ ID NO: 5676 - protein, 31 aa, Artificial Sequence
  Description of Artificial Sequence: Synthetic polypeptide
DEEEIRTTNPVATEQYGSVSTNLTQNFGGNI

SEQ ID NO: 5677 - protein, 30 aa, Artificial Sequence
  Description of Artificial Sequence: Synthetic polypeptide
DEEEIRTTNPVATEQYGSVSTNLNMGGNND

SEQ ID NO: 5678 - protein, 30 aa, Artificial Sequence
  Description of Artificial Sequence: Synthetic polypeptide
DEEEIRATNPVATEQYGIVSMTNLNQGGNR

SEQ ID NO: 5679 - protein, 30 aa, Artificial Sequence
  Description of Artificial Sequence: Synthetic polypeptide
DEEEIRATNPVATEQYGKVSMTNLPQGGNR

SEQ ID NO: 5680 - protein, 30 aa, Artificial Sequence
  Description of Artificial Sequence: Synthetic polypeptide
DEEEIRTTNPVATEQYGSVSTNLNQDGQTQ

SEQ ID NO: 5681 - protein, 31 aa, Artificial Sequence
  Description of Artificial Sequence: Synthetic polypeptide
DEEEIRTTNPVATEQYGSVSTNLQDIGENQV

SEQ ID NO: 5682 - protein, 30 aa, Artificial Sequence
  Description of Artificial Sequence: Synthetic polypeptide
DEVEIRTTNPVATEQYGSVSTNLQIGGQNI

SEQ ID NO: 5683 - protein, 29 aa, Artificial Sequence
  Description of Artificial Sequence: Synthetic peptide
MEEEIRTTNPVATSQYGSVSTGVLQHGNR

SEQ ID NO: 5684 - protein, 28 aa, Artificial Sequence
  Description of Artificial Sequence: Synthetic peptide
DEAEIYTTNPVATEQYGSVSTNLTYGNL

SEQ ID NO: 5685 - protein, 30 aa, Artificial Sequence
  Description of Artificial Sequence: Synthetic polypeptide
DEEEIRTTNPVATEQYGSVSTNLQDGEDTD

SEQ ID NO: 5686 - protein, 28 aa, Artificial Sequence
  Description of Artificial Sequence: Synthetic peptide
MEEEIRTTNPVNTEQYGSVSVNLERGNG

SEQ ID NO: 5687 - protein, 32 aa, Artificial Sequence
  Description of Artificial Sequence: Synthetic polypeptide
MEEEIRTTNPVATEQYGSVSTPNLDQRGENDR

SEQ ID NO: 5688 - protein, 31 aa, Artificial Sequence
  Description of Artificial Sequence: Synthetic polypeptide
DEEEIRTTNPVATEQYGSVSTNDVGQERGNT

SEQ ID NO: 5689 - protein, 30 aa, Artificial Sequence
  Description of Artificial Sequence: Synthetic polypeptide
QEEEIRTTNPVATEQYGSASTNLCCRGNDR

SEQ ID NO: 5690 - protein, 30 aa, Artificial Sequence
  Description of Artificial Sequence: Synthetic polypeptide
DEEEIRTTNPVATEQYGSVSTNLLQNGSFD

SEQ ID NO: 5691 - protein, 30 aa, Artificial Sequence
  Description of Artificial Sequence: Synthetic polypeptide
DEVEIRTTNPVATEQYGSVSTNLQLGGPNI

SEQ ID NO: 5692 - protein, 30 aa, Artificial Sequence
  Description of Artificial Sequence: Synthetic polypeptide
DEEEIRTTNPVATEQYGQTISTNELERGNR

SEQ ID NO: 5693 - protein, 29 aa, Artificial Sequence
  Description of Artificial Sequence: Synthetic peptide
MEEEIRTTNPYATEQYGSVSTNLVQRGEE

SEQ ID NO: 5694 - protein, 28 aa, Artificial Sequence
  Description of Artificial Sequence: Synthetic peptide
MEEEIRTTNPYATEQYGSVSVNQQYGNR

SEQ ID NO: 5695 - protein, 31 aa, Artificial Sequence
  Description of Artificial Sequence: Synthetic polypeptide
DEEEIRTTNPVATEQYGSVSTNEAQNSGGNR

SEQ ID NO: 5696 - protein, 30 aa, Artificial Sequence
  Description of Artificial Sequence: Synthetic polypeptide
QEEEIRTTNPVATEQYGSVSANLQRGEPRE

SEQ ID NO: 5697 - protein, 30 aa, Artificial Sequence
  Description of Artificial Sequence: Synthetic polypeptide
DEEEIRTTNPVATEQYGDVSTNLQHGENSN

SEQ ID NO: 5698 - protein, 30 aa, Artificial Sequence
  Description of Artificial Sequence: Synthetic polypeptide
DEVEIRTTNPVATEQYGSVSTNLQIGGQNQ

SEQ ID NO: 5699 - protein, 29 aa, Artificial Sequence
  Description of Artificial Sequence: Synthetic peptide
MEEEIRTVNPVATEQYGSVSTNVERGSNR

SEQ ID NO: 5700 - protein, 30 aa, Artificial Sequence
  Description of Artificial Sequence: Synthetic polypeptide
DEEEIRATNPVATEQYGNVSMTNLPQNGNR

SEQ ID NO: 5701 - protein, 29 aa, Artificial Sequence
  Description of Artificial Sequence: Synthetic peptide
DEVEIRTTNPVATEQYGSVSTPEGQMGNR

SEQ ID NO: 5702 - protein, 30 aa, Artificial Sequence
  Description of Artificial Sequence: Synthetic polypeptide
AEEEIRTTNPVATEQYGSVSVTSNLQTGNT

SEQ ID NO: 5703 - protein, 31 aa, Artificial Sequence
  Description of Artificial Sequence: Synthetic polypeptide
DEEEIRTTNPVATEQYGSVSTNEDLQEGENP

SEQ ID NO: 5704 - protein, 30 aa, Artificial Sequence
  Description of Artificial Sequence: Synthetic polypeptide
DEEEIRTTNPVATEQYGSVSTNLIFGDNIG

SEQ ID NO: 5705 - protein, 28 aa, Artificial Sequence
  Description of Artificial Sequence: Synthetic peptide
NEEEIRTTNPVATEQYGSTSTELQREGR

SEQ ID NO: 5706 - protein, 31 aa, Artificial Sequence
  Description of Artificial Sequence: Synthetic polypeptide
DEEEIRTTNPVATEQYGSVSTNDQHPGGNER

SEQ ID NO: 5707 - protein, 30 aa, Artificial Sequence
  Description of Artificial Sequence: Synthetic polypeptide
AEEEIRTTNPVATEQYGSVVSTNNLQNGNN

SEQ ID NO: 5708 - protein, 30 aa, Artificial Sequence
  Description of Artificial Sequence: Synthetic polypeptide
DEEEIRTTNPVATEQYGSVSTNLIGGVNGD

SEQ ID NO: 5709 - protein, 28 aa, Artificial Sequence
  Description of Artificial Sequence: Synthetic peptide
QEEEIRTTNPVATEQYGSVATALQGGFR

SEQ ID NO: 5710 - protein, 30 aa, Artificial Sequence
  Description of Artificial Sequence: Synthetic polypeptide
AEEEIRTTNPVATEQYGSVVSTNLLRTGNA

SEQ ID NO: 5711 - protein, 30 aa, Artificial Sequence
  Description of Artificial Sequence: Synthetic polypeptide
DEVEIRTTNPVATEQYGSVSVSTNLQRVNI

SEQ ID NO: 5712 - protein, 29 aa, Artificial Sequence
  Description of Artificial Sequence: Synthetic peptide
AEEEIRTTNPVATEQYGTVSSTNLQQLNR

SEQ ID NO: 5713 - protein, 31 aa, Artificial Sequence
  Description of Artificial Sequence: Synthetic polypeptide
DEEEIRTTNPVATEQYGQCVCSTNHDQRGNR

SEQ ID NO: 5714 - protein, 30 aa, Artificial Sequence
  Description of Artificial Sequence: Synthetic polypeptide
DEEEIRTTNPVATEQYGSVSFTNEQRGEEH

SEQ ID NO: 5715 - protein, 28 aa, Artificial Sequence
  Description of Artificial Sequence: Synthetic peptide
AEEEIRTTNPVATEQYGTVSTNLQFENL

SEQ ID NO: 5716 - protein, 30 aa, Artificial Sequence
  Description of Artificial Sequence: Synthetic polypeptide
DEEEIRTTNPVATEQYGSVSTNHQCFGFNQ

SEQ ID NO: 5717 - protein, 30 aa, Artificial Sequence
  Description of Artificial Sequence: Synthetic polypeptide
MEEEIRTTNPVATEQYGSVSTNLQNGGNTA

SEQ ID NO: 5718 - protein, 31 aa, Artificial Sequence
  Description of Artificial Sequence: Synthetic polypeptide
DEEEIRTTNPVATEQYGQTVSTNLQRGEPRS

SEQ ID NO: 5719 - protein, 30 aa, Artificial Sequence
  Description of Artificial Sequence: Synthetic polypeptide
DEVEIRTTNPVATEQYGSVSTNLQSTGTNF

SEQ ID NO: 5720 - protein, 30 aa, Artificial Sequence
  Description of Artificial Sequence: Synthetic polypeptide
AEEEIRTTNPVATEQYGTVSTNLQIEGNAR

SEQ ID NO: 5721 - protein, 30 aa, Artificial Sequence
  Description of Artificial Sequence: Synthetic polypeptide
AEEEIRTTNPVATEQYGTVSTNLQNLGNNR

SEQ ID NO: 5722 - protein, 29 aa, Artificial Sequence
  Description of Artificial Sequence: Synthetic peptide
AEEEIRTTNPVATEQYGSVYTNLQIYGNN

SEQ ID NO: 5723 - protein, 31 aa, Artificial Sequence
  Description of Artificial Sequence: Synthetic polypeptide
DEEEIRTTNPVATEQYGSVSTNLLQYGEDFR

SEQ ID NO: 5724 - protein, 30 aa, Artificial Sequence
  Description of Artificial Sequence: Synthetic polypeptide
AEEEIRTTNPVATEQYGSVVSTNLQGDGNQ

SEQ ID NO: 5725 - protein, 30 aa, Artificial Sequence
  Description of Artificial Sequence: Synthetic polypeptide
AEEEIRTTNPVATEQYGSVVSTNLQDVGNG

SEQ ID NO: 5726 - protein, 30 aa, Artificial Sequence
  Description of Artificial Sequence: Synthetic polypeptide
AEEEIRTTNPVATEQYGSVVSTNLQDTGNN

SEQ ID NO: 5727 - protein, 29 aa, Artificial Sequence
  Description of Artificial Sequence: Synthetic peptide
AEEEIRTTNPVATEQYGTVSTNLQPGGNS

SEQ ID NO: 5728 - protein, 30 aa, Artificial Sequence
  Description of Artificial Sequence: Synthetic polypeptide
DEEEIRTTNPVATEQYGSVSTNDQRGGGIL

SEQ ID NO: 5729 - protein, 30 aa, Artificial Sequence
  Description of Artificial Sequence: Synthetic polypeptide
AEEEIRTTNPVATEQYGTVSTNLQPTGNPR

SEQ ID NO: 5730 - protein, 28 aa, Artificial Sequence
  Description of Artificial Sequence: Synthetic peptide
NEEEIRTTNPVATEQYGSVATALQDGPR

SEQ ID NO: 5731 - protein, 31 aa, Artificial Sequence
  Description of Artificial Sequence: Synthetic polypeptide
DEVEIRTTNPVATEQYGSVSTTGLQRGDNER

SEQ ID NO: 5732 - protein, 31 aa, Artificial Sequence
  Description of Artificial Sequence: Synthetic polypeptide
DEEEIRTTNPVATEQYGSVSTNLQDGGGNEP

SEQ ID NO: 5733 - protein, 30 aa, Artificial Sequence
  Description of Artificial Sequence: Synthetic polypeptide
DEEEIRTTNPVATEQYGSVSTNDQLGSNGV

SEQ ID NO: 5734 - protein, 30 aa, Artificial Sequence
  Description of Artificial Sequence: Synthetic polypeptide
AEEEIRTTNPVATEQYGSVVSTNLNRGENN

SEQ ID NO: 5735 - protein, 30 aa, Artificial Sequence
  Description of Artificial Sequence: Synthetic polypeptide
AEEEIRTTNPVATEQYGTVSTNLQREGVER

SEQ ID NO: 5736 - protein, 29 aa, Artificial Sequence
  Description of Artificial Sequence: Synthetic peptide
AEEEIRTTNPVATEQYGSVYTNLQYGNLD

SEQ ID NO: 5737 - protein, 30 aa, Artificial Sequence
  Description of Artificial Sequence: Synthetic polypeptide
AEEEIRTTNPVATEQYGSVVSTNLQQVGNA

SEQ ID NO: 5738 - protein, 31 aa, Artificial Sequence
  Description of Artificial Sequence: Synthetic polypeptide
DEEEIRTTNPVATEQYGSVSTNLLQSGGNDD

SEQ ID NO: 5739 - protein, 30 aa, Artificial Sequence
  Description of Artificial Sequence: Synthetic polypeptide
AEEEIRTTNPVATEQYGSVVSTNLQSGNNA

SEQ ID NO: 5740 - protein, 30 aa, Artificial Sequence
  Description of Artificial Sequence: Synthetic polypeptide
DEEEIRTTNPVATEQYGSVSTNDQLGQNDN

SEQ ID NO: 5741 - protein, 29 aa, Artificial Sequence
  Description of Artificial Sequence: Synthetic peptide
AEEEIRTTNPVATEQYGSVYTNLQIGNDN

SEQ ID NO: 5742 - protein, 30 aa, Artificial Sequence
  Description of Artificial Sequence: Synthetic polypeptide
AEEEIRTTNPVATEQYGSVVSTNMQIGNTR

SEQ ID NO: 5743 - protein, 30 aa, Artificial Sequence
  Description of Artificial Sequence: Synthetic polypeptide
MEEEIRTTNPVATEQYGSVSTNLQRATNFY

SEQ ID NO: 5744 - protein, 28 aa, Artificial Sequence
  Description of Artificial Sequence: Synthetic peptide
AEEEIRTTNPVATEQYGTVSTNLNPGNT

SEQ ID NO: 5745 - protein, 31 aa, Artificial Sequence
  Description of Artificial Sequence: Synthetic polypeptide
AEEEIRTTNPVATEQYGSVSVTTNLQERGNL

SEQ ID NO: 5746 - protein, 30 aa, Artificial Sequence
  Description of Artificial Sequence: Synthetic polypeptide
MEEEIRTTNPVATEQYGSVSTNLQQGNEGA

SEQ ID NO: 5747 - protein, 30 aa, Artificial Sequence
  Description of Artificial Sequence: Synthetic polypeptide
DEEEIRTTNPVATEQYGDVSTNLQNGDNPQ

SEQ ID NO: 5748 - protein, 30 aa, Artificial Sequence
  Description of Artificial Sequence: Synthetic polypeptide
AEEEIRTTNPVATEQYGSVSVTSVLQAGNR

SEQ ID NO: 5749 - protein, 30 aa, Artificial Sequence
  Description of Artificial Sequence: Synthetic polypeptide
DEEEIRTTNPVATEQYGDVSTNLQNGDNPN

SEQ ID NO: 5750 - protein, 30 aa, Artificial Sequence
  Description of Artificial Sequence: Synthetic polypeptide
DEVEIRTTNPVATEQYGSVSTNNDQRGNDG

SEQ ID NO: 5751 - protein, 30 aa, Artificial Sequence
  Description of Artificial Sequence: Synthetic polypeptide
AEEEIRTTNPVATEQYGSVVSTNLSGSGNR

SEQ ID NO: 5752 - protein, 28 aa, Artificial Sequence
  Description of Artificial Sequence: Synthetic peptide
DNEEIRSTNPVATEQYGSSSTNQQRGNV

SEQ ID NO: 5753 - protein, 30 aa, Artificial Sequence
  Description of Artificial Sequence: Synthetic polypeptide
DEEEIRTTNPVATEQYGSVSTNDQNGTNVA

SEQ ID NO: 5754 - protein, 30 aa, Artificial Sequence
  Description of Artificial Sequence: Synthetic polypeptide
DEEEIRATNPVATEQYGNVSDTNLFQGGNR

SEQ ID NO: 5755 - protein, 31 aa, Artificial Sequence
  Description of Artificial Sequence: Synthetic polypeptide
DEEEIRTTNPVATEQYGSVSTNLLQVEGNEF

SEQ ID NO: 5756 - protein, 31 aa, Artificial Sequence
  Description of Artificial Sequence: Synthetic polypeptide
DEEEIRTTNPVATEQYGSVSTNLTQEDFGNF

SEQ ID NO: 5757 - protein, 30 aa, Artificial Sequence
  Description of Artificial Sequence: Synthetic polypeptide
DEEEIRTTNPVATEQYGNVSTTNLQMGNDA

SEQ ID NO: 5758 - protein, 30 aa, Artificial Sequence
  Description of Artificial Sequence: Synthetic polypeptide
DEEEIRTTNPVATEQYGSVSTNHQNNGSRD

SEQ ID NO: 5759 - protein, 30 aa, Artificial Sequence
  Description of Artificial Sequence: Synthetic polypeptide
DEEEIRATNPVATEQYGNVSATNLVQDGNR

SEQ ID NO: 5760 - protein, 29 aa, Artificial Sequence
  Description of Artificial Sequence: Synthetic peptide
AEEEIRTTNPVATEQYGTVSTNLNQGNRE

SEQ ID NO: 5761 - protein, 31 aa, Artificial Sequence
  Description of Artificial Sequence: Synthetic polypeptide
DEEEIRTTNPVATEQYGSVSTNLLQTGQDPR

SEQ ID NO: 5762 - protein, 31 aa, Artificial Sequence
  Description of Artificial Sequence: Synthetic polypeptide
DEEEIRTTNPVATEQYGSVSFTNLQNGFNTE

SEQ ID NO: 5763 - protein, 29 aa, Artificial Sequence
  Description of Artificial Sequence: Synthetic peptide
DEEEIRTTNPVATEQYGSVSTNDQLDNQH

SEQ ID NO: 5764 - protein, 30 aa, Artificial Sequence
  Description of Artificial Sequence: Synthetic polypeptide
DEEEIRTTNPVATEQYGDVSTNLQPDGGNI

SEQ ID NO: 5765 - protein, 30 aa, Artificial Sequence
  Description of Artificial Sequence: Synthetic polypeptide
DEVEIRTTNPVATEQYGSVSTNLQTGGNDD

SEQ ID NO: 5766 - protein, 30 aa, Artificial Sequence
  Description of Artificial Sequence: Synthetic polypeptide
AEEEIRTTNPVATEQYGSVSVTTNLQEGNQ

SEQ ID NO: 5767 - protein, 29 aa, Artificial Sequence
  Description of Artificial Sequence: Synthetic peptide
DEEEIRTTNPVATEQYGDVSTNLQIGTGD

SEQ ID NO: 5768 - protein, 30 aa, Artificial Sequence
  Description of Artificial Sequence: Synthetic polypeptide
DEEEIRTTNPVATEQYGSVSTNLQYEDNFE

SEQ ID NO: 5769 - protein, 30 aa, Artificial Sequence
  Description of Artificial Sequence: Synthetic polypeptide
MEEEIRTTNPVATEQYGSVSTNLQRNANFN

SEQ ID NO: 5770 - protein, 30 aa, Artificial Sequence
  Description of Artificial Sequence: Synthetic polypeptide
MEEEIRTTNPVATEQYGSVSTNLQRNANIY

SEQ ID NO: 5771 - protein, 30 aa, Artificial Sequence
  Description of Artificial Sequence: Synthetic polypeptide
DEVEIRTTNPVATEQYGSVSTNLQRDGETL

SEQ ID NO: 5772 - protein, 32 aa, Artificial Sequence
  Description of Artificial Sequence: Synthetic polypeptide
DEEEIRTTNPVATEQYGSVSFTNLQREGLNEE

SEQ ID NO: 5773 - protein, 29 aa, Artificial Sequence
  Description of Artificial Sequence: Synthetic peptide
QEEEIRTTNPVATEQYGSVSANLQNPNRN

SEQ ID NO: 5774 - protein, 30 aa, Artificial Sequence
  Description of Artificial Sequence: Synthetic polypeptide
DEVEIRTTNPVATEQYGSVSTNLQPDGNDL

SEQ ID NO: 5775 - protein, 30 aa, Artificial Sequence
  Description of Artificial Sequence: Synthetic polypeptide
DEEEIRTTNPVATEQYGDVSTNNLQNFGNL

SEQ ID NO: 5776 - protein, 28 aa, Artificial Sequence
  Description of Artificial Sequence: Synthetic peptide
DNEEISTTNPVATAQYGSVSTNPSRGNR

SEQ ID NO: 5777 - protein, 30 aa, Artificial Sequence
  Description of Artificial Sequence: Synthetic polypeptide
DEEEIRTTNPVATEQYGDVSTPNLQNGNAQ

SEQ ID NO: 5778 - protein, 29 aa, Artificial Sequence
  Description of Artificial Sequence: Synthetic peptide
DEVEIRTTNPVATEQYGSVSTVLQHTGNS

SEQ ID NO: 5779 - protein, 28 aa, Artificial Sequence
  Description of Artificial Sequence: Synthetic peptide
DEEEIRTTNPVATEQYGSVSTNDQNTEG

SEQ ID NO: 5780 - protein, 30 aa, Artificial Sequence
  Description of Artificial Sequence: Synthetic polypeptide
DEEEIRTTNPVATEQYGDVSTNNLNQDGNE

SEQ ID NO: 5781 - protein, 31 aa, Artificial Sequence
  Description of Artificial Sequence: Synthetic polypeptide
DEVEIRTTNPVATEQYGSVSTVNGLQQAGNR

SEQ ID NO: 5782 - protein, 32 aa, Artificial Sequence
  Description of Artificial Sequence: Synthetic polypeptide
DEEEIRTTNPVATEQYGSVSTNDQYRSGNIRP

SEQ ID NO: 5783 - protein, 28 aa, Artificial Sequence
  Description of Artificial Sequence: Synthetic peptide
AEEEIRTTNPVATEQYGSVYTPLQVGND

SEQ ID NO: 5784 - protein, 30 aa, Artificial Sequence
  Description of Artificial Sequence: Synthetic polypeptide
AEEEIRTTNPVATEQYGSVVSTNLMIGNNR

SEQ ID NO: 5785 - protein, 31 aa, Artificial Sequence
  Description of Artificial Sequence: Synthetic polypeptide
DEEEIRTTNPVATEQYGSVSTNLQDGGNDKS

SEQ ID NO: 5786 - protein, 29 aa, Artificial Sequence
  Description of Artificial Sequence: Synthetic peptide
AEEEIRTTNPVATEQYGSVYTTLQRGNDN

SEQ ID NO: 5787 - protein, 30 aa, Artificial Sequence
  Description of Artificial Sequence: Synthetic polypeptide
DEVEIRTTNPVATEQYGSVSTWNDQRGNQG

SEQ ID NO: 5788 - protein, 30 aa, Artificial Sequence
  Description of Artificial Sequence: Synthetic polypeptide
DEEEIRTTNPVATEQYGSVSTNHQRGEFQF

SEQ ID NO: 5789 - protein, 30 aa, Artificial Sequence
  Description of Artificial Sequence: Synthetic polypeptide
DEEEIRTTNPVATEQYGSVSTNDSQEGGNS

SEQ ID NO: 5790 - protein, 29 aa, Artificial Sequence
  Description of Artificial Sequence: Synthetic peptide
DEVEIRTTNPVATEQYGSVSTNLQNPGEM

SEQ ID NO: 5791 - protein, 29 aa, Artificial Sequence
  Description of Artificial Sequence: Synthetic peptide
DEVEIRTTNPVATEQYGSVSTNLQNIGEQ

SEQ ID NO: 5792 - protein, 31 aa, Artificial Sequence
  Description of Artificial Sequence: Synthetic polypeptide
DEEEIRTTNPVATEQYGSVSTNLTESFGNRP

SEQ ID NO: 5793 - protein, 31 aa, Artificial Sequence
  Description of Artificial Sequence: Synthetic polypeptide
DEEEIRTTNPVATEQYGQTISTNELQRGNPR

SEQ ID NO: 5794 - protein, 30 aa, Artificial Sequence
  Description of Artificial Sequence: Synthetic polypeptide
DEEEIRTTNPVATEQYGSVSTNDSQPGGNT

SEQ ID NO: 5795 - protein, 30 aa, Artificial Sequence
  Description of Artificial Sequence: Synthetic polypeptide
DEEEIRTTNPVATEQYGSVSTNLNGEDENR

SEQ ID NO: 5796 - protein, 29 aa, Artificial Sequence
  Description of Artificial Sequence: Synthetic peptide
AEEEIRTTNPVATEQYGSVVSTNLLRGTA

SEQ ID NO: 5797 - protein, 30 aa, Artificial Sequence
  Description of Artificial Sequence: Synthetic polypeptide
QEEEIRTTNPVATEQYGSVATNLERDGNER

SEQ ID NO: 5798 - protein, 30 aa, Artificial Sequence
  Description of Artificial Sequence: Synthetic polypeptide
AEEEIRTTNPVATEQYGSVVSTNSLQNGNL

SEQ ID NO: 5799 - protein, 30 aa, Artificial Sequence
  Description of Artificial Sequence: Synthetic polypeptide
DEEEIRTTNPVATEQYGSVSTNDQYGGNLG

SEQ ID NO: 5800 - protein, 30 aa, Artificial Sequence
  Description of Artificial Sequence: Synthetic polypeptide
MEEEIRTTNPVATEQYGSVSTNLQRNDNEY

SEQ ID NO: 5801 - protein, 30 aa, Artificial Sequence
  Description of Artificial Sequence: Synthetic polypeptide
DEEEIRTTNPVATEQYGSVSTNLNLDGGNE

SEQ ID NO: 5802 - protein, 29 aa, Artificial Sequence
  Description of Artificial Sequence: Synthetic peptide
AEEEIRTTNPVATEQYGTVSGTNLQGNNR

SEQ ID NO: 5803 - protein, 30 aa, Artificial Sequence
  Description of Artificial Sequence: Synthetic polypeptide
DEEEIRTTNPVATEQYGDVSTNNLQSFGNP

SEQ ID NO: 5804 - protein, 29 aa, Artificial Sequence
  Description of Artificial Sequence: Synthetic peptide
DEEEIRTTNPVATEQYGSVSTNLMDDGSM

SEQ ID NO: 5805 - protein, 30 aa, Artificial Sequence
  Description of Artificial Sequence: Synthetic polypeptide
MEEEIRTTNPVATEQYGSVSTNLQLVGNQV

SEQ ID NO: 5806 - protein, 30 aa, Artificial Sequence
  Description of Artificial Sequence: Synthetic polypeptide
DEEEIRTTNPVATEQYGSVSTNLNEVGGNT

SEQ ID NO: 5807 - protein, 30 aa, Artificial Sequence
  Description of Artificial Sequence: Synthetic polypeptide
DEEEIRATNPVATEQYGMVSMTNLFQNGNR

SEQ ID NO: 5808 - protein, 30 aa, Artificial Sequence
  Description of Artificial Sequence: Synthetic polypeptide
AEEEIRTTNPVATEQYGSVVSTTNLQRTNT

SEQ ID NO: 5809 - protein, 30 aa, Artificial Sequence
  Description of Artificial Sequence: Synthetic polypeptide
DEEEIRTTNPVATEQYGSVSTNHQRDGEID

SEQ ID NO: 5810 - protein, 31 aa, Artificial Sequence
  Description of Artificial Sequence: Synthetic polypeptide
DEEEIRTTNPVATEQYGQCVSMTNMQRGSNR

SEQ ID NO: 5811 - protein, 30 aa, Artificial Sequence
  Description of Artificial Sequence: Synthetic polypeptide
AEEEIRTTNPVATEQYGTVSTNNLQRGNDI

SEQ ID NO: 5812 - protein, 30 aa, Artificial Sequence
  Description of Artificial Sequence: Synthetic polypeptide
DEEEIRTTNPVATEQYGSVSTNHQREGELL

SEQ ID NO: 5813 - protein, 30 aa, Artificial Sequence
  Description of Artificial Sequence: Synthetic polypeptide
MEEEIRTTNPVATEQYGSVSTNLQRNVNFV

SEQ ID NO: 5814 - protein, 30 aa, Artificial Sequence
  Description of Artificial Sequence: Synthetic polypeptide
DEEEIRTTNPVATEQYGSVSTNLIMNGGNP

SEQ ID NO: 5815 - protein, 30 aa, Artificial Sequence
  Description of Artificial Sequence: Synthetic polypeptide
DEEEIRTTNPVATEQYGSVSTNLLSMGNTA

SEQ ID NO: 5816 - protein, 29 aa, Artificial Sequence
  Description of Artificial Sequence: Synthetic peptide
QEEEIRTTNPVATEQYGSVSANLQNDNRE

SEQ ID NO: 5817 - protein, 29 aa, Artificial Sequence
  Description of Artificial Sequence: Synthetic peptide
QEEEIRTTNPVATEQYGSVSANLQNGNEE

SEQ ID NO: 5818 - protein, 31 aa, Artificial Sequence
  Description of Artificial Sequence: Synthetic polypeptide
DEEEIRTTNPVATEQYGSVSTNHQRFMQNTR

SEQ ID NO: 5819 - protein, 29 aa, Artificial Sequence
  Description of Artificial Sequence: Synthetic peptide
NEEEIATTNPVATEQYGSVSTNLQDGDRM

SEQ ID NO: 5820 - protein, 29 aa, Artificial Sequence
  Description of Artificial Sequence: Synthetic peptide
NEEEIATTNPVATEQYGSVSTNLQQGDDR

SEQ ID NO: 5821 - protein, 31 aa, Artificial Sequence
  Description of Artificial Sequence: Synthetic polypeptide
DEEEIRTTNPVATEQYGSVSTNDQSRGEDRQ

SEQ ID NO: 5822 - protein, 29 aa, Artificial Sequence
  Description of Artificial Sequence: Synthetic peptide
NEEEIATTNPVATESYGSVSTNLQQGNDR

SEQ ID NO: 5823 - protein, 30 aa, Artificial Sequence
  Description of Artificial Sequence: Synthetic polypeptide
DEEEIRTTNPVATEQYGSVSGTNLQAGGEI

SEQ ID NO: 5824 - protein, 30 aa, Artificial Sequence
  Description of Artificial Sequence: Synthetic polypeptide
DEEEIRTTNPVATEQYGSVSTNDQVIGFNQ

SEQ ID NO: 5825 - protein, 30 aa, Artificial Sequence
  Description of Artificial Sequence: Synthetic polypeptide
DEEEIRTTNPVATEQYGSVSTNLNQMDQNA

SEQ ID NO: 5826 - protein, 30 aa, Artificial Sequence
  Description of Artificial Sequence: Synthetic polypeptide
NEEEIRTTNPVATEQYGSVATNLQRGENDT

SEQ ID NO: 5827 - protein, 30 aa, Artificial Sequence
  Description of Artificial Sequence: Synthetic polypeptide
DEEEIRTTNPVATEQYGSVSTNLNQGTGFE

SEQ ID NO: 5828 - protein, 28 aa, Artificial Sequence
  Description of Artificial Sequence: Synthetic peptide
DEEEIRTTNPCATEGYGSCSTNLTRGNA

SEQ ID NO: 5829 - protein, 30 aa, Artificial Sequence
  Description of Artificial Sequence: Synthetic polypeptide
AEEEIRTTNPVATEQYGSVVSTNLGGYGNR

SEQ ID NO: 5830 - protein, 31 aa, Artificial Sequence
  Description of Artificial Sequence: Synthetic polypeptide
DEEEIRTTNPVATEQYGSVSTNEIQRGGNEV

SEQ ID NO: 5831 - protein, 30 aa, Artificial Sequence
  Description of Artificial Sequence: Synthetic polypeptide
DEEEIRTTNPVATEQYGEVSTNAHHRTGNR

SEQ ID NO: 5832 - protein, 29 aa, Artificial Sequence
  Description of Artificial Sequence: Synthetic peptide
DEEEIRTTNPVATEQYGSVSTNLSDVMNV

SEQ ID NO: 5833 - protein, 30 aa, Artificial Sequence
  Description of Artificial Sequence: Synthetic polypeptide
AEEEIRTTNPVATEQYGSVTNTNLQGGNRN

SEQ ID NO: 5834 - protein, 32 aa, Artificial Sequence
  Description of Artificial Sequence: Synthetic polypeptide
DEEEIRTTNPVATEQYGEVSCTNLSQRPGNTR

SEQ ID NO: 5835 - protein, 30 aa, Artificial Sequence
  Description of Artificial Sequence: Synthetic polypeptide
AEEEIRTTNPVATEQYGSVTATNLQRGNNS

SEQ ID NO: 5836 - protein, 28 aa, Artificial Sequence
  Description of Artificial Sequence: Synthetic peptide
DEDAIRTTNPVATEQYGSFSTNLIHGNR

SEQ ID NO: 5837 - protein, 29 aa, Artificial Sequence
  Description of Artificial Sequence: Synthetic peptide
DEEEIRTTNPVATEQYGSVSTNLQANIIV

SEQ ID NO: 5838 - protein, 28 aa, Artificial Sequence
  Description of Artificial Sequence: Synthetic peptide
DEDAIRTTNPVATEQYGSYSTNLIIGNR

SEQ ID NO: 5839 - protein, 29 aa, Artificial Sequence
  Description of Artificial Sequence: Synthetic peptide
QEEEICTTNPVATEQYGSVSTNLAQNGNP

SEQ ID NO: 5840 - protein, 30 aa, Artificial Sequence
  Description of Artificial Sequence: Synthetic polypeptide
DGEEIRSTNPVATEQYGSVSTNLQARDGQR

SEQ ID NO: 5841 - protein, 30 aa, Artificial Sequence
  Description of Artificial Sequence: Synthetic polypeptide
DEEEIRTTNPVATEQYGSVSTNLPGTGFNQ

SEQ ID NO: 5842 - protein, 30 aa, Artificial Sequence
  Description of Artificial Sequence: Synthetic polypeptide
DGEEIRSTNPVATEQYGSVSTNLQTRNGQR

SEQ ID NO: 5843 - protein, 30 aa, Artificial Sequence
  Description of Artificial Sequence: Synthetic polypeptide
DEEEIRTTNPVATEQYGEVSTNLQDEGNMS

SEQ ID NO: 5844 - protein, 30 aa, Artificial Sequence
  Description of Artificial Sequence: Synthetic polypeptide
DEEEIRTTNPVATEQYGSVSTNGQWSGERA

SEQ ID NO: 5845 - protein, 29 aa, Artificial Sequence
  Description of Artificial Sequence: Synthetic peptide
DEEEIRTTNPVATEQYGSVSTNLQAPVQF

SEQ ID NO: 5846 - protein, 31 aa, Artificial Sequence
  Description of Artificial Sequence: Synthetic polypeptide
DEEEIRTTNPVATEQYGSFVSTNLQGSGNND

SEQ ID NO: 5847 - protein, 30 aa, Artificial Sequence
  Description of Artificial Sequence: Synthetic polypeptide
DEEEIRTTNPVATEQYGEVSTNLQQGQNNA

SEQ ID NO: 5848 - protein, 30 aa, Artificial Sequence
  Description of Artificial Sequence: Synthetic polypeptide
DEEEIRTTNPVATEQYGEVSTMNQSQSGNR

SEQ ID NO: 5849 - protein, 30 aa, Artificial Sequence
  Description of Artificial Sequence: Synthetic polypeptide
QEEEICTTNPVATEGYGSVSTNLQDRGNSR

SEQ ID NO: 5850 - protein, 31 aa, Artificial Sequence
  Description of Artificial Sequence: Synthetic polypeptide
DEEEIRTTNPVATEQYGSVSTNGQTGGGNER

SEQ ID NO: 5851 - protein, 30 aa, Artificial Sequence
  Description of Artificial Sequence: Synthetic polypeptide
AEEEIRTTNPVATEQYGSVTSDTNLQNQNR

SEQ ID NO: 5852 - protein, 29 aa, Artificial Sequence
  Description of Artificial Sequence: Synthetic peptide
AEEEIRTTNPVATEQYGVVSTTLQRGNVE

SEQ ID NO: 5853 - protein, 31 aa, Artificial Sequence
  Description of Artificial Sequence: Synthetic polypeptide
DEEEIRTTNPVATEQYGSVSTNLQAIGINEL

SEQ ID NO: 5854 - protein, 30 aa, Artificial Sequence
  Description of Artificial Sequence: Synthetic polypeptide
DEEEIRTTNPVATEQYGSVSTNLQAMGDGD

SEQ ID NO: 5855 - protein, 29 aa, Artificial Sequence
  Description of Artificial Sequence: Synthetic peptide
AEEEIRTTNPVATEQYGSVTTNLQALDNR

SEQ ID NO: 5856 - protein, 30 aa, Artificial Sequence
  Description of Artificial Sequence: Synthetic polypeptide
AEEEIRTTNPVATEQYGSVTTNLDQGTGNR

SEQ ID NO: 5857 - protein, 32 aa, Artificial Sequence
  Description of Artificial Sequence: Synthetic polypeptide
DEEEIRTTNPVATEQYGQSVPSENLSQRGNNR

SEQ ID NO: 5858 - protein, 29 aa, Artificial Sequence
  Description of Artificial Sequence: Synthetic peptide
AEEEIRTTNPVATEQYGSVTSTSLQSGNV

SEQ ID NO: 5859 - protein, 31 aa, Artificial Sequence
  Description of Artificial Sequence: Synthetic polypeptide
DEEEIRTTNPVATEQYGSVSTNLQAMGGNDI

SEQ ID NO: 5860 - protein, 30 aa, Artificial Sequence
  Description of Artificial Sequence: Synthetic polypeptide
DEEEIRTTNPVATEQYGSVSTNGGQTGDNL

SEQ ID NO: 5861 - protein, 30 aa, Artificial Sequence
  Description of Artificial Sequence: Synthetic polypeptide
AEEEIRTTNPVATEQYGSVTSTNLQLQGNP

SEQ ID NO: 5862 - protein, 31 aa, Artificial Sequence
  Description of Artificial Sequence: Synthetic polypeptide
AEEEIRTTNPVATEQYGSVTSTNLQGNGDNR

SEQ ID NO: 5863 - protein, 31 aa, Artificial Sequence
  Description of Artificial Sequence: Synthetic polypeptide
AEEEIRTTNPVATEQYGSVTSTNLQAIGVNR

SEQ ID NO: 5864 - protein, 30 aa, Artificial Sequence
  Description of Artificial Sequence: Synthetic polypeptide
AEEEIRTTNPVATEQYGSVTSTNLEQGGNN

SEQ ID NO: 5865 - protein, 30 aa, Artificial Sequence
  Description of Artificial Sequence: Synthetic polypeptide
QEEEICTTNPVATEMYGSVSTNLQDRGNDR

SEQ ID NO: 5866 - protein, 30 aa, Artificial Sequence
  Description of Artificial Sequence: Synthetic polypeptide
DEEEIRTTNPVATEQYGSVSTNGQSEGNAN

SEQ ID NO: 5867 - protein, 30 aa, Artificial Sequence
  Description of Artificial Sequence: Synthetic polypeptide
DEEEIRTTNPVATEQYGSVSTNGQSGNLTV

SEQ ID NO: 5868 - protein, 30 aa, Artificial Sequence
  Description of Artificial Sequence: Synthetic polypeptide
AEEEIRTTNPVATEQYGSVTSGNLQRGNDQ

SEQ ID NO: 5869 - protein, 31 aa, Artificial Sequence
  Description of Artificial Sequence: Synthetic polypeptide
DEEEIRTTNPVATEQYGSVSTNLSFHGSNRV

SEQ ID NO: 5870 - protein, 31 aa, Artificial Sequence
  Description of Artificial Sequence: Synthetic polypeptide
DEEEIRTTNPVATEQYGQSVSNTNEQRGNQQ

SEQ ID NO: 5871 - protein, 29 aa, Artificial Sequence
  Description of Artificial Sequence: Synthetic peptide
AEEEIRTTNPVATEQYGSVTTNLQIGSDR

SEQ ID NO: 5872 - protein, 32 aa, Artificial Sequence
  Description of Artificial Sequence: Synthetic polypeptide
DEEEIRTTNPVATEQYGQSVSTELHQRGSNRI

SEQ ID NO: 5873 - protein, 29 aa, Artificial Sequence
  Description of Artificial Sequence: Synthetic peptide
DGEEIRTTNPVATEQWGSVNSTLLQRGTR

SEQ ID NO: 5874 - protein, 28 aa, Artificial Sequence
  Description of Artificial Sequence: Synthetic peptide
MEREIRTTNPVATEQYGSVWTNLQIGDR

SEQ ID NO: 5875 - protein, 29 aa, Artificial Sequence
  Description of Artificial Sequence: Synthetic peptide
DEEEIRTTNPVATEQYGQCVSWNLQRGQQ

SEQ ID NO: 5876 - protein, 30 aa, Artificial Sequence
  Description of Artificial Sequence: Synthetic polypeptide
MEREIRTTNPVATEQYGSVSTNLQRGGNFY

SEQ ID NO: 5877 - protein, 29 aa, Artificial Sequence
  Description of Artificial Sequence: Synthetic peptide
QEEEICTTNPVATEQYGSVSTNLQHGNHL

SEQ ID NO: 5878 - protein, 30 aa, Artificial Sequence
  Description of Artificial Sequence: Synthetic polypeptide
DEEEIRTTNPVATEQYGSVSTNLNTGSGNE

SEQ ID NO: 5879 - protein, 31 aa, Artificial Sequence
  Description of Artificial Sequence: Synthetic polypeptide
DEEEIRTTNPVATEQYGEVCSDTPNLQFGNR

SEQ ID NO: 5880 - protein, 29 aa, Artificial Sequence
  Description of Artificial Sequence: Synthetic peptide
QEEEICTTNPVATEQYGSVSTNLQRQNPV

SEQ ID NO: 5881 - protein, 29 aa, Artificial Sequence
  Description of Artificial Sequence: Synthetic peptide
MENEIRTTNPVATEQYGSVSTSLQGGNHR

SEQ ID NO: 5882 - protein, 29 aa, Artificial Sequence
  Description of Artificial Sequence: Synthetic peptide
QEEEICTTNPVATEQYGSVSTNLQRQNTA

SEQ ID NO: 5883 - protein, 29 aa, Artificial Sequence
  Description of Artificial Sequence: Synthetic peptide
QEEEICTTNPVATEQYGSVSTNLQRVNEQ

SEQ ID NO: 5884 - protein, 29 aa, Artificial Sequence
  Description of Artificial Sequence: Synthetic peptide
DEEEIRTTNPVATEQYGSVSTNGGNEGNF

SEQ ID NO: 5885 - protein, 29 aa, Artificial Sequence
  Description of Artificial Sequence: Synthetic peptide
DGEEIRTTNPVATEQWGSVTSTPLQRGVR

SEQ ID NO: 5886 - protein, 29 aa, Artificial Sequence
  Description of Artificial Sequence: Synthetic peptide
NEEEIRTTNPVATEQYGSISTHLQRVGPR

SEQ ID NO: 5887 - protein, 31 aa, Artificial Sequence
  Description of Artificial Sequence: Synthetic polypeptide
DEEEIRTTNPVATEQYGSVSTNGEQRNGNQS

SEQ ID NO: 5888 - protein, 30 aa, Artificial Sequence
  Description of Artificial Sequence: Synthetic polypeptide
DEEEIRATNPVATEQYGFVSATNLFQTGNR

SEQ ID NO: 5889 - protein, 31 aa, Artificial Sequence
  Description of Artificial Sequence: Synthetic polypeptide
DEEEIRTTNPVATEQYGSVSTNGEGQERGNA

SEQ ID NO: 5890 - protein, 31 aa, Artificial Sequence
  Description of Artificial Sequence: Synthetic polypeptide
DEEEIRTTNPVATEQYGNVTNSTNELQMGNR

SEQ ID NO: 5891 - protein, 28 aa, Artificial Sequence
  Description of Artificial Sequence: Synthetic peptide
MEREIRTTNPVATEQYGSVWTNLQTGSR

SEQ ID NO: 5892 - protein, 29 aa, Artificial Sequence
  Description of Artificial Sequence: Synthetic peptide
NEDEIRTTNPVATEQYGSVSTNLGQGGNH

SEQ ID NO: 5893 - protein, 31 aa, Artificial Sequence
  Description of Artificial Sequence: Synthetic polypeptide
DEEEIRTTNPVATEQYGSVSTNLQAQGNGPQ

SEQ ID NO: 5894 - protein, 30 aa, Artificial Sequence
  Description of Artificial Sequence: Synthetic polypeptide
AEEEIRTTNPVATEQYGSVVDTNLLQVGNR

SEQ ID NO: 5895 - protein, 28 aa, Artificial Sequence
  Description of Artificial Sequence: Synthetic peptide
QEEEICATNPVATEIYGSVSTDLQRGNR

SEQ ID NO: 5896 - protein, 29 aa, Artificial Sequence
  Description of Artificial Sequence: Synthetic peptide
DGEEIRTTNPVATEQWGSVTSTGLQRGER

SEQ ID NO: 5897 - protein, 30 aa, Artificial Sequence
  Description of Artificial Sequence: Synthetic polypeptide
DEEEIRTTNPVATEQYGSVSTNLIVGGNEQ

SEQ ID NO: 5898 - protein, 31 aa, Artificial Sequence
  Description of Artificial Sequence: Synthetic polypeptide
DEEEIRTTNPVATEQYGSVSTNLQAQGGNDT

SEQ ID NO: 5899 - protein, 29 aa, Artificial Sequence
  Description of Artificial Sequence: Synthetic peptide
DEEEIRATNPVATEQYGAVSTNLQRGSED

SEQ ID NO: 5900 - protein, 31 aa, Artificial Sequence
  Description of Artificial Sequence: Synthetic polypeptide
DEEEIRTTNPVATEQYGQSVCSNTYLQRNNR

SEQ ID NO: 5901 - protein, 30 aa, Artificial Sequence
  Description of Artificial Sequence: Synthetic polypeptide
DEEEIRTTNPVATEQYGSVSTNLPGGDNNQ

SEQ ID NO: 5902 - protein, 30 aa, Artificial Sequence
  Description of Artificial Sequence: Synthetic polypeptide
DEEEIRTTNPVATEQYGQSVCNTNDQRTNR

SEQ ID NO: 5903 - protein, 31 aa, Artificial Sequence
  Description of Artificial Sequence: Synthetic polypeptide
DEEEIRTTNPVATEQYGSVSTNGSLRGGNPR

SEQ ID NO: 5904 - protein, 29 aa, Artificial Sequence
  Description of Artificial Sequence: Synthetic peptide
QEEEICTTNPVATEQYGSVSTNLQFGNTD

SEQ ID NO: 5905 - protein, 31 aa, Artificial Sequence
  Description of Artificial Sequence: Synthetic polypeptide
DEEEIRTTNPVATEQYGQSVSTELQRSGNFP

SEQ ID NO: 5906 - protein, 28 aa, Artificial Sequence
  Description of Artificial Sequence: Synthetic peptide
NEDEIRTTNPVATEQYGSVPTNLQQGER

SEQ ID NO: 5907 - protein, 28 aa, Artificial Sequence
  Description of Artificial Sequence: Synthetic peptide
QEEEICTTNPVATEQYGSVSTNLQHANV

SEQ ID NO: 5908 - protein, 29 aa, Artificial Sequence
  Description of Artificial Sequence: Synthetic peptide
DEEEIRATNPVATEQYGAVSTNLQRGEGD

SEQ ID NO: 5909 - protein, 31 aa, Artificial Sequence
  Description of Artificial Sequence: Synthetic polypeptide
DEEEIRTTNPVATEQYGSVSTNLIQRGPEQP

SEQ ID NO: 5910 - protein, 31 aa, Artificial Sequence
  Description of Artificial Sequence: Synthetic polypeptide
AEEEIRTTNPVATEQYGSVVASTNLQRGTER

SEQ ID NO: 5911 - protein, 29 aa, Artificial Sequence
  Description of Artificial Sequence: Synthetic peptide
NEDEIRTTNPVATEQYGSVSTNLDQHGNI

SEQ ID NO: 5912 - protein, 28 aa, Artificial Sequence
  Description of Artificial Sequence: Synthetic peptide
NEEEIRTTNPVATEQYGSISTHLQRTGR

SEQ ID NO: 5913 - protein, 30 aa, Artificial Sequence
  Description of Artificial Sequence: Synthetic polypeptide
DEEEIRTTNPVATEQYGSVSTNLPGFGNQE

SEQ ID NO: 5914 - protein, 30 aa, Artificial Sequence
  Description of Artificial Sequence: Synthetic polypeptide
DEEEIRATNPVATEQYGFVSDTNLDQGGNR

SEQ ID NO: 5915 - protein, 31 aa, Artificial Sequence
  Description of Artificial Sequence: Synthetic polypeptide
DEEEIRTTNPVATEQYGQSVDSTNLQFDNRV

SEQ ID NO: 5916 - protein, 30 aa, Artificial Sequence
  Description of Artificial Sequence: Synthetic polypeptide
AEEEIRTTNPVATEQYGSVTTNLQREGGNG

SEQ ID NO: 5917 - protein, 30 aa, Artificial Sequence
  Description of Artificial Sequence: Synthetic polypeptide
DEEEIRTTNPVATEQYGSVSTNGQGIGNEV

SEQ ID NO: 5918 - protein, 31 aa, Artificial Sequence
  Description of Artificial Sequence: Synthetic polypeptide
DEEEIRTTNPVATEQYGSVSTNGLQSDGDNQ

SEQ ID NO: 5919 - protein, 31 aa, Artificial Sequence
  Description of Artificial Sequence: Synthetic polypeptide
DEEEIRTTNPVATEQYGSVSTNLPQVAQNDR

SEQ ID NO: 5920 - protein, 30 aa, Artificial Sequence
  Description of Artificial Sequence: Synthetic polypeptide
DEYEIRTTNPVATEQYGSVSTNLERFGQRY

SEQ ID NO: 5921 - protein, 30 aa, Artificial Sequence
  Description of Artificial Sequence: Synthetic polypeptide
NEEEIRTTNPVATEQYGQSVSTNLQGGSIR

SEQ ID NO: 5922 - protein, 31 aa, Artificial Sequence
  Description of Artificial Sequence: Synthetic polypeptide
DEEEIRTTNPVATEQYGSVSTNLPQVDSGND

SEQ ID NO: 5923 - protein, 28 aa, Artificial Sequence
  Description of Artificial Sequence: Synthetic peptide
DEYEIRTTNPVATEQYGFASTNLQQGNK

SEQ ID NO: 5924 - protein, 31 aa, Artificial Sequence
  Description of Artificial Sequence: Synthetic polypeptide
DEEEIRTTNPVATEQYGSVSTNLIRFGNNAS

SEQ ID NO: 5925 - protein, 28 aa, Artificial Sequence
  Description of Artificial Sequence: Synthetic peptide
NEAEIRTTNPVATEQYGSVFTNLQIGDR

SEQ ID NO: 5926 - protein, 31 aa, Artificial Sequence
  Description of Artificial Sequence: Synthetic polypeptide
DEEEIRTTNPVATEQYGSVSTNLPQQGNTTD

SEQ ID NO: 5927 - protein, 32 aa, Artificial Sequence
  Description of Artificial Sequence: Synthetic polypeptide
DEEEIRTTNPVATEQYGSVSTNGLQRGSNNEE

SEQ ID NO: 5928 - protein, 31 aa, Artificial Sequence
  Description of Artificial Sequence: Synthetic polypeptide
NEEEIRTTNPVATEQYGCVSTNLQERGNSRD

SEQ ID NO: 5929 - protein, 31 aa, Artificial Sequence
  Description of Artificial Sequence: Synthetic polypeptide
DEEEIRTTNPVATEQYGSVSTNLIQSIGENP

SEQ ID NO: 5930 - protein, 31 aa, Artificial Sequence
  Description of Artificial Sequence: Synthetic polypeptide
DEEEIRTTNPVATEQYGSVSTNLPQQGNTQQ

SEQ ID NO: 5931 - protein, 29 aa, Artificial Sequence
  Description of Artificial Sequence: Synthetic peptide
NEEEIRTTNPVATEQYGCVSTNLQEMINR

SEQ ID NO: 5932 - protein, 30 aa, Artificial Sequence
  Description of Artificial Sequence: Synthetic polypeptide
DEEEIRTTNPVATEQYGSVSGNLQQEGNEI

SEQ ID NO: 5933 - protein, 30 aa, Artificial Sequence
  Description of Artificial Sequence: Synthetic polypeptide
DEEEIRTTNPVATEQYGSVSTNGQISGNEN

SEQ ID NO: 5934 - protein, 30 aa, Artificial Sequence
  Description of Artificial Sequence: Synthetic polypeptide
DEEEIRTTNPVATEQYGSVSTNLISFGVNI

SEQ ID NO: 5935 - protein, 29 aa, Artificial Sequence
  Description of Artificial Sequence: Synthetic peptide
DEYEIRTTNPVATEQYGSVSTNDNDSGNR

SEQ ID NO: 5936 - protein, 30 aa, Artificial Sequence
  Description of Artificial Sequence: Synthetic polypeptide
DEEEIRTTNPVATEQYGSVSTNGLQSNGDN

SEQ ID NO: 5937 - protein, 30 aa, Artificial Sequence
  Description of Artificial Sequence: Synthetic polypeptide
DEEEIRTTNPVATEQYGSVSTNGLQSSGSN

SEQ ID NO: 5938 - protein, 32 aa, Artificial Sequence
  Description of Artificial Sequence: Synthetic polypeptide
DEEEIRTTNPVATEQYGSVSTNLSQRDGGNEN

SEQ ID NO: 5939 - protein, 28 aa, Artificial Sequence
  Description of Artificial Sequence: Synthetic peptide
DEEEIRTTNPCATEGYGSISTNLARGNW

SEQ ID NO: 5940 - protein, 30 aa, Artificial Sequence
  Description of Artificial Sequence: Synthetic polypeptide
DEEEIRTTNPVATEQYGEVSSTNLQEVGNG

SEQ ID NO: 5941 - protein, 29 aa, Artificial Sequence
  Description of Artificial Sequence: Synthetic peptide
DEEEIRTTNPVATEQYGSGSPSVLQRGNN

SEQ ID NO: 5942 - protein, 28 aa, Artificial Sequence
  Description of Artificial Sequence: Synthetic peptide
NEAEIRTTNPVATECYGSVSTNLQKGER

SEQ ID NO: 5943 - protein, 31 aa, Artificial Sequence
  Description of Artificial Sequence: Synthetic polypeptide
DEEEIRTTNPVATEQYGSVSTNLPQRGPDVN

SEQ ID NO: 5944 - protein, 28 aa, Artificial Sequence
  Description of Artificial Sequence: Synthetic peptide
DEEEIRTTNPCATEGYGSISTNLLRGNN

SEQ ID NO: 5945 - protein, 28 aa, Artificial Sequence
  Description of Artificial Sequence: Synthetic peptide
NEEEIRTTNPVATEQYGSASTELQRIGR

SEQ ID NO: 5946 - protein, 31 aa, Artificial Sequence
  Description of Artificial Sequence: Synthetic polypeptide
DEEEIRTTNPVATEQYGSVSTNLPQNIGNST

SEQ ID NO: 5947 - protein, 31 aa, Artificial Sequence
  Description of Artificial Sequence: Synthetic polypeptide
DEEEIRTTNPVATEQYGSVSTNLSQRGGQEH

SEQ ID NO: 5948 - protein, 30 aa, Artificial Sequence
  Description of Artificial Sequence: Synthetic polypeptide
DEEEIRTTNPVATEQYGSVSTNGLQYFGEE

SEQ ID NO: 5949 - protein, 30 aa, Artificial Sequence
  Description of Artificial Sequence: Synthetic polypeptide
DEYEIRTTNPVATEQYGSVSNTNLQGGSDR

SEQ ID NO: 5950 - protein, 28 aa, Artificial Sequence
  Description of Artificial Sequence: Synthetic peptide
DEYEIRTTNPVATEQYGSVQTALIRENR

SEQ ID NO: 5951 - protein, 30 aa, Artificial Sequence
  Description of Artificial Sequence: Synthetic polypeptide
DEEEIRTTNPVATEQYGSVSGTNGGQRGGL

SEQ ID NO: 5952 - protein, 30 aa, Artificial Sequence
  Description of Artificial Sequence: Synthetic polypeptide
DEEEIRTTNPVATEQYGSVSGTNGGQRGDE

SEQ ID NO: 5953 - protein, 30 aa, Artificial Sequence
  Description of Artificial Sequence: Synthetic polypeptide
AEEEIRTTNPVATEQYGSVTVTNLQSNGNR

SEQ ID NO: 5954 - protein, 32 aa, Artificial Sequence
  Description of Artificial Sequence: Synthetic polypeptide
DEEEIRTTNPVATEQYGSVSTNGLQTRDNTNR

SEQ ID NO: 5955 - protein, 28 aa, Artificial Sequence
  Description of Artificial Sequence: Synthetic peptide
DEEEIRTTNPCATEGYGSCSTNLARGNK

SEQ ID NO: 5956 - protein, 30 aa, Artificial Sequence
  Description of Artificial Sequence: Synthetic polypeptide
DEEEIRTTNPVATEQYGSGSTDLNQRGDDR

SEQ ID NO: 5957 - protein, 31 aa, Artificial Sequence
  Description of Artificial Sequence: Synthetic polypeptide
DEEEIRTTNPVATEQYGQSVCSYNLQRGSNA

SEQ ID NO: 5958 - protein, 29 aa, Artificial Sequence
  Description of Artificial Sequence: Synthetic peptide
NEEEIRTTNPVATEQYGSCSTGLQRQGQR

SEQ ID NO: 5959 - protein, 31 aa, Artificial Sequence
  Description of Artificial Sequence: Synthetic polypeptide
DEEEIRTTNPVATEQYGSVSTNLIQSGGGNI

SEQ ID NO: 5960 - protein, 30 aa, Artificial Sequence
  Description of Artificial Sequence: Synthetic polypeptide
DEEEIRTTNPVATEQYGSGSTTLLQRGNEM

SEQ ID NO: 5961 - protein, 31 aa, Artificial Sequence
  Description of Artificial Sequence: Synthetic polypeptide
DEEEIRTTNPVATEQYGSVSTNLSQRVLNSA

SEQ ID NO: 5962 - protein, 30 aa, Artificial Sequence
  Description of Artificial Sequence: Synthetic polypeptide
AEEEIRTTNPVATEQYGVVSTTNLQRGNVQ

SEQ ID NO: 5963 - protein, 31 aa, Artificial Sequence
  Description of Artificial Sequence: Synthetic polypeptide
DEEEIRTTNPVATEQYGSVSTNLPQITTGNQ

SEQ ID NO: 5964 - protein, 30 aa, Artificial Sequence
  Description of Artificial Sequence: Synthetic polypeptide
DEEEIRGTNPVATEQYGNVSYTNLQQGGNR

SEQ ID NO: 5965 - protein, 30 aa, Artificial Sequence
  Description of Artificial Sequence: Synthetic polypeptide
DEEEIRTTNPVATEQYGSVSTNLSQTGEIE

SEQ ID NO: 5966 - protein, 29 aa, Artificial Sequence
  Description of Artificial Sequence: Synthetic peptide
NAEEIRTTNPVATEQYGVVSTNLQDGHNR

SEQ ID NO: 5967 - protein, 30 aa, Artificial Sequence
  Description of Artificial Sequence: Synthetic polypeptide
DEEEIRQTNPVATEQYGSASTNLTQPEGNR

SEQ ID NO: 5968 - protein, 31 aa, Artificial Sequence
  Description of Artificial Sequence: Synthetic polypeptide
DEEEIRTTNPVATEQYGSVSTNGLQDAGNGI

SEQ ID NO: 5969 - protein, 32 aa, Artificial Sequence
  Description of Artificial Sequence: Synthetic polypeptide
DEEEIRTTNPVATEQYGSVSTNLSQDAGGSNR

SEQ ID NO: 5970 - protein, 31 aa, Artificial Sequence
  Description of Artificial Sequence: Synthetic polypeptide
DEEEIRTTNPVATEQYGSVSTNLPQGDGEGR

SEQ ID NO: 5971 - protein, 30 aa, Artificial Sequence
  Description of Artificial Sequence: Synthetic polypeptide
DEEEIRGTNPVATEQYGSVCSTNLQSGNNV

SEQ ID NO: 5972 - protein, 31 aa, Artificial Sequence
  Description of Artificial Sequence: Synthetic polypeptide
DEEEIRTTNPVATEQYGEVSGTNLQRGNDNM

SEQ ID NO: 5973 - protein, 28 aa, Artificial Sequence
  Description of Artificial Sequence: Synthetic peptide
NEDEIRTTNPVATEMYGSVSTNLQNGNM

SEQ ID NO: 5974 - protein, 31 aa, Artificial Sequence
  Description of Artificial Sequence: Synthetic polypeptide
DEEEIRTTNPVATEQYGSVSTNLQAHGGNTP

SEQ ID NO: 5975 - protein, 30 aa, Artificial Sequence
  Description of Artificial Sequence: Synthetic polypeptide
DEEEIRTTNPVATEQYGSVSGNLQRGMQIS

SEQ ID NO: 5976 - protein, 29 aa, Artificial Sequence
  Description of Artificial Sequence: Synthetic peptide
AEEEIRTTNPVATEQYGSVTTNLQVGDQR

SEQ ID NO: 5977 - protein, 30 aa, Artificial Sequence
  Description of Artificial Sequence: Synthetic polypeptide
DEEEIRTTNPVATEQYGSVSTNLQAGIEQN

SEQ ID NO: 5978 - protein, 31 aa, Artificial Sequence
  Description of Artificial Sequence: Synthetic polypeptide
DEEEIRTTNPVATEQYGEVSNTNLQRGSERP

SEQ ID NO: 5979 - protein, 30 aa, Artificial Sequence
  Description of Artificial Sequence: Synthetic polypeptide
DEEEIRTTNPVATEQYGSVSTNGLQNDNEE

SEQ ID NO: 5980 - protein, 29 aa, Artificial Sequence
  Description of Artificial Sequence: Synthetic peptide
DEYEIRTTNPVATEQYGSYSTNTQREGLR

SEQ ID NO: 5981 - protein, 28 aa, Artificial Sequence
  Description of Artificial Sequence: Synthetic peptide
NEAEIRTTNPVATEQYGSVWTNLQGGSR

SEQ ID NO: 5982 - protein, 30 aa, Artificial Sequence
  Description of Artificial Sequence: Synthetic polypeptide
DEEEIRATNPVATEQYGCVSMTNLAQGGNR

SEQ ID NO: 5983 - protein, 30 aa, Artificial Sequence
  Description of Artificial Sequence: Synthetic polypeptide
DEEEIRTTNPVATEQYGSVSTNLITGTNGG

SEQ ID NO: 5984 - protein, 31 aa, Artificial Sequence
  Description of Artificial Sequence: Synthetic polypeptide
DEEEIRTTNPVATEQYGSVSTNLIQSGGENP

SEQ ID NO: 5985 - protein, 29 aa, Artificial Sequence
  Description of Artificial Sequence: Synthetic peptide
NEAEIRTTNPVATESYGSVSTNLQEGNDR

SEQ ID NO: 5986 - protein, 31 aa, Artificial Sequence
  Description of Artificial Sequence: Synthetic polypeptide
DEEEIRTTNPVATEQYGSVSTNLSQPEGGPR

SEQ ID NO: 5987 - protein, 30 aa, Artificial Sequence
  Description of Artificial Sequence: Synthetic polypeptide
DEEEIRTTNPVATEQYGSVSTNLPSGGNLV

SEQ ID NO: 5988 - protein, 29 aa, Artificial Sequence
  Description of Artificial Sequence: Synthetic peptide
NDEEIRTTNPVATEQYGVVSTNLQLGPNR

SEQ ID NO: 5989 - protein, 31 aa, Artificial Sequence
  Description of Artificial Sequence: Synthetic polypeptide
DEEEIRTTNPVATEQYGSVSTNLPQNGNNAA

SEQ ID NO: 5990 - protein, 28 aa, Artificial Sequence
  Description of Artificial Sequence: Synthetic peptide
DEYEIRTTNPVATEQYGCVSTKLQRPND

SEQ ID NO: 5991 - protein, 29 aa, Artificial Sequence
  Description of Artificial Sequence: Synthetic peptide
DEEEIRTTNPCATEGYGSVCSTNLERGNA

SEQ ID NO: 5992 - protein, 31 aa, Artificial Sequence
  Description of Artificial Sequence: Synthetic polypeptide
DEEEIRTTNPVATEQYGSVSTNGLQQSGNSI

SEQ ID NO: 5993 - protein, 30 aa, Artificial Sequence
  Description of Artificial Sequence: Synthetic polypeptide
DEEEIRTTNPVATEQYGSVSTNLQADGIIF

SEQ ID NO: 5994 - protein, 31 aa, Artificial Sequence
  Description of Artificial Sequence: Synthetic polypeptide
DEEEIRTTNPVATEQYGSVSTNLQAEGGNTT

SEQ ID NO: 5995 - protein, 28 aa, Artificial Sequence
  Description of Artificial Sequence: Synthetic peptide
NEEEIRTTNPVATEQYGSHSTHLQRQQR

SEQ ID NO: 5996 - protein, 31 aa, Artificial Sequence
  Description of Artificial Sequence: Synthetic polypeptide
DEEEIRTTNPVATEQYGSVSTNLSQRHGGTE

SEQ ID NO: 5997 - protein, 28 aa, Artificial Sequence
  Description of Artificial Sequence: Synthetic peptide
DEEEIRTTNPCATEHYGSCSTNLARGNN

SEQ ID NO: 5998 - protein, 28 aa, Artificial Sequence
  Description of Artificial Sequence: Synthetic peptide
DEEEIRTTNPCATEIYGSISTNLARGNT

SEQ ID NO: 5999 - protein, 30 aa, Artificial Sequence
  Description of Artificial Sequence: Synthetic polypeptide
DEEEIRTTNPVATEQYGSVSTNLPSNGMNE

SEQ ID NO: 6000 - protein, 29 aa, Artificial Sequence
  Description of Artificial Sequence: Synthetic peptide
DGEEIRTTNPVATEQWGSVYSTPLQRGTR

SEQ ID NO: 6001 - protein, 30 aa, Artificial Sequence
  Description of Artificial Sequence: Synthetic polypeptide
DEEEIRTTNPVATEQYGSVSTNLQASGELS

SEQ ID NO: 6002 - protein, 30 aa, Artificial Sequence
  Description of Artificial Sequence: Synthetic polypeptide
DEEEIRTTNPVATEQYGSVSTNLQATGSDQ

SEQ ID NO: 6003 - protein, 31 aa, Artificial Sequence
  Description of Artificial Sequence: Synthetic polypeptide
DEEEIRTTNPVATEQYGSVSTNLNQNFGPNI

SEQ ID NO: 6004 - protein, 30 aa, Artificial Sequence
  Description of Artificial Sequence: Synthetic polypeptide
AEEEIRTTNPVATEQYGSVVSTNLGILGNR

SEQ ID NO: 6005 - protein, 31 aa, Artificial Sequence
  Description of Artificial Sequence: Synthetic polypeptide
DEEEIRTTNPVATEQYGSVSTNLSTRVGNQH

SEQ ID NO: 6006 - protein, 30 aa, Artificial Sequence
  Description of Artificial Sequence: Synthetic polypeptide
AEEEIRTTNPVATEQYGSVVSTNLGQQGNG

SEQ ID NO: 6007 - protein, 31 aa, Artificial Sequence
  Description of Artificial Sequence: Synthetic polypeptide
DEEEIRTTNPVATEQYGSVSTNLLIRGSNVE

SEQ ID NO: 6008 - protein, 30 aa, Artificial Sequence
  Description of Artificial Sequence: Synthetic polypeptide
DEEEIRATNPVATEQYGFVSMTNLYQEGNR

SEQ ID NO: 6009 - protein, 29 aa, Artificial Sequence
  Description of Artificial Sequence: Synthetic peptide
DEVEIRTTNPVATEWYGSVSTNLQAGGNA

SEQ ID NO: 6010 - protein, 28 aa, Artificial Sequence
  Description of Artificial Sequence: Synthetic peptide
DEVEIRTTNPVATEVYGWVSTNLQSGNA

SEQ ID NO: 6011 - protein, 28 aa, Artificial Sequence
  Description of Artificial Sequence: Synthetic peptide
DEEEIRTTNPVATEQYGSVSTNLTAFHT

SEQ ID NO: 6012 - protein, 31 aa, Artificial Sequence
  Description of Artificial Sequence: Synthetic polypeptide
MEEELRTTNPVATEQYGSVSTVNLDQRIGNR

SEQ ID NO: 6013 - protein, 30 aa, Artificial Sequence
  Description of Artificial Sequence: Synthetic polypeptide
AEEEIRTTNPVATEQYGSVVSTNLIYGGNR

SEQ ID NO: 6014 - protein, 30 aa, Artificial Sequence
  Description of Artificial Sequence: Synthetic polypeptide
MEEEIYTTNPVATEQYGSASETNLQRPGNR

SEQ ID NO: 6015 - protein, 31 aa, Artificial Sequence
  Description of Artificial Sequence: Synthetic polypeptide
DEEEIRTTNPVATEQYGSVSTNLIQDGENDV

SEQ ID NO: 6016 - protein, 29 aa, Artificial Sequence
  Description of Artificial Sequence: Synthetic peptide
NEEEIRTTNPVATEQYGSLSTHNLQREGR

SEQ ID NO: 6017 - protein, 31 aa, Artificial Sequence
  Description of Artificial Sequence: Synthetic polypeptide
DEEEIRTTNPVATEQYGQSVSTNLQYSGNVF

SEQ ID NO: 6018 - protein, 32 aa, Artificial Sequence
  Description of Artificial Sequence: Synthetic polypeptide
DEEEIRTTNPVATEQYGQSVSTNLSERGGNDR

SEQ ID NO: 6019 - protein, 31 aa, Artificial Sequence
  Description of Artificial Sequence: Synthetic polypeptide
DEEEIRTTNPVATEQYGSVSTNLLQEGNMQA

SEQ ID NO: 6020 - protein, 30 aa, Artificial Sequence
  Description of Artificial Sequence: Synthetic polypeptide
DEEEIRTTNPVATEQYGSVSTNHFQSGNQG

SEQ ID NO: 6021 - protein, 30 aa, Artificial Sequence
  Description of Artificial Sequence: Synthetic polypeptide
AEEEIRTTNPVATEQYGSVVSTNLAQGGNG

SEQ ID NO: 6022 - protein, 30 aa, Artificial Sequence
  Description of Artificial Sequence: Synthetic polypeptide
DEEEIRTTNPVATEQYGSVSTNLNQNGDSQ

SEQ ID NO: 6023 - protein, 30 aa, Artificial Sequence
  Description of Artificial Sequence: Synthetic polypeptide
AEEEIRTTNPVATEQYGSVVSTNGEQGGNR

SEQ ID NO: 6024 - protein, 28 aa, Artificial Sequence
  Description of Artificial Sequence: Synthetic peptide
DMEEIRATNPVATEQYGSSSTNMQRGNQ

SEQ ID NO: 6025 - protein, 31 aa, Artificial Sequence
  Description of Artificial Sequence: Synthetic polypeptide
DEEEIRTTNPVATEQYGSVSTNEVGRGGNRV

SEQ ID NO: 6026 - protein, 30 aa, Artificial Sequence
  Description of Artificial Sequence: Synthetic polypeptide
AEEEIRTTNPVATEQYGSVVSTNELQNGNN

SEQ ID NO: 6027 - protein, 29 aa, Artificial Sequence
  Description of Artificial Sequence: Synthetic peptide
NEEEIRATNPVATEMYGSVSTNLQRGNQT

SEQ ID NO: 6028 - protein, 30 aa, Artificial Sequence
  Description of Artificial Sequence: Synthetic polypeptide
DMEEIRATNPVATEQYGSVSTNLQARNGQR

SEQ ID NO: 6029 - protein, 30 aa, Artificial Sequence
  Description of Artificial Sequence: Synthetic polypeptide
DEEEIRTTNPVATEQYGSVSTNEQTESNNR

SEQ ID NO: 6030 - protein, 30 aa, Artificial Sequence
  Description of Artificial Sequence: Synthetic polypeptide
AEEEIRTTNPVATEQYGVVCSTTNLQNGNR

SEQ ID NO: 6031 - protein, 30 aa, Artificial Sequence
  Description of Artificial Sequence: Synthetic polypeptide
DEEEIRTTNPVATEQYGSVSTNEQSGNGTT

SEQ ID NO: 6032 - protein, 29 aa, Artificial Sequence
  Description of Artificial Sequence: Synthetic peptide
DEVEIRTTNPVATERYGSVSTNLQEDGNG

SEQ ID NO: 6033 - protein, 31 aa, Artificial Sequence
  Description of Artificial Sequence: Synthetic polypeptide
DEEEIRTTNPVATEQYGSVSTNLIQGIGGND

SEQ ID NO: 6034 - protein, 30 aa, Artificial Sequence
  Description of Artificial Sequence: Synthetic polypeptide
DEEEIRTTNPVATEQYGSVSTNLSRNYNVQ

SEQ ID NO: 6035 - protein, 31 aa, Artificial Sequence
  Description of Artificial Sequence: Synthetic polypeptide
DEEEIRTTNPVATEQYGSVSTNLNQQGGERE

SEQ ID NO: 6036 - protein, 32 aa, Artificial Sequence
  Description of Artificial Sequence: Synthetic polypeptide
DEEEIRTTNPVATEQYGSVSTNLSTRVGNNRS

SEQ ID NO: 6037 - protein, 30 aa, Artificial Sequence
  Description of Artificial Sequence: Synthetic polypeptide
DEEEIRTTNPVATEQYGEISTNLQSGGNNR

SEQ ID NO: 6038 - protein, 31 aa, Artificial Sequence
  Description of Artificial Sequence: Synthetic polypeptide
DEEEIRTTNPVATEQYGSVSTNLIQGGNQDQ

SEQ ID NO: 6039 - protein, 31 aa, Artificial Sequence
  Description of Artificial Sequence: Synthetic polypeptide
DEEEIRTTNPVATEQYGSVSGNLQRMGSNTQ

SEQ ID NO: 6040 - protein, 30 aa, Artificial Sequence
  Description of Artificial Sequence: Synthetic polypeptide
DEEEIRTTNPVATEQYGSVSTNLIQDPNLT

SEQ ID NO: 6041 - protein, 30 aa, Artificial Sequence
  Description of Artificial Sequence: Synthetic polypeptide
AEEEIRTTNPVATEQYGSVVSTNFTQDGNR

SEQ ID NO: 6042 - protein, 31 aa, Artificial Sequence
  Description of Artificial Sequence: Synthetic polypeptide
DEEEIRTTNPVATEQYGSVSTNLNQQGNIED

SEQ ID NO: 6043 - protein, 28 aa, Artificial Sequence
  Description of Artificial Sequence: Synthetic peptide
NEEEIRATNPVATEQYGSVATNLQAGNK

SEQ ID NO: 6044 - protein, 32 aa, Artificial Sequence
  Description of Artificial Sequence: Synthetic polypeptide
DEEEIRTTNPVATEQYGQSVSTNLSGRGGNLR

SEQ ID NO: 6045 - protein, 28 aa, Artificial Sequence
  Description of Artificial Sequence: Synthetic peptide
DEVEIRTTNPVATEQYGVVSTFLQRPND

SEQ ID NO: 6046 - protein, 31 aa, Artificial Sequence
  Description of Artificial Sequence: Synthetic polypeptide
DEEEIRTTNPVATEQYGSVSTNELQQGSNQT

SEQ ID NO: 6047 - protein, 28 aa, Artificial Sequence
  Description of Artificial Sequence: Synthetic peptide
MEEEISTTNPVATEQYGSVSDNLQNGNY

SEQ ID NO: 6048 - protein, 28 aa, Artificial Sequence
  Description of Artificial Sequence: Synthetic peptide
DMEEIRSTNPVATEQYGSTSTNIQRGNN

SEQ ID NO: 6049 - protein, 32 aa, Artificial Sequence
  Description of Artificial Sequence: Synthetic polypeptide
DEEEIRTTNPVATEQYGSVSTNELQDRSGNQN

SEQ ID NO: 6050 - protein, 28 aa, Artificial Sequence
  Description of Artificial Sequence: Synthetic peptide
DEEEIRTTNPVATEQYGSHSPNLQNGEI

SEQ ID NO: 6051 - protein, 29 aa, Artificial Sequence
  Description of Artificial Sequence: Synthetic peptide
QEEEIRTTNPVATEGYGSVSTNVQGGNRD

SEQ ID NO: 6052 - protein, 28 aa, Artificial Sequence
  Description of Artificial Sequence: Synthetic peptide
DMEEIRSTNPVATEQYGSTSTNQQRGNL

SEQ ID NO: 6053 - protein, 29 aa, Artificial Sequence
  Description of Artificial Sequence: Synthetic peptide
QEEEIRTTNPVATELYGSVSTNLQQGDRQ

SEQ ID NO: 6054 - protein, 30 aa, Artificial Sequence
  Description of Artificial Sequence: Synthetic polypeptide
AEEEIRTTNPVATEQYGSVSVTTNPQEGNR

SEQ ID NO: 6055 - protein, 29 aa, Artificial Sequence
  Description of Artificial Sequence: Synthetic peptide
QEEEIRTTNPVATEPYGSVSTNLQNGVRD

SEQ ID NO: 6056 - protein, 29 aa, Artificial Sequence
  Description of Artificial Sequence: Synthetic peptide
DEVEIRTTNPVATEQYGSVVTNLQHGNDS

SEQ ID NO: 6057 - protein, 31 aa, Artificial Sequence
  Description of Artificial Sequence: Synthetic polypeptide
DEEEIRTTNPVATEQYGSVSTNLLQEHGSNV

SEQ ID NO: 6058 - protein, 30 aa, Artificial Sequence
  Description of Artificial Sequence: Synthetic polypeptide
DEEEIRTTNPVATEQYGSVSTNLLQGNIEI

SEQ ID NO: 6059 - protein, 29 aa, Artificial Sequence
  Description of Artificial Sequence: Synthetic peptide
DEVEIRTTNPVATEQYGSVTTNLQGGNDE

SEQ ID NO: 6060 - protein, 31 aa, Artificial Sequence
  Description of Artificial Sequence: Synthetic polypeptide
DEEEIRTTNPVATEQYGSVSTNLLQNGGNGT

SEQ ID NO: 6061 - protein, 30 aa, Artificial Sequence
  Description of Artificial Sequence: Synthetic polypeptide
DEEEIRATNPVATEQYGHVSETNLFQGGNR

SEQ ID NO: 6062 - protein, 31 aa, Artificial Sequence
  Description of Artificial Sequence: Synthetic polypeptide
DEEEIRTTNPVATEQYGSVSFTNLQRVGAFL

SEQ ID NO: 6063 - protein, 31 aa, Artificial Sequence
  Description of Artificial Sequence: Synthetic polypeptide
MEEEISTTNPVATEQYGSVSTNLPQRSGVNR

SEQ ID NO: 6064 - protein, 29 aa, Artificial Sequence
  Description of Artificial Sequence: Synthetic peptide
DEEEIRTTNPVATEQYGSVSTNEMNTGNI

SEQ ID NO: 6065 - protein, 31 aa, Artificial Sequence
  Description of Artificial Sequence: Synthetic polypeptide
DEEEIRTTNPVATEQYGSHSLPNELQRDGNR

SEQ ID NO: 6066 - protein, 28 aa, Artificial Sequence
  Description of Artificial Sequence: Synthetic peptide
DEEEIRTTNPCATEQWGSVATNLQRNNQ

SEQ ID NO: 6067 - protein, 31 aa, Artificial Sequence
  Description of Artificial Sequence: Synthetic polypeptide
DEEEIRTTNPVATEQYGSVSTNLNQNFGPNG

SEQ ID NO: 6068 - protein, 31 aa, Artificial Sequence
  Description of Artificial Sequence: Synthetic polypeptide
DEEEIRTTNPVATEQYGSVSTNLNQNFGLNT

SEQ ID NO: 6069 - protein, 30 aa, Artificial Sequence
  Description of Artificial Sequence: Synthetic polypeptide
AEEEIRTTNPVATEQYGSVVSTNLLQPGNF

SEQ ID NO: 6070 - protein, 28 aa, Artificial Sequence
  Description of Artificial Sequence: Synthetic peptide
DMEEIRSTNPVATEQYGSISTNEQRGNQ

SEQ ID NO: 6071 - protein, 28 aa, Artificial Sequence
  Description of Artificial Sequence: Synthetic peptide
DEEEIRATNPVATEQWGSVSTDLDNGNR

SEQ ID NO: 6072 - protein, 30 aa, Artificial Sequence
  Description of Artificial Sequence: Synthetic polypeptide
DEVEIRTTNPVATEQYGTVSCTNLSQLGNR

SEQ ID NO: 6073 - protein, 28 aa, Artificial Sequence
  Description of Artificial Sequence: Synthetic peptide
DMEEIRSTNPVATEQYGSISTNMQRGNQ

SEQ ID NO: 6074 - protein, 28 aa, Artificial Sequence
  Description of Artificial Sequence: Synthetic peptide
DMEEIRSTNPVATEQYGSSSTNFQRGNL

SEQ ID NO: 6075 - protein, 28 aa, Artificial Sequence
  Description of Artificial Sequence: Synthetic peptide
DEDCIRTTNPVATEQYGSFSTNLIIGNR

SEQ ID NO: 6076 - protein, 30 aa, Artificial Sequence
  Description of Artificial Sequence: Synthetic polypeptide
AEEEIRTTNPVATEQYGSVVSTNLLQSQNR

SEQ ID NO: 6077 - protein, 32 aa, Artificial Sequence
  Description of Artificial Sequence: Synthetic polypeptide
DEEEIRTTNPVATEQYGSVSTNLQYIGSNFRP

SEQ ID NO: 6078 - protein, 28 aa, Artificial Sequence
  Description of Artificial Sequence: Synthetic peptide
NEEEIRTTNPVATEQYGSMSTHLQRQSR

SEQ ID NO: 6079 - protein, 28 aa, Artificial Sequence
  Description of Artificial Sequence: Synthetic peptide
QEEEIRTTNPIATEQYGEVSENLMRGNR

SEQ ID NO: 6080 - protein, 28 aa, Artificial Sequence
  Description of Artificial Sequence: Synthetic peptide
NEEEIATTNPVATEMYGSVSTNLTRGNE

SEQ ID NO: 6081 - protein, 30 aa, Artificial Sequence
  Description of Artificial Sequence: Synthetic polypeptide
DEEEIRATNPVATEQYGFVSVTNLQQGGNR

SEQ ID NO: 6082 - protein, 28 aa, Artificial Sequence
  Description of Artificial Sequence: Synthetic peptide
QEEEIRTTNPIATEQYGSVSECLMRGNR

SEQ ID NO: 6083 - protein, 28 aa, Artificial Sequence
  Description of Artificial Sequence: Synthetic peptide
QEEEIRTTNPVATEAYGSVSANLQHGNQ

SEQ ID NO: 6084 - protein, 29 aa, Artificial Sequence
  Description of Artificial Sequence: Synthetic peptide
DEEEIRTTNPVATEQYGSVSTNENGGNGE

SEQ ID NO: 6085 - protein, 31 aa, Artificial Sequence
  Description of Artificial Sequence: Synthetic polypeptide
DEEEIRTTNPVATEQYGSVSTNLQYNGDNSQ

SEQ ID NO: 6086 - protein, 28 aa, Artificial Sequence
  Description of Artificial Sequence: Synthetic peptide
QEEEIRCTNPVATEQYGVVSSTLQRGNR

SEQ ID NO: 6087 - protein, 28 aa, Artificial Sequence
  Description of Artificial Sequence: Synthetic peptide
NEEEIRTTNPVATEQYGSLSTHLQRIER

SEQ ID NO: 6088 - protein, 29 aa, Artificial Sequence
  Description of Artificial Sequence: Synthetic peptide
DEEEIRTTNPVATEQYGSVSTNFDNGGND

SEQ ID NO: 6089 - protein, 29 aa, Artificial Sequence
  Description of Artificial Sequence: Synthetic peptide
AEEEIRTTNPVATEQYGVVSTNLQPEGNW

SEQ ID NO: 6090 - protein, 30 aa, Artificial Sequence
  Description of Artificial Sequence: Synthetic polypeptide
AEEEIRTTNPVATEQYGVVSTNLQILGNDR

SEQ ID NO: 6091 - protein, 29 aa, Artificial Sequence
  Description of Artificial Sequence: Synthetic peptide
AEEEIRTTNPVATEQYGVVSTNLQDGGND

SEQ ID NO: 6092 - protein, 28 aa, Artificial Sequence
  Description of Artificial Sequence: Synthetic peptide
QEEEIRCTNPIATEQYGSVAENLQRGNR

SEQ ID NO: 6093 - protein, 30 aa, Artificial Sequence
  Description of Artificial Sequence: Synthetic polypeptide
DEEEIRTTNPVATEQYGSVSTNFQHDNGNM

SEQ ID NO: 6094 - protein, 28 aa, Artificial Sequence
  Description of Artificial Sequence: Synthetic peptide
MEEYIGTTNPTATEQYGSVSTNLQRGER

SEQ ID NO: 6095 - protein, 28 aa, Artificial Sequence
  Description of Artificial Sequence: Synthetic peptide
QEEEIRCTNPIATEQYGSVSENLMRGNR

SEQ ID NO: 6096 - protein, 28 aa, Artificial Sequence
  Description of Artificial Sequence: Synthetic peptide
MEETIRTTNPVATEQYGSVSTNLSMTNR

SEQ ID NO: 6097 - protein, 30 aa, Artificial Sequence
  Description of Artificial Sequence: Synthetic polypeptide
MEEQIRTTNPVATEQYGSVVSYTNLERGNR

SEQ ID NO: 6098 - protein, 28 aa, Artificial Sequence
  Description of Artificial Sequence: Synthetic peptide
QEEEIRCTNPIATEQYGSVSSNLMRGNR

SEQ ID NO: 6099 - protein, 30 aa, Artificial Sequence
  Description of Artificial Sequence: Synthetic polypeptide
DEEEIRTTNPVATEQYGSVSTNLNREVNVS

SEQ ID NO: 6100 - protein, 31 aa, Artificial Sequence
  Description of Artificial Sequence: Synthetic polypeptide
DEEEIRTTNPVATEQYGSVSTNLIQMGNGDL

SEQ ID NO: 6101 - protein, 30 aa, Artificial Sequence
  Description of Artificial Sequence: Synthetic polypeptide
DEEEIRTTNPVATEQYGSVSTNFQGEGDLR

SEQ ID NO: 6102 - protein, 31 aa, Artificial Sequence
  Description of Artificial Sequence: Synthetic polypeptide
DEEEIRTTNPVATEQYGSVSTNGSQTGTNRM

SEQ ID NO: 6103 - protein, 30 aa, Artificial Sequence
  Description of Artificial Sequence: Synthetic polypeptide
DEEEIRTTNPVATEQYGEVSTNLQVGNEDD

SEQ ID NO: 6104 - protein, 31 aa, Artificial Sequence
  Description of Artificial Sequence: Synthetic polypeptide
DEEEIRTTNPVATEQYGSVSTNLNQYSINRP

SEQ ID NO: 6105 - protein, 31 aa, Artificial Sequence
  Description of Artificial Sequence: Synthetic polypeptide
DEEEIRTTNPVATEQYGEVSTNLSQDRGGNQ

SEQ ID NO: 6106 - protein, 28 aa, Artificial Sequence
  Description of Artificial Sequence: Synthetic peptide
QEEEIRCTNPCATEQYGSVSENLMRGNR

SEQ ID NO: 6107 - protein, 31 aa, Artificial Sequence
  Description of Artificial Sequence: Synthetic polypeptide
DEEEIRTTNPVATEQYGSVSTNLIQMGNNDG

SEQ ID NO: 6108 - protein, 28 aa, Artificial Sequence
  Description of Artificial Sequence: Synthetic peptide
NEEEIRTTNPVATEQYGSLSTALQRDGR

SEQ ID NO: 6109 - protein, 28 aa, Artificial Sequence
  Description of Artificial Sequence: Synthetic peptide
DHEEIRTTNPVATEQYGSVWTNDQPGNP

SEQ ID NO: 6110 - protein, 30 aa, Artificial Sequence
  Description of Artificial Sequence: Synthetic polypeptide
DEEEIRATNPVATEQYGFVSDTNLFQPGNR

SEQ ID NO: 6111 - protein, 30 aa, Artificial Sequence
  Description of Artificial Sequence: Synthetic polypeptide
MEHEIRTTNPVATEQYGSVSTNLQRGSNFS

SEQ ID NO: 6112 - protein, 28 aa, Artificial Sequence
  Description of Artificial Sequence: Synthetic peptide
DEWEIRTTNPVATEQYGVVSTQLQRPND

SEQ ID NO: 6113 - protein, 30 aa, Artificial Sequence
  Description of Artificial Sequence: Synthetic polypeptide
DEEEIRTTNPVATEQYGETISTNQLQRGNG

SEQ ID NO: 6114 - protein, 31 aa, Artificial Sequence
  Description of Artificial Sequence: Synthetic polypeptide
DEEEIRTTNPVATEQYGETISTNELQRDGNR

SEQ ID NO: 6115 - protein, 31 aa, Artificial Sequence
  Description of Artificial Sequence: Synthetic polypeptide
DEEEIRTTNPVATEQYGNVVSSTNLQRGNGD

SEQ ID NO: 6116 - protein, 31 aa, Artificial Sequence
  Description of Artificial Sequence: Synthetic polypeptide
DEEEIRTTNPVATEQYGNVVSSTNLQRGNQF

SEQ ID NO: 6117 - protein, 31 aa, Artificial Sequence
  Description of Artificial Sequence: Synthetic polypeptide
DEEEIRTTNPVATEQYGETCSTNELSQRGNR

SEQ ID NO: 6118 - protein, 28 aa, Artificial Sequence
  Description of Artificial Sequence: Synthetic peptide
QEEEIRCTNPSATEQYGSVSENLARGNR

SEQ ID NO: 6119 - protein, 31 aa, Artificial Sequence
  Description of Artificial Sequence: Synthetic polypeptide
DEEEIRTTNPVATEQYGSVSTNLQATVGNYE

SEQ ID NO: 6120 - protein, 30 aa, Artificial Sequence
  Description of Artificial Sequence: Synthetic polypeptide
DEEEIRTTNPVATEQYGSVSTNLNRSVNIS

SEQ ID NO: 6121 - protein, 30 aa, Artificial Sequence
  Description of Artificial Sequence: Synthetic polypeptide
DEEEIRTTNPVATEQYGSVSTNLNRSVNDF

SEQ ID NO: 6122 - protein, 28 aa, Artificial Sequence
  Description of Artificial Sequence: Synthetic peptide
QEEEICTTNPVAYEQYGSVSTNLQNGNV

SEQ ID NO: 6123 - protein, 30 aa, Artificial Sequence
  Description of Artificial Sequence: Synthetic polypeptide
DEEEIRTTNPVATEQYGSVSTNLNRSMNDI

SEQ ID NO: 6124 - protein, 30 aa, Artificial Sequence
  Description of Artificial Sequence: Synthetic polypeptide
AEEEIRTTNPVATEQYGSVSVTYNTQEGNR

SEQ ID NO: 6125 - protein, 29 aa, Artificial Sequence
  Description of Artificial Sequence: Synthetic peptide
QEEEIRATNPVATEAYGSVSTNLQDGNHR

SEQ ID NO: 6126 - protein, 29 aa, Artificial Sequence
  Description of Artificial Sequence: Synthetic peptide
QEEEIRATNPVATEGYGSVSTNLQHGNVR

SEQ ID NO: 6127 - protein, 30 aa, Artificial Sequence
  Description of Artificial Sequence: Synthetic polypeptide
DEEEIRTTNPVATEQYGSVSTNLLEMGNTP

SEQ ID NO: 6128 - protein, 30 aa, Artificial Sequence
  Description of Artificial Sequence: Synthetic polypeptide
DEEEIRTTNPVATEQYGSVSGNLQRGSQQQ

SEQ ID NO: 6129 - protein, 30 aa, Artificial Sequence
  Description of Artificial Sequence: Synthetic polypeptide
DEEEIRTTNPVATEQYGEVSTNMQGNGQNR

SEQ ID NO: 6130 - protein, 29 aa, Artificial Sequence
  Description of Artificial Sequence: Synthetic peptide
DEEEIRTTNPVATEQYGEVSTNTQGEGNA

SEQ ID NO: 6131 - protein, 28 aa, Artificial Sequence
  Description of Artificial Sequence: Synthetic peptide
QEEEIRCTNPVATECYGSVSENLMRGNR

SEQ ID NO: 6132 - protein, 28 aa, Artificial Sequence
  Description of Artificial Sequence: Synthetic peptide
QEEEIRCTNPVATEQYGSVSENLMRGNI

SEQ ID NO: 6133 - protein, 29 aa, Artificial Sequence
  Description of Artificial Sequence: Synthetic peptide
DEEEIRTTNPVATEQYGSVSTNHDRLSNE

SEQ ID NO: 6134 - protein, 28 aa, Artificial Sequence
  Description of Artificial Sequence: Synthetic peptide
MEEGIRTTNPVATEQYGSVSTNLNMQNR

SEQ ID NO: 6135 - protein, 29 aa, Artificial Sequence
  Description of Artificial Sequence: Synthetic peptide
AEEEIRTTNPVATEQYGSVVSSNLGIGNR

SEQ ID NO: 6136 - protein, 29 aa, Artificial Sequence
  Description of Artificial Sequence: Synthetic peptide
AEEEIRTTNPVATEQYGSVVSTNAQADNR

SEQ ID NO: 6137 - protein, 28 aa, Artificial Sequence
  Description of Artificial Sequence: Synthetic peptide
MEEGIRTTNPVATEFYGSVSTNLQRNNS

SEQ ID NO: 6138 - protein, 30 aa, Artificial Sequence
  Description of Artificial Sequence: Synthetic polypeptide
AEEEIRTTNPVATEQYGVVSNTNLQRGNEM

SEQ ID NO: 6139 - protein, 30 aa, Artificial Sequence
  Description of Artificial Sequence: Synthetic polypeptide
AEEEIRTTNPVATEQYGVVSATNLQRGNAI

SEQ ID NO: 6140 - protein, 28 aa, Artificial Sequence
  Description of Artificial Sequence: Synthetic peptide
MEEGIRTTNPVATEQYGSVSTNLSDDNR

SEQ ID NO: 6141 - protein, 28 aa, Artificial Sequence
  Description of Artificial Sequence: Synthetic peptide
NEEEIRTTNPVATEQYGSLSTHLQREQR

SEQ ID NO: 6142 - protein, 30 aa, Artificial Sequence
  Description of Artificial Sequence: Synthetic polypeptide
DEEEIRATNPVATEQYGFVSMTNLSQGGNR

SEQ ID NO: 6143 - protein, 28 aa, Artificial Sequence
  Description of Artificial Sequence: Synthetic peptide
QEEEIRCTNPVATEQYGSVSSNLQRGDI

SEQ ID NO: 6144 - protein, 28 aa, Artificial Sequence
  Description of Artificial Sequence: Synthetic peptide
DMEEIRATNPVATEQYGSASTNQQRGNN

SEQ ID NO: 6145 - protein, 28 aa, Artificial Sequence
  Description of Artificial Sequence: Synthetic peptide
DMEEIRATNPVATEQYGSISTNMQRGNN

SEQ ID NO: 6146 - protein, 29 aa, Artificial Sequence
  Description of Artificial Sequence: Synthetic peptide
QEEEIRCTNPVATEQYGSVSTNLQDRGES

SEQ ID NO: 6147 - protein, 30 aa, Artificial Sequence
  Description of Artificial Sequence: Synthetic polypeptide
DEEEIRTTNPVATEQYGSVSTNLLGGSNST

SEQ ID NO: 6148 - protein, 29 aa, Artificial Sequence
  Description of Artificial Sequence: Synthetic peptide
DEEEIRTTNPVATEQYGSVSTNFGNGNGE

SEQ ID NO: 6149 - protein, 30 aa, Artificial Sequence
  Description of Artificial Sequence: Synthetic polypeptide
AEEEIRTTNPVATEQYGSVVSTNELQGSNR

SEQ ID NO: 6150 - protein, 30 aa, Artificial Sequence
  Description of Artificial Sequence: Synthetic polypeptide
AEEEIRTTNPVATEQYGSVVSTNELQFGNF

SEQ ID NO: 6151 - protein, 29 aa, Artificial Sequence
  Description of Artificial Sequence: Synthetic peptide
NEEEIRTTNPVATEQYGSSSTELQRQGSR

SEQ ID NO: 6152 - protein, 28 aa, Artificial Sequence
  Description of Artificial Sequence: Synthetic peptide
MEEGIRTTNPVATEQYGSVSTNLSTNNR

SEQ ID NO: 6153 - protein, 29 aa, Artificial Sequence
  Description of Artificial Sequence: Synthetic peptide
DEEEIRTTNPVATEQYGSVSTNGTQPDAR

SEQ ID NO: 6154 - protein, 29 aa, Artificial Sequence
  Description of Artificial Sequence: Synthetic peptide
DEEEIRTTNPVATEQYGEVSTPLERGNDF

SEQ ID NO: 6155 - protein, 28 aa, Artificial Sequence
  Description of Artificial Sequence: Synthetic peptide
QEEEIRCTNPVATEQYGSASENLMRGNR

SEQ ID NO: 6156 - protein, 30 aa, Artificial Sequence
  Description of Artificial Sequence: Synthetic polypeptide
AEEEIRTTNPVATEQYGSVVNTNLQRGNLD

SEQ ID NO: 6157 - protein, 28 aa, Artificial Sequence
  Description of Artificial Sequence: Synthetic peptide
DEVEITTTNPVATEQYGSVSENLQTGNG

SEQ ID NO: 6158 - protein, 29 aa, Artificial Sequence
  Description of Artificial Sequence: Synthetic peptide
DEEEIRTTNPVATEQYGEVSTPLGRGNQY

SEQ ID NO: 6159 - protein, 30 aa, Artificial Sequence
  Description of Artificial Sequence: Synthetic polypeptide
DEVEISTTNPVATEQYGQSVSTNLQRGNNA

SEQ ID NO: 6160 - protein, 28 aa, Artificial Sequence
  Description of Artificial Sequence: Synthetic peptide
NEEEIRCTNPIATEQYGSVSENLPRGNR

SEQ ID NO: 6161 - protein, 29 aa, Artificial Sequence
  Description of Artificial Sequence: Synthetic peptide
DEEEIRTTNPVATEQYGSVSTNGTQALDR

SEQ ID NO: 6162 - protein, 28 aa, Artificial Sequence
  Description of Artificial Sequence: Synthetic peptide
MEENIRTTNPVATEQYGSVSTNLDMLNR

SEQ ID NO: 6163 - protein, 31 aa, Artificial Sequence
  Description of Artificial Sequence: Synthetic polypeptide
DEEEIRTTNPVATEQYGSGVSTNLQRFQSNI

SEQ ID NO: 6164 - protein, 30 aa, Artificial Sequence
  Description of Artificial Sequence: Synthetic polypeptide
DEEEIRATNPVATEQYGFVSMTNLFQQGNR

SEQ ID NO: 6165 - protein, 28 aa, Artificial Sequence
  Description of Artificial Sequence: Synthetic peptide
NEEEIRCTNPIATEQYGSVSENLMRGNR

SEQ ID NO: 6166 - protein, 30 aa, Artificial Sequence
  Description of Artificial Sequence: Synthetic polypeptide
DEEEIRATNPVATEQYGFVSMTNLHQEGNR

SEQ ID NO: 6167 - protein, 30 aa, Artificial Sequence
  Description of Artificial Sequence: Synthetic polypeptide
DEEEIRTTNPVATEQYGSVSTNLLFNGGND

SEQ ID NO: 6168 - protein, 28 aa, Artificial Sequence
  Description of Artificial Sequence: Synthetic peptide
NEEEIRATNPVATEQYGSVATNLQSGNH

SEQ ID NO: 6169 - protein, 31 aa, Artificial Sequence
  Description of Artificial Sequence: Synthetic polypeptide
DEEEIRTTNPVATEQYGEVSWTNLNREGMNR

SEQ ID NO: 6170 - protein, 31 aa, Artificial Sequence
  Description of Artificial Sequence: Synthetic polypeptide
DEEEIRTTNPVATEQYGEVSWTNLNRGMNRQ

SEQ ID NO: 6171 - protein, 28 aa, Artificial Sequence
  Description of Artificial Sequence: Synthetic peptide
AEEEIRTTNPVATEQYGSVVSNLQRGDV

SEQ ID NO: 6172 - protein, 28 aa, Artificial Sequence
  Description of Artificial Sequence: Synthetic peptide
DEVEISTTNPVATDQYGQVSTALQRGNR

SEQ ID NO: 6173 - protein, 32 aa, Artificial Sequence
  Description of Artificial Sequence: Synthetic polypeptide
DEEEIRTTNPVATEQYGSVSTNLQLRGGDERQ

SEQ ID NO: 6174 - protein, 31 aa, Artificial Sequence
  Description of Artificial Sequence: Synthetic polypeptide
DEEEIRTTNPVATEQYGSVSGTNANNQTGNR

SEQ ID NO: 6175 - protein, 31 aa, Artificial Sequence
  Description of Artificial Sequence: Synthetic polypeptide
DEEEIRTTNPVATEQYGSVSTNLHTRGSELR

SEQ ID NO: 6176 - protein, 29 aa, Artificial Sequence
  Description of Artificial Sequence: Synthetic peptide
DEEEIRTCNPVATEQYGSVSTTLQRNQRE

SEQ ID NO: 6177 - protein, 28 aa, Artificial Sequence
  Description of Artificial Sequence: Synthetic peptide
DEEEIRTCNPVATEQYGSVSTTLQRNQD

SEQ ID NO: 6178 - protein, 30 aa, Artificial Sequence
  Description of Artificial Sequence: Synthetic polypeptide
DEEEIRTTNPVATEQYGSVSTNLQHGEPVD

SEQ ID NO: 6179 - protein, 31 aa, Artificial Sequence
  Description of Artificial Sequence: Synthetic polypeptide
DEEEIRTTNPVATEQYGSVSTNLQHGGNGDS

SEQ ID NO: 6180 - protein, 32 aa, Artificial Sequence
  Description of Artificial Sequence: Synthetic polypeptide
DEEEIRTTNPVATEQYGSVSTNLQHGNSNTRE

SEQ ID NO: 6181 - protein, 29 aa, Artificial Sequence
  Description of Artificial Sequence: Synthetic peptide
FEEEIRTTNPVATEQYGSVSVTMLQRGLP

SEQ ID NO: 6182 - protein, 28 aa, Artificial Sequence
  Description of Artificial Sequence: Synthetic peptide
DEEEIRTCNPVATEQYGSVSTSLQRNTE

SEQ ID NO: 6183 - protein, 31 aa, Artificial Sequence
  Description of Artificial Sequence: Synthetic polypeptide
DEEEIRTTNPVATEQYGSVSTNLQHGQNQLM

SEQ ID NO: 6184 - protein, 31 aa, Artificial Sequence
  Description of Artificial Sequence: Synthetic polypeptide
DEEEIRTTNPVATEQYGSVSTNLDQTGVQRD

SEQ ID NO: 6185 - protein, 29 aa, Artificial Sequence
  Description of Artificial Sequence: Synthetic peptide
NSEEIRTTNPVATEQYGVVSTNLQDGENR

SEQ ID NO: 6186 - protein, 29 aa, Artificial Sequence
  Description of Artificial Sequence: Synthetic peptide
NSEEIRTTNPVATEQYGVVSTNLQDGANR

SEQ ID NO: 6187 - protein, 28 aa, Artificial Sequence
  Description of Artificial Sequence: Synthetic peptide
AEGEIRTTNPVATEQYGSVTTNLQIGER

SEQ ID NO: 6188 - protein, 31 aa, Artificial Sequence
  Description of Artificial Sequence: Synthetic polypeptide
DEEEIRSTNPVATEQYGSVATNLQARGNDRV

SEQ ID NO: 6189 - protein, 28 aa, Artificial Sequence
  Description of Artificial Sequence: Synthetic peptide
DEEEIRTCNPVATEQYGSVSTRLQRNQE

SEQ ID NO: 6190 - protein, 31 aa, Artificial Sequence
  Description of Artificial Sequence: Synthetic polypeptide
DEEEIRCTNPVATEQYGSVCSTGNLQRGNQE

SEQ ID NO: 6191 - protein, 28 aa, Artificial Sequence
  Description of Artificial Sequence: Synthetic peptide
DEEEIRTCNPVATEQYGSVSTRLQRNDE

SEQ ID NO: 6192 - protein, 28 aa, Artificial Sequence
  Description of Artificial Sequence: Synthetic peptide
DEEEIRTCNPVATEQYGSVSTQLQRQQE

SEQ ID NO: 6193 - protein, 31 aa, Artificial Sequence
  Description of Artificial Sequence: Synthetic polypeptide
DEEEIRTTNPVATEQYGSVSTNLDRGGINNS

SEQ ID NO: 6194 - protein, 29 aa, Artificial Sequence
  Description of Artificial Sequence: Synthetic peptide
NQEEIRTTNPVATEQYGVVSTNLQGGNNR

SEQ ID NO: 6195 - protein, 28 aa, Artificial Sequence
  Description of Artificial Sequence: Synthetic peptide
NQEEIRTTNPVATEQWGTVSTNLQEGNR

SEQ ID NO: 6196 - protein, 31 aa, Artificial Sequence
  Description of Artificial Sequence: Synthetic polypeptide
DEEEIRTTNPVATEQYGSVSTNLDRGGNNHE

SEQ ID NO: 6197 - protein, 30 aa, Artificial Sequence
  Description of Artificial Sequence: Synthetic polypeptide
DEEEIRTTNPVATEQYGSVSTNLQHIDTRV

SEQ ID NO: 6198 - protein, 28 aa, Artificial Sequence
  Description of Artificial Sequence: Synthetic peptide
DEEEIRTCNPVATEQYGSVSTPLQRDQG

SEQ ID NO: 6199 - protein, 31 aa, Artificial Sequence
  Description of Artificial Sequence: Synthetic polypeptide
DEEEIRTTNPVATEQYGSVSTNLQHMGDNDD

SEQ ID NO: 6200 - protein, 31 aa, Artificial Sequence
  Description of Artificial Sequence: Synthetic polypeptide
DEEEIRTTNPVATEQYGSVSTNLQHMGDNDF

SEQ ID NO: 6201 - protein, 30 aa, Artificial Sequence
  Description of Artificial Sequence: Synthetic polypeptide
FEEEIRTTNPVATEQYGSVSTVNLQDGNEF

SEQ ID NO: 6202 - protein, 31 aa, Artificial Sequence
  Description of Artificial Sequence: Synthetic polypeptide
DEEEIRTTNPVATEQYGSVSTNLQHMGGNTL

SEQ ID NO: 6203 - protein, 28 aa, Artificial Sequence
  Description of Artificial Sequence: Synthetic peptide
DEEEIRTCNPVATEQYGSVSTMLQRNEE

SEQ ID NO: 6204 - protein, 30 aa, Artificial Sequence
  Description of Artificial Sequence: Synthetic polypeptide
DEEEIRCTNPVATEQYGSVATNLQSGGNER

SEQ ID NO: 6205 - protein, 28 aa, Artificial Sequence
  Description of Artificial Sequence: Synthetic peptide
DEEEIRTCNPVATEQYGSVSTLLQRNGG

SEQ ID NO: 6206 - protein, 31 aa, Artificial Sequence
  Description of Artificial Sequence: Synthetic polypeptide
DEEEIRTTNPVATEQYGSVSTNLDRFGILNS

SEQ ID NO: 6207 - protein, 30 aa, Artificial Sequence
  Description of Artificial Sequence: Synthetic polypeptide
DEEEIRCTNPVATEQYGSVATNLQRGTNEQ

SEQ ID NO: 6208 - protein, 28 aa, Artificial Sequence
  Description of Artificial Sequence: Synthetic peptide
DEEEIRTCNPVATEQYGSVSTVLQRDDE

SEQ ID NO: 6209 - protein, 31 aa, Artificial Sequence
  Description of Artificial Sequence: Synthetic polypeptide
DEEEIRTTNPVATEQYGSCSPTNLLQRTQNR

SEQ ID NO: 6210 - protein, 30 aa, Artificial Sequence
  Description of Artificial Sequence: Synthetic polypeptide
AELEIRTTNPVATEQYGSVSTNLQTGVNRP

SEQ ID NO: 6211 - protein, 28 aa, Artificial Sequence
  Description of Artificial Sequence: Synthetic peptide
EEEEIATTNPVAYEQYGSVSTNLQNGNQ

SEQ ID NO: 6212 - protein, 29 aa, Artificial Sequence
  Description of Artificial Sequence: Synthetic peptide
DEEEIRTTNPVATEQYGSCSTDDQRGNQD

SEQ ID NO: 6213 - protein, 30 aa, Artificial Sequence
  Description of Artificial Sequence: Synthetic polypeptide
DEEEIRTTNPVATEQYGSVSTNLDQGNNEG

SEQ ID NO: 6214 - protein, 29 aa, Artificial Sequence
  Description of Artificial Sequence: Synthetic peptide
FEEEIRTTNPVATETYGSVSTNLQRGSVV

SEQ ID NO: 6215 - protein, 29 aa, Artificial Sequence
  Description of Artificial Sequence: Synthetic peptide
FEEEIRTTNPVATETYGSVSTNGQKGNRL

SEQ ID NO: 6216 - protein, 30 aa, Artificial Sequence
  Description of Artificial Sequence: Synthetic polypeptide
FEEEIRTTNPVATESYGSVSTNLQRSGNNG

SEQ ID NO: 6217 - protein, 31 aa, Artificial Sequence
  Description of Artificial Sequence: Synthetic polypeptide
DEEEIRTTNPVATEQYGSVSTNLQHEGNDLK

SEQ ID NO: 6218 - protein, 28 aa, Artificial Sequence
  Description of Artificial Sequence: Synthetic peptide
EEEEICTTNPVAYEHYGSVSTNLQRGNS

SEQ ID NO: 6219 - protein, 28 aa, Artificial Sequence
  Description of Artificial Sequence: Synthetic peptide
DEEEIRTTNPVATEQYGSASGNLQGGEA

SEQ ID NO: 6220 - protein, 31 aa, Artificial Sequence
  Description of Artificial Sequence: Synthetic polypeptide
DEEEIRTTNPVATEQYGSVSTNLQHFGGNDT

SEQ ID NO: 6221 - protein, 30 aa, Artificial Sequence
  Description of Artificial Sequence: Synthetic polypeptide
DEEEIRTTNPVATEQYGSASLGNMLQRVNR

SEQ ID NO: 6222 - protein, 32 aa, Artificial Sequence
  Description of Artificial Sequence: Synthetic polypeptide
DEEEIRTTNPVATEQYGSVSTNLDQGRGGNQL

SEQ ID NO: 6223 - protein, 29 aa, Artificial Sequence
  Description of Artificial Sequence: Synthetic peptide
DEEEIRTTNPVATEQYGSCSSPTQRGNER

SEQ ID NO: 6224 - protein, 31 aa, Artificial Sequence
  Description of Artificial Sequence: Synthetic polypeptide
DEEEIRTTNPVATEQYGSVSTNLQREINNNS

SEQ ID NO: 6225 - protein, 29 aa, Artificial Sequence
  Description of Artificial Sequence: Synthetic peptide
FEEEIRTTNPVATEQYGVVSTNLQFGNDV

SEQ ID NO: 6226 - protein, 28 aa, Artificial Sequence
  Description of Artificial Sequence: Synthetic peptide
NEGEIRTTNPVATEQYGSVPTNLQIGIR

SEQ ID NO: 6227 - protein, 30 aa, Artificial Sequence
  Description of Artificial Sequence: Synthetic polypeptide
DEEEIRTTNPVATEQYGSVSTNLDQGSNEI

SEQ ID NO: 6228 - protein, 28 aa, Artificial Sequence
  Description of Artificial Sequence: Synthetic peptide
EEEEIRCTNPIATEQYGSVSENLERGNR

SEQ ID NO: 6229 - protein, 30 aa, Artificial Sequence
  Description of Artificial Sequence: Synthetic polypeptide
DEEEIRTTNPVATEQYGSVSTNLDQINNEG

SEQ ID NO: 6230 - protein, 30 aa, Artificial Sequence
  Description of Artificial Sequence: Synthetic polypeptide
DECEIRTTNPVATEAYGSVSTNLQRGNGDM

SEQ ID NO: 6231 - protein, 28 aa, Artificial Sequence
  Description of Artificial Sequence: Synthetic peptide
EEEEIRCTNPIATEQYGSVSENLMRGNR

SEQ ID NO: 6232 - protein, 28 aa, Artificial Sequence
  Description of Artificial Sequence: Synthetic peptide
NEGEIRTTNPVATEQYGSVVTNLQMGSR

SEQ ID NO: 6233 - protein, 31 aa, Artificial Sequence
  Description of Artificial Sequence: Synthetic polypeptide
DECEIRTTNPVATEAYGSVASCTNLSQRGNR

SEQ ID NO: 6234 - protein, 28 aa, Artificial Sequence
  Description of Artificial Sequence: Synthetic peptide
EEEEIRTTNPVATEGYGCTSDNLQRGNR

SEQ ID NO: 6235 - protein, 30 aa, Artificial Sequence
  Description of Artificial Sequence: Synthetic polypeptide
DEEEIRTCNPVATEQYGSVSTYLQTRGNQE

SEQ ID NO: 6236 - protein, 29 aa, Artificial Sequence
  Description of Artificial Sequence: Synthetic peptide
DEEEIRTCNPVATEQYGSVSTVNLQRNQE

SEQ ID NO: 6237 - protein, 30 aa, Artificial Sequence
  Description of Artificial Sequence: Synthetic polypeptide
DEEEIRCTNPVATEQYGSVCSTNLQSGSNQ

SEQ ID NO: 6238 - protein, 28 aa, Artificial Sequence
  Description of Artificial Sequence: Synthetic peptide
DECEIRTTNPVATDQYGAVSTNLERGND

SEQ ID NO: 6239 - protein, 28 aa, Artificial Sequence
  Description of Artificial Sequence: Synthetic peptide
DEEEIRTCNPVATEQYGSVSTVLQRNEE

SEQ ID NO: 6240 - protein, 30 aa, Artificial Sequence
  Description of Artificial Sequence: Synthetic polypeptide
DEEEIRTTNPVATEQYGSVSTNLQHGDEDA

SEQ ID NO: 6241 - protein, 28 aa, Artificial Sequence
  Description of Artificial Sequence: Synthetic peptide
DECEINTTNPVATEQYGSVSTNLTYGNT

SEQ ID NO: 6242 - protein, 30 aa, Artificial Sequence
  Description of Artificial Sequence: Synthetic polypeptide
DEEEIRTTNPVATEQYGSCSPNDQRGNERQ

SEQ ID NO: 6243 - protein, 29 aa, Artificial Sequence
  Description of Artificial Sequence: Synthetic peptide
NNEEIRTTNPVATEQYGVVSTNLQPGNNR

SEQ ID NO: 6244 - protein, 32 aa, Artificial Sequence
  Description of Artificial Sequence: Synthetic polypeptide
DEEEIRTTNPVATEQYGSVSTNLQRDGGNEDH

SEQ ID NO: 6245 - protein, 31 aa, Artificial Sequence
  Description of Artificial Sequence: Synthetic polypeptide
DEEEIRTTNPVATEQYGSVSTNLQIGEGNFE

SEQ ID NO: 6246 - protein, 30 aa, Artificial Sequence
  Description of Artificial Sequence: Synthetic polypeptide
DEEEIRTTNPVATEQYGSVSGPIQRGENER

SEQ ID NO: 6247 - protein, 30 aa, Artificial Sequence
  Description of Artificial Sequence: Synthetic polypeptide
AEEVIRTTNPVATEQYGSVPTGNLQRGSNR

SEQ ID NO: 6248 - protein, 30 aa, Artificial Sequence
  Description of Artificial Sequence: Synthetic polypeptide
DEEEIRCTNPVATEQYGSVATNLQLDGNAR

SEQ ID NO: 6249 - protein, 29 aa, Artificial Sequence
  Description of Artificial Sequence: Synthetic peptide
DEEEIRTCNPVATEQYGSVSTGGQRGNGE

SEQ ID NO: 6250 - protein, 29 aa, Artificial Sequence
  Description of Artificial Sequence: Synthetic peptide
DEEEIRCTNPVATEQYGSVATNLQERSNQ

SEQ ID NO: 6251 - protein, 31 aa, Artificial Sequence
  Description of Artificial Sequence: Synthetic polypeptide
EEEEIRTTNPVATEQYGSVSCTNLQRGGNNG

SEQ ID NO: 6252 - protein, 31 aa, Artificial Sequence
  Description of Artificial Sequence: Synthetic polypeptide
DEEEIRTTNPVATEQYGSVSTNLQIGGENEM

SEQ ID NO: 6253 - protein, 29 aa, Artificial Sequence
  Description of Artificial Sequence: Synthetic peptide
DEEEIRCTNPVATEQYGSVATNLQEAGNQ

SEQ ID NO: 6254 - protein, 30 aa, Artificial Sequence
  Description of Artificial Sequence: Synthetic polypeptide
AEEEIRTTNPVATEQYGSVVVTNLQNGQNR

SEQ ID NO: 6255 - protein, 30 aa, Artificial Sequence
  Description of Artificial Sequence: Synthetic polypeptide
DEEEIRTTNPVATEQYGSVSTNLDRSGIIV

SEQ ID NO: 6256 - protein, 28 aa, Artificial Sequence
  Description of Artificial Sequence: Synthetic peptide
DECEIFTTNPVATEQYGSVSTNLPYGNT

SEQ ID NO: 6257 - protein, 30 aa, Artificial Sequence
  Description of Artificial Sequence: Synthetic polypeptide
DEEEIRTTNPVATEQYGSVSTNLQRAQVEI

SEQ ID NO: 6258 - protein, 29 aa, Artificial Sequence
  Description of Artificial Sequence: Synthetic peptide
DEEEIRTTNPVATEQYGSCSLNQNQRGDR

SEQ ID NO: 6259 - protein, 31 aa, Artificial Sequence
  Description of Artificial Sequence: Synthetic polypeptide
DEEEIRTTNPVATEQYGSVSTNLQIGMNQEL

SEQ ID NO: 6260 - protein, 29 aa, Artificial Sequence
  Description of Artificial Sequence: Synthetic peptide
NENEIRTTNPVATEFYGSVSTNLPRPGNR

SEQ ID NO: 6261 - protein, 28 aa, Artificial Sequence
  Description of Artificial Sequence: Synthetic peptide
NENEIRTTNPVATEQYGSVCTNLQEGSR

SEQ ID NO: 6262 - protein, 28 aa, Artificial Sequence
  Description of Artificial Sequence: Synthetic peptide
NENEIRTTNPVATEQYGSVGTNLQIGSR

SEQ ID NO: 6263 - protein, 30 aa, Artificial Sequence
  Description of Artificial Sequence: Synthetic polypeptide
DEEEIRTTNPVATEQYGSVSTNLFERMNDP

SEQ ID NO: 6264 - protein, 30 aa, Artificial Sequence
  Description of Artificial Sequence: Synthetic polypeptide
DEEEIRTTNPVATEQYGSVSTNLQQVSGMI

SEQ ID NO: 6265 - protein, 30 aa, Artificial Sequence
  Description of Artificial Sequence: Synthetic polypeptide
DEEEIRTTNPVATEQYGSVSTNLDRTENGG

SEQ ID NO: 6266 - protein, 31 aa, Artificial Sequence
  Description of Artificial Sequence: Synthetic polypeptide
DEEEIRTTNPVATEQYGSVSTNLQQTQGFNN

SEQ ID NO: 6267 - protein, 31 aa, Artificial Sequence
  Description of Artificial Sequence: Synthetic polypeptide
DEEEIRTTNPVATEQYGSVSTNLQQTGANEL

SEQ ID NO: 6268 - protein, 31 aa, Artificial Sequence
  Description of Artificial Sequence: Synthetic polypeptide
DEEEIRTTNPVATEQYGSVSTNLDSNGNDRF

SEQ ID NO: 6269 - protein, 31 aa, Artificial Sequence
  Description of Artificial Sequence: Synthetic polypeptide
DEEEIRTTNPVATEQYGSVSTNLDSNGNERI

SEQ ID NO: 6270 - protein, 32 aa, Artificial Sequence
  Description of Artificial Sequence: Synthetic polypeptide
DEEEIRTTNPVATEQYGSVSTNLDSRTGNSRG

SEQ ID NO: 6271 - protein, 30 aa, Artificial Sequence
  Description of Artificial Sequence: Synthetic polypeptide
EEEEIRTTNPVATEQYGSVSPTNLQDGNLL

SEQ ID NO: 6272 - protein, 30 aa, Artificial Sequence
  Description of Artificial Sequence: Synthetic polypeptide
EEEEIRTTNPVATEQYGSVSPTNLQLGNNQ

SEQ ID NO: 6273 - protein, 32 aa, Artificial Sequence
  Description of Artificial Sequence: Synthetic polypeptide
DEEEIRTTNPVATEQYGSVSTNLDTRTGNQRD

SEQ ID NO: 6274 - protein, 28 aa, Artificial Sequence
  Description of Artificial Sequence: Synthetic peptide
DECEIDTTNPVATEQYGSVSTNLDQGNT

SEQ ID NO: 6275 - protein, 30 aa, Artificial Sequence
  Description of Artificial Sequence: Synthetic polypeptide
DEEEIRTTNPVATEQYGSCSLVNMLQRDNR

SEQ ID NO: 6276 - protein, 30 aa, Artificial Sequence
  Description of Artificial Sequence: Synthetic polypeptide
DEEEIRTTNPVATEQYGMVSTTNLQLGNDD

SEQ ID NO: 6277 - protein, 30 aa, Artificial Sequence
  Description of Artificial Sequence: Synthetic polypeptide
DEEEIRCTNPVATEQYGSVATNLQMDGNGR

SEQ ID NO: 6278 - protein, 28 aa, Artificial Sequence
  Description of Artificial Sequence: Synthetic peptide
DECEINTTNPVATEQYGSVSTNLMKGNT

SEQ ID NO: 6279 - protein, 31 aa, Artificial Sequence
  Description of Artificial Sequence: Synthetic polypeptide
DEEEIRTTNPVATEQYGSVSTNLQHMGNNIP

SEQ ID NO: 6280 - protein, 28 aa, Artificial Sequence
  Description of Artificial Sequence: Synthetic peptide
EEEEIRTTNPVATEQYGSVATALQGGIR

SEQ ID NO: 6281 - protein, 29 aa, Artificial Sequence
  Description of Artificial Sequence: Synthetic peptide
DEEEIRTTNPVATEQYGSCSNTNLDGLNR

SEQ ID NO: 6282 - protein, 29 aa, Artificial Sequence
  Description of Artificial Sequence: Synthetic peptide
AEEEIRTTNPVSTEQYGSVSTNLQHGNPQ

SEQ ID NO: 6283 - protein, 29 aa, Artificial Sequence
  Description of Artificial Sequence: Synthetic peptide
AEEEIRTTNPVSTEQYGSVSTNLQNGNTV

SEQ ID NO: 6284 - protein, 32 aa, Artificial Sequence
  Description of Artificial Sequence: Synthetic polypeptide
DEEEIRTTNPVATEQYGSCSNTENDLQRGNRD

SEQ ID NO: 6285 - protein, 31 aa, Artificial Sequence
  Description of Artificial Sequence: Synthetic polypeptide
DEEEIRTTNPVATEQYGSVSTNLQHNGNENK

SEQ ID NO: 6286 - protein, 31 aa, Artificial Sequence
  Description of Artificial Sequence: Synthetic polypeptide
DEEEIRTTNPVATEQYGMVSTVNLQERGGNN

SEQ ID NO: 6287 - protein, 31 aa, Artificial Sequence
  Description of Artificial Sequence: Synthetic polypeptide
DEEEIRTTNPVATEQYGSVSTNLQHQGNNDT

SEQ ID NO: 6288 - protein, 28 aa, Artificial Sequence
  Description of Artificial Sequence: Synthetic peptide
DEEEIRTCNPVATEQYGSVSTILQRNQD

SEQ ID NO: 6289 - protein, 31 aa, Artificial Sequence
  Description of Artificial Sequence: Synthetic polypeptide
FEEEIRTTNPVATEQYGSVSTTNLQREGNNI

SEQ ID NO: 6290 - protein, 29 aa, Artificial Sequence
  Description of Artificial Sequence: Synthetic peptide
DEEEIRTCNPVATEQYGSVSTHLQRNNQE

SEQ ID NO: 6291 - protein, 30 aa, Artificial Sequence
  Description of Artificial Sequence: Synthetic polypeptide
DEEEIRTTNPVATEQYGSVSTNLQHSGDQV

SEQ ID NO: 6292 - protein, 28 aa, Artificial Sequence
  Description of Artificial Sequence: Synthetic peptide
EEEEIRTTNPVATEQYGSVATGLQNGER

SEQ ID NO: 6293 - protein, 30 aa, Artificial Sequence
  Description of Artificial Sequence: Synthetic polypeptide
DEEEIRTTNPVATEQYGSVSTNLFGGTNIL

SEQ ID NO: 6294 - protein, 31 aa, Artificial Sequence
  Description of Artificial Sequence: Synthetic polypeptide
DEEEIRTTNPVATEQYGSVSTNLQHSGNDTD

SEQ ID NO: 6295 - protein, 30 aa, Artificial Sequence
  Description of Artificial Sequence: Synthetic polypeptide
DEEEIRTTNPVATEQYGSVSTNLQIEENVL

SEQ ID NO: 6296 - protein, 30 aa, Artificial Sequence
  Description of Artificial Sequence: Synthetic polypeptide
DEEEIRTTNPVATEQYGSVSTNLQIDGIID

SEQ ID NO: 6297 - protein, 28 aa, Artificial Sequence
  Description of Artificial Sequence: Synthetic peptide
DEEEIRTCNPVATEQYGSVSTGLQRPQE

SEQ ID NO: 6298 - protein, 29 aa, Artificial Sequence
  Description of Artificial Sequence: Synthetic peptide
EEEEIRTTNPVATEQYGSVETALQNGNIR

SEQ ID NO: 6299 - protein, 30 aa, Artificial Sequence
  Description of Artificial Sequence: Synthetic polypeptide
DEEEIRTTNPVATEQYGSVSTNLDRINNME

SEQ ID NO: 6300 - protein, 31 aa, Artificial Sequence
  Description of Artificial Sequence: Synthetic polypeptide
DEEEIRTTNPVATEQYGSVSTNLQHSGSDNQ

SEQ ID NO: 6301 - protein, 30 aa, Artificial Sequence
  Description of Artificial Sequence: Synthetic polypeptide
EEEEIATTNPVATEQYGSVSTNLQRGANET

SEQ ID NO: 6302 - protein, 28 aa, Artificial Sequence
  Description of Artificial Sequence: Synthetic peptide
NEHEIRTTNPVATEQYGSVPTNLQIGSR

SEQ ID NO: 6303 - protein, 30 aa, Artificial Sequence
  Description of Artificial Sequence: Synthetic polypeptide
DEEEIRTTNPVATEQYGSCSNPNMLQRENR

SEQ ID NO: 6304 - protein, 31 aa, Artificial Sequence
  Description of Artificial Sequence: Synthetic polypeptide
DEEEIRTTNPVATEQYGSVSTNLQRDGVLFA

SEQ ID NO: 6305 - protein, 31 aa, Artificial Sequence
  Description of Artificial Sequence: Synthetic polypeptide
DEEEIRTTNPVATEQYGSVSTNLDRIGQNNE

SEQ ID NO: 6306 - protein, 28 aa, Artificial Sequence
  Description of Artificial Sequence: Synthetic peptide
EEEEIRTTNPVATEQYGSVATTLQIGFR

SEQ ID NO: 6307 - protein, 31 aa, Artificial Sequence
  Description of Artificial Sequence: Synthetic polypeptide
DEEEIRTTNPVATEQYGSVSTNLQRDGVTEA

SEQ ID NO: 6308 - protein, 30 aa, Artificial Sequence
  Description of Artificial Sequence: Synthetic polypeptide
AEEEIRTTNPVATEQYGSVVVTNLQALGNR

SEQ ID NO: 6309 - protein, 32 aa, Artificial Sequence
  Description of Artificial Sequence: Synthetic polypeptide
DEEEIRTTNPVATEQYGSVSTNLQRDGPEPNQ

SEQ ID NO: 6310 - protein, 32 aa, Artificial Sequence
  Description of Artificial Sequence: Synthetic polypeptide
EEEEIRTTNPVATEQYGSVSTANLSQRGENNR

SEQ ID NO: 6311 - protein, 31 aa, Artificial Sequence
  Description of Artificial Sequence: Synthetic polypeptide
DEEEIRTTNPVATEQYGSVSTNLQRFGDEGF

SEQ ID NO: 6312 - protein, 32 aa, Artificial Sequence
  Description of Artificial Sequence: Synthetic polypeptide
DEEEIRTTNPVATEQYGSVSTNLQRFGDEGNQ

SEQ ID NO: 6313 - protein, 28 aa, Artificial Sequence
  Description of Artificial Sequence: Synthetic peptide
AEEEIRTTNPVATEVYGSVSTLLQRNNM

SEQ ID NO: 6314 - protein, 29 aa, Artificial Sequence
  Description of Artificial Sequence: Synthetic peptide
AEEEIRTTNPVATEVYGSVSTNLQIEGDR

SEQ ID NO: 6315 - protein, 28 aa, Artificial Sequence
  Description of Artificial Sequence: Synthetic peptide
DEEEIRTTNPVATEQYGNTATNLERGNE

SEQ ID NO: 6316 - protein, 29 aa, Artificial Sequence
  Description of Artificial Sequence: Synthetic peptide
DEEEIRTTNPVATEQYGSCSTNDQSGNPV

SEQ ID NO: 6317 - protein, 29 aa, Artificial Sequence
  Description of Artificial Sequence: Synthetic peptide
DEEEIRTTNPVATEQYGSCSTNDQSGNGE

SEQ ID NO: 6318 - protein, 30 aa, Artificial Sequence
  Description of Artificial Sequence: Synthetic polypeptide
DEEEIRTTNPVATEQYGSCSTNDQRNNVRT

SEQ ID NO: 6319 - protein, 30 aa, Artificial Sequence
  Description of Artificial Sequence: Synthetic polypeptide
DECEIRTTNPVATEQYGEVSTNLQRGENNS

SEQ ID NO: 6320 - protein, 29 aa, Artificial Sequence
  Description of Artificial Sequence: Synthetic peptide
DECEIRTTNPVATEQYGEVSTNLQGDGDR

SEQ ID NO: 6321 - protein, 28 aa, Artificial Sequence
  Description of Artificial Sequence: Synthetic peptide
DEEEIRTTNPVATEQYGSCSTNDQRHTQ

SEQ ID NO: 6322 - protein, 30 aa, Artificial Sequence
  Description of Artificial Sequence: Synthetic polypeptide
DEEEIRTTNPVATEQYGSVSTNLDIGINNM

SEQ ID NO: 6323 - protein, 29 aa, Artificial Sequence
  Description of Artificial Sequence: Synthetic peptide
AEEEIRTTNPVATEVYGSVSTVNLQNGNT

SEQ ID NO: 6324 - protein, 28 aa, Artificial Sequence
  Description of Artificial Sequence: Synthetic peptide
DEEEIRTTNPVATEQYGSCSTNDQPEER

SEQ ID NO: 6325 - protein, 30 aa, Artificial Sequence
  Description of Artificial Sequence: Synthetic polypeptide
DEEEIRTTNPAATEQYGSVCATNLQRGNHL

SEQ ID NO: 6326 - protein, 28 aa, Artificial Sequence
  Description of Artificial Sequence: Synthetic peptide
DEEEIRTTNPVATEQYGSCSTNDQLNER

SEQ ID NO: 6327 - protein, 31 aa, Artificial Sequence
  Description of Artificial Sequence: Synthetic polypeptide
DEEEIRTTNPVATEQYGSVSTNLQGLGNLDG

SEQ ID NO: 6328 - protein, 30 aa, Artificial Sequence
  Description of Artificial Sequence: Synthetic polypeptide
DECEIRTTNPVATEQYGDVSTNLQRGNNEV

SEQ ID NO: 6329 - protein, 30 aa, Artificial Sequence
  Description of Artificial Sequence: Synthetic polypeptide
DECEIRTTNPVATEQYGCVSTNLQRGNNNP

SEQ ID NO: 6330 - protein, 31 aa, Artificial Sequence
  Description of Artificial Sequence: Synthetic polypeptide
DEEEIRTTNPVATEQYGSVSGSTNLQEGGNS

SEQ ID NO: 6331 - protein, 29 aa, Artificial Sequence
  Description of Artificial Sequence: Synthetic peptide
DTEEIRYTNPVATEQYGSAVSTNLQNGER

SEQ ID NO: 6332 - protein, 30 aa, Artificial Sequence
  Description of Artificial Sequence: Synthetic polypeptide
DECEIRTTNPVATEQYGAVSTNLQMDGNNR

SEQ ID NO: 6333 - protein, 28 aa, Artificial Sequence
  Description of Artificial Sequence: Synthetic peptide
DECEIRTTNPVATEQYGAVSTDLQRPND

SEQ ID NO: 6334 - protein, 28 aa, Artificial Sequence
  Description of Artificial Sequence: Synthetic peptide
GDEEIRTTNPVATEQYGSVSENLEHGNR

SEQ ID NO: 6335 - protein, 30 aa, Artificial Sequence
  Description of Artificial Sequence: Synthetic polypeptide
DEEEIRTTNPVATEQYGSVSTNLDPEGGNT

SEQ ID NO: 6336 - protein, 29 aa, Artificial Sequence
  Description of Artificial Sequence: Synthetic peptide
AEEEIRTTNPVATEYYGSVASTNLQSGNN

SEQ ID NO: 6337 - protein, 29 aa, Artificial Sequence
  Description of Artificial Sequence: Synthetic peptide
DEEEIRTTNPVATEQYGSVSTNLDPIGIS

SEQ ID NO: 6338 - protein, 31 aa, Artificial Sequence
  Description of Artificial Sequence: Synthetic polypeptide
DEEEIRTTNPVATEQYGSVSTNLDQEGFGNE

SEQ ID NO: 6339 - protein, 29 aa, Artificial Sequence
  Description of Artificial Sequence: Synthetic peptide
DTEEIRYTNPVATEQYGSGVSTNLQNGDR

SEQ ID NO: 6340 - protein, 29 aa, Artificial Sequence
  Description of Artificial Sequence: Synthetic peptide
DTEEIRYTNPVATEQYGSGVSTNLQNGPR

SEQ ID NO: 6341 - protein, 29 aa, Artificial Sequence
  Description of Artificial Sequence: Synthetic peptide
AEEEIRTTNPVATEYYGSVESTNLQNGNG

SEQ ID NO: 6342 - protein, 30 aa, Artificial Sequence
  Description of Artificial Sequence: Synthetic polypeptide
DEEEIRTTNPVATEQYGLVSWTNLNRGQNE

SEQ ID NO: 6343 - protein, 30 aa, Artificial Sequence
  Description of Artificial Sequence: Synthetic polypeptide
DEEEIRTTNPVATEQYGSVSTNLDITGNEI

SEQ ID NO: 6344 - protein, 31 aa, Artificial Sequence
  Description of Artificial Sequence: Synthetic polypeptide
DEEEIRTTNPVATEQYGMCVSTNLQRGSNQN

SEQ ID NO: 6345 - protein, 28 aa, Artificial Sequence
  Description of Artificial Sequence: Synthetic peptide
AEEEIRTTNPVATEVYGSVSNNLQLLNR

SEQ ID NO: 6346 - protein, 30 aa, Artificial Sequence
  Description of Artificial Sequence: Synthetic polypeptide
DEEEIRTTNPVATEQYGSCSTNDTRNGNVR

SEQ ID NO: 6347 - protein, 29 aa, Artificial Sequence
  Description of Artificial Sequence: Synthetic peptide
GEEEIATTNPVATECYGSVSTNLQGGNDR

SEQ ID NO: 6348 - protein, 30 aa, Artificial Sequence
  Description of Artificial Sequence: Synthetic polypeptide
DEEEIRTTNPVATEQYGSCSTNILQQGIDR

SEQ ID NO: 6349 - protein, 30 aa, Artificial Sequence
  Description of Artificial Sequence: Synthetic polypeptide
DEEEIRTTNPVATEQYGSCSTNGQRNNVRD

SEQ ID NO: 6350 - protein, 28 aa, Artificial Sequence
  Description of Artificial Sequence: Synthetic peptide
AEEEIRTTNPVATETYGAISINLQRGNR

SEQ ID NO: 6351 - protein, 29 aa, Artificial Sequence
  Description of Artificial Sequence: Synthetic peptide
AEEEIRTTNPVATETYGSVDSTNLQSGNG

SEQ ID NO: 6352 - protein, 30 aa, Artificial Sequence
  Description of Artificial Sequence: Synthetic polypeptide
AEEEIRTTNPVATETYGSVSITNLQEGENR

SEQ ID NO: 6353 - protein, 30 aa, Artificial Sequence
  Description of Artificial Sequence: Synthetic polypeptide
AEEEIRTTNPVATETYGSVSSTNLQSGNNR

SEQ ID NO: 6354 - protein, 30 aa, Artificial Sequence
  Description of Artificial Sequence: Synthetic polypeptide
DEEEIRTTNPVATEQYGLVSTNLNQPEGNT

SEQ ID NO: 6355 - protein, 30 aa, Artificial Sequence
  Description of Artificial Sequence: Synthetic polypeptide
DEEEIRTTNPAATEQYGSVIITNLQRGNQN

SEQ ID NO: 6356 - protein, 30 aa, Artificial Sequence
  Description of Artificial Sequence: Synthetic polypeptide
AEEEIRTTNPVATETYGSVSTNLQAAGNIR

SEQ ID NO: 6357 - protein, 30 aa, Artificial Sequence
  Description of Artificial Sequence: Synthetic polypeptide
AEEEIRTTNPVATETYGSVSTNLQLQGNIR

SEQ ID NO: 6358 - protein, 28 aa, Artificial Sequence
  Description of Artificial Sequence: Synthetic peptide
DTEEIRTTNPVATEQWGSWHTNDQRGNR

SEQ ID NO: 6359 - protein, 30 aa, Artificial Sequence
  Description of Artificial Sequence: Synthetic polypeptide
DECEIRTTNPVATEQYGSVATNLQHMGNGR

SEQ ID NO: 6360 - protein, 30 aa, Artificial Sequence
  Description of Artificial Sequence: Synthetic polypeptide
DEEEIRTTNPAATEQYGSVIATNLQRGNYE

SEQ ID NO: 6361 - protein, 29 aa, Artificial Sequence
  Description of Artificial Sequence: Synthetic peptide
AEEEIRTTNPVATETYGSVSVTNLDDGNR

SEQ ID NO: 6362 - protein, 30 aa, Artificial Sequence
  Description of Artificial Sequence: Synthetic polypeptide
DEEEIRTTNPVATEQYGSCSTNEQRGNNEK

SEQ ID NO: 6363 - protein, 30 aa, Artificial Sequence
  Description of Artificial Sequence: Synthetic polypeptide
DEEEIRTTNPVATEQYGSVSTNLDFEGQNT

SEQ ID NO: 6364 - protein, 29 aa, Artificial Sequence
  Description of Artificial Sequence: Synthetic peptide
DEEEIRTTNPVATEQYGSCSTNEQFGNEI

SEQ ID NO: 6365 - protein, 30 aa, Artificial Sequence
  Description of Artificial Sequence: Synthetic polypeptide
DEEEIRTTNPVATEQYGSVSTNLDFGNAQE

SEQ ID NO: 6366 - protein, 30 aa, Artificial Sequence
  Description of Artificial Sequence: Synthetic polypeptide
DEEEIRTTNPVATEQYGSVSTNLDFMGGNQ

SEQ ID NO: 6367 - protein, 28 aa, Artificial Sequence
  Description of Artificial Sequence: Synthetic peptide
DECEIRTTNPVATEQYGSVATALIRENR

SEQ ID NO: 6368 - protein, 30 aa, Artificial Sequence
  Description of Artificial Sequence: Synthetic polypeptide
DEEEIRTTNPVATEQYGSVSTNLDFNGQNV

SEQ ID NO: 6369 - protein, 30 aa, Artificial Sequence
  Description of Artificial Sequence: Synthetic polypeptide
DEEEIRTTNPVATEQYGSVSTNLDGGINGT

SEQ ID NO: 6370 - protein, 31 aa, Artificial Sequence
  Description of Artificial Sequence: Synthetic polypeptide
AEEEIRTTNPVATEQYGSVVVSTNLQDGGNR

SEQ ID NO: 6371 - protein, 31 aa, Artificial Sequence
  Description of Artificial Sequence: Synthetic polypeptide
DEEEIRTTNPVATEQYGSVSTNLQGIGMNGQ

SEQ ID NO: 6372 - protein, 30 aa, Artificial Sequence
  Description of Artificial Sequence: Synthetic polypeptide
DECEIRTTNPVATEQYGNVSTNLQATGDNR

SEQ ID NO: 6373 - protein, 30 aa, Artificial Sequence
  Description of Artificial Sequence: Synthetic polypeptide
AEMEIRTTNPVATEQYGSVSTNLERGANRA

SEQ ID NO: 6374 - protein, 28 aa, Artificial Sequence
  Description of Artificial Sequence: Synthetic peptide
AEEEIRTTNPVATETYGSVSTQQQRGNV

SEQ ID NO: 6375 - protein, 31 aa, Artificial Sequence
  Description of Artificial Sequence: Synthetic polypeptide
DEEEIRTTNPVATEQYGSVSTNLQGIGNTSA

SEQ ID NO: 6376 - protein, 29 aa, Artificial Sequence
  Description of Artificial Sequence: Synthetic peptide
DECEIRTTNPVATEQYGIVSTNLQLGGNM

SEQ ID NO: 6377 - protein, 28 aa, Artificial Sequence
  Description of Artificial Sequence: Synthetic peptide
DEEEIRTTNPVATEQYGSCSTNEQPEPR

SEQ ID NO: 6378 - protein, 29 aa, Artificial Sequence
  Description of Artificial Sequence: Synthetic peptide
DEEEIRTTNPVATEQYGSCSTNDLQGFNI

SEQ ID NO: 6379 - protein, 29 aa, Artificial Sequence
  Description of Artificial Sequence: Synthetic peptide
AEEEIRTTNPVATEYYGSVISTNLQLGND

SEQ ID NO: 6380 - protein, 32 aa, Artificial Sequence
  Description of Artificial Sequence: Synthetic polypeptide
DEEEIRTTNPVATEQYGSVSTNLQGNGGNDRG

SEQ ID NO: 6381 - protein, 31 aa, Artificial Sequence
  Description of Artificial Sequence: Synthetic polypeptide
DEEEIRTTNPVATEQYGSCSTGNLQRGNEPQ

SEQ ID NO: 6382 - protein, 30 aa, Artificial Sequence
  Description of Artificial Sequence: Synthetic polypeptide
DEEEIRTTNPVATEQYGSVSTNLDQGNNAM

SEQ ID NO: 6383 - protein, 29 aa, Artificial Sequence
  Description of Artificial Sequence: Synthetic peptide
QECEIHTTNPVATEQYGSVSTNIDQRGNR

SEQ ID NO: 6384 - protein, 29 aa, Artificial Sequence
  Description of Artificial Sequence: Synthetic peptide
DVGEIRTTNPVATEQYGSVSTNGLQLGPR

SEQ ID NO: 6385 - protein, 29 aa, Artificial Sequence
  Description of Artificial Sequence: Synthetic peptide
DVGEIRTTNPVATEQYGSVSTNKLQIGDR

SEQ ID NO: 6386 - protein, 30 aa, Artificial Sequence
  Description of Artificial Sequence: Synthetic polypeptide
DEEEIRTTNPVATEQYGSCSTGNLQRGDTE

SEQ ID NO: 6387 - protein, 31 aa, Artificial Sequence
  Description of Artificial Sequence: Synthetic polypeptide
DEEEIRTTNPVATEQYGMVVSTGNLSQGGNR

SEQ ID NO: 6388 - protein, 30 aa, Artificial Sequence
  Description of Artificial Sequence: Synthetic polypeptide
DEEEIRTTNPVATEQYGSCSTFLQRSGNTG

SEQ ID NO: 6389 - protein, 30 aa, Artificial Sequence
  Description of Artificial Sequence: Synthetic polypeptide
FEENIRTTNPVATEQYGSVSTNLQRGNESV

SEQ ID NO: 6390 - protein, 30 aa, Artificial Sequence
  Description of Artificial Sequence: Synthetic polypeptide
DEEEIRCTNPVATEQYGSVSANLQNNGDNR

SEQ ID NO: 6391 - protein, 28 aa, Artificial Sequence
  Description of Artificial Sequence: Synthetic peptide
DEEEIRTTNPVATEQYGSASANLQIGEL

SEQ ID NO: 6392 - protein, 31 aa, Artificial Sequence
  Description of Artificial Sequence: Synthetic polypeptide
DEEEIRTTNPVATEQYGSVSTNLQGSGDNQL

SEQ ID NO: 6393 - protein, 30 aa, Artificial Sequence
  Description of Artificial Sequence: Synthetic polypeptide
DEEEIRTTNPVATEQYGSCSTDNLQRGVGQ

SEQ ID NO: 6394 - protein, 30 aa, Artificial Sequence
  Description of Artificial Sequence: Synthetic polypeptide
DEEEIRTTNPVATEQYGSVSTNLQGSGFGD

SEQ ID NO: 6395 - protein, 30 aa, Artificial Sequence
  Description of Artificial Sequence: Synthetic polypeptide
DVEEIRSTNPVATEQYGSVSTNLQARNGER

SEQ ID NO: 6396 - protein, 31 aa, Artificial Sequence
  Description of Artificial Sequence: Synthetic polypeptide
DEEEIRTTNPVATEQYGSCSTDNLQRGDNMQ

SEQ ID NO: 6397 - protein, 28 aa, Artificial Sequence
  Description of Artificial Sequence: Synthetic peptide
FEEEISTTNPVATEQYGYVSTNLQGGNV

SEQ ID NO: 6398 - protein, 29 aa, Artificial Sequence
  Description of Artificial Sequence: Synthetic peptide
NEEEIRTTNPVSTEQYGSHSTNLQRMGER

SEQ ID NO: 6399 - protein, 31 aa, Artificial Sequence
  Description of Artificial Sequence: Synthetic polypeptide
NEEEIRTTNPYATEQYGSVSTNLEQRSGNRA

SEQ ID NO: 6400 - protein, 28 aa, Artificial Sequence
  Description of Artificial Sequence: Synthetic peptide
EECEIRTTNPVATEQYGSVHTNQQVGNR

SEQ ID NO: 6401 - protein, 28 aa, Artificial Sequence
  Description of Artificial Sequence: Synthetic peptide
EECEIRTTNPVATEQYGSVWTNLQDGSR

SEQ ID NO: 6402 - protein, 29 aa, Artificial Sequence
  Description of Artificial Sequence: Synthetic peptide
NEEEISTTNPVATEQYGSVSTNLQHNGNP

SEQ ID NO: 6403 - protein, 30 aa, Artificial Sequence
  Description of Artificial Sequence: Synthetic polypeptide
DEEEIRTTNPVATEQYGMVSWTNLNMGMNR

SEQ ID NO: 6404 - protein, 30 aa, Artificial Sequence
  Description of Artificial Sequence: Synthetic polypeptide
FEEEIRTTNPVATQQYGSVSTNLQHRGERP

SEQ ID NO: 6405 - protein, 31 aa, Artificial Sequence
  Description of Artificial Sequence: Synthetic polypeptide
DEEEIRTTNPVATEQYGSVSTNLFQEDFGNN

SEQ ID NO: 6406 - protein, 28 aa, Artificial Sequence
  Description of Artificial Sequence: Synthetic peptide
FEEEIRTTNPVATHQYGSACTNLQRGNV

SEQ ID NO: 6407 - protein, 31 aa, Artificial Sequence
  Description of Artificial Sequence: Synthetic polypeptide
NEEEVRTTNPVATEQYGSVSTNNLDQRIGNR

SEQ ID NO: 6408 - protein, 28 aa, Artificial Sequence
  Description of Artificial Sequence: Synthetic peptide
NEEGIRTTNPVATEQYGSVSTNLSMLNR

SEQ ID NO: 6409 - protein, 29 aa, Artificial Sequence
  Description of Artificial Sequence: Synthetic peptide
DEEEIRTTNPVATEQYGSCSTDLQDGTRH

SEQ ID NO: 6410 - protein, 30 aa, Artificial Sequence
  Description of Artificial Sequence: Synthetic polypeptide
EEEEIATTNPVATEQYGSVSANLSQRGENR

SEQ ID NO: 6411 - protein, 29 aa, Artificial Sequence
  Description of Artificial Sequence: Synthetic peptide
NEEEIRTTNPVCTEQYGSVSTNLQGTDNR

SEQ ID NO: 6412 - protein, 29 aa, Artificial Sequence
  Description of Artificial Sequence: Synthetic peptide
DEEEIRTTNPVATEQYGSCSTILERINRA

SEQ ID NO: 6413 - protein, 30 aa, Artificial Sequence
  Description of Artificial Sequence: Synthetic polypeptide
DEEEIRCTNPVATEQYGSVSCNLPMREGNR

SEQ ID NO: 6414 - protein, 29 aa, Artificial Sequence
  Description of Artificial Sequence: Synthetic peptide
FEEVIRTTNPVATEQYGSVSTNPLQHGNE

SEQ ID NO: 6415 - protein, 30 aa, Artificial Sequence
  Description of Artificial Sequence: Synthetic polypeptide
AEEEIRTTNPVATEYYGSVSTNELQEEGNR

SEQ ID NO: 6416 - protein, 29 aa, Artificial Sequence
  Description of Artificial Sequence: Synthetic peptide
DTEEIRYTNPVATEQYGSKVSTNLQNGTR

SEQ ID NO: 6417 - protein, 30 aa, Artificial Sequence
  Description of Artificial Sequence: Synthetic polypeptide
DECEIRTTNPVATEGYGSVSTNLQRGDQDR

SEQ ID NO: 6418 - protein, 30 aa, Artificial Sequence
  Description of Artificial Sequence: Synthetic polypeptide
AEEEIRTTNPVATEYYGSVSTNLQRETENR

SEQ ID NO: 6419 - protein, 29 aa, Artificial Sequence
  Description of Artificial Sequence: Synthetic peptide
DTEEIRYTNPVATEQYGSLVSTNLQNGER

SEQ ID NO: 6420 - protein, 30 aa, Artificial Sequence
  Description of Artificial Sequence: Synthetic polypeptide
DEEEIRATNPVATEQYGYVSNTNLFQGGNR

SEQ ID NO: 6421 - protein, 30 aa, Artificial Sequence
  Description of Artificial Sequence: Synthetic polypeptide
DEEEIRATNPVATEQYGYVSTTNLDQGGNR

SEQ ID NO: 6422 - protein, 29 aa, Artificial Sequence
  Description of Artificial Sequence: Synthetic peptide
DTEEIRYTNPVATEQYGSVVSTNLQPGTR

SEQ ID NO: 6423 - protein, 31 aa, Artificial Sequence
  Description of Artificial Sequence: Synthetic polypeptide
DEEEIRTTNPVATEQYGSVSTNLDQEIGGNL

SEQ ID NO: 6424 - protein, 32 aa, Artificial Sequence
  Description of Artificial Sequence: Synthetic polypeptide
DEEEIRTTNPVATEQYGSVSTNLDQERMGNQD

SEQ ID NO: 6425 - protein, 30 aa, Artificial Sequence
  Description of Artificial Sequence: Synthetic polypeptide
DEEEIRTTNPVATEQYGSCSTNDIRQGNER

SEQ ID NO: 6426 - protein, 30 aa, Artificial Sequence
  Description of Artificial Sequence: Synthetic polypeptide
DECEIRTTNPVATECYGSVSTNLQRDGDQR

SEQ ID NO: 6427 - protein, 28 aa, Artificial Sequence
  Description of Artificial Sequence: Synthetic peptide
AEEEIRTTNPVATEYYGSVSTNLQYGQE

SEQ ID NO: 6428 - protein, 29 aa, Artificial Sequence
  Description of Artificial Sequence: Synthetic peptide
AEEEIRTTNPVATEYYGSVSTVNLQDGNT

SEQ ID NO: 6429 - protein, 29 aa, Artificial Sequence
  Description of Artificial Sequence: Synthetic peptide
DTEEIVTTNPVATEQYGTVSTNLQGGSNR

SEQ ID NO: 6430 - protein, 29 aa, Artificial Sequence
  Description of Artificial Sequence: Synthetic peptide
NEEEIRTTNPVATEQYGSYSTMLQRGQGR

SEQ ID NO: 6431 - protein, 29 aa, Artificial Sequence
  Description of Artificial Sequence: Synthetic peptide
AEEEIRTTNPVATEYYGSVSVTNLLDGNR

SEQ ID NO: 6432 - protein, 32 aa, Artificial Sequence
  Description of Artificial Sequence: Synthetic polypeptide
DEEEIRTTNPVATEQYGSVSTNLQGREGNQLG

SEQ ID NO: 6433 - protein, 30 aa, Artificial Sequence
  Description of Artificial Sequence: Synthetic polypeptide
FEPEIRTTNPVATDQYGSVSTNLQNRMGNR

SEQ ID NO: 6434 - protein, 28 aa, Artificial Sequence
  Description of Artificial Sequence: Synthetic peptide
QEDEIRTTNPVATEQYGSVSTALERGNW

SEQ ID NO: 6435 - protein, 29 aa, Artificial Sequence
  Description of Artificial Sequence: Synthetic peptide
FESEIRTTNPVATEQYGSAVSTNLQRGSG

SEQ ID NO: 6436 - protein, 31 aa, Artificial Sequence
  Description of Artificial Sequence: Synthetic polypeptide
DEEEIRTTNPVATEQYGSVSTNLQGPGGNEA

SEQ ID NO: 6437 - protein, 31 aa, Artificial Sequence
  Description of Artificial Sequence: Synthetic polypeptide
DEEEIRTTNPVATEQYGSVSTNLFQTNIGND

SEQ ID NO: 6438 - protein, 31 aa, Artificial Sequence
  Description of Artificial Sequence: Synthetic polypeptide
DEEEIRTTNPVATEQYGSVSTNLFNHGSNRG

SEQ ID NO: 6439 - protein, 31 aa, Artificial Sequence
  Description of Artificial Sequence: Synthetic polypeptide
DEEEIRTTNPVATEQYGSVSTNLDQEVGNNL

SEQ ID NO: 6440 - protein, 29 aa, Artificial Sequence
  Description of Artificial Sequence: Synthetic peptide
DEEEIRTTNPVATEQYGSCSTLNLQVSNQ

SEQ ID NO: 6441 - protein, 29 aa, Artificial Sequence
  Description of Artificial Sequence: Synthetic peptide
DTTEIRTTNPVATEQYGSVSTNMLQDGMR

SEQ ID NO: 6442 - protein, 31 aa, Artificial Sequence
  Description of Artificial Sequence: Synthetic polypeptide
FETEIRTTNPVATEQYGSVYSTNLQRGVNRT

SEQ ID NO: 6443 - protein, 30 aa, Artificial Sequence
  Description of Artificial Sequence: Synthetic polypeptide
DEEEIRTTNPVATEQYGSVSTNLQGPDNPA

SEQ ID NO: 6444 - protein, 32 aa, Artificial Sequence
  Description of Artificial Sequence: Synthetic polypeptide
DEEEIRTTNPVATEQYGSVSTNLQGNQGNNAR

SEQ ID NO: 6445 - protein, 30 aa, Artificial Sequence
  Description of Artificial Sequence: Synthetic polypeptide
NEEEIRTTNPVATEVYGSVSETNLQVNGNR

SEQ ID NO: 6446 - protein, 29 aa, Artificial Sequence
  Description of Artificial Sequence: Synthetic peptide
NEEEIRTTNPVATHQYGEVSTNNLQHGNR

SEQ ID NO: 6447 - protein, 29 aa, Artificial Sequence
  Description of Artificial Sequence: Synthetic peptide
GEEEIRTTNPVATDQYGSVSTNQYQMGNR

SEQ ID NO: 6448 - protein, 32 aa, Artificial Sequence
  Description of Artificial Sequence: Synthetic polypeptide
DEEEIRTTNPVATEQYGSCSITENLSQRIGNR

SEQ ID NO: 6449 - protein, 30 aa, Artificial Sequence
  Description of Artificial Sequence: Synthetic polypeptide
DEEEIRTTNPVATEQYGSASLPNNLQRDNR

SEQ ID NO: 6450 - protein, 29 aa, Artificial Sequence
  Description of Artificial Sequence: Synthetic peptide
FEEEIRTTNPVATEQYGIVSTNLQDGGNG

SEQ ID NO: 6451 - protein, 28 aa, Artificial Sequence
  Description of Artificial Sequence: Synthetic peptide
FEEEIRTTNPVATEQYGSASTVLQRQGR

SEQ ID NO: 6452 - protein, 29 aa, Artificial Sequence
  Description of Artificial Sequence: Synthetic peptide
DEEEIRTTNPVATEQYGMVSTDLQMGGNT

SEQ ID NO: 6453 - protein, 30 aa, Artificial Sequence
  Description of Artificial Sequence: Synthetic polypeptide
FEEEIRTTNPVATEQYGSVSTNLQQRGEQV

SEQ ID NO: 6454 - protein, 31 aa, Artificial Sequence
  Description of Artificial Sequence: Synthetic polypeptide
DEEEIRTTNPVATEQYGMVSTDNLQERGTNI

SEQ ID NO: 6455 - protein, 28 aa, Artificial Sequence
  Description of Artificial Sequence: Synthetic peptide
FEEEIRTTNPVATEQYGSLSTALQRQGR

SEQ ID NO: 6456 - protein, 29 aa, Artificial Sequence
  Description of Artificial Sequence: Synthetic peptide
DEEEIRTTNPVATEQYGSCCSTALQRNNI

SEQ ID NO: 6457 - protein, 30 aa, Artificial Sequence
  Description of Artificial Sequence: Synthetic polypeptide
DEEEIRTTNPVATEQYGSCCSTALQHGNRF

SEQ ID NO: 6458 - protein, 30 aa, Artificial Sequence
  Description of Artificial Sequence: Synthetic polypeptide
DEEEIRTTNPVATEQYGSVSTNLQLGIGQI

SEQ ID NO: 6459 - protein, 28 aa, Artificial Sequence
  Description of Artificial Sequence: Synthetic peptide
FEEEIRTTNPVATEQYGSVATALQNGER

SEQ ID NO: 6460 - protein, 28 aa, Artificial Sequence
  Description of Artificial Sequence: Synthetic peptide
FEEEIRTTNPVATEQYGSVATALQNGQR

SEQ ID NO: 6461 - protein, 28 aa, Artificial Sequence
  Description of Artificial Sequence: Synthetic peptide
FEEEIRTTNPVATEQYGSVATLLQNGFR

SEQ ID NO: 6462 - protein, 30 aa, Artificial Sequence
  Description of Artificial Sequence: Synthetic polypeptide
DEEEIRTTNPVATEQYGSVSTNLQNRMEDI

SEQ ID NO: 6463 - protein, 31 aa, Artificial Sequence
  Description of Artificial Sequence: Synthetic polypeptide
DEEEIRTTNPVATEQYGSVSTNLQNRLNALI

SEQ ID NO: 6464 - protein, 29 aa, Artificial Sequence
  Description of Artificial Sequence: Synthetic peptide
DEEEIRTTNPVATEQYGMVSTNNGQGGNE

SEQ ID NO: 6465 - protein, 30 aa, Artificial Sequence
  Description of Artificial Sequence: Synthetic polypeptide
FEEEIRTTNPVATEQYGSVSTNLQQGGNGN

SEQ ID NO: 6466 - protein, 30 aa, Artificial Sequence
  Description of Artificial Sequence: Synthetic polypeptide
DEEEIRTTNPVATEQYGSVSTNLQNMGMGE

SEQ ID NO: 6467 - protein, 30 aa, Artificial Sequence
  Description of Artificial Sequence: Synthetic polypeptide
DEEEIRTTNPVATEQYGSVSTNLQNIGMID

SEQ ID NO: 6468 - protein, 30 aa, Artificial Sequence
  Description of Artificial Sequence: Synthetic polypeptide
DEEEIRTTNPVATEQYGMVSTNLVQDGNGD

SEQ ID NO: 6469 - protein, 30 aa, Artificial Sequence
  Description of Artificial Sequence: Synthetic polypeptide
DEEEIRTTNPVATEQYGSAVYTNLEQRGDI

SEQ ID NO: 6470 - protein, 30 aa, Artificial Sequence
  Description of Artificial Sequence: Synthetic polypeptide
DEEEIRTTNPVATEQYGSAVSVTNLDRGEE

SEQ ID NO: 6471 - protein, 31 aa, Artificial Sequence
  Description of Artificial Sequence: Synthetic polypeptide
DEEEIRTTNPVATEQYGMVSTNLSTRTVGNR

SEQ ID NO: 6472 - protein, 30 aa, Artificial Sequence
  Description of Artificial Sequence: Synthetic polypeptide
FEEEIRTTNPVATEQYGSVISTTNLQFGNI

SEQ ID NO: 6473 - protein, 29 aa, Artificial Sequence
  Description of Artificial Sequence: Synthetic peptide
FEEEIRTTNPVATEQYGSVITNQQRGNQN

SEQ ID NO: 6474 - protein, 30 aa, Artificial Sequence
  Description of Artificial Sequence: Synthetic polypeptide
DEEEIRTTNPVATEQYGSAVSTNLQDGTEI

SEQ ID NO: 6475 - protein, 31 aa, Artificial Sequence
  Description of Artificial Sequence: Synthetic polypeptide
DEEEIRTTNPVATEQYGSVSTNLQNFGQFRG

SEQ ID NO: 6476 - protein, 28 aa, Artificial Sequence
  Description of Artificial Sequence: Synthetic peptide
NETEIRTTNPVATEEYGSVSTNLQWGND

SEQ ID NO: 6477 - protein, 31 aa, Artificial Sequence
  Description of Artificial Sequence: Synthetic polypeptide
DEEEIRTTNPVATEQYGSVSTNLQNFGGNAT

SEQ ID NO: 6478 - protein, 31 aa, Artificial Sequence
  Description of Artificial Sequence: Synthetic polypeptide
DEEEIRTTNPVATEQYGSVSTNLQNEGDNSP

SEQ ID NO: 6479 - protein, 29 aa, Artificial Sequence
  Description of Artificial Sequence: Synthetic peptide
DEEEIRTTNPVATEQYGSVSGNLQEDQNV

SEQ ID NO: 6480 - protein, 30 aa, Artificial Sequence
  Description of Artificial Sequence: Synthetic polypeptide
DEEEIRTTNPVATEQYGSVSTNLERTSNDQ

SEQ ID NO: 6481 - protein, 32 aa, Artificial Sequence
  Description of Artificial Sequence: Synthetic polypeptide
DEEEIRTTNPVATEQYGSAVSTENLQNGGSNR

SEQ ID NO: 6482 - protein, 28 aa, Artificial Sequence
  Description of Artificial Sequence: Synthetic peptide
DEEEIRTTNPVATEQYGSCETNPQRGED

SEQ ID NO: 6483 - protein, 28 aa, Artificial Sequence
  Description of Artificial Sequence: Synthetic peptide
DEEEIRCTNPVATEQYGAVDTNWERGNR

SEQ ID NO: 6484 - protein, 31 aa, Artificial Sequence
  Description of Artificial Sequence: Synthetic polypeptide
DEEEIRTTNPVATEQYGMVSITNLQRGGNNT

SEQ ID NO: 6485 - protein, 31 aa, Artificial Sequence
  Description of Artificial Sequence: Synthetic polypeptide
DEEEIRTTNPVATEQYGSVSTNLEQGGENTS

SEQ ID NO: 6486 - protein, 31 aa, Artificial Sequence
  Description of Artificial Sequence: Synthetic polypeptide
DEEEIRTTNPVATEQYGSVSTNLETGGENPR

SEQ ID NO: 6487 - protein, 28 aa, Artificial Sequence
  Description of Artificial Sequence: Synthetic peptide
ESEEIRTTNPVATDQYGSVSTTLQRGNV

SEQ ID NO: 6488 - protein, 30 aa, Artificial Sequence
  Description of Artificial Sequence: Synthetic polypeptide
DEEEIRTTNPVATEQYGSVSTNLQPGIETI

SEQ ID NO: 6489 - protein, 29 aa, Artificial Sequence
  Description of Artificial Sequence: Synthetic peptide
ETEEIRTTNPVATEQYGVVSTNLQLGANR

SEQ ID NO: 6490 - protein, 28 aa, Artificial Sequence
  Description of Artificial Sequence: Synthetic peptide
FDEEIRTTNPVATDQYGSVSTGLQRGNF

SEQ ID NO: 6491 - protein, 28 aa, Artificial Sequence
  Description of Artificial Sequence: Synthetic peptide
NEREIRTTNPVATEQYGSVITNLQYGSR

SEQ ID NO: 6492 - protein, 31 aa, Artificial Sequence
  Description of Artificial Sequence: Synthetic polypeptide
DEEEIRTTNPVATEQYGSVSTNLQPGGDNDQ

SEQ ID NO: 6493 - protein, 28 aa, Artificial Sequence
  Description of Artificial Sequence: Synthetic peptide
DEEEIRTTNPVATEQYGSCITNIQRGEE

SEQ ID NO: 6494 - protein, 28 aa, Artificial Sequence
  Description of Artificial Sequence: Synthetic peptide
FEEEIRCTNPIATEQYGSVSDNLARGNR

SEQ ID NO: 6495 - protein, 31 aa, Artificial Sequence
  Description of Artificial Sequence: Synthetic polypeptide
DEEEIRTTNPVATEQYGSVSTNLQPDGDNEH

SEQ ID NO: 6496 - protein, 28 aa, Artificial Sequence
  Description of Artificial Sequence: Synthetic peptide
FEEEIRCTNPIATEQYGSVSENLMRGNR

SEQ ID NO: 6497 - protein, 31 aa, Artificial Sequence
  Description of Artificial Sequence: Synthetic polypeptide
DEEEIRTTNPVATEQYGSVSTNLQNVPGLRP

SEQ ID NO: 6498 - protein, 30 aa, Artificial Sequence
  Description of Artificial Sequence: Synthetic polypeptide
DEEEIRTTNPVATEQYGSVSTNLQNSGEDS

SEQ ID NO: 6499 - protein, 30 aa, Artificial Sequence
  Description of Artificial Sequence: Synthetic polypeptide
FEEEIRTTNPVATEQYGSVSTNLQRNANFW

SEQ ID NO: 6500 - protein, 29 aa, Artificial Sequence
  Description of Artificial Sequence: Synthetic peptide
FEEEIRTTNPGATEQYGSVSTMNIQKGNR

SEQ ID NO: 6501 - protein, 28 aa, Artificial Sequence
  Description of Artificial Sequence: Synthetic peptide
NEREIRTTNPVATEQYGSVPTNLQIGDR

SEQ ID NO: 6502 - protein, 31 aa, Artificial Sequence
  Description of Artificial Sequence: Synthetic polypeptide
DEEEIRTTNPVATEQYGSVSTNLESIGLNTR

SEQ ID NO: 6503 - protein, 30 aa, Artificial Sequence
  Description of Artificial Sequence: Synthetic polypeptide
FEEEIRTTNPVATEFYGSVSTNLQRNGNIQ

SEQ ID NO: 6504 - protein, 30 aa, Artificial Sequence
  Description of Artificial Sequence: Synthetic polypeptide
FEEEIRTTNPVATEFYGSVSTNLQRVGNND

SEQ ID NO: 6505 - protein, 30 aa, Artificial Sequence
  Description of Artificial Sequence: Synthetic polypeptide
FEEEIRTTNPVATEGYGSVSTNLQREGNNT

SEQ ID NO: 6506 - protein, 30 aa, Artificial Sequence
  Description of Artificial Sequence: Synthetic polypeptide
FEEEIRTTNPVATEGYGSVSTNLQRNGNTN

SEQ ID NO: 6507 - protein, 30 aa, Artificial Sequence
  Description of Artificial Sequence: Synthetic polypeptide
FEEEIRTTNPVATEGYGSVSTNLQRSGNGD

SEQ ID NO: 6508 - protein, 29 aa, Artificial Sequence
  Description of Artificial Sequence: Synthetic peptide
DEEEIRTTNPVATEQYGMVSTDDQFGSNR

SEQ ID NO: 6509 - protein, 28 aa, Artificial Sequence
  Description of Artificial Sequence: Synthetic peptide
DEEEIRCTNPVATEQWGSVSENLMRGNA

SEQ ID NO: 6510 - protein, 29 aa, Artificial Sequence
  Description of Artificial Sequence: Synthetic peptide
DEEEIRTTNPVATEQYGSVSTNLQNSVII

SEQ ID NO: 6511 - protein, 29 aa, Artificial Sequence
  Description of Artificial Sequence: Synthetic peptide
FEEEIRTTNPVATEQYGCVSTNLQQPGNG

SEQ ID NO: 6512 - protein, 29 aa, Artificial Sequence
  Description of Artificial Sequence: Synthetic peptide
DEEEIRTTNPVATEQYGMVSTDLQGGNNQ

SEQ ID NO: 6513 - protein, 29 aa, Artificial Sequence
  Description of Artificial Sequence: Synthetic peptide
FEEEIRTTNPVATEQYGDVSTNLQQGGNV

SEQ ID NO: 6514 - protein, 30 aa, Artificial Sequence
  Description of Artificial Sequence: Synthetic polypeptide
DEEEIRTTNPVATEQYGSVSTNLQNVENFE

SEQ ID NO: 6515 - protein, 30 aa, Artificial Sequence
  Description of Artificial Sequence: Synthetic polypeptide
DEEEIRTTNPVATEQYGSVSGNLQEGGNGD

SEQ ID NO: 6516 - protein, 29 aa, Artificial Sequence
  Description of Artificial Sequence: Synthetic peptide
DEEEIRTTNPVATEQYGMVSTEPQRGSER

SEQ ID NO: 6517 - protein, 30 aa, Artificial Sequence
  Description of Artificial Sequence: Synthetic polypeptide
DEEEIRTTNPVATEQYGMVSTINLQLGGNE

SEQ ID NO: 6518 - protein, 30 aa, Artificial Sequence
  Description of Artificial Sequence: Synthetic polypeptide
DEEEIRTTNPVATEQYGSVSTNLQMNGFGE

SEQ ID NO: 6519 - protein, 30 aa, Artificial Sequence
  Description of Artificial Sequence: Synthetic polypeptide
DEEEIRTTNPVATEQYGSVSTNLERGVEEF

SEQ ID NO: 6520 - protein, 30 aa, Artificial Sequence
  Description of Artificial Sequence: Synthetic polypeptide
DEEEIRTTNPVATEQYGSVSTNLERGSQQE

SEQ ID NO: 6521 - protein, 30 aa, Artificial Sequence
  Description of Artificial Sequence: Synthetic polypeptide
DEEEIRTTNPVATEQYGSVSTNLQMIGQPF

SEQ ID NO: 6522 - protein, 32 aa, Artificial Sequence
  Description of Artificial Sequence: Synthetic polypeptide
FEEEIRTTNPVATEQYGSVSTENLKQRGENYR

SEQ ID NO: 6523 - protein, 32 aa, Artificial Sequence
  Description of Artificial Sequence: Synthetic polypeptide
FEEEIRTTNPVATEQYGSVSTENLNQRGSNFR

SEQ ID NO: 6524 - protein, 31 aa, Artificial Sequence
  Description of Artificial Sequence: Synthetic polypeptide
DEEEIRTTNPVATEQYGSVSTNLQMIGNNEG

SEQ ID NO: 6525 - protein, 29 aa, Artificial Sequence
  Description of Artificial Sequence: Synthetic peptide
DEEEIRTTNPVATEQYGSASTNLQPINGM

SEQ ID NO: 6526 - protein, 31 aa, Artificial Sequence
  Description of Artificial Sequence: Synthetic polypeptide
DEEEIRTTNPVATEQYGSVSTNLQMIGINEQ

SEQ ID NO: 6527 - protein, 28 aa, Artificial Sequence
  Description of Artificial Sequence: Synthetic peptide
DEEEIRTTNPVATEQYGSASTNLQNEEM

SEQ ID NO: 6528 - protein, 30 aa, Artificial Sequence
  Description of Artificial Sequence: Synthetic polypeptide
DEEEIRTTNPVATEQYGSVSTNLQMGVEGT

SEQ ID NO: 6529 - protein, 30 aa, Artificial Sequence
  Description of Artificial Sequence: Synthetic polypeptide
DEEEIRCTNPVATEQYGCVSMTNLQRGNAE

SEQ ID NO: 6530 - protein, 30 aa, Artificial Sequence
  Description of Artificial Sequence: Synthetic polypeptide
DEEEIRTTNPVATEQYGSASTNLQITLGLR

SEQ ID NO: 6531 - protein, 29 aa, Artificial Sequence
  Description of Artificial Sequence: Synthetic peptide
DEEEIRCTNPVATEQYGCVSTNLQREDNG

SEQ ID NO: 6532 - protein, 30 aa, Artificial Sequence
  Description of Artificial Sequence: Synthetic polypeptide
FEEEIRTTNPVATEQYGSVSTDNLQNGNEF

SEQ ID NO: 6533 - protein, 29 aa, Artificial Sequence
  Description of Artificial Sequence: Synthetic peptide
DEEEIRTTNPVATEQYGSASTNLQHNDRN

SEQ ID NO: 6534 - protein, 30 aa, Artificial Sequence
  Description of Artificial Sequence: Synthetic polypeptide
DEEEIRTTNPVATEQYGSVSTNLQMGMDQS

SEQ ID NO: 6535 - protein, 31 aa, Artificial Sequence
  Description of Artificial Sequence: Synthetic polypeptide
DEEEIRTTNPVATEQYGSVSTNLQMGGPNDE

SEQ ID NO: 6536 - protein, 31 aa, Artificial Sequence
  Description of Artificial Sequence: Synthetic polypeptide
DEEEIRTTNPVATEQYGSASTNLEQRGVGRN

SEQ ID NO: 6537 - protein, 31 aa, Artificial Sequence
  Description of Artificial Sequence: Synthetic polypeptide
DEEEIRTTNPVATEQYGSASTNLEQRGEVRE

SEQ ID NO: 6538 - protein, 28 aa, Artificial Sequence
  Description of Artificial Sequence: Synthetic peptide
NETEIRTTNPVATEAYGSVSTNLQNGNY

SEQ ID NO: 6539 - protein, 30 aa, Artificial Sequence
  Description of Artificial Sequence: Synthetic polypeptide
DEEEIRTTNPVATEQYGSVSTNLQMEGQDE

SEQ ID NO: 6540 - protein, 31 aa, Artificial Sequence
  Description of Artificial Sequence: Synthetic polypeptide
DEEEIRTTNPVATEQYGSVSTNLQMDGENQS

SEQ ID NO: 6541 - protein, 30 aa, Artificial Sequence
  Description of Artificial Sequence: Synthetic polypeptide
DEEEIRSTNPVATEQYGSVSTNDQRENTRD

SEQ ID NO: 6542 - protein, 30 aa, Artificial Sequence
  Description of Artificial Sequence: Synthetic polypeptide
DEEEIRTTNPVATEQYGSVSTNLQLTGSHV

SEQ ID NO: 6543 - protein, 32 aa, Artificial Sequence
  Description of Artificial Sequence: Synthetic polypeptide
DEEEIRTTNPVATEQYGMVSTNLFQRSGSNRS

SEQ ID NO: 6544 - protein, 30 aa, Artificial Sequence
  Description of Artificial Sequence: Synthetic polypeptide
DEEEIRTTNPVATEQYGMVSTNLNQDDGNI

SEQ ID NO: 6545 - protein, 30 aa, Artificial Sequence
  Description of Artificial Sequence: Synthetic polypeptide
DEEEIRSTNPVATEQYGSVSTDNLQPGINT

SEQ ID NO: 6546 - protein, 30 aa, Artificial Sequence
  Description of Artificial Sequence: Synthetic polypeptide
DEEEIRCTNPVATEQYGEVSMTNLNQGGNR

SEQ ID NO: 6547 - protein, 30 aa, Artificial Sequence
  Description of Artificial Sequence: Synthetic polypeptide
DEEEIRTTNPVATEQYGSASTGNDQRGEER

SEQ ID NO: 6548 - protein, 29 aa, Artificial Sequence
  Description of Artificial Sequence: Synthetic peptide
DEEEIRTTNPVATEQYGSASTNLQFENVG

SEQ ID NO: 6549 - protein, 30 aa, Artificial Sequence
  Description of Artificial Sequence: Synthetic polypeptide
FEEEIRTTNPVATEQYGSVSTDNLQNGNAF

SEQ ID NO: 6550 - protein, 31 aa, Artificial Sequence
  Description of Artificial Sequence: Synthetic polypeptide
DEEEIRTTNPVATEQYGSVSTNLERMMANRI

SEQ ID NO: 6551 - protein, 31 aa, Artificial Sequence
  Description of Artificial Sequence: Synthetic polypeptide
DEEEIRTTNPVATEQYGSVSTNLERNGNDNS

SEQ ID NO: 6552 - protein, 31 aa, Artificial Sequence
  Description of Artificial Sequence: Synthetic polypeptide
DEEEIRTTNPVATEQYGSVSTNLQNDGENIP

SEQ ID NO: 6553 - protein, 29 aa, Artificial Sequence
  Description of Artificial Sequence: Synthetic peptide
DEEEIRSTNPVATEQYGSVSSTDLQQGNV

SEQ ID NO: 6554 - protein, 28 aa, Artificial Sequence
  Description of Artificial Sequence: Synthetic peptide
DECEICTTNPVATEQYGSVSTNLMIGNT

SEQ ID NO: 6555 - protein, 31 aa, Artificial Sequence
  Description of Artificial Sequence: Synthetic polypeptide
DEEEIRSTNPVATEQYGSVSTNLQRTGNDEI

SEQ ID NO: 6556 - protein, 30 aa, Artificial Sequence
  Description of Artificial Sequence: Synthetic polypeptide
DEEEIRTTNPVATEQYGSVSGNLQEGTNGQ

SEQ ID NO: 6557 - protein, 30 aa, Artificial Sequence
  Description of Artificial Sequence: Synthetic polypeptide
FEEEIRTTNPVATEQYGSVSTNLQQEGNNE

SEQ ID NO: 6558 - protein, 30 aa, Artificial Sequence
  Description of Artificial Sequence: Synthetic polypeptide
DEEEIRTTNPVATEQYGSVSTNLQLGITGD

SEQ ID NO: 6559 - protein, 30 aa, Artificial Sequence
  Description of Artificial Sequence: Synthetic polypeptide
DEEEIRSTNPVATEQYGSVSTNLQGGDNEP

SEQ ID NO: 6560 - protein, 31 aa, Artificial Sequence
  Description of Artificial Sequence: Synthetic polypeptide
DEEEIRTTNPVATEQYGSAVQSTNLQRNNQQ

SEQ ID NO: 6561 - protein, 31 aa, Artificial Sequence
  Description of Artificial Sequence: Synthetic polypeptide
FEEEIRTTNPVATEQYGSVSLTNLQTGENRE

SEQ ID NO: 6562 - protein, 32 aa, Artificial Sequence
  Description of Artificial Sequence: Synthetic polypeptide
DEEEIRTTNPVATEQYGSAVPSTNLQRSMSNR

SEQ ID NO: 6563 - protein, 30 aa, Artificial Sequence
  Description of Artificial Sequence: Synthetic polypeptide
DEEEIRTTNPVATEQYGSVSTNLQMTGSEE

SEQ ID NO: 6564 - protein, 31 aa, Artificial Sequence
  Description of Artificial Sequence: Synthetic polypeptide
DEEEIRTTNPVATEQYGSAVISTNLQRNNAI

SEQ ID NO: 6565 - protein, 30 aa, Artificial Sequence
  Description of Artificial Sequence: Synthetic polypeptide
DEEEIRSTNPVATEQYGSVSTNLQEGINNT

SEQ ID NO: 6566 - protein, 31 aa, Artificial Sequence
  Description of Artificial Sequence: Synthetic polypeptide
DEEEIRTTNPVATEQYGSVSTNLERGGNDDV

SEQ ID NO: 6567 - protein, 30 aa, Artificial Sequence
  Description of Artificial Sequence: Synthetic polypeptide
DEEEIRTTNPVATEQYGSAVCSTNLQNPER

SEQ ID NO: 6568 - protein, 30 aa, Artificial Sequence
  Description of Artificial Sequence: Synthetic polypeptide
DEEEIRTTNPVATEQYGSAVCSTNLQFPER

SEQ ID NO: 6569 - protein, 29 aa, Artificial Sequence
  Description of Artificial Sequence: Synthetic peptide
DEEEIRTTNPVATEQYGSASTNLVRNDGR

SEQ ID NO: 6570 - protein, 30 aa, Artificial Sequence
  Description of Artificial Sequence: Synthetic polypeptide
DEEEIRTTNPVATEQYGSVSTNLQMNGQED

SEQ ID NO: 6571 - protein, 29 aa, Artificial Sequence
  Description of Artificial Sequence: Synthetic peptide
DEEEIRTTNPVATEQYGSASTTLQRGEFG

SEQ ID NO: 6572 - protein, 30 aa, Artificial Sequence
  Description of Artificial Sequence: Synthetic polypeptide
FEEEIRTTNPVATEQYGSVSTNDTQSGSNR

SEQ ID NO: 6573 - protein, 29 aa, Artificial Sequence
  Description of Artificial Sequence: Synthetic peptide
FEEEIRTTNPVATEQYGSVSTNEQGGNTI

SEQ ID NO: 6574 - protein, 28 aa, Artificial Sequence
  Description of Artificial Sequence: Synthetic peptide
NESEIRTTNPVATEQYGSVPTNLQSGSR

SEQ ID NO: 6575 - protein, 31 aa, Artificial Sequence
  Description of Artificial Sequence: Synthetic polypeptide
DEEEIRTTNPVATEQYGSVSTNLEQFEGNAE

SEQ ID NO: 6576 - protein, 30 aa, Artificial Sequence
  Description of Artificial Sequence: Synthetic polypeptide
FEEEIRTTNPVATEQYGSVSPTNNQQLGNR

SEQ ID NO: 6577 - protein, 32 aa, Artificial Sequence
  Description of Artificial Sequence: Synthetic polypeptide
DEEEIRTTNPVATEQYGSAVCSTNDQRGNPRE

SEQ ID NO: 6578 - protein, 28 aa, Artificial Sequence
  Description of Artificial Sequence: Synthetic peptide
NESEIRTTNPVATEQYGSVGTNLQIGER

SEQ ID NO: 6579 - protein, 30 aa, Artificial Sequence
  Description of Artificial Sequence: Synthetic polypeptide
FEEEIRTTNPVATEQYGSVSPTNLQIGNVQ

SEQ ID NO: 6580 - protein, 30 aa, Artificial Sequence
  Description of Artificial Sequence: Synthetic polypeptide
FEEEIRTTNPVATEQYGSVSPTNDTQLGNR

SEQ ID NO: 6581 - protein, 29 aa, Artificial Sequence
  Description of Artificial Sequence: Synthetic peptide
FEEEIRTTNPVATEQYGSVSTNGQGGNND

SEQ ID NO: 6582 - protein, 29 aa, Artificial Sequence
  Description of Artificial Sequence: Synthetic peptide
FEEEIRTTNPVATEQYGSVSPTLLQRGLQ

SEQ ID NO: 6583 - protein, 30 aa, Artificial Sequence
  Description of Artificial Sequence: Synthetic polypeptide
DEEEIRTTNPVATEQYGSVSGNLQHGQNEN

SEQ ID NO: 6584 - protein, 29 aa, Artificial Sequence
  Description of Artificial Sequence: Synthetic peptide
NNEEIRTTNPVATEQYGVVSTNLQAGDNR

SEQ ID NO: 6585 - protein, 29 aa, Artificial Sequence
  Description of Artificial Sequence: Synthetic peptide
FEEEIRTTNPVATEQYGSVSTNLQYGQQN

SEQ ID NO: 6586 - protein, 30 aa, Artificial Sequence
  Description of Artificial Sequence: Synthetic polypeptide
DEEEIRCTNPVATEHYGSVSTNLQDGNDRE

SEQ ID NO: 6587 - protein, 30 aa, Artificial Sequence
  Description of Artificial Sequence: Synthetic polypeptide
DEEEIRCTNPIATEQYGSVSEENLQMRGNR

SEQ ID NO: 6588 - protein, 31 aa, Artificial Sequence
  Description of Artificial Sequence: Synthetic polypeptide
DEEEIRTTNPVATEQYGSVSTNLQQIGLNEM

SEQ ID NO: 6589 - protein, 30 aa, Artificial Sequence
  Description of Artificial Sequence: Synthetic polypeptide
EEEEIRTTNPVATEQYGSVSTNLQRFQNIS

SEQ ID NO: 6590 - protein, 30 aa, Artificial Sequence
  Description of Artificial Sequence: Synthetic polypeptide
DEEEIRTTNPVATEQYGMVSTNNNGQTGNR

SEQ ID NO: 6591 - protein, 30 aa, Artificial Sequence
  Description of Artificial Sequence: Synthetic polypeptide
DEEEIRTTNPVATEQYGSVSTNLEEVGNTG

SEQ ID NO: 6592 - protein, 29 aa, Artificial Sequence
  Description of Artificial Sequence: Synthetic peptide
DEEEIRSVNPVCTEQYGSVSTDNLQRGNV

SEQ ID NO: 6593 - protein, 29 aa, Artificial Sequence
  Description of Artificial Sequence: Synthetic peptide
DEEEIRSVNPVCTEQYGSVSTDNLQRGNQ

SEQ ID NO: 6594 - protein, 30 aa, Artificial Sequence
  Description of Artificial Sequence: Synthetic polypeptide
EEEEIRTTNPVATEQYGSVSTNLQRIINIP

SEQ ID NO: 6595 - protein, 30 aa, Artificial Sequence
  Description of Artificial Sequence: Synthetic polypeptide
EEEEIRTTNPVATEQYGSVSTNLQRNVNQD

SEQ ID NO: 6596 - protein, 30 aa, Artificial Sequence
  Description of Artificial Sequence: Synthetic polypeptide
DEEEIRTTNPVATEQYGSVSTNLQQGVEPD

SEQ ID NO: 6597 - protein, 29 aa, Artificial Sequence
  Description of Artificial Sequence: Synthetic peptide
NNEEIRTTNPVATEQYGEVSTNLQDGHNR

SEQ ID NO: 6598 - protein, 29 aa, Artificial Sequence
  Description of Artificial Sequence: Synthetic peptide
NNEEIRTTNPVATEQYGDVSTNLQDGDNR

SEQ ID NO: 6599 - protein, 30 aa, Artificial Sequence
  Description of Artificial Sequence: Synthetic polypeptide
DEEEIRTTNPVATEQYGSVSTNLEMGGNQD

SEQ ID NO: 6600 - protein, 30 aa, Artificial Sequence
  Description of Artificial Sequence: Synthetic polypeptide
DEEEIRTTNPVATEQYGSVSTNLQQGSEVD

SEQ ID NO: 6601 - protein, 30 aa, Artificial Sequence
  Description of Artificial Sequence: Synthetic polypeptide
EEEEIRTTNPVATEQYGSVSTNLQQGENTG

SEQ ID NO: 6602 - protein, 29 aa, Artificial Sequence
  Description of Artificial Sequence: Synthetic peptide
NNEEIRTTNPVATEQYGCVSTNLQNGFNR

SEQ ID NO: 6603 - protein, 30 aa, Artificial Sequence
  Description of Artificial Sequence: Synthetic polypeptide
EEEEIRTTNPVATEQYGSVSTNLVRGNVEA

SEQ ID NO: 6604 - protein, 29 aa, Artificial Sequence
  Description of Artificial Sequence: Synthetic peptide
DEEEIRTTNPVATEQYGSVSTNLENFGDT

SEQ ID NO: 6605 - protein, 28 aa, Artificial Sequence
  Description of Artificial Sequence: Synthetic peptide
DEEEIRCTNPIATEQYGSVSEHLMRGNR

SEQ ID NO: 6606 - protein, 31 aa, Artificial Sequence
  Description of Artificial Sequence: Synthetic polypeptide
DEEEIRTTNPVATEQYGSVSTNLQQGQGNNN

SEQ ID NO: 6607 - protein, 29 aa, Artificial Sequence
  Description of Artificial Sequence: Synthetic peptide
DEEEIRTTNPVATEQYGSVSTNLENFGED

SEQ ID NO: 6608 - protein, 28 aa, Artificial Sequence
  Description of Artificial Sequence: Synthetic peptide
DEEEIRCTNPIATEQYGSVSEILMRGNR

SEQ ID NO: 6609 - protein, 30 aa, Artificial Sequence
  Description of Artificial Sequence: Synthetic polypeptide
DEEEIRTTNPVATEQYGSVSTNLENIGNQG

SEQ ID NO: 6610 - protein, 31 aa, Artificial Sequence
  Description of Artificial Sequence: Synthetic polypeptide
DEEEIRTTNPVATEQYGSVSTNLEQAFGNQD

SEQ ID NO: 6611 - protein, 29 aa, Artificial Sequence
  Description of Artificial Sequence: Synthetic peptide
NMEEIRTTNPVATEQYGKVSTNLQDGPNR

SEQ ID NO: 6612 - protein, 29 aa, Artificial Sequence
  Description of Artificial Sequence: Synthetic peptide
DEEEIRCTNPIATEQYGSVSENLDMRGNR

SEQ ID NO: 6613 - protein, 28 aa, Artificial Sequence
  Description of Artificial Sequence: Synthetic peptide
DEEEIRCTNPIATEQYGSVSENLMHGNR

SEQ ID NO: 6614 - protein, 29 aa, Artificial Sequence
  Description of Artificial Sequence: Synthetic peptide
DEEEIRCTNPIATEQYGSVSENLMNRGNR

SEQ ID NO: 6615 - protein, 29 aa, Artificial Sequence
  Description of Artificial Sequence: Synthetic peptide
DEEEIRCTNPIATEQYGSVSENLMRGFNR

SEQ ID NO: 6616 - protein, 29 aa, Artificial Sequence
  Description of Artificial Sequence: Synthetic peptide
DEEEIRCTNPIATEQYGSVSENLMRGNDR

SEQ ID NO: 6617 - protein, 29 aa, Artificial Sequence
  Description of Artificial Sequence: Synthetic peptide
NNEEIRTTNPVATEQYGCVSTNLQMGENR

SEQ ID NO: 6618 - protein, 29 aa, Artificial Sequence
  Description of Artificial Sequence: Synthetic peptide
NLEEIRTTNPVATEQYGIVSTNLQDGPNR

SEQ ID NO: 6619 - protein, 31 aa, Artificial Sequence
  Description of Artificial Sequence: Synthetic polypeptide
DEEEIRTTNPVATEQYGSVSTNLQQIGTNEL

SEQ ID NO: 6620 - protein, 30 aa, Artificial Sequence
  Description of Artificial Sequence: Synthetic polypeptide
EEEEIRTTNPVATEQYGSVSTNLQGNGNEY

SEQ ID NO: 6621 - protein, 31 aa, Artificial Sequence
  Description of Artificial Sequence: Synthetic polypeptide
DEEEIRTTNPVATEQYGSVSTNLQQRGPHHD

SEQ ID NO: 6622 - protein, 29 aa, Artificial Sequence
  Description of Artificial Sequence: Synthetic peptide
EEEEIRTTNPVATEQYGSVSTGGLQTGNP

SEQ ID NO: 6623 - protein, 29 aa, Artificial Sequence
  Description of Artificial Sequence: Synthetic peptide
DEEEIRTTNPVATEQYGSCSINELNRGND

SEQ ID NO: 6624 - protein, 28 aa, Artificial Sequence
  Description of Artificial Sequence: Synthetic peptide
DEEEIRCTNPIATEQYGNVSENLMRGNR

SEQ ID NO: 6625 - protein, 28 aa, Artificial Sequence
  Description of Artificial Sequence: Synthetic peptide
DEEEIRTCNPVATEQYGSVSTFLQGNQE

SEQ ID NO: 6626 - protein, 28 aa, Artificial Sequence
  Description of Artificial Sequence: Synthetic peptide
DEEEIRTCNPVATEQYGSVSTDLQRDQE

SEQ ID NO: 6627 - protein, 30 aa, Artificial Sequence
  Description of Artificial Sequence: Synthetic polypeptide
DEEEIRTTNPVATEQYGSVSGNQQRGSDRD

SEQ ID NO: 6628 - protein, 31 aa, Artificial Sequence
  Description of Artificial Sequence: Synthetic polypeptide
DEEEIRTTNPVATEQYGSVSTNLQIGQNQMM

SEQ ID NO: 6629 - protein, 28 aa, Artificial Sequence
  Description of Artificial Sequence: Synthetic peptide
DEEEIRTCNPVATEQYGSVSTALQRNEE

SEQ ID NO: 6630 - protein, 29 aa, Artificial Sequence
  Description of Artificial Sequence: Synthetic peptide
DEEEIRCTNPIATEQYGSTVSENLMRGNR

SEQ ID NO: 6631 - protein, 28 aa, Artificial Sequence
  Description of Artificial Sequence: Synthetic peptide
AEEQIRTTNPVATEQYGSVSTNLSPLNR

SEQ ID NO: 6632 - protein, 31 aa, Artificial Sequence
  Description of Artificial Sequence: Synthetic polypeptide
DEEEIRTTNPVATEQYGSVSTNLQIIGNGGG

SEQ ID NO: 6633 - protein, 29 aa, Artificial Sequence
  Description of Artificial Sequence: Synthetic peptide
DEEEIRTTNPVATEQYGMVSTPLERGNQM

SEQ ID NO: 6634 - protein, 31 aa, Artificial Sequence
  Description of Artificial Sequence: Synthetic polypeptide
DEEEIRTTNPVATEQYGSVSTNLQQQGLERN

SEQ ID NO: 6635 - protein, 29 aa, Artificial Sequence
  Description of Artificial Sequence: Synthetic peptide
EEEEIRTTNPVATEQYGSVSTNLQNGPGE

SEQ ID NO: 6636 - protein, 30 aa, Artificial Sequence
  Description of Artificial Sequence: Synthetic polypeptide
DEEEIRTTNPVATEQYGSVSTNLQQNGSGD

SEQ ID NO: 6637 - protein, 31 aa, Artificial Sequence
  Description of Artificial Sequence: Synthetic polypeptide
EEEEIRTTNPVATEQYGSVSTNLEQRGNTGV

SEQ ID NO: 6638 - protein, 31 aa, Artificial Sequence
  Description of Artificial Sequence: Synthetic polypeptide
DEEEIRTTNPVATEQYGSVSTNLQQNGNENE

SEQ ID NO: 6639 - protein, 31 aa, Artificial Sequence
  Description of Artificial Sequence: Synthetic polypeptide
DEEEIRTTNPVATEQYGSVSTNLQQNGNDNA

SEQ ID NO: 6640 - protein, 29 aa, Artificial Sequence
  Description of Artificial Sequence: Synthetic peptide
DEEEIRCTNPIATEQYGSVSATDLMRGNR

SEQ ID NO: 6641 - protein, 31 aa, Artificial Sequence
  Description of Artificial Sequence: Synthetic polypeptide
DEEEIRTTNPVATEQYGSVSTNLQIREVNET

SEQ ID NO: 6642 - protein, 28 aa, Artificial Sequence
  Description of Artificial Sequence: Synthetic peptide
NEQEIRTTNPVATEQYGSVGTNLQIGSR

SEQ ID NO: 6643 - protein, 31 aa, Artificial Sequence
  Description of Artificial Sequence: Synthetic polypeptide
EEEEIRTTNPVATEQYGSVSTNLQERGNIDI

SEQ ID NO: 6644 - protein, 31 aa, Artificial Sequence
  Description of Artificial Sequence: Synthetic polypeptide
EEEEIRTTNPVATEQYGSVSTNLQERGNLMT

SEQ ID NO: 6645 - protein, 31 aa, Artificial Sequence
  Description of Artificial Sequence: Synthetic polypeptide
DEEEIRTTNPVATEQYGSVSTNLEDVGENER

SEQ ID NO: 6646 - protein, 29 aa, Artificial Sequence
  Description of Artificial Sequence: Synthetic peptide
AEENIRTTNPVATEQYGSVSTELARSGNR

SEQ ID NO: 6647 - protein, 31 aa, Artificial Sequence
  Description of Artificial Sequence: Synthetic polypeptide
DEEEIRTTNPVATEQYGSVSTNLQQMGNIIG

SEQ ID NO: 6648 - protein, 31 aa, Artificial Sequence
  Description of Artificial Sequence: Synthetic polypeptide
DEEEIRTTNPVATEQYGSVSTNLQQMGDNQP

SEQ ID NO: 6649 - protein, 30 aa, Artificial Sequence
  Description of Artificial Sequence: Synthetic polypeptide
EEEEIRTTNPVATEQYGSVSTNLQEVANNR

SEQ ID NO: 6650 - protein, 31 aa, Artificial Sequence
  Description of Artificial Sequence: Synthetic polypeptide
DEEEIRTTNPVATEQYGSVSTNLQQMGDNGA

SEQ ID NO: 6651 - protein, 29 aa, Artificial Sequence
  Description of Artificial Sequence: Synthetic peptide
EEEEIRTTNPVATEQYGSVSTNLEQGLNV

SEQ ID NO: 6652 - protein, 29 aa, Artificial Sequence
  Description of Artificial Sequence: Synthetic peptide
DEEEIRCTNPIATEQYGSVSENLNRGNPR

SEQ ID NO: 6653 - protein, 30 aa, Artificial Sequence
  Description of Artificial Sequence: Synthetic polypeptide
DEEEIRTTNPVATEQYGMVGSTNLQFGNLD

SEQ ID NO: 6654 - protein, 31 aa, Artificial Sequence
  Description of Artificial Sequence: Synthetic polypeptide
DEEEIRTTNPVATEQYGSVSTNLEQAGSNII

SEQ ID NO: 6655 - protein, 30 aa, Artificial Sequence
  Description of Artificial Sequence: Synthetic polypeptide
EEEEIRTTNPVATETYGSVSTINLQRGNGT

SEQ ID NO: 6656 - protein, 31 aa, Artificial Sequence
  Description of Artificial Sequence: Synthetic polypeptide
DEEEIRTTNPVATEQYGSVSTNLQQDDNTRD

SEQ ID NO: 6657 - protein, 30 aa, Artificial Sequence
  Description of Artificial Sequence: Synthetic polypeptide
FEEEIRTTNPVATEQYGSVSTPNLQIGSQR

SEQ ID NO: 6658 - protein, 31 aa, Artificial Sequence
  Description of Artificial Sequence: Synthetic polypeptide
DEEEIRTTNPVATEQYGSVSTNLQPVSNNRG

SEQ ID NO: 6659 - protein, 31 aa, Artificial Sequence
  Description of Artificial Sequence: Synthetic polypeptide
DEEEIRTTNPVATEQYGSVSTNLQKDGDNAL

SEQ ID NO: 6660 - protein, 29 aa, Artificial Sequence
  Description of Artificial Sequence: Synthetic peptide
EEEEIRTTNPVSTEQYGQVSTNIQQRGNR

SEQ ID NO: 6661 - protein, 29 aa, Artificial Sequence
  Description of Artificial Sequence: Synthetic peptide
DEEEIRTTNPVATEQYGSVSTNLQPTEIN

SEQ ID NO: 6662 - protein, 31 aa, Artificial Sequence
  Description of Artificial Sequence: Synthetic polypeptide
DEEEIRTTNPVATEQYGSVSTNLQPSGNLVN

SEQ ID NO: 6663 - protein, 31 aa, Artificial Sequence
  Description of Artificial Sequence: Synthetic polypeptide
DEEEIRTTNPVATEQYGSVSTNLQLAGENDV

SEQ ID NO: 6664 - protein, 30 aa, Artificial Sequence
  Description of Artificial Sequence: Synthetic polypeptide
DEEEIRTTNPVATEQYGSVSGNLQHSGNTD

SEQ ID NO: 6665 - protein, 28 aa, Artificial Sequence
  Description of Artificial Sequence: Synthetic peptide
DEEEIRCTNPIATEQYGTVSMNLMRGNR

SEQ ID NO: 6666 - protein, 30 aa, Artificial Sequence
  Description of Artificial Sequence: Synthetic polypeptide
DEEEIRTTNPVATEQYGSVSTNLQLAGETG

SEQ ID NO: 6667 - protein, 31 aa, Artificial Sequence
  Description of Artificial Sequence: Synthetic polypeptide
DEEEIRTTNPVATEQYGSVSTNLQLDGDNQK

SEQ ID NO: 6668 - protein, 31 aa, Artificial Sequence
  Description of Artificial Sequence: Synthetic polypeptide
EEEEVRTTNPVATEQYGSVSTNNLDQRIGNR

SEQ ID NO: 6669 - protein, 30 aa, Artificial Sequence
  Description of Artificial Sequence: Synthetic polypeptide
DEEEIRTTNPVATEQYGSVSTNLEVGGNPG

SEQ ID NO: 6670 - protein, 31 aa, Artificial Sequence
  Description of Artificial Sequence: Synthetic polypeptide
EEEEVRTTNPVATEQYGSVSTWNLDQRHGNR

SEQ ID NO: 6671 - protein, 28 aa, Artificial Sequence
  Description of Artificial Sequence: Synthetic peptide
EEEGIRTTNPVATEQYGSVSTNLSMENR

SEQ ID NO: 6672 - protein, 29 aa, Artificial Sequence
  Description of Artificial Sequence: Synthetic peptide
NETEIRTTNPVATEQYGSVSTNLQGGNMM

SEQ ID NO: 6673 - protein, 30 aa, Artificial Sequence
  Description of Artificial Sequence: Synthetic polypeptide
DEEEIRTTNPVATEQYGSCSADNNLQRDNR

SEQ ID NO: 6674 - protein, 31 aa, Artificial Sequence
  Description of Artificial Sequence: Synthetic polypeptide
DEEEIRTTNPVATEQYGSVSTNLQPPGQERV

SEQ ID NO: 6675 - protein, 31 aa, Artificial Sequence
  Description of Artificial Sequence: Synthetic polypeptide
DEEEIRTTNPVATEQYGSVSTNLQPNGGNMQ

SEQ ID NO: 6676 - protein, 29 aa, Artificial Sequence
  Description of Artificial Sequence: Synthetic peptide
EENEIRTTNPVATDQYGSVSTNTLQGGNR

SEQ ID NO: 6677 - protein, 31 aa, Artificial Sequence
  Description of Artificial Sequence: Synthetic polypeptide
DEEEIRTTNPVATEQYGSVSTNLQPNGEERI

SEQ ID NO: 6678 - protein, 28 aa, Artificial Sequence
  Description of Artificial Sequence: Synthetic peptide
EENEIRTTNPVATEQYGSVCTNLQIGSR

SEQ ID NO: 6679 - protein, 30 aa, Artificial Sequence
  Description of Artificial Sequence: Synthetic polypeptide
DEEEIRTTNPVATEQYGMVSTNNLIQTGNE

SEQ ID NO: 6680 - protein, 29 aa, Artificial Sequence
  Description of Artificial Sequence: Synthetic peptide
NETEIRTTNPVATEQYGSVSTNDQMGNTR

SEQ ID NO: 6681 - protein, 29 aa, Artificial Sequence
  Description of Artificial Sequence: Synthetic peptide
EEYEIRTTNPVATEQYGSVWSTNLEYGNR

SEQ ID NO: 6682 - protein, 30 aa, Artificial Sequence
  Description of Artificial Sequence: Synthetic polypeptide
DEEEIRTTNPVATEQYGSVSTNLQPLENQQ

SEQ ID NO: 6683 - protein, 32 aa, Artificial Sequence
  Description of Artificial Sequence: Synthetic polypeptide
DEEEIRTTNPVATEQYGSVSTNLETRTGNGRL

SEQ ID NO: 6684 - protein, 30 aa, Artificial Sequence
  Description of Artificial Sequence: Synthetic polypeptide
AEEEISTTNPVATEQYGSVSTNIQHRSGNR

SEQ ID NO: 6685 - protein, 31 aa, Artificial Sequence
  Description of Artificial Sequence: Synthetic polypeptide
EEEEVRTTNPVATEQYGSVSTWNLEQREGNR

SEQ ID NO: 6686 - protein, 28 aa, Artificial Sequence
  Description of Artificial Sequence: Synthetic peptide
DEEEIRCTNPIATEQYGTVSENLMRGNR

SEQ ID NO: 6687 - protein, 31 aa, Artificial Sequence
  Description of Artificial Sequence: Synthetic polypeptide
DEEEIRTTNPVATEQYGSVSTNLQQDGDNPH

SEQ ID NO: 6688 - protein, 31 aa, Artificial Sequence
  Description of Artificial Sequence: Synthetic polypeptide
EEEEIRTTNPVATEQYGTVCSTNLQRSGNRL

SEQ ID NO: 6689 - protein, 31 aa, Artificial Sequence
  Description of Artificial Sequence: Synthetic polypeptide
DEEEIRTTNPVATEQYGSVSTNLEQAGSNLV

SEQ ID NO: 6690 - protein, 29 aa, Artificial Sequence
  Description of Artificial Sequence: Synthetic peptide
DEEEIRCTNPIATEQYGSVSENLPMRGNR

SEQ ID NO: 6691 - protein, 30 aa, Artificial Sequence
  Description of Artificial Sequence: Synthetic polypeptide
DEEEIRCTNPIATEQYGSVSENLPQREGNR

SEQ ID NO: 6692 - protein, 29 aa, Artificial Sequence
  Description of Artificial Sequence: Synthetic peptide
DEEEIRTTNPVATEQYGMVGSTNLQSGEL

SEQ ID NO: 6693 - protein, 31 aa, Artificial Sequence
  Description of Artificial Sequence: Synthetic polypeptide
DEEEIRTTNPVATEQYGSVSTNLEQAGTNGS

SEQ ID NO: 6694 - protein, 30 aa, Artificial Sequence
  Description of Artificial Sequence: Synthetic polypeptide
EEEEIRTTNPVATEQYGSVSTTNLVQQANR

SEQ ID NO: 6695 - protein, 30 aa, Artificial Sequence
  Description of Artificial Sequence: Synthetic polypeptide
DEEEIRTTNPVATEQYGSVSTNLQQGGTED

SEQ ID NO: 6696 - protein, 29 aa, Artificial Sequence
  Description of Artificial Sequence: Synthetic peptide
DEEEIRTTNPVATEQYGMVGSTNLQYGMT

SEQ ID NO: 6697 - protein, 28 aa, Artificial Sequence
  Description of Artificial Sequence: Synthetic peptide
NETEIRTTNPVATEQYGSVWTNLQIGPR

SEQ ID NO: 6698 - protein, 28 aa, Artificial Sequence
  Description of Artificial Sequence: Synthetic peptide
DEEEIRCTNPIATEQYGSVSENWMRGNR

SEQ ID NO: 6699 - protein, 30 aa, Artificial Sequence
  Description of Artificial Sequence: Synthetic polypeptide
EEEEIRTTNPVATEQYGSVSTVNLQRLEND

SEQ ID NO: 6700 - protein, 31 aa, Artificial Sequence
  Description of Artificial Sequence: Synthetic polypeptide
DEEEIRTTNPVATEQYGSVSTNLQQGGNNDD

SEQ ID NO: 6701 - protein, 31 aa, Artificial Sequence
  Description of Artificial Sequence: Synthetic polypeptide
DEEEIRTTNPVATEQYGSVSTNLQQGGGNID

SEQ ID NO: 6702 - protein, 30 aa, Artificial Sequence
  Description of Artificial Sequence: Synthetic polypeptide
DEEEIRTTNPVATEQYGSVSTNLEYLGNVG

SEQ ID NO: 6703 - protein, 29 aa, Artificial Sequence
  Description of Artificial Sequence: Synthetic peptide
DEEEIRTTNPVATEQYGSCSDNNLTRGND

SEQ ID NO: 6704 - protein, 30 aa, Artificial Sequence
  Description of Artificial Sequence: Synthetic polypeptide
DEEEIRTTNPVATEQYGSVSTNLEVGNSQA

SEQ ID NO: 6705 - protein, 30 aa, Artificial Sequence
  Description of Artificial Sequence: Synthetic polypeptide
DEEEIRTTNPVATEQYGSVSTNLQQGGEII

SEQ ID NO: 6706 - protein, 31 aa, Artificial Sequence
  Description of Artificial Sequence: Synthetic polypeptide
DEEEIRTTNPVATEQYGSVSTNLQQDGGNVV

SEQ ID NO: 6707 - protein, 30 aa, Artificial Sequence
  Description of Artificial Sequence: Synthetic polypeptide
DEEEIRTTNPVATEQYGSVSTNLQQDMNLN

SEQ ID NO: 6708 - protein, 30 aa, Artificial Sequence
  Description of Artificial Sequence: Synthetic polypeptide
DEEEIRTTNPVATEQYGSVSTNLQQDPNEP

SEQ ID NO: 6709 - protein, 29 aa, Artificial Sequence
  Description of Artificial Sequence: Synthetic peptide
DEEEIRCTNPIATEQYGSVSTNLEDHGNR

SEQ ID NO: 6710 - protein, 32 aa, Artificial Sequence
  Description of Artificial Sequence: Synthetic polypeptide
DEEEIRTTNPVATEQYGSVSTNLQQERALNLR

SEQ ID NO: 6711 - protein, 31 aa, Artificial Sequence
  Description of Artificial Sequence: Synthetic polypeptide
DEEEIRTTNPVATEQYGMVISTNLNQTNGNR

SEQ ID NO: 6712 - protein, 29 aa, Artificial Sequence
  Description of Artificial Sequence: Synthetic peptide
DEEEIRCTNPVATEHYGVVSTNLQRGNTA

SEQ ID NO: 6713 - protein, 30 aa, Artificial Sequence
  Description of Artificial Sequence: Synthetic polypeptide
DEEEIRTTNPVATEQYGSVSTNLQQFGSDQ

SEQ ID NO: 6714 - protein, 29 aa, Artificial Sequence
  Description of Artificial Sequence: Synthetic peptide
DEEEIRTTNPVATEQYGSCSAPSQRGNQR

SEQ ID NO: 6715 - protein, 31 aa, Artificial Sequence
  Description of Artificial Sequence: Synthetic polypeptide
DEEEIRTTNPVATEQYGSVSTNLQQGEGGND

SEQ ID NO: 6716 - protein, 30 aa, Artificial Sequence
  Description of Artificial Sequence: Synthetic polypeptide
DEEEIRTTNPVATEQYGSVSTNLEVGNPLD

SEQ ID NO: 6717 - protein, 30 aa, Artificial Sequence
  Description of Artificial Sequence: Synthetic polypeptide
DEEEIRCTNPIATEQYGSVSTENLNRNGNR

SEQ ID NO: 6718 - protein, 31 aa, Artificial Sequence
  Description of Artificial Sequence: Synthetic polypeptide
DEEEIRTTNPVATEQYGSVSTNLQQGEPNND

SEQ ID NO: 6719 - protein, 31 aa, Artificial Sequence
  Description of Artificial Sequence: Synthetic polypeptide
DEEEIRTTNPVATEQYGSVSTNLQQGFGNGQ

SEQ ID NO: 6720 - protein, 28 aa, Artificial Sequence
  Description of Artificial Sequence: Synthetic peptide
NEREIRTTNPVATEQYGSVATNLQDGSR

SEQ ID NO: 6721 - protein, 28 aa, Artificial Sequence
  Description of Artificial Sequence: Synthetic peptide
AEEEIRTTNPVATEQYGSVVTNLQIQNE

SEQ ID NO: 6722 - protein, 30 aa, Artificial Sequence
  Description of Artificial Sequence: Synthetic polypeptide
GEEEIRTTNPVATELYGSVCSTNLQREGNA

SEQ ID NO: 6723 - protein, 30 aa, Artificial Sequence
  Description of Artificial Sequence: Synthetic polypeptide
DEEEIRTTNPVATEQYGLTISTTELQRGNR

SEQ ID NO: 6724 - protein, 30 aa, Artificial Sequence
  Description of Artificial Sequence: Synthetic polypeptide
DEEEIRTTNPVATEQYGSVSTNLQSDGDGD

SEQ ID NO: 6725 - protein, 29 aa, Artificial Sequence
  Description of Artificial Sequence: Synthetic peptide
DEEEIRTTNPVATEQYGSCSTYLQRNGYE

SEQ ID NO: 6726 - protein, 30 aa, Artificial Sequence
  Description of Artificial Sequence: Synthetic polypeptide
DEEEIRTTNPVATEQYGHSISNNALQRGER

SEQ ID NO: 6727 - protein, 28 aa, Artificial Sequence
  Description of Artificial Sequence: Synthetic peptide
DEEEIRTTNPVATEQYGSCSTVVQVGER

SEQ ID NO: 6728 - protein, 28 aa, Artificial Sequence
  Description of Artificial Sequence: Synthetic peptide
DSEEIRSTNPVATEQYGSISTNIQRGNQ

SEQ ID NO: 6729 - protein, 30 aa, Artificial Sequence
  Description of Artificial Sequence: Synthetic polypeptide
AEEEIRTTNPVATEQYGSVVTTNDLQQGNR

SEQ ID NO: 6730 - protein, 28 aa, Artificial Sequence
  Description of Artificial Sequence: Synthetic peptide
DSEEIRSTNPVATEQYGSMSTNEQRGNN

SEQ ID NO: 6731 - protein, 30 aa, Artificial Sequence
  Description of Artificial Sequence: Synthetic polypeptide
DEEEIRATNPVATEQYGSVPTNDQRDGNRN

SEQ ID NO: 6732 - protein, 30 aa, Artificial Sequence
  Description of Artificial Sequence: Synthetic polypeptide
DEEEIRTTNPVATEQYGSCSTVLQRGENSS

SEQ ID NO: 6733 - protein, 28 aa, Artificial Sequence
  Description of Artificial Sequence: Synthetic peptide
DEAVIRTTNPVATEQYGCVETNYQRGNR

SEQ ID NO: 6734 - protein, 31 aa, Artificial Sequence
  Description of Artificial Sequence: Synthetic polypeptide
LENEIRTTNPVATEQYGSVTSETNLQRGQNR

SEQ ID NO: 6735 - protein, 29 aa, Artificial Sequence
  Description of Artificial Sequence: Synthetic peptide
DEEEIRTTNPVATEQYGSCSTTLGRMNRD

SEQ ID NO: 6736 - protein, 30 aa, Artificial Sequence
  Description of Artificial Sequence: Synthetic polypeptide
DEEEIRTTNPVATEQYGHTVSTNLSQTSNR

SEQ ID NO: 6737 - protein, 29 aa, Artificial Sequence
  Description of Artificial Sequence: Synthetic peptide
DEEEIRTTNPCATECYGSVSTNLQIGGNV

SEQ ID NO: 6738 - protein, 31 aa, Artificial Sequence
  Description of Artificial Sequence: Synthetic polypeptide
DEEEIRTTNPVATEQYGSVSTNLQSDGENVS

SEQ ID NO: 6739 - protein, 30 aa, Artificial Sequence
  Description of Artificial Sequence: Synthetic polypeptide
DEEEIRTTNPVATEQYGSVSTNLQRVMTTI

SEQ ID NO: 6740 - protein, 30 aa, Artificial Sequence
  Description of Artificial Sequence: Synthetic polypeptide
DEEEIRCTNPVATEQYGSVSTNLQRGAPEM

SEQ ID NO: 6741 - protein, 31 aa, Artificial Sequence
  Description of Artificial Sequence: Synthetic polypeptide
DEEEIRTTNPVATEQYGSVSTNLQFFGQFRG

SEQ ID NO: 6742 - protein, 29 aa, Artificial Sequence
  Description of Artificial Sequence: Synthetic peptide
DEEEIRTTNPVATEQYGSCSTSLQIGNSS

SEQ ID NO: 6743 - protein, 31 aa, Artificial Sequence
  Description of Artificial Sequence: Synthetic polypeptide
DEEEIRTTNPVATEQYGSVSTNLQRVFQNIE

SEQ ID NO: 6744 - protein, 28 aa, Artificial Sequence
  Description of Artificial Sequence: Synthetic peptide
DECEIYTTNPVATEQYGSVSTNLMTGNV

SEQ ID NO: 6745 - protein, 29 aa, Artificial Sequence
  Description of Artificial Sequence: Synthetic peptide
DEEEIRTTNPVATEQYGSCSTSLQIGNQY

SEQ ID NO: 6746 - protein, 31 aa, Artificial Sequence
  Description of Artificial Sequence: Synthetic polypeptide
DEEEIRTTNPVATEQYGSVSTNLQFFNSNRA

SEQ ID NO: 6747 - protein, 30 aa, Artificial Sequence
  Description of Artificial Sequence: Synthetic polypeptide
DEEEIRTTNPVATEQYGHVSCGNLNRGGNR

SEQ ID NO: 6748 - protein, 28 aa, Artificial Sequence
  Description of Artificial Sequence: Synthetic peptide
DECEIYTTNPVATEQYGSVSTNLMDGNP

SEQ ID NO: 6749 - protein, 30 aa, Artificial Sequence
  Description of Artificial Sequence: Synthetic polypeptide
DSEEIRTTNPVATEHYGSVSTNLQGGNDRS

SEQ ID NO: 6750 - protein, 30 aa, Artificial Sequence
  Description of Artificial Sequence: Synthetic polypeptide
DSEEIRTTNPVATEMYGSVSTNLQQGNDRD

SEQ ID NO: 6751 - protein, 28 aa, Artificial Sequence
  Description of Artificial Sequence: Synthetic peptide
LEEEIRCTNPIATEQYGSVSENLMRGNR

SEQ ID NO: 6752 - protein, 30 aa, Artificial Sequence
  Description of Artificial Sequence: Synthetic polypeptide
DEEEIRTTNPVATEQYGSCSTQLQRNGNEG

SEQ ID NO: 6753 - protein, 30 aa, Artificial Sequence
  Description of Artificial Sequence: Synthetic polypeptide
DSEEIRTTNPVATEPYGSVSCTNLSQSGNR

SEQ ID NO: 6754 - protein, 30 aa, Artificial Sequence
  Description of Artificial Sequence: Synthetic polypeptide
DEEEIRCTNPVATEQYGSVSTNLQRGGDEQ

SEQ ID NO: 6755 - protein, 31 aa, Artificial Sequence
  Description of Artificial Sequence: Synthetic polypeptide
DEEEIRCTNPVATEQYGSVSTNLQREGSENQ

SEQ ID NO: 6756 - protein, 31 aa, Artificial Sequence
  Description of Artificial Sequence: Synthetic polypeptide
DEEEIRTTNPVATEQYGSVSTNLQSEGFNEF

SEQ ID NO: 6757 - protein, 31 aa, Artificial Sequence
  Description of Artificial Sequence: Synthetic polypeptide
DEEEIRTTNPVATEQYGSVSTNLQFFGNTAA

SEQ ID NO: 6758 - protein, 30 aa, Artificial Sequence
  Description of Artificial Sequence: Synthetic polypeptide
DEEEIRTTNPVATEQYGSVSTNLQSNGFGI

SEQ ID NO: 6759 - protein, 31 aa, Artificial Sequence
  Description of Artificial Sequence: Synthetic polypeptide
DEEEIRTTNPVATEQYGSVSTNLQSNGENDA

SEQ ID NO: 6760 - protein, 30 aa, Artificial Sequence
  Description of Artificial Sequence: Synthetic polypeptide
DEEEIRTTNPVATEQYGSVSTNLQSMGELS

SEQ ID NO: 6761 - protein, 31 aa, Artificial Sequence
  Description of Artificial Sequence: Synthetic polypeptide
DEEEIRCTNPVATEQYGSVSTNNLQGGDNRQ

SEQ ID NO: 6762 - protein, 29 aa, Artificial Sequence
  Description of Artificial Sequence: Synthetic peptide
DSEEIATTNPVAYEQYGSVSTANLQRGND

SEQ ID NO: 6763 - protein, 30 aa, Artificial Sequence
  Description of Artificial Sequence: Synthetic polypeptide
DEEEIRCTNPVATEQYGSVSTNLQRMGEFQ

SEQ ID NO: 6764 - protein, 31 aa, Artificial Sequence
  Description of Artificial Sequence: Synthetic polypeptide
DEEEIRTTNPVATEQYGSVSTNLQSIGNIAN

SEQ ID NO: 6765 - protein, 30 aa, Artificial Sequence
  Description of Artificial Sequence: Synthetic polypeptide
DEEEIRTTNPVATEQYGSVSTNLQSIGMDP

SEQ ID NO: 6766 - protein, 31 aa, Artificial Sequence
  Description of Artificial Sequence: Synthetic polypeptide
DEEEIRTTNPVATEQYGSCVSATMLQRGDRN

SEQ ID NO: 6767 - protein, 30 aa, Artificial Sequence
  Description of Artificial Sequence: Synthetic polypeptide
DEEEIRTTNPVATEQYGSVSTNLQSIFLRS

SEQ ID NO: 6768 - protein, 30 aa, Artificial Sequence
  Description of Artificial Sequence: Synthetic polypeptide
DEEEIRCTNPVATEQYGSVSTNLQRGTPEQ

SEQ ID NO: 6769 - protein, 29 aa, Artificial Sequence
  Description of Artificial Sequence: Synthetic peptide
DEEEIRTTNPVATEQYGSVSTNLQFEEET

SEQ ID NO: 6770 - protein, 29 aa, Artificial Sequence
  Description of Artificial Sequence: Synthetic peptide
DSEEICTTNPVATEHYGSVSTNLQRGTER

SEQ ID NO: 6771 - protein, 29 aa, Artificial Sequence
  Description of Artificial Sequence: Synthetic peptide
DEEEIRTTNPVATEQYGSCSYNDDRGNDR

SEQ ID NO: 6772 - protein, 30 aa, Artificial Sequence
  Description of Artificial Sequence: Synthetic polypeptide
DEEEIRCTNPVATEQYGSVSTNLQRGTETQ

SEQ ID NO: 6773 - protein, 31 aa, Artificial Sequence
  Description of Artificial Sequence: Synthetic polypeptide
DEEEIRTTNPVATEQYGSVSTNLQSGGGNDD

SEQ ID NO: 6774 - protein, 30 aa, Artificial Sequence
  Description of Artificial Sequence: Synthetic polypeptide
DEEEIRCTNPVATEQYGSVSTNLQRGTPAL

SEQ ID NO: 6775 - protein, 31 aa, Artificial Sequence
  Description of Artificial Sequence: Synthetic polypeptide
DEEEIRTTNPVATEQYGSVSTNLQSGGENQP

SEQ ID NO: 6776 - protein, 31 aa, Artificial Sequence
  Description of Artificial Sequence: Synthetic polypeptide
DEEEIRTTNPVATEQYGSVSTNLQSGGENPG

SEQ ID NO: 6777 - protein, 31 aa, Artificial Sequence
  Description of Artificial Sequence: Synthetic polypeptide
DEEEIRTTNPVATEQYGSVSTNLQSGGENIP

SEQ ID NO: 6778 - protein, 30 aa, Artificial Sequence
  Description of Artificial Sequence: Synthetic polypeptide
DEEEIRATNPVATEQYGSVCSTNGQRGNHQ

SEQ ID NO: 6779 - protein, 29 aa, Artificial Sequence
  Description of Artificial Sequence: Synthetic peptide
DSEEIRATNPVATEQYGSGVSTNLQNGTR

SEQ ID NO: 6780 - protein, 31 aa, Artificial Sequence
  Description of Artificial Sequence: Synthetic polypeptide
DEEEIRTTNPVATEQYGSVSTNLQSFGMNNI

SEQ ID NO: 6781 - protein, 31 aa, Artificial Sequence
  Description of Artificial Sequence: Synthetic polypeptide
DEEEIRTTNPVATEQYGSVSTNLQSFGMNGP

SEQ ID NO: 6782 - protein, 31 aa, Artificial Sequence
  Description of Artificial Sequence: Synthetic polypeptide
DEEEIRTTNPVATEQYGSVSTNLQSFGDNDT

SEQ ID NO: 6783 - protein, 31 aa, Artificial Sequence
  Description of Artificial Sequence: Synthetic polypeptide
DEEEIRTTNPVATEQYGSVSTNLQSEMGNTN

SEQ ID NO: 6784 - protein, 30 aa, Artificial Sequence
  Description of Artificial Sequence: Synthetic polypeptide
DEEEIRATNPVATEQYGSVCTNLERGDNPR

SEQ ID NO: 6785 - protein, 29 aa, Artificial Sequence
  Description of Artificial Sequence: Synthetic peptide
DEEEIRATNPVATEQYGSVCTNLQENGNQ

SEQ ID NO: 6786 - protein, 31 aa, Artificial Sequence
  Description of Artificial Sequence: Synthetic polypeptide
DEEEIRTTNPVATEQYGSVSTNLQSEGMNIN

SEQ ID NO: 6787 - protein, 30 aa, Artificial Sequence
  Description of Artificial Sequence: Synthetic polypeptide
DEEEIRTTNPVATEQYGNVSTNLQQGGGNE

SEQ ID NO: 6788 - protein, 31 aa, Artificial Sequence
  Description of Artificial Sequence: Synthetic polypeptide
DEEEIRTTNPVATEQYGSVSTNLQSGGFNEE

SEQ ID NO: 6789 - protein, 30 aa, Artificial Sequence
  Description of Artificial Sequence: Synthetic polypeptide
DEEEIRCTNPVATEQYGSVSTNLQREGETV

SEQ ID NO: 6790 - protein, 30 aa, Artificial Sequence
  Description of Artificial Sequence: Synthetic polypeptide
DEEEIRATNPVATEQYGSVSDNLQERNNRP

SEQ ID NO: 6791 - protein, 30 aa, Artificial Sequence
  Description of Artificial Sequence: Synthetic polypeptide
DEEEIRTTNPVATEQYGSVSTNLQRTFVTF

SEQ ID NO: 6792 - protein, 30 aa, Artificial Sequence
  Description of Artificial Sequence: Synthetic polypeptide
DEEEIRATNPVATEQYGSVSSTNLQGDGNA

SEQ ID NO: 6793 - protein, 30 aa, Artificial Sequence
  Description of Artificial Sequence: Synthetic polypeptide
DEEEIRTTNPVATEQYGSVSTNIQGNEGRN

SEQ ID NO: 6794 - protein, 30 aa, Artificial Sequence
  Description of Artificial Sequence: Synthetic polypeptide
DEEEIRCTNPVATEQYGSVSTNLQERGQQV

SEQ ID NO: 6795 - protein, 30 aa, Artificial Sequence
  Description of Artificial Sequence: Synthetic polypeptide
DEEEIRATNPVATEQYGSVSSTNLQPDGNQ

SEQ ID NO: 6796 - protein, 31 aa, Artificial Sequence
  Description of Artificial Sequence: Synthetic polypeptide
DSEEIRTTNPVATERYGSVSTNALQREGGNR

SEQ ID NO: 6797 - protein, 30 aa, Artificial Sequence
  Description of Artificial Sequence: Synthetic polypeptide
DEEEIRTTNPVATEQYGSVSTNIQGNGERY

SEQ ID NO: 6798 - protein, 31 aa, Artificial Sequence
  Description of Artificial Sequence: Synthetic polypeptide
DEEEIRCTNPVATEQYGSVSTNLQERGEPRT

SEQ ID NO: 6799 - protein, 30 aa, Artificial Sequence
  Description of Artificial Sequence: Synthetic polypeptide
DEEEIRTTNPVATEQYGSVSTNLQRPPLQE

SEQ ID NO: 6800 - protein, 30 aa, Artificial Sequence
  Description of Artificial Sequence: Synthetic polypeptide
DEEEIRTTNPVATEQYGSCSTPLQSRGNIQ

SEQ ID NO: 6801 - protein, 29 aa, Artificial Sequence
  Description of Artificial Sequence: Synthetic peptide
DEEEIRATNPVATEQYGSVSTDLQDGNMT

SEQ ID NO: 6802 - protein, 30 aa, Artificial Sequence
  Description of Artificial Sequence: Synthetic polypeptide
DEEEIRATNPVATEQYGSVSTELQRGNDPE

SEQ ID NO: 6803 - protein, 30 aa, Artificial Sequence
  Description of Artificial Sequence: Synthetic polypeptide
DEEEIRATNPVATEQYGSVSTELQRGNDSV

SEQ ID NO: 6804 - protein, 30 aa, Artificial Sequence
  Description of Artificial Sequence: Synthetic polypeptide
DEEEIRATNPVATEQYGSVSTELQRGNEPS

SEQ ID NO: 6805 - protein, 30 aa, Artificial Sequence
  Description of Artificial Sequence: Synthetic polypeptide
DEEEIRATNPVATEQYGSVSTELQRGNPEE

SEQ ID NO: 6806 - protein, 29 aa, Artificial Sequence
  Description of Artificial Sequence: Synthetic peptide
QEEEIATTNPVATEQYGSVSTNLQGGDPR

SEQ ID NO: 6807 - protein, 29 aa, Artificial Sequence
  Description of Artificial Sequence: Synthetic peptide
QEEEIATTNPVATEQYGSVSTNLQDGNTA

SEQ ID NO: 6808 - protein, 31 aa, Artificial Sequence
  Description of Artificial Sequence: Synthetic polypeptide
DEEEIRATNPVATEQYGSVSTGNLERGNLRL

SEQ ID NO: 6809 - protein, 31 aa, Artificial Sequence
  Description of Artificial Sequence: Synthetic polypeptide
DEEEIRATNPVATEQYGSVSTGNLQDDGNRE

SEQ ID NO: 6810 - protein, 30 aa, Artificial Sequence
  Description of Artificial Sequence: Synthetic polypeptide
DEEEIRATNPVATEQYGSVSTGNLQGIGNA

SEQ ID NO: 6811 - protein, 30 aa, Artificial Sequence
  Description of Artificial Sequence: Synthetic polypeptide
DEEEIRTTNPVATEQYGSVSTNLQRNMVPE

SEQ ID NO: 6812 - protein, 31 aa, Artificial Sequence
  Description of Artificial Sequence: Synthetic polypeptide
DEEEIRTTNPVATEQYGSVSTNLQRNGTTGG

SEQ ID NO: 6813 - protein, 29 aa, Artificial Sequence
  Description of Artificial Sequence: Synthetic peptide
DEEEIRTTNPVATEQYGSCSTNYQRTDRF

SEQ ID NO: 6814 - protein, 29 aa, Artificial Sequence
  Description of Artificial Sequence: Synthetic peptide
DEEEIRATNPVATEQYGSVSTNDQDGNSF

SEQ ID NO: 6815 - protein, 29 aa, Artificial Sequence
  Description of Artificial Sequence: Synthetic peptide
DEEEIRATNPVATEQYGSVSTNDQNGNHT

SEQ ID NO: 6816 - protein, 30 aa, Artificial Sequence
  Description of Artificial Sequence: Synthetic polypeptide
IEEEIRTTNPVAYEQYGSVSTNPLQLRGNG

SEQ ID NO: 6817 - protein, 32 aa, Artificial Sequence
  Description of Artificial Sequence: Synthetic polypeptide
IEEEIRTTNPVATEQYGSVSTVNLAQRGENER

SEQ ID NO: 6818 - protein, 31 aa, Artificial Sequence
  Description of Artificial Sequence: Synthetic polypeptide
DEEEIRCTNPVATEQYGSVSTGNLQNNGNRE

SEQ ID NO: 6819 - protein, 30 aa, Artificial Sequence
  Description of Artificial Sequence: Synthetic polypeptide
DEEEIRCTNPVATEQYGSVSTGLQRGDNGE

SEQ ID NO: 6820 - protein, 29 aa, Artificial Sequence
  Description of Artificial Sequence: Synthetic peptide
DEEEIRATNPVATEQYGSVSTNLDRGDLA

SEQ ID NO: 6821 - protein, 29 aa, Artificial Sequence
  Description of Artificial Sequence: Synthetic peptide
DEEEIRATNPVATEQYGSVSTNLDRGDTD

SEQ ID NO: 6822 - protein, 29 aa, Artificial Sequence
  Description of Artificial Sequence: Synthetic peptide
QEEEIATTNPVATEQYGSVSTNLQDGEND

SEQ ID NO: 6823 - protein, 29 aa, Artificial Sequence
  Description of Artificial Sequence: Synthetic peptide
DEEEIRTTNPVATEQYGSVSTNIQGIGIM

SEQ ID NO: 6824 - protein, 29 aa, Artificial Sequence
  Description of Artificial Sequence: Synthetic peptide
QEEEIATTNPVATEQYGSVSTNLQHGNDN

SEQ ID NO: 6825 - protein, 29 aa, Artificial Sequence
  Description of Artificial Sequence: Synthetic peptide
DEEEIRCTNPVATEQYGSVSTNLQMGGTS

SEQ ID NO: 6826 - protein, 31 aa, Artificial Sequence
  Description of Artificial Sequence: Synthetic polypeptide
DEEEIRTTNPVATEQYGHVSGTNLNDRGMNR

SEQ ID NO: 6827 - protein, 30 aa, Artificial Sequence
  Description of Artificial Sequence: Synthetic polypeptide
DEEEIRCTNPVATEQYGSVSTNLQREGDQD

SEQ ID NO: 6828 - protein, 30 aa, Artificial Sequence
  Description of Artificial Sequence: Synthetic polypeptide
DEEEIRTTNPVATEQYGHVSLTNLNDGMNR

SEQ ID NO: 6829 - protein, 31 aa, Artificial Sequence
  Description of Artificial Sequence: Synthetic polypeptide
DEEEIRTTNPVATEQYGHVSMTNLNRDGMNR

SEQ ID NO: 6830 - protein, 29 aa, Artificial Sequence
  Description of Artificial Sequence: Synthetic peptide
DEEEIRTTNPVATEQYGSCSTQLQRMGEF

SEQ ID NO: 6831 - protein, 31 aa, Artificial Sequence
  Description of Artificial Sequence: Synthetic polypeptide
DEEEIRTTNPVATEQYGSVSTNLQRSINNQS

SEQ ID NO: 6832 - protein, 31 aa, Artificial Sequence
  Description of Artificial Sequence: Synthetic polypeptide
DEEEIRCTNPVATEQYGSVSTNLQRDTPNER

SEQ ID NO: 6833 - protein, 31 aa, Artificial Sequence
  Description of Artificial Sequence: Synthetic polypeptide
DEEEIRTTNPVATEQYGSVSTNLQRSINEYS

SEQ ID NO: 6834 - protein, 28 aa, Artificial Sequence
  Description of Artificial Sequence: Synthetic peptide
KEREIRTTNPVATEQYGSVGTNLQIGER

SEQ ID NO: 6835 - protein, 30 aa, Artificial Sequence
  Description of Artificial Sequence: Synthetic polypeptide
DEEEIRTTNPVATEQYGHVSQSNLNRGMNR

SEQ ID NO: 6836 - protein, 31 aa, Artificial Sequence
  Description of Artificial Sequence: Synthetic polypeptide
DEEEIRTTNPVATEQYGSVSTNLQFGEPNDD

SEQ ID NO: 6837 - protein, 31 aa, Artificial Sequence
  Description of Artificial Sequence: Synthetic polypeptide
DEEEIRTTNPVATEQYGSVSTNLQRSENNEI

SEQ ID NO: 6838 - protein, 31 aa, Artificial Sequence
  Description of Artificial Sequence: Synthetic polypeptide
DEEEIRTTNPVATEQYGSVSTNLQRSDNNQS

SEQ ID NO: 6839 - protein, 31 aa, Artificial Sequence
  Description of Artificial Sequence: Synthetic polypeptide
DSEEIRTTNPVATEQYGCSTVSTNLQRGGNM

SEQ ID NO: 6840 - protein, 29 aa, Artificial Sequence
  Description of Artificial Sequence: Synthetic peptide
DEEEIRATNPVATEQYGSVSGNLDRGNNQ

SEQ ID NO: 6841 - protein, 30 aa, Artificial Sequence
  Description of Artificial Sequence: Synthetic polypeptide
DEEEIRTTNPVATEQYGNVSTNLQADGNSL

SEQ ID NO: 6842 - protein, 29 aa, Artificial Sequence
  Description of Artificial Sequence: Synthetic peptide
DEEEIRATNPVATEQYGSVSGNLERGNNE

SEQ ID NO: 6843 - protein, 30 aa, Artificial Sequence
  Description of Artificial Sequence: Synthetic polypeptide
DEEEIRCTNPVATEQYGSVSTNLQNRGGMA

SEQ ID NO: 6844 - protein, 28 aa, Artificial Sequence
  Description of Artificial Sequence: Synthetic peptide
KEEEIATTNPVATEQYGSVDSNLQRGNH

SEQ ID NO: 6845 - protein, 30 aa, Artificial Sequence
  Description of Artificial Sequence: Synthetic polypeptide
AEEEIRTTNPVATEQYGSVVTTNLQRGTNP

SEQ ID NO: 6846 - protein, 28 aa, Artificial Sequence
  Description of Artificial Sequence: Synthetic peptide
KEEEIRCTNPIATEQYGSVSENLMRGNR

SEQ ID NO: 6847 - protein, 30 aa, Artificial Sequence
  Description of Artificial Sequence: Synthetic polypeptide
DSEEIRTTNPVATEQYGSVSTNIQRGGENG

SEQ ID NO: 6848 - protein, 29 aa, Artificial Sequence
  Description of Artificial Sequence: Synthetic peptide
DEEEIRTTNPVATEQYGNVSTNLDGDGNG

SEQ ID NO: 6849 - protein, 31 aa, Artificial Sequence
  Description of Artificial Sequence: Synthetic polypeptide
DEEEIRTTNPVATEQYGSVSTNLQSNGFTNQ

SEQ ID NO: 6850 - protein, 31 aa, Artificial Sequence
  Description of Artificial Sequence: Synthetic polypeptide
DSEEIRTTNPVATEQYGSVSTGNMFQRGGNR

SEQ ID NO: 6851 - protein, 30 aa, Artificial Sequence
  Description of Artificial Sequence: Synthetic polypeptide
DEEEIRTTNPVATEQYGSCSTPNLQHGENH

SEQ ID NO: 6852 - protein, 29 aa, Artificial Sequence
  Description of Artificial Sequence: Synthetic peptide
DEEEIRATNPVATEQYGSVSMNLERGNPE

SEQ ID NO: 6853 - protein, 30 aa, Artificial Sequence
  Description of Artificial Sequence: Synthetic polypeptide
DEEEIRATNPVATEQYGSVSITNLQMIGNP

SEQ ID NO: 6854 - protein, 31 aa, Artificial Sequence
  Description of Artificial Sequence: Synthetic polypeptide
DEEEIRCTNPVATEQYGSVSTNLQPRDVNER

SEQ ID NO: 6855 - protein, 30 aa, Artificial Sequence
  Description of Artificial Sequence: Synthetic polypeptide
AEEEIRTTNPVATEQYGSVVTTNLQPGGNR

SEQ ID NO: 6856 - protein, 30 aa, Artificial Sequence
  Description of Artificial Sequence: Synthetic polypeptide
DEEEIRATNPVATEQYGSVSITNLQAGQNN

SEQ ID NO: 6857 - protein, 29 aa, Artificial Sequence
  Description of Artificial Sequence: Synthetic peptide
KEEEIRTTNPVATEQYGSVSTNLQDTGEL

SEQ ID NO: 6858 - protein, 29 aa, Artificial Sequence
  Description of Artificial Sequence: Synthetic peptide
DEEEIRATNPVATEQYGSVSTNLDRGGEA

SEQ ID NO: 6859 - protein, 31 aa, Artificial Sequence
  Description of Artificial Sequence: Synthetic polypeptide
DEEEIRTTNPVATEQYGSVSTNLQSNGGNVT

SEQ ID NO: 6860 - protein, 30 aa, Artificial Sequence
  Description of Artificial Sequence: Synthetic polypeptide
DEEEIRTTNPVATEQYGSCVSTNLERNYDR

SEQ ID NO: 6861 - protein, 30 aa, Artificial Sequence
  Description of Artificial Sequence: Synthetic polypeptide
DEEEIRTTNPVATEQYGQVSTNLQDGHNTE

SEQ ID NO: 6862 - protein, 30 aa, Artificial Sequence
  Description of Artificial Sequence: Synthetic polypeptide
DEEEIRTTNPVATEQYGQVSTNLQHGENAE

SEQ ID NO: 6863 - protein, 30 aa, Artificial Sequence
  Description of Artificial Sequence: Synthetic polypeptide
DEEEIRTTNPVATEQYGSVSTNLQDTQNTN

SEQ ID NO: 6864 - protein, 30 aa, Artificial Sequence
  Description of Artificial Sequence: Synthetic polypeptide
DEEEIRTTNPVATEQYGNVSTNLQQNGNNA

SEQ ID NO: 6865 - protein, 29 aa, Artificial Sequence
  Description of Artificial Sequence: Synthetic peptide
DEEEIRTTNPVATEQYGSVSGNLQQDINP

SEQ ID NO: 6866 - protein, 31 aa, Artificial Sequence
  Description of Artificial Sequence: Synthetic polypeptide
DEEEIRTTNPVATEQYGSVSTNLQDVEGNDT

SEQ ID NO: 6867 - protein, 28 aa, Artificial Sequence
  Description of Artificial Sequence: Synthetic peptide
MEEEIRTTNPVATEEYGCISINLQRGNR

SEQ ID NO: 6868 - protein, 30 aa, Artificial Sequence
  Description of Artificial Sequence: Synthetic polypeptide
DEEEIRTTNPVATEQYGNVSTNLQQGGNNA

SEQ ID NO: 6869 - protein, 28 aa, Artificial Sequence
  Description of Artificial Sequence: Synthetic peptide
MEEEIRTTNPVATEEYGCASINLQRGNR

SEQ ID NO: 6870 - protein, 29 aa, Artificial Sequence
  Description of Artificial Sequence: Synthetic peptide
DEEEIRATNPVATEQYGSIATINLQRGDR

SEQ ID NO: 6871 - protein, 29 aa, Artificial Sequence
  Description of Artificial Sequence: Synthetic peptide
DEEEIRTTNPVATEQYGSFSTNLERAGDV

SEQ ID NO: 6872 - protein, 31 aa, Artificial Sequence
  Description of Artificial Sequence: Synthetic polypeptide
DEEEIRTTNPVATEQYGSVSTNLQDVTGNTS

SEQ ID NO: 6873 - protein, 32 aa, Artificial Sequence
  Description of Artificial Sequence: Synthetic polypeptide
DEEEIRTTNPVATEQYGSVSTNLQVQGSNHRE

SEQ ID NO: 6874 - protein, 31 aa, Artificial Sequence
  Description of Artificial Sequence: Synthetic polypeptide
DEEEIRTTNPVATEQYGSVSTNLQVQGNIQS

SEQ ID NO: 6875 - protein, 28 aa, Artificial Sequence
  Description of Artificial Sequence: Synthetic peptide
MEEEIRTTNPVATEQYGSCSTILQRMDR

SEQ ID NO: 6876 - protein, 30 aa, Artificial Sequence
  Description of Artificial Sequence: Synthetic polypeptide
DEEEIRTTNPVATEQYGSVSTNLQVQENVD

SEQ ID NO: 6877 - protein, 32 aa, Artificial Sequence
  Description of Artificial Sequence: Synthetic polypeptide
DEEEIRTTNPVATEQYGSVSTNLQVNGQNNRE

SEQ ID NO: 6878 - protein, 28 aa, Artificial Sequence
  Description of Artificial Sequence: Synthetic peptide
DEEEIRATNPVATEQYGSVANNLPRGND

SEQ ID NO: 6879 - protein, 29 aa, Artificial Sequence
  Description of Artificial Sequence: Synthetic peptide
DEEEIRTTNPVATEQYGSVSTNLQVLEIQ

SEQ ID NO: 6880 - protein, 30 aa, Artificial Sequence
  Description of Artificial Sequence: Synthetic polypeptide
DEEEIRATNPVATEQYGSVATDNLQEGNRS

SEQ ID NO: 6881 - protein, 30 aa, Artificial Sequence
  Description of Artificial Sequence: Synthetic polypeptide
DEEEIRATNPVATEQYGSVATGNLQDGNRV

SEQ ID NO: 6882 - protein, 30 aa, Artificial Sequence
  Description of Artificial Sequence: Synthetic polypeptide
DEEEIRTTNPVATEQYGQVSTNLQSGENGM

SEQ ID NO: 6883 - protein, 30 aa, Artificial Sequence
  Description of Artificial Sequence: Synthetic polypeptide
MEEEIRCTNPVATEQYGSVSTNLQRGNEVQ

SEQ ID NO: 6884 - protein, 28 aa, Artificial Sequence
  Description of Artificial Sequence: Synthetic peptide
MEEEIRCTNPVACEQYGSVSTNLQNGNM

SEQ ID NO: 6885 - protein, 28 aa, Artificial Sequence
  Description of Artificial Sequence: Synthetic peptide
MEEEIRCTNPIATEQYGSVSSNLVRGNR

SEQ ID NO: 6886 - protein, 30 aa, Artificial Sequence
  Description of Artificial Sequence: Synthetic polypeptide
DEEEIRATNPVATEQYGSVATNDQRNGNRP

SEQ ID NO: 6887 - protein, 28 aa, Artificial Sequence
  Description of Artificial Sequence: Synthetic peptide
MEEEIRCTNPIATEQYGSVSENLTRGNR

SEQ ID NO: 6888 - protein, 28 aa, Artificial Sequence
  Description of Artificial Sequence: Synthetic peptide
MEEEIRCTNPIATEQYGSVSENLMRGNR

SEQ ID NO: 6889 - protein, 30 aa, Artificial Sequence
  Description of Artificial Sequence: Synthetic polypeptide
DEEEIRTTNPVATEQYGSVSTNLQVGGMAD

SEQ ID NO: 6890 - protein, 29 aa, Artificial Sequence
  Description of Artificial Sequence: Synthetic peptide
DEEEIRTTNPVATEQYGSVSTNLQVEEEG

SEQ ID NO: 6891 - protein, 31 aa, Artificial Sequence
  Description of Artificial Sequence: Synthetic polypeptide
DEEEIRTTNPVATEQYGSVSTNLQVPGNLPQ

SEQ ID NO: 6892 - protein, 30 aa, Artificial Sequence
  Description of Artificial Sequence: Synthetic polypeptide
DEEEIRTTNPVATEQYGQVSTNLSQSGNEE

SEQ ID NO: 6893 - protein, 28 aa, Artificial Sequence
  Description of Artificial Sequence: Synthetic peptide
MEEEIRTTNPVATEQYGSTSTQLQRTER

SEQ ID NO: 6894 - protein, 29 aa, Artificial Sequence
  Description of Artificial Sequence: Synthetic peptide
DNGEIRTTNPVATEQYGSVSTNGLQLGER

SEQ ID NO: 6895 - protein, 31 aa, Artificial Sequence
  Description of Artificial Sequence: Synthetic polypeptide
DEEEIRTTNPVATEQYGSVSTNHSQAGGNTR

SEQ ID NO: 6896 - protein, 28 aa, Artificial Sequence
  Description of Artificial Sequence: Synthetic peptide
DNEEISTTNPVATGQYGSVSTNPTRGNR

SEQ ID NO: 6897 - protein, 31 aa, Artificial Sequence
  Description of Artificial Sequence: Synthetic polypeptide
DEEEIRTTNPVATEQYGSVSTNHSQTGGNFR

SEQ ID NO: 6898 - protein, 30 aa, Artificial Sequence
  Description of Artificial Sequence: Synthetic polypeptide
AEEEIRTTNPVATEQYGSVVTNLQREGING

SEQ ID NO: 6899 - protein, 28 aa, Artificial Sequence
  Description of Artificial Sequence: Synthetic peptide
DECNIRTTNPVATEQYGCVETNPQRGNR

SEQ ID NO: 6900 - protein, 31 aa, Artificial Sequence
  Description of Artificial Sequence: Synthetic polypeptide
DEEEIRTTNPVATEQYGSVSTNIDRNGNERG

SEQ ID NO: 6901 - protein, 31 aa, Artificial Sequence
  Description of Artificial Sequence: Synthetic polypeptide
DEEEIRTTNPVATEQYGSVSTNLQDLGGNTI

SEQ ID NO: 6902 - protein, 30 aa, Artificial Sequence
  Description of Artificial Sequence: Synthetic polypeptide
AEEEIRTTNPVATEQYGSVVTNQLQQRGND

SEQ ID NO: 6903 - protein, 29 aa, Artificial Sequence
  Description of Artificial Sequence: Synthetic peptide
MEEEIRTTNPVATEQYGSVSSTQLQTGNN

SEQ ID NO: 6904 - protein, 31 aa, Artificial Sequence
  Description of Artificial Sequence: Synthetic polypeptide
DEEEIRTTNPVATEQYGSVSTNLQDPGGNEI

SEQ ID NO: 6905 - protein, 30 aa, Artificial Sequence
  Description of Artificial Sequence: Synthetic polypeptide
DEEEIRTTNPVATEQYGNVSTPNLDRGNQE

SEQ ID NO: 6906 - protein, 30 aa, Artificial Sequence
  Description of Artificial Sequence: Synthetic polypeptide
AEEEIRTTNPVATEQYGSVVTQNLQPGSNR

SEQ ID NO: 6907 - protein, 30 aa, Artificial Sequence
  Description of Artificial Sequence: Synthetic polypeptide
DEEEIRATNPVATEQYGNVSSTNLQQGGNR

SEQ ID NO: 6908 - protein, 30 aa, Artificial Sequence
  Description of Artificial Sequence: Synthetic polypeptide
DEEEIRTTNPVATEQYGQVSGTNLQMAGNF

SEQ ID NO: 6909 - protein, 28 aa, Artificial Sequence
  Description of Artificial Sequence: Synthetic peptide
MEEEIRTTNPVATEQYGSVATALQIGLR

SEQ ID NO: 6910 - protein, 31 aa, Artificial Sequence
  Description of Artificial Sequence: Synthetic polypeptide
DEEEIRTTNPVATEQYGSVSTNLHQGFGNNQ

SEQ ID NO: 6911 - protein, 28 aa, Artificial Sequence
  Description of Artificial Sequence: Synthetic peptide
DNEEISTTNPVATTQYGSVSTNDNRGNR

SEQ ID NO: 6912 - protein, 30 aa, Artificial Sequence
  Description of Artificial Sequence: Synthetic polypeptide
MEEEIRTTNPVATEQYGSVSCTELQRGSNF

SEQ ID NO: 6913 - protein, 30 aa, Artificial Sequence
  Description of Artificial Sequence: Synthetic polypeptide
DEEEIRTTNPVATEQYGQVSGTNLQQGGND

SEQ ID NO: 6914 - protein, 31 aa, Artificial Sequence
  Description of Artificial Sequence: Synthetic polypeptide
DEEEIRTTNPVATEQYGQVSTGNELQRGGNE

SEQ ID NO: 6915 - protein, 30 aa, Artificial Sequence
  Description of Artificial Sequence: Synthetic polypeptide
DEEEIRATNPVATEQYGQVSYTNLFQGGNR

SEQ ID NO: 6916 - protein, 31 aa, Artificial Sequence
  Description of Artificial Sequence: Synthetic polypeptide
DEEEIRTTNPVATEQYGQVSTLNELQRGGNE

SEQ ID NO: 6917 - protein, 28 aa, Artificial Sequence
  Description of Artificial Sequence: Synthetic peptide
MEEEIRTTNPVATEQYGSVETALQNGTR

SEQ ID NO: 6918 - protein, 28 aa, Artificial Sequence
  Description of Artificial Sequence: Synthetic peptide
MEEEIRTTNPVATEQYGSVETALQNGFR

SEQ ID NO: 6919 - protein, 30 aa, Artificial Sequence
  Description of Artificial Sequence: Synthetic polypeptide
DEEEIRTTNPVATEQYGSVSTNLHESDNRI

SEQ ID NO: 6920 - protein, 31 aa, Artificial Sequence
  Description of Artificial Sequence: Synthetic polypeptide
MEEEIRTTNPVATEQYGSVCSTNLQTGNNRG

SEQ ID NO: 6921 - protein, 29 aa, Artificial Sequence
  Description of Artificial Sequence: Synthetic peptide
MEEEIRTTNPVATEQYGSVCSTELQNGDR

SEQ ID NO: 6922 - protein, 29 aa, Artificial Sequence
  Description of Artificial Sequence: Synthetic peptide
DEEEIRTTNPVATEQYGQVSTNHSQRVNS

SEQ ID NO: 6923 - protein, 31 aa, Artificial Sequence
  Description of Artificial Sequence: Synthetic polypeptide
DEEEIRTTNPVATEQYGSVSTNLQDSGINNQ

SEQ ID NO: 6924 - protein, 28 aa, Artificial Sequence
  Description of Artificial Sequence: Synthetic peptide
MEEEIRTTNPVATEQYGSVATALQPGFR

SEQ ID NO: 6925 - protein, 31 aa, Artificial Sequence
  Description of Artificial Sequence: Synthetic polypeptide
DEEEIRTTNPVATEQYGSVSTNIIQVGENRQ

SEQ ID NO: 6926 - protein, 30 aa, Artificial Sequence
  Description of Artificial Sequence: Synthetic polypeptide
DEEEIRTTNPVATEQYGSVSTNLQTVTENE

SEQ ID NO: 6927 - protein, 31 aa, Artificial Sequence
  Description of Artificial Sequence: Synthetic polypeptide
DEEEIRTTNPVATEQYGSVSTNLQEEGENGM

SEQ ID NO: 6928 - protein, 30 aa, Artificial Sequence
  Description of Artificial Sequence: Synthetic polypeptide
DEEEIRTTNPVATEQYGSVSTNLQTVQNPE

SEQ ID NO: 6929 - protein, 30 aa, Artificial Sequence
  Description of Artificial Sequence: Synthetic polypeptide
DEEEIRTTNPVATEQYGQVSWTNLNEGMNR

SEQ ID NO: 6930 - protein, 31 aa, Artificial Sequence
  Description of Artificial Sequence: Synthetic polypeptide
DEEEIRTTNPVATEQYGSVSTNLQEHGSQRF

SEQ ID NO: 6931 - protein, 28 aa, Artificial Sequence
  Description of Artificial Sequence: Synthetic peptide
DEEEIRCTNPVATEQYGTVSMDLMRGNR

SEQ ID NO: 6932 - protein, 29 aa, Artificial Sequence
  Description of Artificial Sequence: Synthetic peptide
DEEEIRATNPVATEQYGSVATSLQRGDRG

SEQ ID NO: 6933 - protein, 31 aa, Artificial Sequence
  Description of Artificial Sequence: Synthetic polypeptide
DEEEIRTTNPVATEQYGSVSTNLQELMGNQI

SEQ ID NO: 6934 - protein, 31 aa, Artificial Sequence
  Description of Artificial Sequence: Synthetic polypeptide
DEEEIRTTNPVATEQYGQVSYTNLQRTGGNE

SEQ ID NO: 6935 - protein, 32 aa, Artificial Sequence
  Description of Artificial Sequence: Synthetic polypeptide
DEEEIRTTNPVATEQYGSFCSTNLQRGGSNRQ

SEQ ID NO: 6936 - protein, 31 aa, Artificial Sequence
  Description of Artificial Sequence: Synthetic polypeptide
DEEEIRTTNPVATEQYGSVSTNLQTEMGTNE

SEQ ID NO: 6937 - protein, 31 aa, Artificial Sequence
  Description of Artificial Sequence: Synthetic polypeptide
DEEEIRTTNPVATEQYGSVSTNLQEMGDNNL

SEQ ID NO: 6938 - protein, 31 aa, Artificial Sequence
  Description of Artificial Sequence: Synthetic polypeptide
DEEEIRTTNPVATEQYGSVSTNLQTEGNLID

SEQ ID NO: 6939 - protein, 30 aa, Artificial Sequence
  Description of Artificial Sequence: Synthetic polypeptide
DEEEIRCTNPVATEQYGSVTSTNDLQHGNA

SEQ ID NO: 6940 - protein, 29 aa, Artificial Sequence
  Description of Artificial Sequence: Synthetic peptide
MEEEIETTNPVATEQYGQVSANNLQRGNR

SEQ ID NO: 6941 - protein, 31 aa, Artificial Sequence
  Description of Artificial Sequence: Synthetic polypeptide
DEEEIRTTNPVATEQYGSVSTNLQTEGDNTP

SEQ ID NO: 6942 - protein, 31 aa, Artificial Sequence
  Description of Artificial Sequence: Synthetic polypeptide
DEEEIRTTNPVATEQYGSVSTNLQEQEGNDF

SEQ ID NO: 6943 - protein, 31 aa, Artificial Sequence
  Description of Artificial Sequence: Synthetic polypeptide
DEEEIRTTNPVATEQYGSVSTNLQEGNGNFE

SEQ ID NO: 6944 - protein, 30 aa, Artificial Sequence
  Description of Artificial Sequence: Synthetic polypeptide
DEEEIRTTNPVATEQYGSVSTNLQTDGGEN

SEQ ID NO: 6945 - protein, 31 aa, Artificial Sequence
  Description of Artificial Sequence: Synthetic polypeptide
DEEEIRTTNPVATEQYGSVSTNLQERFGDTS

SEQ ID NO: 6946 - protein, 28 aa, Artificial Sequence
  Description of Artificial Sequence: Synthetic peptide
DECEIYTTNPVATEQYGSVSTNLNFGNT

SEQ ID NO: 6947 - protein, 29 aa, Artificial Sequence
  Description of Artificial Sequence: Synthetic peptide
MEEEIATTNPVATEQYGSVSTNLQHNGNA

SEQ ID NO: 6948 - protein, 31 aa, Artificial Sequence
  Description of Artificial Sequence: Synthetic polypeptide
DEEEIRTTNPVATEQYGSVSTNLQSVGENSS

SEQ ID NO: 6949 - protein, 31 aa, Artificial Sequence
  Description of Artificial Sequence: Synthetic polypeptide
DEEEIRTTNPVATEQYGSVSTNLQSTGENGI

SEQ ID NO: 6950 - protein, 31 aa, Artificial Sequence
  Description of Artificial Sequence: Synthetic polypeptide
DEEEIRTTNPVATEQYGSVSTNLQSRLGSQQ

SEQ ID NO: 6951 - protein, 32 aa, Artificial Sequence
  Description of Artificial Sequence: Synthetic polypeptide
DEEEIRTTNPVATEQYGSVSTNLQSREGNQFF

SEQ ID NO: 6952 - protein, 30 aa, Artificial Sequence
  Description of Artificial Sequence: Synthetic polypeptide
DEEEIRTTNPVATEQYGSVSTNLQSQDNFN

SEQ ID NO: 6953 - protein, 31 aa, Artificial Sequence
  Description of Artificial Sequence: Synthetic polypeptide
DEEEIRTTNPVATEQYGSVSFTYNLQRGVTE

SEQ ID NO: 6954 - protein, 29 aa, Artificial Sequence
  Description of Artificial Sequence: Synthetic peptide
DSAEIRTTNPVATEQYGSVSTNLQTGGNQ

SEQ ID NO: 6955 - protein, 31 aa, Artificial Sequence
  Description of Artificial Sequence: Synthetic polypeptide
DEEEIRTTNPVATEQYGSVSTNLQSPGENTP

SEQ ID NO: 6956 - protein, 30 aa, Artificial Sequence
  Description of Artificial Sequence: Synthetic polypeptide
DEEEIRTTNPVATEQYGSVSTNLQSNGTTN

SEQ ID NO: 6957 - protein, 31 aa, Artificial Sequence
  Description of Artificial Sequence: Synthetic polypeptide
DEEEIRTTNPVATEQYGSVSTNLQSNGTQNT

SEQ ID NO: 6958 - protein, 30 aa, Artificial Sequence
  Description of Artificial Sequence: Synthetic polypeptide
DEEEIRTTNPVATEQYGSVSTNLQSNGMTD

SEQ ID NO: 6959 - protein, 31 aa, Artificial Sequence
  Description of Artificial Sequence: Synthetic polypeptide
DEEEIRTTNPVATEQYGSVSTNLQEQGINNI

SEQ ID NO: 6960 - protein, 31 aa, Artificial Sequence
  Description of Artificial Sequence: Synthetic polypeptide
DEEEIRTTNPVATEQYGSVSTNLQEGNGNEK

SEQ ID NO: 6961 - protein, 31 aa, Artificial Sequence
  Description of Artificial Sequence: Synthetic polypeptide
DEEEIRTTNPVATEQYGSVSTNLQEGGENVI

SEQ ID NO: 6962 - protein, 29 aa, Artificial Sequence
  Description of Artificial Sequence: Synthetic peptide
QEEEIATTNPVATEVYGSVSTNLQAGSNR

SEQ ID NO: 6963 - protein, 28 aa, Artificial Sequence
  Description of Artificial Sequence: Synthetic peptide
DEEEIRCTNPVAVEQYGSISTDLQRGGR

SEQ ID NO: 6964 - protein, 31 aa, Artificial Sequence
  Description of Artificial Sequence: Synthetic polypeptide
DEEEIRTTNPVATEQYGSVSTNLQTVGGNAT

SEQ ID NO: 6965 - protein, 31 aa, Artificial Sequence
  Description of Artificial Sequence: Synthetic polypeptide
DEEEIRTTNPVATEQYGSVSTNLQTSGLNVQ

SEQ ID NO: 6966 - protein, 30 aa, Artificial Sequence
  Description of Artificial Sequence: Synthetic polypeptide
DEEEIRTTNPVATEQYGSVSGNLQPGMNTF

SEQ ID NO: 6967 - protein, 31 aa, Artificial Sequence
  Description of Artificial Sequence: Synthetic polypeptide
DEEEIRTTNPVATEQYGGVSWTNLNRGMNRD

SEQ ID NO: 6968 - protein, 31 aa, Artificial Sequence
  Description of Artificial Sequence: Synthetic polypeptide
DEEEIRTTNPVATEQYGSVSTNLQEFGNGGD

SEQ ID NO: 6969 - protein, 31 aa, Artificial Sequence
  Description of Artificial Sequence: Synthetic polypeptide
DEEEIRTTNPVATEQYGSVSTNLGTRGQELR

SEQ ID NO: 6970 - protein, 31 aa, Artificial Sequence
  Description of Artificial Sequence: Synthetic polypeptide
DEEEIRTTNPVATEQYGSVSTNLQEFGNPEA

SEQ ID NO: 6971 - protein, 28 aa, Artificial Sequence
  Description of Artificial Sequence: Synthetic peptide
DECEIYTTNPVATEQYGSVSTNLVDGNT

SEQ ID NO: 6972 - protein, 29 aa, Artificial Sequence
  Description of Artificial Sequence: Synthetic peptide
NEEEIRTTNPVATEQYGSVSANLQAGNTE

SEQ ID NO: 6973 - protein, 30 aa, Artificial Sequence
  Description of Artificial Sequence: Synthetic polypeptide
DEEEIRTTNPVATEQYGSFSLPNMLQRLNR

SEQ ID NO: 6974 - protein, 29 aa, Artificial Sequence
  Description of Artificial Sequence: Synthetic peptide
DEEEIRATNPVATEQYGSVATNLQEGEND

SEQ ID NO: 6975 - protein, 29 aa, Artificial Sequence
  Description of Artificial Sequence: Synthetic peptide
DEEEIRATNPVATEQYGSVATNLQEMGNT

SEQ ID NO: 6976 - protein, 28 aa, Artificial Sequence
  Description of Artificial Sequence: Synthetic peptide
DQEEIRSTNPVATEQYGSISTNSQRGNN

SEQ ID NO: 6977 - protein, 29 aa, Artificial Sequence
  Description of Artificial Sequence: Synthetic peptide
DEEEIRATNPVATEQYGSVATNLQERMNN

SEQ ID NO: 6978 - protein, 32 aa, Artificial Sequence
  Description of Artificial Sequence: Synthetic polypeptide
DEEEIRTTNPVATEQYGSVSTNLQEFGNSNRD

SEQ ID NO: 6979 - protein, 30 aa, Artificial Sequence
  Description of Artificial Sequence: Synthetic polypeptide
DQEEIRSTNPVATEQYGSVSTNLQARNGVR

SEQ ID NO: 6980 - protein, 31 aa, Artificial Sequence
  Description of Artificial Sequence: Synthetic polypeptide
DEEEIRTTNPVATEQYGSVSTNLQEGGENIA

SEQ ID NO: 6981 - protein, 31 aa, Artificial Sequence
  Description of Artificial Sequence: Synthetic polypeptide
DQEEIRTTNPVATEQYGSVSCTNLSQRAVNR

SEQ ID NO: 6982 - protein, 31 aa, Artificial Sequence
  Description of Artificial Sequence: Synthetic polypeptide
DQEEIRTTNPVATEQYGSVCSTNLQRGQNQG

SEQ ID NO: 6983 - protein, 31 aa, Artificial Sequence
  Description of Artificial Sequence: Synthetic polypeptide
DEEEIRTTNPVATEQYGSVSTNLQEGGDNQP

SEQ ID NO: 6984 - protein, 30 aa, Artificial Sequence
  Description of Artificial Sequence: Synthetic polypeptide
DEEEIRTTNPVATEQYGSVSTNLQEGELEP

SEQ ID NO: 6985 - protein, 29 aa, Artificial Sequence
  Description of Artificial Sequence: Synthetic peptide
DEEEIRCTNPVATEQYGVVSTNLQRSENV

SEQ ID NO: 6986 - protein, 31 aa, Artificial Sequence
  Description of Artificial Sequence: Synthetic polypeptide
DEEEIRCTNPVATEQYGSVSTNNLQNDGNRL

SEQ ID NO: 6987 - protein, 29 aa, Artificial Sequence
  Description of Artificial Sequence: Synthetic peptide
DEEEIRATNPVATEQYGSVATNLQTRSNL

SEQ ID NO: 6988 - protein, 31 aa, Artificial Sequence
  Description of Artificial Sequence: Synthetic polypeptide
DEEEIRTTNPVATEQYGSVSTNLQTGTGNDQ

SEQ ID NO: 6989 - protein, 32 aa, Artificial Sequence
  Description of Artificial Sequence: Synthetic polypeptide
DEEEIRTTNPVATEQYGSVSTNLGTREGNGRG

SEQ ID NO: 6990 - protein, 31 aa, Artificial Sequence
  Description of Artificial Sequence: Synthetic polypeptide
DEEEIRTTNPVATEQYGSVSTNLQTIGVNNM

SEQ ID NO: 6991 - protein, 28 aa, Artificial Sequence
  Description of Artificial Sequence: Synthetic peptide
DQEEIRTTNPMATEHYGSVSFNLQRENR

SEQ ID NO: 6992 - protein, 31 aa, Artificial Sequence
  Description of Artificial Sequence: Synthetic polypeptide
DEEEIRTTNPVATEQYGSVSTNLQTLGNEGG

SEQ ID NO: 6993 - protein, 31 aa, Artificial Sequence
  Description of Artificial Sequence: Synthetic polypeptide
DEEEIRTTNPVATEQYGSVSTNLQTNGNFIG

SEQ ID NO: 6994 - protein, 30 aa, Artificial Sequence
  Description of Artificial Sequence: Synthetic polypeptide
DEEEIRTTNPVATEQYGSVSTNLQEGEDGG

SEQ ID NO: 6995 - protein, 28 aa, Artificial Sequence
  Description of Artificial Sequence: Synthetic peptide
NEEEIRTTNPVATEQYGSVVTNLQNAER

SEQ ID NO: 6996 - protein, 30 aa, Artificial Sequence
  Description of Artificial Sequence: Synthetic polypeptide
DEEEIRTTNPVATEQYGNVSTGNLQAGNIA

SEQ ID NO: 6997 - protein, 30 aa, Artificial Sequence
  Description of Artificial Sequence: Synthetic polypeptide
DEEEIRATNPVATEQYGSVSTNLQAGANEL

SEQ ID NO: 6998 - protein, 30 aa, Artificial Sequence
  Description of Artificial Sequence: Synthetic polypeptide
DEEEIRTTNPVATEQYGSCSTNLQNRGQLI

SEQ ID NO: 6999 - protein, 30 aa, Artificial Sequence
  Description of Artificial Sequence: Synthetic polypeptide
DECEIRTTNPVATEQYGSVSTNLQRGGDDG

SEQ ID NO: 7000 - protein, 30 aa, Artificial Sequence
  Description of Artificial Sequence: Synthetic polypeptide
DTEEIRCTNPVATEQYGSVVSTNLQNGSNR

SEQ ID NO: 7001 - protein, 31 aa, Artificial Sequence
  Description of Artificial Sequence: Synthetic polypeptide
DEEEIRTTNPVATEQYGSVSTNLQGGGDNNT

SEQ ID NO: 7002 - protein, 30 aa, Artificial Sequence
  Description of Artificial Sequence: Synthetic polypeptide
DECEIRTTNPVATEQYGSVSTNLQRDGEME

SEQ ID NO: 7003 - protein, 29 aa, Artificial Sequence
  Description of Artificial Sequence: Synthetic peptide
DTEEIRPTNPVATEQYGSTVSTNLQNGDR

SEQ ID NO: 7004 - protein, 29 aa, Artificial Sequence
  Description of Artificial Sequence: Synthetic peptide
DTEEIRQTNPVATEQYGSTVSTNLQGGTR

SEQ ID NO: 7005 - protein, 30 aa, Artificial Sequence
  Description of Artificial Sequence: Synthetic polypeptide
DECEIRTTNPVATEQYGSVSTNLQGGPNQE

SEQ ID NO: 7006 - protein, 30 aa, Artificial Sequence
  Description of Artificial Sequence: Synthetic polypeptide
DEEEIRATNPVATEQYGTVSDTNLFQGGNR

SEQ ID NO: 7007 - protein, 28 aa, Artificial Sequence
  Description of Artificial Sequence: Synthetic peptide
DEEEIRTTNPCASEWYGCVSTNLERGNR

SEQ ID NO: 7008 - protein, 28 aa, Artificial Sequence
  Description of Artificial Sequence: Synthetic peptide
DTEEIRSTNPVATEQYGSASTNDQRGNN

SEQ ID NO: 7009 - protein, 31 aa, Artificial Sequence
  Description of Artificial Sequence: Synthetic polypeptide
DEEEIRTTNPVATEQYGKVSCTGNLQQTGNR

SEQ ID NO: 7010 - protein, 32 aa, Artificial Sequence
  Description of Artificial Sequence: Synthetic polypeptide
DEEEIRTTNPVATEQYGKVSCTNLQNRTGNDR

SEQ ID NO: 7011 - protein, 29 aa, Artificial Sequence
  Description of Artificial Sequence: Synthetic peptide
DECEIRTTNPVATEQYGSVSTNLQGEMNE

SEQ ID NO: 7012 - protein, 31 aa, Artificial Sequence
  Description of Artificial Sequence: Synthetic polypeptide
DECEIRTTNPVATEQYGSVSTNNQRDGMNRG

SEQ ID NO: 7013 - protein, 28 aa, Artificial Sequence
  Description of Artificial Sequence: Synthetic peptide
DTEEIRSTNPVATEQYGSCSTNMQRGND

SEQ ID NO: 7014 - protein, 29 aa, Artificial Sequence
  Description of Artificial Sequence: Synthetic peptide
DTEEIRSTNPVATEQYGSHVSTNLQEGTR

SEQ ID NO: 7015 - protein, 29 aa, Artificial Sequence
  Description of Artificial Sequence: Synthetic peptide
DTEEIRSTNPVATEQYGSVSSTNSQRGNS

SEQ ID NO: 7016 - protein, 30 aa, Artificial Sequence
  Description of Artificial Sequence: Synthetic polypeptide
DTEEIRSTNPVATEQYGSVSTNLQGGNGQR

SEQ ID NO: 7017 - protein, 30 aa, Artificial Sequence
  Description of Artificial Sequence: Synthetic polypeptide
DEEEIRTTNPVATEQYGSVSTNLQGGGMEE

SEQ ID NO: 7018 - protein, 28 aa, Artificial Sequence
  Description of Artificial Sequence: Synthetic peptide
HEEEIRCTNPIATEQYGSVSENLMRGNR

SEQ ID NO: 7019 - protein, 28 aa, Artificial Sequence
  Description of Artificial Sequence: Synthetic peptide
HEEEIRCTNPIATEQYGSVSENLARGNR

SEQ ID NO: 7020 - protein, 28 aa, Artificial Sequence
  Description of Artificial Sequence: Synthetic peptide
HEEEICTTNPVATEQYGSVSTNQQRGLP

SEQ ID NO: 7021 - protein, 30 aa, Artificial Sequence
  Description of Artificial Sequence: Synthetic polypeptide
DEEEIRATNPVATEQYGTVSMTNLFQNGNR

SEQ ID NO: 7022 - protein, 28 aa, Artificial Sequence
  Description of Artificial Sequence: Synthetic peptide
DTEEIRTTNPAATEGYGSVSSNLQRENR

SEQ ID NO: 7023 - protein, 31 aa, Artificial Sequence
  Description of Artificial Sequence: Synthetic polypeptide
DEEEIRTTNPVATEQYGSVSTNLQGGGMNSP

SEQ ID NO: 7024 - protein, 28 aa, Artificial Sequence
  Description of Artificial Sequence: Synthetic peptide
DTEEIRTTNPCATEAYGSVSNNLQRENR

SEQ ID NO: 7025 - protein, 30 aa, Artificial Sequence
  Description of Artificial Sequence: Synthetic polypeptide
DEEEIRATNPVATEQYGTVSMTNLSQGGNR

SEQ ID NO: 7026 - protein, 28 aa, Artificial Sequence
  Description of Artificial Sequence: Synthetic peptide
HEEEIATTNPVATEPYGEVSTNLQHGNR

SEQ ID NO: 7027 - protein, 30 aa, Artificial Sequence
  Description of Artificial Sequence: Synthetic polypeptide
DEEEIRTTNPVATEQYGSAMTNLQPGNLRD

SEQ ID NO: 7028 - protein, 29 aa, Artificial Sequence
  Description of Artificial Sequence: Synthetic peptide
DTEEIRSTNPVATEQYGSFVSTNLQNGER

SEQ ID NO: 7029 - protein, 29 aa, Artificial Sequence
  Description of Artificial Sequence: Synthetic peptide
DEEEIRTTNPVATEQYGSANSTDLQRNNQ

SEQ ID NO: 7030 - protein, 30 aa, Artificial Sequence
  Description of Artificial Sequence: Synthetic polypeptide
DECEIRTTNPVATEQYGSVSTNSQGEGNER

SEQ ID NO: 7031 - protein, 30 aa, Artificial Sequence
  Description of Artificial Sequence: Synthetic polypeptide
DEEEIRATNPVATEQYGSVVTNLDRGNDRP

SEQ ID NO: 7032 - protein, 31 aa, Artificial Sequence
  Description of Artificial Sequence: Synthetic polypeptide
DEEEIRTTNPVATEQYGKTVSTNLSQSGNMR

SEQ ID NO: 7033 - protein, 31 aa, Artificial Sequence
  Description of Artificial Sequence: Synthetic polypeptide
DEEEIRTTNPVATEQYGKTVSTNLSQSGSNR

SEQ ID NO: 7034 - protein, 31 aa, Artificial Sequence
  Description of Artificial Sequence: Synthetic polypeptide
DEEEIRTTNPVATEQYGSVSTNLQGDGDNQS

SEQ ID NO: 7035 - protein, 29 aa, Artificial Sequence
  Description of Artificial Sequence: Synthetic peptide
QEEEIATTNPVATEPYGSVSTNLQRDGNL

SEQ ID NO: 7036 - protein, 28 aa, Artificial Sequence
  Description of Artificial Sequence: Synthetic peptide
DEEEIRTTNPCATEAYGSISTNLERGNS

SEQ ID NO: 7037 - protein, 28 aa, Artificial Sequence
  Description of Artificial Sequence: Synthetic peptide
DECEIRTTNPVATEQYGVVSTELQRTND

SEQ ID NO: 7038 - protein, 30 aa, Artificial Sequence
  Description of Artificial Sequence: Synthetic polypeptide
QEEEIATTNPVATEIYGSVSTNLQDRGNDR

SEQ ID NO: 7039 - protein, 28 aa, Artificial Sequence
  Description of Artificial Sequence: Synthetic peptide
DECEIRTTNPVATEQYGVVSTALQRPNI

SEQ ID NO: 7040 - protein, 30 aa, Artificial Sequence
  Description of Artificial Sequence: Synthetic polypeptide
DEEEIRSTNPVATEQYGCVCSLTNLQFGNR

SEQ ID NO: 7041 - protein, 29 aa, Artificial Sequence
  Description of Artificial Sequence: Synthetic peptide
QEEEIATTNPVATEHYGSVSTNLQTGPNR

SEQ ID NO: 7042 - protein, 31 aa, Artificial Sequence
  Description of Artificial Sequence: Synthetic polypeptide
DEEEIRTTNPVATEQYGSVSTNLQGDGEGNT

SEQ ID NO: 7043 - protein, 32 aa, Artificial Sequence
  Description of Artificial Sequence: Synthetic polypeptide
HEEEIRTTNPVATEQYGSVSTMNLSQRGGNYR

SEQ ID NO: 7044 - protein, 28 aa, Artificial Sequence
  Description of Artificial Sequence: Synthetic peptide
DEEEIRTTNPCATEAYGSCSTNLIRGNV

SEQ ID NO: 7045 - protein, 30 aa, Artificial Sequence
  Description of Artificial Sequence: Synthetic polypeptide
DEEEIRTTNPVATEQYGSVSTNLGGGVNIN

SEQ ID NO: 7046 - protein, 28 aa, Artificial Sequence
  Description of Artificial Sequence: Synthetic peptide
QEEEIATTNPIATEQYGDVSENLQRGNR

SEQ ID NO: 7047 - protein, 31 aa, Artificial Sequence
  Description of Artificial Sequence: Synthetic polypeptide
HEEEIRTTNPVATEQYGSVSTGNLQDGINGR

SEQ ID NO: 7048 - protein, 31 aa, Artificial Sequence
  Description of Artificial Sequence: Synthetic polypeptide
DEEEIRTTNPVATEQYGSVSTNLQGDVGDDR

SEQ ID NO: 7049 - protein, 30 aa, Artificial Sequence
  Description of Artificial Sequence: Synthetic polypeptide
DEEEIRTTNPVATEQYGSVSTNLGGESGNI

SEQ ID NO: 7050 - protein, 30 aa, Artificial Sequence
  Description of Artificial Sequence: Synthetic polypeptide
DEEEIRATNPVATEQYGSVSVTNGQQGNRV

SEQ ID NO: 7051 - protein, 28 aa, Artificial Sequence
  Description of Artificial Sequence: Synthetic peptide
QEEEIATTNPVATEGYGEVSTNLQGGNR

SEQ ID NO: 7052 - protein, 31 aa, Artificial Sequence
  Description of Artificial Sequence: Synthetic polypeptide
DEEEIRTTNPVATEQYGSVSTNLQGEDQNTR

SEQ ID NO: 7053 - protein, 29 aa, Artificial Sequence
  Description of Artificial Sequence: Synthetic peptide
DEEEIRTTNPVATEQYGSCSTNLTRADGR

SEQ ID NO: 7054 - protein, 30 aa, Artificial Sequence
  Description of Artificial Sequence: Synthetic polypeptide
DEEEIRTTNPVATEQYGSVSTNLQGEFNAE

SEQ ID NO: 7055 - protein, 30 aa, Artificial Sequence
  Description of Artificial Sequence: Synthetic polypeptide
DEEEIRTTNPVATEQYGSCSTNLQTSNNRI

SEQ ID NO: 7056 - protein, 32 aa, Artificial Sequence
  Description of Artificial Sequence: Synthetic polypeptide
NEEEIRTTNPVATEQYGSVSTDNLKQRGENQR

SEQ ID NO: 7057 - protein, 30 aa, Artificial Sequence
  Description of Artificial Sequence: Synthetic polypeptide
DEEEIRTTNPVATEQYGSVSTNLQGEPNIA

SEQ ID NO: 7058 - protein, 30 aa, Artificial Sequence
  Description of Artificial Sequence: Synthetic polypeptide
DEEEIRTTNPVATEQYGSCSTNLQSGDNVM

SEQ ID NO: 7059 - protein, 31 aa, Artificial Sequence
  Description of Artificial Sequence: Synthetic polypeptide
DEEEIRTTNPVATEQYGNVDSTNLQRGNDQE

SEQ ID NO: 7060 - protein, 30 aa, Artificial Sequence
  Description of Artificial Sequence: Synthetic polypeptide
DEEEIRTTNPVATEQYGSVSTNLQGFGDQM

SEQ ID NO: 7061 - protein, 29 aa, Artificial Sequence
  Description of Artificial Sequence: Synthetic peptide
DECEIRTTNPVATEQYGSVSVNLNRNMNR

SEQ ID NO: 7062 - protein, 31 aa, Artificial Sequence
  Description of Artificial Sequence: Synthetic polypeptide
DEEEIRTTNPVATEQYGSVSTNLQGDHGNEI

SEQ ID NO: 7063 - protein, 31 aa, Artificial Sequence
  Description of Artificial Sequence: Synthetic polypeptide
DEEEIRTTNPVATEQYGSCSTNLQNMGEMNR

SEQ ID NO: 7064 - protein, 30 aa, Artificial Sequence
  Description of Artificial Sequence: Synthetic polypeptide
DEEEIRTTNPVATEQYGSCSTNLQNGNPEK

SEQ ID NO: 7065 - protein, 31 aa, Artificial Sequence
  Description of Artificial Sequence: Synthetic polypeptide
DEEEIRTTNPVATEQYGSVSTNLQGGGNDLI

SEQ ID NO: 7066 - protein, 31 aa, Artificial Sequence
  Description of Artificial Sequence: Synthetic polypeptide
DECEIRTTNPVATEQYGSVSTNLEQHGGGNR

SEQ ID NO: 7067 - protein, 30 aa, Artificial Sequence
  Description of Artificial Sequence: Synthetic polypeptide
GEEEISTTNPVATEQYGQSVSVTNLVRGNR

SEQ ID NO: 7068 - protein, 29 aa, Artificial Sequence
  Description of Artificial Sequence: Synthetic peptide
DEEEIRTTNPVATEQYGSVSGLLQNGGND

SEQ ID NO: 7069 - protein, 28 aa, Artificial Sequence
  Description of Artificial Sequence: Synthetic peptide
DTEEIRTTNPNATEIYGSVSDNLQRENR

SEQ ID NO: 7070 - protein, 28 aa, Artificial Sequence
  Description of Artificial Sequence: Synthetic peptide
DEEEIRTTNPVATEQYGSCSTNLMRVDD

SEQ ID NO: 7071 - protein, 32 aa, Artificial Sequence
  Description of Artificial Sequence: Synthetic polypeptide
NEEEIRTTNPVATEQYGSVSTSNLTQRGFNGR

SEQ ID NO: 7072 - protein, 29 aa, Artificial Sequence
  Description of Artificial Sequence: Synthetic peptide
DEEEIRTTNPVATEQYGSVSTNLGFGIGG

SEQ ID NO: 7073 - protein, 30 aa, Artificial Sequence
  Description of Artificial Sequence: Synthetic polypeptide
DEEEIRTTNPVATEQYGKVSTNLSQIVNRP

SEQ ID NO: 7074 - protein, 31 aa, Artificial Sequence
  Description of Artificial Sequence: Synthetic polypeptide
DECEIRTTNPVATEQYGSVSTNLEQDGAGNR

SEQ ID NO: 7075 - protein, 32 aa, Artificial Sequence
  Description of Artificial Sequence: Synthetic polypeptide
NEEEIRTTNPVATEQYGSVSTVNLFQRGENYR

SEQ ID NO: 7076 - protein, 29 aa, Artificial Sequence
  Description of Artificial Sequence: Synthetic peptide
DEEEIRTTNPVATEQYGSVSTNLAYFQNQ

SEQ ID NO: 7077 - protein, 29 aa, Artificial Sequence
  Description of Artificial Sequence: Synthetic peptide
DEEEIRTTNPVATEQYGSCSTNLERMGTV

SEQ ID NO: 7078 - protein, 29 aa, Artificial Sequence
  Description of Artificial Sequence: Synthetic peptide
DECEIRTTNPVATEQYGSVSTNDQRGGEQ

SEQ ID NO: 7079 - protein, 31 aa, Artificial Sequence
  Description of Artificial Sequence: Synthetic polypeptide
DEEEIRTTNPVATEQYGSVSTNLGERNGVRG

SEQ ID NO: 7080 - protein, 29 aa, Artificial Sequence
  Description of Artificial Sequence: Synthetic peptide
DTEEIRTTNPIATEHYGSVSANLQRGENR

SEQ ID NO: 7081 - protein, 29 aa, Artificial Sequence
  Description of Artificial Sequence: Synthetic peptide
DEEEIRTTNPVATEQYGSCSTNLEREGSD

SEQ ID NO: 7082 - protein, 29 aa, Artificial Sequence
  Description of Artificial Sequence: Synthetic peptide
DECEIRTTNPVATEQYGSVSTNAQHGDVR

SEQ ID NO: 7083 - protein, 31 aa, Artificial Sequence
  Description of Artificial Sequence: Synthetic polypeptide
DEEEIRTTNPVATEQYGKVSWTNELTRGTNR

SEQ ID NO: 7084 - protein, 28 aa, Artificial Sequence
  Description of Artificial Sequence: Synthetic peptide
DTEEIRTTNPQATEWYGSVSSNLQRENR

SEQ ID NO: 7085 - protein, 30 aa, Artificial Sequence
  Description of Artificial Sequence: Synthetic polypeptide
NEEEIRTTNPVATEQYGSVSVTNLDEFGNR

SEQ ID NO: 7086 - protein, 28 aa, Artificial Sequence
  Description of Artificial Sequence: Synthetic peptide
DTEEIRTTNPSATEHYGSVSENLQRENR

SEQ ID NO: 7087 - protein, 28 aa, Artificial Sequence
  Description of Artificial Sequence: Synthetic peptide
DTEEIRTTNPVAMEQWGSVSTPDQRGNR

SEQ ID NO: 7088 - protein, 29 aa, Artificial Sequence
  Description of Artificial Sequence: Synthetic peptide
AEEEIRTTNPVATEQYGSVVVNLQVSGNR

SEQ ID NO: 7089 - protein, 30 aa, Artificial Sequence
  Description of Artificial Sequence: Synthetic polypeptide
DECEIRTTNPVATEQYGSVSTANQQMGGNR

SEQ ID NO: 7090 - protein, 30 aa, Artificial Sequence
  Description of Artificial Sequence: Synthetic polypeptide
DEEEIRTTNPVATEQYGSVSGTDGDRGNER

SEQ ID NO: 7091 - protein, 30 aa, Artificial Sequence
  Description of Artificial Sequence: Synthetic polypeptide
DEEEIRTTNPVATEQYGSVSTNLGEFDNRI

SEQ ID NO: 7092 - protein, 29 aa, Artificial Sequence
  Description of Artificial Sequence: Synthetic peptide
DEEEIRTTNPVATEQYGSVSTNLGDNGQM

SEQ ID NO: 7093 - protein, 29 aa, Artificial Sequence
  Description of Artificial Sequence: Synthetic peptide
AEEEIRTTNPVATESYGSVSVTNLQRTNA

SEQ ID NO: 7094 - protein, 29 aa, Artificial Sequence
  Description of Artificial Sequence: Synthetic peptide
AEEEIRTTNPVATESYGSVVSTNNQNGNR

SEQ ID NO: 7095 - protein, 28 aa, Artificial Sequence
  Description of Artificial Sequence: Synthetic peptide
GEEEIRTTNPVATEQYGSVATALQNGMR

SEQ ID NO: 7096 - protein, 28 aa, Artificial Sequence
  Description of Artificial Sequence: Synthetic peptide
DEEEIRTTNPAATEQYGSVSANFFRGND

SEQ ID NO: 7097 - protein, 28 aa, Artificial Sequence
  Description of Artificial Sequence: Synthetic peptide
DTEEIRTTNPHATEVYGSVSANLQRENR

SEQ ID NO: 7098 - protein, 31 aa, Artificial Sequence
  Description of Artificial Sequence: Synthetic polypeptide
DECEIRTTNPVATEQYGSVSTNLMQDGMGNR

SEQ ID NO: 7099 - protein, 28 aa, Artificial Sequence
  Description of Artificial Sequence: Synthetic peptide
DTEEIRTTNPGATEHYGSVSMNLQRENR

SEQ ID NO: 7100 - protein, 29 aa, Artificial Sequence
  Description of Artificial Sequence: Synthetic peptide
DEEEIRTTNPAATEQYGSVSTNLERQSNA

SEQ ID NO: 7101 - protein, 29 aa, Artificial Sequence
  Description of Artificial Sequence: Synthetic peptide
DEEEIRTTNPVATEQYGSCSTNLQHNDRG

SEQ ID NO: 7102 - protein, 29 aa, Artificial Sequence
  Description of Artificial Sequence: Synthetic peptide
DECEIRTTNPVATEQYGSVSTNLQGDEND

SEQ ID NO: 7103 - protein, 30 aa, Artificial Sequence
  Description of Artificial Sequence: Synthetic polypeptide
HEAEIRTTNPVATEQYGSVSTNLQRDGNDD

SEQ ID NO: 7104 - protein, 28 aa, Artificial Sequence
  Description of Artificial Sequence: Synthetic peptide
HDEEIRTTNPVATEQWGTVSTNLQEGNR

SEQ ID NO: 7105 - protein, 31 aa, Artificial Sequence
  Description of Artificial Sequence: Synthetic polypeptide
DECEIRTTNPVATEQYGSVSTNLQGAEGNER

SEQ ID NO: 7106 - protein, 28 aa, Artificial Sequence
  Description of Artificial Sequence: Synthetic peptide
GTEEIRTTNPVATDQYGSVSTELQRGNI

SEQ ID NO: 7107 - protein, 30 aa, Artificial Sequence
  Description of Artificial Sequence: Synthetic polypeptide
NEEEIRTTNPVATEQYGSVSTNLQRNANEN

SEQ ID NO: 7108 - protein, 31 aa, Artificial Sequence
  Description of Artificial Sequence: Synthetic polypeptide
DEEEIRTTNPVATEQYGKVSTGNLQRGGNPQ

SEQ ID NO: 7109 - protein, 30 aa, Artificial Sequence
  Description of Artificial Sequence: Synthetic polypeptide
NEEEIRTTNPVATEQYGSVSTNLQRNYNFQ

SEQ ID NO: 7110 - protein, 28 aa, Artificial Sequence
  Description of Artificial Sequence: Synthetic peptide
GSEEIRTTNPVATVQYGSVSTELQRGNQ

SEQ ID NO: 7111 - protein, 30 aa, Artificial Sequence
  Description of Artificial Sequence: Synthetic polypeptide
DEEEIRTTNPVATEQYGSCSTNLQHGDNPP

SEQ ID NO: 7112 - protein, 28 aa, Artificial Sequence
  Description of Artificial Sequence: Synthetic peptide
GQEEIRTTNPVATEQWGTVSTNLQHGNR

SEQ ID NO: 7113 - protein, 29 aa, Artificial Sequence
  Description of Artificial Sequence: Synthetic peptide
DEEEIRTTNPVATEQYGSCSTNLQHADRK

SEQ ID NO: 7114 - protein, 32 aa, Artificial Sequence
  Description of Artificial Sequence: Synthetic polypeptide
NEEEIRTTNPVATEQYGSVSTNNLQQRGENYR

SEQ ID NO: 7115 - protein, 29 aa, Artificial Sequence
  Description of Artificial Sequence: Synthetic peptide
DEEEIRTTNPVATEQYGSCSTNLQEGSEN

SEQ ID NO: 7116 - protein, 30 aa, Artificial Sequence
  Description of Artificial Sequence: Synthetic polypeptide
DEEEIRTTNPVATEQYGSCSTNLQDQGNEE

SEQ ID NO: 7117 - protein, 30 aa, Artificial Sequence
  Description of Artificial Sequence: Synthetic polypeptide
GEFEIRTTNPVATEQYGSVSTNLQPRGDER

SEQ ID NO: 7118 - protein, 28 aa, Artificial Sequence
  Description of Artificial Sequence: Synthetic peptide
DTEEIRTTNPGATEAYGSVSFNLQRENR

SEQ ID NO: 7119 - protein, 28 aa, Artificial Sequence
  Description of Artificial Sequence: Synthetic peptide
DTEEIRTTNPFATEHYGSVSENLQRENR

SEQ ID NO: 7120 - protein, 28 aa, Artificial Sequence
  Description of Artificial Sequence: Synthetic peptide
DECEIATTNPVATEQYGSVSTNLPMGNT

SEQ ID NO: 7121 - protein, 28 aa, Artificial Sequence
  Description of Artificial Sequence: Synthetic peptide
DEEEIRTTNPVATEQYGSCSTNLNREDD

SEQ ID NO: 7122 - protein, 29 aa, Artificial Sequence
  Description of Artificial Sequence: Synthetic peptide
DECEIATTNPVATEQYGSVSTNLMQDGNT

SEQ ID NO: 7123 - protein, 31 aa, Artificial Sequence
  Description of Artificial Sequence: Synthetic polypeptide
DEEEIRTTNPVATEQYGKTVSTNLSQAGNQR

SEQ ID NO: 7124 - protein, 29 aa, Artificial Sequence
  Description of Artificial Sequence: Synthetic peptide
DECEIRTTNPVATEQYGSVSTNLNMGDER

SEQ ID NO: 7125 - protein, 30 aa, Artificial Sequence
  Description of Artificial Sequence: Synthetic polypeptide
DEEEIRATNPVATEQYGVVSMTNLNQGGNR

SEQ ID NO: 7126 - protein, 32 aa, Artificial Sequence
  Description of Artificial Sequence: Synthetic polypeptide
NEEEIRTTNPVATEQYGSVSTSNLMQRGENAR

SEQ ID NO: 7127 - protein, 30 aa, Artificial Sequence
  Description of Artificial Sequence: Synthetic polypeptide
DEEEIRTTNPVATEQYGNTTSTNELQRGPR

SEQ ID NO: 7128 - protein, 31 aa, Artificial Sequence
  Description of Artificial Sequence: Synthetic polypeptide
DECEIRTTNPVATEQYGSVSTNLNQDGADNR

SEQ ID NO: 7129 - protein, 29 aa, Artificial Sequence
  Description of Artificial Sequence: Synthetic peptide
DEEEIRTTNPVATEQYGSCSTNLPREGDI

SEQ ID NO: 7130 - protein, 30 aa, Artificial Sequence
  Description of Artificial Sequence: Synthetic polypeptide
DEEEIRCTNPVATEQYGSVSEINLPMRGNR

SEQ ID NO: 7131 - protein, 28 aa, Artificial Sequence
  Description of Artificial Sequence: Synthetic peptide
DECEIATTNPVATEQYGSVSTNLMIGNT

SEQ ID NO: 7132 - protein, 30 aa, Artificial Sequence
  Description of Artificial Sequence: Synthetic polypeptide
DEEEIRATNPVATEQYGSVSTNLIQTGNFV

SEQ ID NO: 7133 - protein, 29 aa, Artificial Sequence
  Description of Artificial Sequence: Synthetic peptide
DEEEIRTTNPVATEQYGSCSTNLVRDDGR

SEQ ID NO: 7134 - protein, 31 aa, Artificial Sequence
  Description of Artificial Sequence: Synthetic polypeptide
DEEEIRTTNPVATEQYGNVSCTNLSQHGNRP

SEQ ID NO: 7135 - protein, 32 aa, Artificial Sequence
  Description of Artificial Sequence: Synthetic polypeptide
DEEEIRTTNPVATEQYGISVCSTNDQRGNFRT

SEQ ID NO: 7136 - protein, 28 aa, Artificial Sequence
  Description of Artificial Sequence: Synthetic peptide
DEEEIRTTNPVATEQYGSVSTNISVINQ

SEQ ID NO: 7137 - protein, 29 aa, Artificial Sequence
  Description of Artificial Sequence: Synthetic peptide
HENEIRTTNPVATEQYGTFVSTNLQYGNR

SEQ ID NO: 7138 - protein, 31 aa, Artificial Sequence
  Description of Artificial Sequence: Synthetic polypeptide
DEEEIRTTNPVATEQYGSVSTNISVRGGNPR

SEQ ID NO: 7139 - protein, 30 aa, Artificial Sequence
  Description of Artificial Sequence: Synthetic polypeptide
DEEEIRTTNPVATEQYGSACTNLQTGNLRE

SEQ ID NO: 7140 - protein, 33 aa, Artificial Sequence
  Description of Artificial Sequence: Synthetic polypeptide
DEEEIRTTNPVATEQYGISVSTGNALSQRGDNR

SEQ ID NO: 7141 - protein, 32 aa, Artificial Sequence
  Description of Artificial Sequence: Synthetic polypeptide
DEEEIRTTNPVATEQYGISVSTNALSQMGSNR

SEQ ID NO: 7142 - protein, 32 aa, Artificial Sequence
  Description of Artificial Sequence: Synthetic polypeptide
DEEEIRTTNPVATEQYGISVSTNALSQRVENR

SEQ ID NO: 7143 - protein, 31 aa, Artificial Sequence
  Description of Artificial Sequence: Synthetic polypeptide
DEEEIRATNPVATEQYGSVSTNLQRGPNVEQ

SEQ ID NO: 7144 - protein, 30 aa, Artificial Sequence
  Description of Artificial Sequence: Synthetic polypeptide
AEEEIRTTNPVATEQYGWVCSTNLQRGNQN

SEQ ID NO: 7145 - protein, 30 aa, Artificial Sequence
  Description of Artificial Sequence: Synthetic polypeptide
DEEEIRATNPVATEQYGSVSTNLQRVGGQE

SEQ ID NO: 7146 - protein, 28 aa, Artificial Sequence
  Description of Artificial Sequence: Synthetic peptide
DEEEIRATNPVATEQYGSVSTNLTRNTQ

SEQ ID NO: 7147 - protein, 31 aa, Artificial Sequence
  Description of Artificial Sequence: Synthetic polypeptide
DEEEIRCTNPVATEQYGSVSSTENLNRGNPR

SEQ ID NO: 7148 - protein, 28 aa, Artificial Sequence
  Description of Artificial Sequence: Synthetic peptide
AEEEIRTTNPVATESYGSVDTNLGQGNR

SEQ ID NO: 7149 - protein, 28 aa, Artificial Sequence
  Description of Artificial Sequence: Synthetic peptide
HEREIRTTNPVATEQYGSVNTNLQIGSR

SEQ ID NO: 7150 - protein, 28 aa, Artificial Sequence
  Description of Artificial Sequence: Synthetic peptide
DECEIRTVNPVSTEQYGSVSTNLQQLNR

SEQ ID NO: 7151 - protein, 29 aa, Artificial Sequence
  Description of Artificial Sequence: Synthetic peptide
AEEEIRTTNPVATESYGSVQSTNLQGGNG

SEQ ID NO: 7152 - protein, 29 aa, Artificial Sequence
  Description of Artificial Sequence: Synthetic peptide
DEEEIRATNPVATEQYGSVSTNQQDGNQM

SEQ ID NO: 7153 - protein, 28 aa, Artificial Sequence
  Description of Artificial Sequence: Synthetic peptide
AEEEIRTTNPVATESYGSVSNNLQDSNR

SEQ ID NO: 7154 - protein, 30 aa, Artificial Sequence
  Description of Artificial Sequence: Synthetic polypeptide
DEEEIRTTNPVATEQYGSVSTNLQRIETTF

SEQ ID NO: 7155 - protein, 31 aa, Artificial Sequence
  Description of Artificial Sequence: Synthetic polypeptide
DEEEIRTTNPVATEQYGSVSTNLQRIENNGS

SEQ ID NO: 7156 - protein, 30 aa, Artificial Sequence
  Description of Artificial Sequence: Synthetic polypeptide
DEEEIRTTNPVATEQYGSVSTNLQRIAEVY

SEQ ID NO: 7157 - protein, 30 aa, Artificial Sequence
  Description of Artificial Sequence: Synthetic polypeptide
DEEEIRATNPVATEQYGSVSTPLQRPGNED

SEQ ID NO: 7158 - protein, 30 aa, Artificial Sequence
  Description of Artificial Sequence: Synthetic polypeptide
DEEEIRTTNPVATEQYGSCSTNYLQNGQER

SEQ ID NO: 7159 - protein, 31 aa, Artificial Sequence
  Description of Artificial Sequence: Synthetic polypeptide
DEEEIRTTNPVATEQYGSVSTNLQFSGPNIQ

SEQ ID NO: 7160 - protein, 29 aa, Artificial Sequence
  Description of Artificial Sequence: Synthetic peptide
DTDEIRTTNPVATEQYGSVSTNTLQLGMR

SEQ ID NO: 7161 - protein, 30 aa, Artificial Sequence
  Description of Artificial Sequence: Synthetic polypeptide
DEEEIRTTNPVATEQYGSVSTNLANGQNGN

SEQ ID NO: 7162 - protein, 31 aa, Artificial Sequence
  Description of Artificial Sequence: Synthetic polypeptide
DEEEIRTTNPVATEQYGSVSTNLQFSGQNVA

SEQ ID NO: 7163 - protein, 29 aa, Artificial Sequence
  Description of Artificial Sequence: Synthetic peptide
DEEEIRATNPVATEQYGSVSTSLQGGNED

SEQ ID NO: 7164 - protein, 30 aa, Artificial Sequence
  Description of Artificial Sequence: Synthetic polypeptide
HEEEIRTTNPVATEQYGSVSTNLQRVTNQY

SEQ ID NO: 7165 - protein, 29 aa, Artificial Sequence
  Description of Artificial Sequence: Synthetic peptide
DECEIRTTNPVAYEQYGSVSTNLQGGNED

SEQ ID NO: 7166 - protein, 29 aa, Artificial Sequence
  Description of Artificial Sequence: Synthetic peptide
AEEEIRTTNPVATESYGSVSSGNLQRGNQ

SEQ ID NO: 7167 - protein, 30 aa, Artificial Sequence
  Description of Artificial Sequence: Synthetic polypeptide
DEEEIRTTNPVATEQYGSVSTNIQVNGQNM

SEQ ID NO: 7168 - protein, 31 aa, Artificial Sequence
  Description of Artificial Sequence: Synthetic polypeptide
DEEEIRTTNPVATEQYGHVSWTNLERNGMNR

SEQ ID NO: 7169 - protein, 31 aa, Artificial Sequence
  Description of Artificial Sequence: Synthetic polypeptide
DEEEIRATNPVATEQYGSVSTNLQAGSNDRQ

SEQ ID NO: 7170 - protein, 29 aa, Artificial Sequence
  Description of Artificial Sequence: Synthetic peptide
DEEEIRCTNPVATEQYGSVSTGLQNDGNQ

SEQ ID NO: 7171 - protein, 30 aa, Artificial Sequence
  Description of Artificial Sequence: Synthetic polypeptide
DEEEIRATNPVATEQYGSVSTNLQDGEGRP

SEQ ID NO: 7172 - protein, 30 aa, Artificial Sequence
  Description of Artificial Sequence: Synthetic polypeptide
DEEEIRTTNPVATEQYGSVSTNIQHDSGNQ

SEQ ID NO: 7173 - protein, 30 aa, Artificial Sequence
  Description of Artificial Sequence: Synthetic polypeptide
DEEEIRATNPVATEQYGSVSTNLQDGEPRN

SEQ ID NO: 7174 - protein, 30 aa, Artificial Sequence
  Description of Artificial Sequence: Synthetic polypeptide
DEEEIRATNPVATEQYGSVSTNLQNGDNEN

SEQ ID NO: 7175 - protein, 30 aa, Artificial Sequence
  Description of Artificial Sequence: Synthetic polypeptide
DEEEIRATNPVATEQYGSVSTNLQNGENAE

SEQ ID NO: 7176 - protein, 29 aa, Artificial Sequence
  Description of Artificial Sequence: Synthetic peptide
DEEEIRTTNPVATEQYGSAATNLQRGDQD

SEQ ID NO: 7177 - protein, 30 aa, Artificial Sequence
  Description of Artificial Sequence: Synthetic polypeptide
QEEEIATTNPVATEQYGSVSGTNLQNGNRQ

SEQ ID NO: 7178 - protein, 28 aa, Artificial Sequence
  Description of Artificial Sequence: Synthetic peptide
IEEEIRTTNPVATEQYGSVATWLQNGFR

SEQ ID NO: 7179 - protein, 30 aa, Artificial Sequence
  Description of Artificial Sequence: Synthetic polypeptide
DEEEIRTTNPVATEQYGSVSTNLQRLQPEE

SEQ ID NO: 7180 - protein, 29 aa, Artificial Sequence
  Description of Artificial Sequence: Synthetic peptide
DEEEIRTTNPVATEQYGSAATNLQRGLLQ

SEQ ID NO: 7181 - protein, 30 aa, Artificial Sequence
  Description of Artificial Sequence: Synthetic polypeptide
DEEEIRTTNPVATEQYGSVSTNIQHGGGNS

SEQ ID NO: 7182 - protein, 30 aa, Artificial Sequence
  Description of Artificial Sequence: Synthetic polypeptide
DEEEIRATNPVATEQYGSVSTNLQQGANEE

SEQ ID NO: 7183 - protein, 30 aa, Artificial Sequence
  Description of Artificial Sequence: Synthetic polypeptide
DEEEIRTTNPVATEQYGSACSTNLQRVNLG

SEQ ID NO: 7184 - protein, 30 aa, Artificial Sequence
  Description of Artificial Sequence: Synthetic polypeptide
DEEEIRATNPVATEQYGSVSTNLQQGENDN

SEQ ID NO: 7185 - protein, 30 aa, Artificial Sequence
  Description of Artificial Sequence: Synthetic polypeptide
DEEEIRATNPVATEQYGSVSTNLQQGGNEI

SEQ ID NO: 7186 - protein, 30 aa, Artificial Sequence
  Description of Artificial Sequence: Synthetic polypeptide
DEEEIRTTNPVATEQYGSVSTNIQQINEFR

SEQ ID NO: 7187 - protein, 30 aa, Artificial Sequence
  Description of Artificial Sequence: Synthetic polypeptide
DEEEIRTTNPVATEQYGNVSTENLQFGNGP

SEQ ID NO: 7188 - protein, 28 aa, Artificial Sequence
  Description of Artificial Sequence: Synthetic peptide
IEEEIRCTNPIATEQYGSVSENLMRGNR

SEQ ID NO: 7189 - protein, 28 aa, Artificial Sequence
  Description of Artificial Sequence: Synthetic peptide
DECEIVTTNPVATEQYGSVSTNLTYGNT

SEQ ID NO: 7190 - protein, 30 aa, Artificial Sequence
  Description of Artificial Sequence: Synthetic polypeptide
DEEEIRATNPVATEQYGSVSTNLQREDDND

SEQ ID NO: 7191 - protein, 31 aa, Artificial Sequence
  Description of Artificial Sequence: Synthetic polypeptide
DEEEIRATNPVATEQYGSVSTNLQRGENGNN

SEQ ID NO: 7192 - protein, 31 aa, Artificial Sequence
  Description of Artificial Sequence: Synthetic polypeptide
DEEEIRATNPVATEQYGSVSTNLQRGENPEQ

SEQ ID NO: 7193 - protein, 31 aa, Artificial Sequence
  Description of Artificial Sequence: Synthetic polypeptide
DEEEIRATNPVATEQYGSVSTNLQRGENPLD

SEQ ID NO: 7194 - protein, 31 aa, Artificial Sequence
  Description of Artificial Sequence: Synthetic polypeptide
DEEEIRATNPVATEQYGSVSTNLQRGENSEM

SEQ ID NO: 7195 - protein, 30 aa, Artificial Sequence
  Description of Artificial Sequence: Synthetic polypeptide
DEEEIRTTNPVATEQYGHVSWDNLTRGMNR

SEQ ID NO: 7196 - protein, 31 aa, Artificial Sequence
  Description of Artificial Sequence: Synthetic polypeptide
DEEEIRTTNPVATEQYGSVSTNLQFGISNIE

SEQ ID NO: 7197 - protein, 31 aa, Artificial Sequence
  Description of Artificial Sequence: Synthetic polypeptide
DEEEIRTTNPVATEQYGHVSWTNLDRGMNPR

SEQ ID NO: 7198 - protein, 30 aa, Artificial Sequence
  Description of Artificial Sequence: Synthetic polypeptide
DEEEIRTTNPVATEQYGHVSWTNLEQGMNR

SEQ ID NO: 7199 - protein, 30 aa, Artificial Sequence
  Description of Artificial Sequence: Synthetic polypeptide
DEEEIRATNPVATEQYGSVSTNLQQGEQRP

SEQ ID NO: 7200 - protein, 30 aa, Artificial Sequence
  Description of Artificial Sequence: Synthetic polypeptide
DEEEIRATNPVATEQYGSVSTTNLQNGNTG

SEQ ID NO: 7201 - protein, 29 aa, Artificial Sequence
  Description of Artificial Sequence: Synthetic peptide
DEEEIRATNPVATEQYGSVSTVLQGGNEG

SEQ ID NO: 7202 - protein, 28 aa, Artificial Sequence
  Description of Artificial Sequence: Synthetic peptide
DEEEIRTTNPVATEQYGSCSTNWDRNNI

SEQ ID NO: 7203 - protein, 31 aa, Artificial Sequence
  Description of Artificial Sequence: Synthetic polypeptide
HEEEIRTTNPVATEQYGSVSTNLQRNNGNFD

SEQ ID NO: 7204 - protein, 30 aa, Artificial Sequence
  Description of Artificial Sequence: Synthetic polypeptide
DEEEIRTTNPVATEQYGSVSTNLQGDDNNV

SEQ ID NO: 7205 - protein, 30 aa, Artificial Sequence
  Description of Artificial Sequence: Synthetic polypeptide
DEEEIRTTNPVATEQYGIVSTNLQDGDNPF

SEQ ID NO: 7206 - protein, 30 aa, Artificial Sequence
  Description of Artificial Sequence: Synthetic polypeptide
DEEEIRTTNPVATEQYGIVSTNLQDGGNNA

SEQ ID NO: 7207 - protein, 29 aa, Artificial Sequence
  Description of Artificial Sequence: Synthetic peptide
AEEEIRTTNPVATESYGSVSTTNLQQGNT

SEQ ID NO: 7208 - protein, 31 aa, Artificial Sequence
  Description of Artificial Sequence: Synthetic polypeptide
DEEEIRTTNPVATEQYGIVSTNLQREGSNNQ

SEQ ID NO: 7209 - protein, 31 aa, Artificial Sequence
  Description of Artificial Sequence: Synthetic polypeptide
DEEEIRTTNPVATEQYGSVSTNLQGDGDNEF

SEQ ID NO: 7210 - protein, 30 aa, Artificial Sequence
  Description of Artificial Sequence: Synthetic polypeptide
HEEEIRTTNPVATEQYGSVSTNLQRNENFM

SEQ ID NO: 7211 - protein, 29 aa, Artificial Sequence
  Description of Artificial Sequence: Synthetic peptide
DTEEIRATNPVATEQYGSVSSTNQQRGNV

SEQ ID NO: 7212 - protein, 30 aa, Artificial Sequence
  Description of Artificial Sequence: Synthetic polypeptide
HEEEIRTTNPVATEQYGSVSTNLQRNDNFG

SEQ ID NO: 7213 - protein, 30 aa, Artificial Sequence
  Description of Artificial Sequence: Synthetic polypeptide
AEEEIRTTNPVATESYGSVSTVNLQPGENR

SEQ ID NO: 7214 - protein, 30 aa, Artificial Sequence
  Description of Artificial Sequence: Synthetic polypeptide
DEEEIRTTNPVATEQYGSVSTNLARDDIRS

SEQ ID NO: 7215 - protein, 31 aa, Artificial Sequence
  Description of Artificial Sequence: Synthetic polypeptide
DEEEIRTTNPVATEQYGIVTTSTNELQRGNG

SEQ ID NO: 7216 - protein, 31 aa, Artificial Sequence
  Description of Artificial Sequence: Synthetic polypeptide
DEEEIRTTNPVATEQYGKISTNLSQRGGNER

SEQ ID NO: 7217 - protein, 30 aa, Artificial Sequence
  Description of Artificial Sequence: Synthetic polypeptide
DEEEIRTTNPVATEQYGSCSTNNQRGNEEF

SEQ ID NO: 7218 - protein, 30 aa, Artificial Sequence
  Description of Artificial Sequence: Synthetic polypeptide
HEEEIRTTNPVATEQYGSVSTNLQRNDNDQ

SEQ ID NO: 7219 - protein, 30 aa, Artificial Sequence
  Description of Artificial Sequence: Synthetic polypeptide
HEEEIRTTNPVATEQYGSVSTNLQRNANVD

SEQ ID NO: 7220 - protein, 29 aa, Artificial Sequence
  Description of Artificial Sequence: Synthetic peptide
DEEEIRTTNPVATEQYGSCSTNMQQGNEE

SEQ ID NO: 7221 - protein, 30 aa, Artificial Sequence
  Description of Artificial Sequence: Synthetic polypeptide
HEEEIRTTNPVATEQYGSVSTNLQRNANAD

SEQ ID NO: 7222 - protein, 30 aa, Artificial Sequence
  Description of Artificial Sequence: Synthetic polypeptide
DEEEIRTTNPVATEQYGKTISTDELQRGNR

SEQ ID NO: 7223 - protein, 30 aa, Artificial Sequence
  Description of Artificial Sequence: Synthetic polypeptide
DEEEIRTTNPVATEQYGKTPSTNELQNGNR

SEQ ID NO: 7224 - protein, 30 aa, Artificial Sequence
  Description of Artificial Sequence: Synthetic polypeptide
DEEEIRTTNPVATEQYGSVSTNLARGGETQ

SEQ ID NO: 7225 - protein, 30 aa, Artificial Sequence
  Description of Artificial Sequence: Synthetic polypeptide
HEEEIRTTNPVATEQYGSVSTNLQRMSNFY

SEQ ID NO: 7226 - protein, 29 aa, Artificial Sequence
  Description of Artificial Sequence: Synthetic peptide
DEEEIRTTNPVATEQYGSVSTNLGNGDGE

SEQ ID NO: 7227 - protein, 30 aa, Artificial Sequence
  Description of Artificial Sequence: Synthetic polypeptide
DEEEIRTTNPVATEQYGSVSTNLGLDSGNV

SEQ ID NO: 7228 - protein, 28 aa, Artificial Sequence
  Description of Artificial Sequence: Synthetic peptide
DECEIRTTNPVATEQYGVVSTYLQRPNV

SEQ ID NO: 7229 - protein, 30 aa, Artificial Sequence
  Description of Artificial Sequence: Synthetic polypeptide
AEEEIRTTNPVATEQYGSVVTVNLQMGDNR

SEQ ID NO: 7230 - protein, 28 aa, Artificial Sequence
  Description of Artificial Sequence: Synthetic peptide
DECEIRTTNPVATEQYGVVSTTLQRSNT

SEQ ID NO: 7231 - protein, 31 aa, Artificial Sequence
  Description of Artificial Sequence: Synthetic polypeptide
DEEEIRTTNPVATEQYGKTVSTNALQRGNLT

SEQ ID NO: 7232 - protein, 31 aa, Artificial Sequence
  Description of Artificial Sequence: Synthetic polypeptide
DEEEIRTTNPVATEQYGSVSTNLGGPGDNQR

SEQ ID NO: 7233 - protein, 30 aa, Artificial Sequence
  Description of Artificial Sequence: Synthetic polypeptide
DEEEIRTTNPVATEQYGSVSTNLGQNGIGD

SEQ ID NO: 7234 - protein, 30 aa, Artificial Sequence
  Description of Artificial Sequence: Synthetic polypeptide
DEEEIRTTNPVATEQYGSCSTNNQRGNNGS

SEQ ID NO: 7235 - protein, 29 aa, Artificial Sequence
  Description of Artificial Sequence: Synthetic peptide
DTEEIRATNPVATEQYGSVSATNNQRGNN

SEQ ID NO: 7236 - protein, 30 aa, Artificial Sequence
  Description of Artificial Sequence: Synthetic polypeptide
HEEEIRTTNPVATEQYGSVSTNLQRNNNDY

SEQ ID NO: 7237 - protein, 30 aa, Artificial Sequence
  Description of Artificial Sequence: Synthetic polypeptide
AEEEIRTTNPVATESYGSVSSTNLQRGNNQ

SEQ ID NO: 7238 - protein, 29 aa, Artificial Sequence
  Description of Artificial Sequence: Synthetic peptide
DEEEIRTTNPVATEQYGSCSTNVQEYGNT

SEQ ID NO: 7239 - protein, 30 aa, Artificial Sequence
  Description of Artificial Sequence: Synthetic polypeptide
DEEEIRTTNPVATEQYGSCSTNTLQPGQDR

SEQ ID NO: 7240 - protein, 31 aa, Artificial Sequence
  Description of Artificial Sequence: Synthetic polypeptide
DEEEIRTTNPVATEQYGSCSTNQQRDGDNRM

SEQ ID NO: 7241 - protein, 29 aa, Artificial Sequence
  Description of Artificial Sequence: Synthetic peptide
AEEEIRTTNPVATESYGSVSTGNLQVGDR

SEQ ID NO: 7242 - protein, 28 aa, Artificial Sequence
  Description of Artificial Sequence: Synthetic peptide
DTEEIATTNPVATAQYGSVSTNDDRGNR

SEQ ID NO: 7243 - protein, 29 aa, Artificial Sequence
  Description of Artificial Sequence: Synthetic peptide
AEEEIRTTNPVATESYGSVSTNLAGGNQR

SEQ ID NO: 7244 - protein, 29 aa, Artificial Sequence
  Description of Artificial Sequence: Synthetic peptide
DEEEIRTTNPVATEQYGSCSTNPQYGNGE

SEQ ID NO: 7245 - protein, 30 aa, Artificial Sequence
  Description of Artificial Sequence: Synthetic polypeptide
AEEEIRTTNPVATESYGSVSTNLLQMGGNR

SEQ ID NO: 7246 - protein, 30 aa, Artificial Sequence
  Description of Artificial Sequence: Synthetic polypeptide
DEEEIRTTNPVATEQYGSCSTNPQRGNNMM

SEQ ID NO: 7247 - protein, 28 aa, Artificial Sequence
  Description of Artificial Sequence: Synthetic peptide
AEEEIRTTNPVATESYGSVSTNLQGGLQ

SEQ ID NO: 7248 - protein, 29 aa, Artificial Sequence
  Description of Artificial Sequence: Synthetic peptide
DEEEIRTTNPVATEQYGSCSTNPQAGNEF

SEQ ID NO: 7249 - protein, 28 aa, Artificial Sequence
  Description of Artificial Sequence: Synthetic peptide
AEEEIRTTNPVATESYGSVSTNLQIGEL

SEQ ID NO: 7250 - protein, 31 aa, Artificial Sequence
  Description of Artificial Sequence: Synthetic polypeptide
DEEEIRTTNPVATEQYGIVSDTNLNRGMNNR

SEQ ID NO: 7251 - protein, 28 aa, Artificial Sequence
  Description of Artificial Sequence: Synthetic peptide
AEEEIRTTNPVATESYGSVSTNLQIGGP

SEQ ID NO: 7252 - protein, 28 aa, Artificial Sequence
  Description of Artificial Sequence: Synthetic peptide
DEEEIRTTNPVATEQYGSAETNEQRGDF

SEQ ID NO: 7253 - protein, 30 aa, Artificial Sequence
  Description of Artificial Sequence: Synthetic polypeptide
AEEEIRTTNPVATESYGSVSTNLQQGGNAR

SEQ ID NO: 7254 - protein, 29 aa, Artificial Sequence
  Description of Artificial Sequence: Synthetic peptide
DTEEIRATNPVATEQYGSVISTNLQNGTR

SEQ ID NO: 7255 - protein, 29 aa, Artificial Sequence
  Description of Artificial Sequence: Synthetic peptide
DTEEIRATNPVATEQYGSTVSTNLQHGTR

SEQ ID NO: 7256 - protein, 30 aa, Artificial Sequence
  Description of Artificial Sequence: Synthetic polypeptide
DEEEIRTTNPVATEQYGSCSTNNQRGNTEQ

SEQ ID NO: 7257 - protein, 32 aa, Artificial Sequence
  Description of Artificial Sequence: Synthetic polypeptide
DEEEIRTTNPVATEQYGSVSTNLQGDAGNNER

SEQ ID NO: 7258 - protein, 28 aa, Artificial Sequence
  Description of Artificial Sequence: Synthetic peptide
DTEEIRATNPVATEQYGSTSTNMQRGND

SEQ ID NO: 7259 - protein, 30 aa, Artificial Sequence
  Description of Artificial Sequence: Synthetic polypeptide
AEEEIRTTNPVATESYGSVSTNQLQMGNIR

SEQ ID NO: 7260 - protein, 28 aa, Artificial Sequence
  Description of Artificial Sequence: Synthetic peptide
DECEIRTTNPVATEQYGVVSTSLQRMND

SEQ ID NO: 7261 - protein, 29 aa, Artificial Sequence
  Description of Artificial Sequence: Synthetic peptide
DTEEIRATNPVATEQYGSSVSTNLQNGDR

SEQ ID NO: 7262 - protein, 29 aa, Artificial Sequence
  Description of Artificial Sequence: Synthetic peptide
AEEEIRTTNPVATESYGSVSTNLQTMGNG

SEQ ID NO: 7263 - protein, 28 aa, Artificial Sequence
  Description of Artificial Sequence: Synthetic peptide
DTEEIRATNPVATEQYGSSSTNMQRGNN

SEQ ID NO: 7264 - protein, 28 aa, Artificial Sequence
  Description of Artificial Sequence: Synthetic peptide
DTEEIRATNPVATEQYGSSSTNMQRGNE

SEQ ID NO: 7265 - protein, 28 aa, Artificial Sequence
  Description of Artificial Sequence: Synthetic peptide
DTEEIRATNPVATEQYGSNSTNNQRGNN

SEQ ID NO: 7266 - protein, 29 aa, Artificial Sequence
  Description of Artificial Sequence: Synthetic peptide
AEEEIRTTNPVATESYGSVSTNLQTIGND

SEQ ID NO: 7267 - protein, 31 aa, Artificial Sequence
  Description of Artificial Sequence: Synthetic polypeptide
DEEEIRTTNPVATEQYGIVSGTNLQRNGNNA

SEQ ID NO: 7268 - protein, 31 aa, Artificial Sequence
  Description of Artificial Sequence: Synthetic polypeptide
HEEEIRTTNPVATEQYGSVSTNLQRTVGNNS

SEQ ID NO: 7269 - protein, 30 aa, Artificial Sequence
  Description of Artificial Sequence: Synthetic polypeptide
DEEEIRTTNPVATEQYGSCSTNDPDQGGNR

SEQ ID NO: 7270 - protein, 28 aa, Artificial Sequence
  Description of Artificial Sequence: Synthetic peptide
DEREIRTTNPVATEQYGATSTNLQRGTS

SEQ ID NO: 7271 - protein, 29 aa, Artificial Sequence
  Description of Artificial Sequence: Synthetic peptide
DEEEIRTTNPVATEQYGSVSTNLTRTSDD

SEQ ID NO: 7272 - protein, 28 aa, Artificial Sequence
  Description of Artificial Sequence: Synthetic peptide
DEEQIRTTNPVATEQYGSVSTGELRGNE

SEQ ID NO: 7273 - protein, 31 aa, Artificial Sequence
  Description of Artificial Sequence: Synthetic polypeptide
DEEEIRTTNPVATEQYGSVSVTMLLQRSENR

SEQ ID NO: 7274 - protein, 28 aa, Artificial Sequence
  Description of Artificial Sequence: Synthetic peptide
DEEQIRTTNPVATEQYGSVSTFELQGNT

SEQ ID NO: 7275 - protein, 28 aa, Artificial Sequence
  Description of Artificial Sequence: Synthetic peptide
DEEQIRTTNPVATEQYGSVSTETLRGNT

SEQ ID NO: 7276 - protein, 29 aa, Artificial Sequence
  Description of Artificial Sequence: Synthetic peptide
DEEQIRTTNPVATEQYGSVSTEHNLRGNT

SEQ ID NO: 7277 - protein, 28 aa, Artificial Sequence
  Description of Artificial Sequence: Synthetic peptide
DEEQIRTTNPVATEQYGSVSTEEVRGNT

SEQ ID NO: 7278 - protein, 28 aa, Artificial Sequence
  Description of Artificial Sequence: Synthetic peptide
DEEQIRTTNPVATEQYGSVSTEDERGNT

SEQ ID NO: 7279 - protein, 28 aa, Artificial Sequence
  Description of Artificial Sequence: Synthetic peptide
DEEQIRTTNPVATEQYGSVSTDEGRGNT

SEQ ID NO: 7280 - protein, 31 aa, Artificial Sequence
  Description of Artificial Sequence: Synthetic polypeptide
DEEEIRTTNPVATEQYGSVESTNFIQTVGNR

SEQ ID NO: 7281 - protein, 32 aa, Artificial Sequence
  Description of Artificial Sequence: Synthetic polypeptide
DEEEIRTTNPVATEQYGSVESTNGLDQRGDRI

SEQ ID NO: 7282 - protein, 31 aa, Artificial Sequence
  Description of Artificial Sequence: Synthetic polypeptide
DEEEIRTTNPVATEQYGSVSVTNDLQLGLLR

SEQ ID NO: 7283 - protein, 31 aa, Artificial Sequence
  Description of Artificial Sequence: Synthetic polypeptide
DEEEIRTTNPVATEQYGSVESTNLQNNGNGT

SEQ ID NO: 7284 - protein, 31 aa, Artificial Sequence
  Description of Artificial Sequence: Synthetic polypeptide
DEEEIRTTNPVATEQYGSVESTNLQNVGQNG

SEQ ID NO: 7285 - protein, 31 aa, Artificial Sequence
  Description of Artificial Sequence: Synthetic polypeptide
DEEEIRTTNPVATEQYGSVESTENLQRLNIS

SEQ ID NO: 7286 - protein, 31 aa, Artificial Sequence
  Description of Artificial Sequence: Synthetic polypeptide
DEEEIRTTNPVATEQYGSVESTNLQPGMNTD

SEQ ID NO: 7287 - protein, 28 aa, Artificial Sequence
  Description of Artificial Sequence: Synthetic peptide
DEEQIRTTNPVATEQYGCVSTNTQFGNQ

SEQ ID NO: 7288 - protein, 28 aa, Artificial Sequence
  Description of Artificial Sequence: Synthetic peptide
DEEQIRTTNPVATEQYGCVSTNSQFGNQ

SEQ ID NO: 7289 - protein, 28 aa, Artificial Sequence
  Description of Artificial Sequence: Synthetic peptide
DEEQIRTTNPVATEQYGCVSTNGQFGNQ

SEQ ID NO: 7290 - protein, 31 aa, Artificial Sequence
  Description of Artificial Sequence: Synthetic polypeptide
DEEEIRTTNPVATEQYGSVSVTNDLQRNENL

SEQ ID NO: 7291 - protein, 30 aa, Artificial Sequence
  Description of Artificial Sequence: Synthetic polypeptide
DEEEIRTTNPVATEQYGSVSVTNDQRGPFP

SEQ ID NO: 7292 - protein, 30 aa, Artificial Sequence
  Description of Artificial Sequence: Synthetic polypeptide
DEEEIRTTNPVATEQYGSVSVTNEQRGPQN

SEQ ID NO: 7293 - protein, 30 aa, Artificial Sequence
  Description of Artificial Sequence: Synthetic polypeptide
DEEEIRTTNPVATEQYGSVSVTNGAQRGPD

SEQ ID NO: 7294 - protein, 31 aa, Artificial Sequence
  Description of Artificial Sequence: Synthetic polypeptide
DEEEIRTTNPVATEQYGSVESTNLVQEDGND

SEQ ID NO: 7295 - protein, 30 aa, Artificial Sequence
  Description of Artificial Sequence: Synthetic polypeptide
DEEEIRTTNPVATEQYGSVSANLQRDGTIL

SEQ ID NO: 7296 - protein, 30 aa, Artificial Sequence
  Description of Artificial Sequence: Synthetic polypeptide
DEEEIRTTNPVATEQYGSVESTQDQRGNND

SEQ ID NO: 7297 - protein, 30 aa, Artificial Sequence
  Description of Artificial Sequence: Synthetic polypeptide
DEEEIRTTNPVATEQYGSVSVTNIGQRGKF

SEQ ID NO: 7298 - protein, 29 aa, Artificial Sequence
  Description of Artificial Sequence: Synthetic peptide
DEEEIRTTNPVATEQYGSVETALQRGAGD

SEQ ID NO: 7299 - protein, 30 aa, Artificial Sequence
  Description of Artificial Sequence: Synthetic polypeptide
DEEEIRTTNPVATEQYGSVETDLQRIGNQQ

SEQ ID NO: 7300 - protein, 32 aa, Artificial Sequence
  Description of Artificial Sequence: Synthetic polypeptide
DEEEIRTTNPVATEQYGSVSVTNDLQRGANDP

SEQ ID NO: 7301 - protein, 31 aa, Artificial Sequence
  Description of Artificial Sequence: Synthetic polypeptide
DEEEIRTTNPVATEQYGSVSVTNLDGRSNFR

SEQ ID NO: 7302 - protein, 31 aa, Artificial Sequence
  Description of Artificial Sequence: Synthetic polypeptide
DEEEIRTTNPVATEQYGSVESTELQRGPERG

SEQ ID NO: 7303 - protein, 30 aa, Artificial Sequence
  Description of Artificial Sequence: Synthetic polypeptide
DEEEIRTTNPVATEQYGSVSVTLPLQRGVT

SEQ ID NO: 7304 - protein, 30 aa, Artificial Sequence
  Description of Artificial Sequence: Synthetic polypeptide
DEEEIRTTNPVATEQYGSVSANQQNGNDRE

SEQ ID NO: 7305 - protein, 29 aa, Artificial Sequence
  Description of Artificial Sequence: Synthetic peptide
DEEEIRTTNPVATEQYGSVSANPQEGGNT

SEQ ID NO: 7306 - protein, 29 aa, Artificial Sequence
  Description of Artificial Sequence: Synthetic peptide
DEEEIRTTNPVATEQYGSVSANNQEGNIA

SEQ ID NO: 7307 - protein, 31 aa, Artificial Sequence
  Description of Artificial Sequence: Synthetic polypeptide
DEEEIRTTNPVATEQYGSVSANNLQRGNEQG

SEQ ID NO: 7308 - protein, 30 aa, Artificial Sequence
  Description of Artificial Sequence: Synthetic polypeptide
DEEEIRTTNPVATEQYGSVSVTDNLNRGDQ

SEQ ID NO: 7309 - protein, 30 aa, Artificial Sequence
  Description of Artificial Sequence: Synthetic polypeptide
DEEEIRTTNPVATEQYGSVSVTDTDRGNNR

SEQ ID NO: 7310 - protein, 30 aa, Artificial Sequence
  Description of Artificial Sequence: Synthetic polypeptide
DEEEIRTTNPVATEQYGSVSANLVRGPIRE

SEQ ID NO: 7311 - protein, 30 aa, Artificial Sequence
  Description of Artificial Sequence: Synthetic polypeptide
DEEEIRTTNPVATEQYGSVSANLQRIVNVH

SEQ ID NO: 7312 - protein, 29 aa, Artificial Sequence
  Description of Artificial Sequence: Synthetic peptide
DEEEIRTTNPVATEQYGSVSANLQRISID

SEQ ID NO: 7313 - protein, 30 aa, Artificial Sequence
  Description of Artificial Sequence: Synthetic polypeptide
DEEEIRTTNPVATEQYGSVSANLQRGSDIY

SEQ ID NO: 7314 - protein, 31 aa, Artificial Sequence
  Description of Artificial Sequence: Synthetic polypeptide
DEEEIRTTNPVATEQYGSVSVTGLQGGQNRD

SEQ ID NO: 7315 - protein, 31 aa, Artificial Sequence
  Description of Artificial Sequence: Synthetic polypeptide
DEEEIRTTNPVATEQYGSVSVTGNLQRQLNT

SEQ ID NO: 7316 - protein, 31 aa, Artificial Sequence
  Description of Artificial Sequence: Synthetic polypeptide
DEEEIRTTNPVATEQYGSVSVTILQEGENRQ

SEQ ID NO: 7317 - protein, 28 aa, Artificial Sequence
  Description of Artificial Sequence: Synthetic peptide
DEEQIRTTNPVATEQYGSVSTHEARGNA

SEQ ID NO: 7318 - protein, 28 aa, Artificial Sequence
  Description of Artificial Sequence: Synthetic peptide
DEEQIRTTNPVATEQYGSVSTVYARGNT

SEQ ID NO: 7319 - protein, 28 aa, Artificial Sequence
  Description of Artificial Sequence: Synthetic peptide
DEEQIRTTNPVATEQYGSVSTTELRGNA

SEQ ID NO: 7320 - protein, 28 aa, Artificial Sequence
  Description of Artificial Sequence: Synthetic peptide
DEEQIRTTNPVATEQYGSVSTTEDRGNQ

SEQ ID NO: 7321 - protein, 28 aa, Artificial Sequence
  Description of Artificial Sequence: Synthetic peptide
DEEQIRTTNPVATEQYGSVSTSILRGNT

SEQ ID NO: 7322 - protein, 28 aa, Artificial Sequence
  Description of Artificial Sequence: Synthetic peptide
DEEQIRTTNPVATEQYGSVSTSEERGNT

SEQ ID NO: 7323 - protein, 28 aa, Artificial Sequence
  Description of Artificial Sequence: Synthetic peptide
DEEQIRTTNPVATEQYGSVSTPELRGNE

SEQ ID NO: 7324 - protein, 29 aa, Artificial Sequence
  Description of Artificial Sequence: Synthetic peptide
DEEEIRTTNPVATEQYGSVSVTLERGNEG

SEQ ID NO: 7325 - protein, 30 aa, Artificial Sequence
  Description of Artificial Sequence: Synthetic polypeptide
DEEQIRTTNPVATEQYGSVSTNLYDNGENR

SEQ ID NO: 7326 - protein, 28 aa, Artificial Sequence
  Description of Artificial Sequence: Synthetic peptide
DEEQIRTTNPVATEQYGSVSTLELRGNA

SEQ ID NO: 7327 - protein, 28 aa, Artificial Sequence
  Description of Artificial Sequence: Synthetic peptide
DEEQIRTTNPVATEQYGSVSTLEARGNG

SEQ ID NO: 7328 - protein, 28 aa, Artificial Sequence
  Description of Artificial Sequence: Synthetic peptide
DEEQIRTTNPVATEQYGSVSTHVVRGNT

SEQ ID NO: 7329 - protein, 28 aa, Artificial Sequence
  Description of Artificial Sequence: Synthetic peptide
DEEQIRTTNPVATEQYGSVSTHFGRGNT

SEQ ID NO: 7330 - protein, 28 aa, Artificial Sequence
  Description of Artificial Sequence: Synthetic peptide
DEEQIRTTNPVATEQYGSVSTHENRGNM

SEQ ID NO: 7331 - protein, 29 aa, Artificial Sequence
  Description of Artificial Sequence: Synthetic peptide
DEEEIRTTNPVATEQYGSVESNLQRGEID

SEQ ID NO: 7332 - protein, 28 aa, Artificial Sequence
  Description of Artificial Sequence: Synthetic peptide
DEEQIRTTNPVATEQYGSVSTTELRGNG

SEQ ID NO: 7333 - protein, 31 aa, Artificial Sequence
  Description of Artificial Sequence: Synthetic polypeptide
DEEEIRTTNPVATEQYGSVSVTNLDQLNGND

SEQ ID NO: 7334 - protein, 31 aa, Artificial Sequence
  Description of Artificial Sequence: Synthetic polypeptide
DEEEIRTTNPVATEQYGSVSVTNLDQRTENH

SEQ ID NO: 7335 - protein, 31 aa, Artificial Sequence
  Description of Artificial Sequence: Synthetic polypeptide
DEEEIRTTNPVATEQYGSVSVTNLDRTFNRN

SEQ ID NO: 7336 - protein, 29 aa, Artificial Sequence
  Description of Artificial Sequence: Synthetic peptide
DEENIRTTNPVATEPYGNVTTNLQRGSNR

SEQ ID NO: 7337 - protein, 30 aa, Artificial Sequence
  Description of Artificial Sequence: Synthetic polypeptide
DEEEIRTTNPVATEQYGSVSANLQQGINVD

SEQ ID NO: 7338 - protein, 29 aa, Artificial Sequence
  Description of Artificial Sequence: Synthetic peptide
DEENIRTTNPVATEIYGTVTTNLQRGANR

SEQ ID NO: 7339 - protein, 31 aa, Artificial Sequence
  Description of Artificial Sequence: Synthetic polypeptide
DEEEIRTTNPVATEQYGSVETNLEQERIGER

SEQ ID NO: 7340 - protein, 30 aa, Artificial Sequence
  Description of Artificial Sequence: Synthetic polypeptide
DEEEIRTTNPVATEQYGSVETNLEVRGGNE

SEQ ID NO: 7341 - protein, 29 aa, Artificial Sequence
  Description of Artificial Sequence: Synthetic peptide
DEENIRTTNPVATEIYGEVYTNLQRGSNR

SEQ ID NO: 7342 - protein, 29 aa, Artificial Sequence
  Description of Artificial Sequence: Synthetic peptide
DEAEIRTTNPVATEQYGSVAATNLSRGNE

SEQ ID NO: 7343 - protein, 29 aa, Artificial Sequence
  Description of Artificial Sequence: Synthetic peptide
DEENIRTTNPVATEHYGQVATNLQRGDNR

SEQ ID NO: 7344 - protein, 29 aa, Artificial Sequence
  Description of Artificial Sequence: Synthetic peptide
DEENIRTTNPVATEGYGTVTTNLQRGSNR

SEQ ID NO: 7345 - protein, 29 aa, Artificial Sequence
  Description of Artificial Sequence: Synthetic peptide
DEENIRTTNPVATEAYGVVTTNLQRGVNR

SEQ ID NO: 7346 - protein, 30 aa, Artificial Sequence
  Description of Artificial Sequence: Synthetic polypeptide
DEEEIRTTNPVATEQYGSVETNLNRTGEND

SEQ ID NO: 7347 - protein, 29 aa, Artificial Sequence
  Description of Artificial Sequence: Synthetic peptide
DEEEIRTTNPVATEQYGSVETNLQIGDQG

SEQ ID NO: 7348 - protein, 29 aa, Artificial Sequence
  Description of Artificial Sequence: Synthetic peptide
DEENIRTTNPVATEAYGQVATNLQRGSNR

SEQ ID NO: 7349 - protein, 29 aa, Artificial Sequence
  Description of Artificial Sequence: Synthetic peptide
DEENIRTTNPVATEPYGVVTTNLQRGSNR

SEQ ID NO: 7350 - protein, 30 aa, Artificial Sequence
  Description of Artificial Sequence: Synthetic polypeptide
DEEEIRTTNPVATEQYGSVETNLQQGVFRM

SEQ ID NO: 7351 - protein, 28 aa, Artificial Sequence
  Description of Artificial Sequence: Synthetic peptide
DEENIRATNPVATEQYGSVSWNFQRGNL

SEQ ID NO: 7352 - protein, 31 aa, Artificial Sequence
  Description of Artificial Sequence: Synthetic polypeptide
DEEEIRTTNPVATEQYGSVSVTNLIRGENVI

SEQ ID NO: 7353 - protein, 31 aa, Artificial Sequence
  Description of Artificial Sequence: Synthetic polypeptide
DEEEIRTTNPVATEQYGSVSVTNLIRGMNDQ

SEQ ID NO: 7354 - protein, 29 aa, Artificial Sequence
  Description of Artificial Sequence: Synthetic peptide
DEEEIRTTNPVATEQYGSVETNLQQSNIT

SEQ ID NO: 7355 - protein, 31 aa, Artificial Sequence
  Description of Artificial Sequence: Synthetic polypeptide
DEEEIRTTNPVATEQYGSVETNLQRGELLRQ

SEQ ID NO: 7356 - protein, 31 aa, Artificial Sequence
  Description of Artificial Sequence: Synthetic polypeptide
DEEEIRTTNPVATEQYGSVETNLQRGFNEWD

SEQ ID NO: 7357 - protein, 31 aa, Artificial Sequence
  Description of Artificial Sequence: Synthetic polypeptide
DEEEIRTTNPVATEQYGSVETNLQRGINQEQ

SEQ ID NO: 7358 - protein, 31 aa, Artificial Sequence
  Description of Artificial Sequence: Synthetic polypeptide
DEEEIRTTNPVATEQYGSVETNLQRGNAIDE

SEQ ID NO: 7359 - protein, 31 aa, Artificial Sequence
  Description of Artificial Sequence: Synthetic polypeptide
DEEEIRTTNPVATEQYGSVSVTNLIRGMNGF

SEQ ID NO: 7360 - protein, 30 aa, Artificial Sequence
  Description of Artificial Sequence: Synthetic polypeptide
DEAEIRTTNPVATEQYGSTVSTNLSHTGNR

SEQ ID NO: 7361 - protein, 29 aa, Artificial Sequence
  Description of Artificial Sequence: Synthetic peptide
DDGEIRTTNPVATEQYGSVSTNPLQLGER

SEQ ID NO: 7362 - protein, 31 aa, Artificial Sequence
  Description of Artificial Sequence: Synthetic polypeptide
DEEEIRTTNPVATEQYGSVSVTNLLDQSGSR

SEQ ID NO: 7363 - protein, 30 aa, Artificial Sequence
  Description of Artificial Sequence: Synthetic polypeptide
DEEEIRTTNPVATEQYGSVETNLQRGQADS

SEQ ID NO: 7364 - protein, 28 aa, Artificial Sequence
  Description of Artificial Sequence: Synthetic peptide
DEENIRCTNPVATEQYGSVSPNQQRGNL

SEQ ID NO: 7365 - protein, 28 aa, Artificial Sequence
  Description of Artificial Sequence: Synthetic peptide
DEENIRTTNPVATEQYGCVSTNCQNGNC

SEQ ID NO: 7366 - protein, 28 aa, Artificial Sequence
  Description of Artificial Sequence: Synthetic peptide
DEENIRTTNPVATEQYGCVSTNHQFGNG

SEQ ID NO: 7367 - protein, 28 aa, Artificial Sequence
  Description of Artificial Sequence: Synthetic peptide
DEENIRTTNPVATEQYGCVSTNTQFGNA

SEQ ID NO: 7368 - protein, 30 aa, Artificial Sequence
  Description of Artificial Sequence: Synthetic polypeptide
DEEEIRTTNPVATEQYGSVETGLQRGMPRT

SEQ ID NO: 7369 - protein, 30 aa, Artificial Sequence
  Description of Artificial Sequence: Synthetic polypeptide
DEEEIRTTNPVATEQYGSVETGLQRGNITN

SEQ ID NO: 7370 - protein, 29 aa, Artificial Sequence
  Description of Artificial Sequence: Synthetic peptide
DEAEIRTTNPVATEQYGSVATNMQRGNES

SEQ ID NO: 7371 - protein, 29 aa, Artificial Sequence
  Description of Artificial Sequence: Synthetic peptide
DEEPIRTTNPVATEQYNDEVSTNLQNGNR

SEQ ID NO: 7372 - protein, 28 aa, Artificial Sequence
  Description of Artificial Sequence: Synthetic peptide
DEEPIRTTNPVATEQYGSVSTHILRGNT

SEQ ID NO: 7373 - protein, 28 aa, Artificial Sequence
  Description of Artificial Sequence: Synthetic peptide
DEEPIRTTNPVATEQYGSVSTAELRGNT

SEQ ID NO: 7374 - protein, 30 aa, Artificial Sequence
  Description of Artificial Sequence: Synthetic polypeptide
DEEPIRTTNPVATEQYGESVSINPQRGDNR

SEQ ID NO: 7375 - protein, 31 aa, Artificial Sequence
  Description of Artificial Sequence: Synthetic polypeptide
DEEEIRTTNPVATEQYGSVETGLQRGPNSRD

SEQ ID NO: 7376 - protein, 28 aa, Artificial Sequence
  Description of Artificial Sequence: Synthetic peptide
DEEPIRTTNPVATEQYGCVSTNDQFGNT

SEQ ID NO: 7377 - protein, 31 aa, Artificial Sequence
  Description of Artificial Sequence: Synthetic polypeptide
DEEEIRTTNPVATEQYGSVETGLQRGQNIRG

SEQ ID NO: 7378 - protein, 29 aa, Artificial Sequence
  Description of Artificial Sequence: Synthetic peptide
DEEPIRTTNPVATEQYFSEVSTNLQIGNQ

SEQ ID NO: 7379 - protein, 28 aa, Artificial Sequence
  Description of Artificial Sequence: Synthetic peptide
DDEEITTTNPVATEQYGSTSTNLEPGNR

SEQ ID NO: 7380 - protein, 28 aa, Artificial Sequence
  Description of Artificial Sequence: Synthetic peptide
DEEPIRTTNPVATEQHGSVVTNLQVGND

SEQ ID NO: 7381 - protein, 29 aa, Artificial Sequence
  Description of Artificial Sequence: Synthetic peptide
DEEPIRTTNPVATEEYGQVTTNLQRGSNR

SEQ ID NO: 7382 - protein, 29 aa, Artificial Sequence
  Description of Artificial Sequence: Synthetic peptide
DEEPIRTTNPVATECYSSEVSTNLQIGNR

SEQ ID NO: 7383 - protein, 31 aa, Artificial Sequence
  Description of Artificial Sequence: Synthetic polypeptide
DEAEIRTTNPVATEQYGSVATNLQRGPNDRV

SEQ ID NO: 7384 - protein, 30 aa, Artificial Sequence
  Description of Artificial Sequence: Synthetic polypeptide
DEAEIRTTNPVATEQYGSVATNLQHAGNQR

SEQ ID NO: 7385 - protein, 29 aa, Artificial Sequence
  Description of Artificial Sequence: Synthetic peptide
DEAEIRTTNPVATEQYGSVATNLPREGNH

SEQ ID NO: 7386 - protein, 30 aa, Artificial Sequence
  Description of Artificial Sequence: Synthetic polypeptide
DEEPIATTNPVATEQYGSVSTNLQRGQNEE

SEQ ID NO: 7387 - protein, 29 aa, Artificial Sequence
  Description of Artificial Sequence: Synthetic peptide
DEAEIRTTNPVATEQYGSVATNIQQRGNV

SEQ ID NO: 7388 - protein, 29 aa, Artificial Sequence
  Description of Artificial Sequence: Synthetic peptide
DEAEIRTTNPVATEQYGSVATNGQRGNED

SEQ ID NO: 7389 - protein, 29 aa, Artificial Sequence
  Description of Artificial Sequence: Synthetic peptide
DEENIRTTNPVAYEQYGSVSTNLSQTGNE

SEQ ID NO: 7390 - protein, 29 aa, Artificial Sequence
  Description of Artificial Sequence: Synthetic peptide
DEENIRTTNPVATESYGQVTTNLQRGSNR

SEQ ID NO: 7391 - protein, 29 aa, Artificial Sequence
  Description of Artificial Sequence: Synthetic peptide
DEENIRTTNPVATESYGQVNTNLQRGSNR

SEQ ID NO: 7392 - protein, 30 aa, Artificial Sequence
  Description of Artificial Sequence: Synthetic polypeptide
DEEEIRTTNPVATEQYGSVETMELQRVNRV

SEQ ID NO: 7393 - protein, 30 aa, Artificial Sequence
  Description of Artificial Sequence: Synthetic polypeptide
DEENIRTTNPVATEQYGSVSTNLNDGGQNR

SEQ ID NO: 7394 - protein, 28 aa, Artificial Sequence
  Description of Artificial Sequence: Synthetic peptide
DEEEIRTTNPVATEQYGSVETMLQRQEE

SEQ ID NO: 7395 - protein, 30 aa, Artificial Sequence
  Description of Artificial Sequence: Synthetic polypeptide
DEAEIRTTNPVATEQYGSVASTNLQDMGSR

SEQ ID NO: 7396 - protein, 28 aa, Artificial Sequence
  Description of Artificial Sequence: Synthetic peptide
DEENIRTTNPVATEQYGCVSTNYQFGNV

SEQ ID NO: 7397 - protein, 30 aa, Artificial Sequence
  Description of Artificial Sequence: Synthetic polypeptide
DEEEIRTTNPVATEQYGSVSVTDGLQRGEE

SEQ ID NO: 7398 - protein, 28 aa, Artificial Sequence
  Description of Artificial Sequence: Synthetic peptide
DEEKIRTTNPVATEQYGAVSTNQQFGNA

SEQ ID NO: 7399 - protein, 30 aa, Artificial Sequence
  Description of Artificial Sequence: Synthetic polypeptide
DEEEIRTTNPVATEQYGSVSVTDEQRQNER

SEQ ID NO: 7400 - protein, 30 aa, Artificial Sequence
  Description of Artificial Sequence: Synthetic polypeptide
DEEEIRTTNPVATEQYGSVEPAWLQRGENR

SEQ ID NO: 7401 - protein, 30 aa, Artificial Sequence
  Description of Artificial Sequence: Synthetic polypeptide
DEEEIRTTNPVATEQYGSVSVNLQTEGLIR

SEQ ID NO: 7402 - protein, 29 aa, Artificial Sequence
  Description of Artificial Sequence: Synthetic peptide
DEETIRTTNPVATEQYGTVVSTNLQGENR

SEQ ID NO: 7403 - protein, 30 aa, Artificial Sequence
  Description of Artificial Sequence: Synthetic polypeptide
DEETIRTTNPVATEQYGTVVSTNLQAGENR

SEQ ID NO: 7404 - protein, 28 aa, Artificial Sequence
  Description of Artificial Sequence: Synthetic peptide
DEEEIRTTNPVATEQYGSVSVNLTGFNI

SEQ ID NO: 7405 - protein, 32 aa, Artificial Sequence
  Description of Artificial Sequence: Synthetic polypeptide
DEEEIRTTNPVATEQYGSVSVNLTQRGQNMRQ

SEQ ID NO: 7406 - protein, 30 aa, Artificial Sequence
  Description of Artificial Sequence: Synthetic polypeptide
DEEEIRTTNPVATEQYGSVSVNLTRGSIRM

SEQ ID NO: 7407 - protein, 30 aa, Artificial Sequence
  Description of Artificial Sequence: Synthetic polypeptide
DEETIRTTNPVATEQYGTTVSINLQRGDNR

SEQ ID NO: 7408 - protein, 29 aa, Artificial Sequence
  Description of Artificial Sequence: Synthetic peptide
DEETIRTTNPVATEQYGSVVSTNLQIGIA

SEQ ID NO: 7409 - protein, 30 aa, Artificial Sequence
  Description of Artificial Sequence: Synthetic polypeptide
DEETIRTTNPVATEQYGSVTVSTNLQIGNN

SEQ ID NO: 7410 - protein, 31 aa, Artificial Sequence
  Description of Artificial Sequence: Synthetic polypeptide
DEETIRTTNPVATEQYGSVSVTDNLQPGDNR

SEQ ID NO: 7411 - protein, 31 aa, Artificial Sequence
  Description of Artificial Sequence: Synthetic polypeptide
DEEEIRTTNPVATEQYGSVDNTNLQRMGAQR

SEQ ID NO: 7412 - protein, 30 aa, Artificial Sequence
  Description of Artificial Sequence: Synthetic polypeptide
DEAEIRTTNPVATEQYGSVISTNQQREGLR

SEQ ID NO: 7413 - protein, 30 aa, Artificial Sequence
  Description of Artificial Sequence: Synthetic polypeptide
DEEEIRTTNPVATEQYGSVDPTLNLQRGEL

SEQ ID NO: 7414 - protein, 29 aa, Artificial Sequence
  Description of Artificial Sequence: Synthetic peptide
DEETIRTTNPVATEQYGTVVSTNLQSGNV

SEQ ID NO: 7415 - protein, 30 aa, Artificial Sequence
  Description of Artificial Sequence: Synthetic polypeptide
DEEEIRTTNPVATEQYGSVSATNLQPNNVM

SEQ ID NO: 7416 - protein, 31 aa, Artificial Sequence
  Description of Artificial Sequence: Synthetic polypeptide
DEEEIRTTNPVATEQYGSVDSNTNLQHFNNR

SEQ ID NO: 7417 - protein, 31 aa, Artificial Sequence
  Description of Artificial Sequence: Synthetic polypeptide
DEEEIRTTNPVATEQYGSVDSNTNLQRGGQG

SEQ ID NO: 7418 - protein, 32 aa, Artificial Sequence
  Description of Artificial Sequence: Synthetic polypeptide
DEEEIRTTNPVATEQYGSVSVPNLQRSGQNRN

SEQ ID NO: 7419 - protein, 31 aa, Artificial Sequence
  Description of Artificial Sequence: Synthetic polypeptide
DEEEIRTTNPVATEQYGSVDSPTNLQRGLQT

SEQ ID NO: 7420 - protein, 31 aa, Artificial Sequence
  Description of Artificial Sequence: Synthetic polypeptide
DEETIRTTNPVATEQYGSVSTQNLQDNGDNR

SEQ ID NO: 7421 - protein, 29 aa, Artificial Sequence
  Description of Artificial Sequence: Synthetic peptide
DEEEIRTTNPVATEQYGSVSATNLEGNQE

SEQ ID NO: 7422 - protein, 31 aa, Artificial Sequence
  Description of Artificial Sequence: Synthetic polypeptide
DEETIRTTNPVATEQYGSVSTNLQDNGSNQR

SEQ ID NO: 7423 - protein, 30 aa, Artificial Sequence
  Description of Artificial Sequence: Synthetic polypeptide
DEEEIRTTNPVATEQYGSVSVSENLQRVNF

SEQ ID NO: 7424 - protein, 30 aa, Artificial Sequence
  Description of Artificial Sequence: Synthetic polypeptide
DEEEIRTTNPVATEQYGSVSVSENLQRVNK

SEQ ID NO: 7425 - protein, 31 aa, Artificial Sequence
  Description of Artificial Sequence: Synthetic polypeptide
DEEEIRTTNPVATEQYGSVDSTALQRGSNAA

SEQ ID NO: 7426 - protein, 31 aa, Artificial Sequence
  Description of Artificial Sequence: Synthetic polypeptide
DEEEIRTTNPVATEQYGSVSATNIQREGNIF

SEQ ID NO: 7427 - protein, 28 aa, Artificial Sequence
  Description of Artificial Sequence: Synthetic peptide
DEETIRTTNPVATEQYGSVSTHELRGNF

SEQ ID NO: 7428 - protein, 31 aa, Artificial Sequence
  Description of Artificial Sequence: Synthetic polypeptide
DEEEIRTTNPVATEQYGSVDSTDLQRGGNNQ

SEQ ID NO: 7429 - protein, 31 aa, Artificial Sequence
  Description of Artificial Sequence: Synthetic polypeptide
DEEEIRTTNPVATEQYGSVDSHTNLQRGTQD

SEQ ID NO: 7430 - protein, 30 aa, Artificial Sequence
  Description of Artificial Sequence: Synthetic polypeptide
DEEEIRTTNPVATEQYGSVSATNDQRNDRG

SEQ ID NO: 7431 - protein, 29 aa, Artificial Sequence
  Description of Artificial Sequence: Synthetic peptide
DEETIRTTNPVATEQYGTVVSTNQQIGNR

SEQ ID NO: 7432 - protein, 31 aa, Artificial Sequence
  Description of Artificial Sequence: Synthetic polypeptide
DEEEIRTTNPVATEQYGSVSVNLQRPGNPLD

SEQ ID NO: 7433 - protein, 30 aa, Artificial Sequence
  Description of Artificial Sequence: Synthetic polypeptide
DDEEIRTTNPVATEQYGSVSTMNLQAGNIP

SEQ ID NO: 7434 - protein, 30 aa, Artificial Sequence
  Description of Artificial Sequence: Synthetic polypeptide
DEEEIRTTNPVATEQYGSVSVNHSQNGGNR

SEQ ID NO: 7435 - protein, 30 aa, Artificial Sequence
  Description of Artificial Sequence: Synthetic polypeptide
DDEEIRTTNPVATEQYGSVSTNLQRVGVFS

SEQ ID NO: 7436 - protein, 30 aa, Artificial Sequence
  Description of Artificial Sequence: Synthetic polypeptide
DDEEIRTTNPVATEQYGSVSTNNLTRGGNM

SEQ ID NO: 7437 - protein, 29 aa, Artificial Sequence
  Description of Artificial Sequence: Synthetic peptide
DEEEIRTTNPVATEQYGSVSVNLESPGIR

SEQ ID NO: 7438 - protein, 31 aa, Artificial Sequence
  Description of Artificial Sequence: Synthetic polypeptide
DDEEIRTTNPVATEQYGSVSTPNLQRFGQRA

SEQ ID NO: 7439 - protein, 31 aa, Artificial Sequence
  Description of Artificial Sequence: Synthetic polypeptide
DEEEIRTTNPVATEQYGSVCTQNLQRGNDFD

SEQ ID NO: 7440 - protein, 30 aa, Artificial Sequence
  Description of Artificial Sequence: Synthetic polypeptide
DEEEIRTTNPVATEQYGSVCTSLQLGNLRS

SEQ ID NO: 7441 - protein, 30 aa, Artificial Sequence
  Description of Artificial Sequence: Synthetic polypeptide
DEEEIRTTNPVATEQYGSVSVNLNTRGDDR

SEQ ID NO: 7442 - protein, 30 aa, Artificial Sequence
  Description of Artificial Sequence: Synthetic polypeptide
DEEEIRTTNPVATEQYGSVSVNLQDSGNDD

SEQ ID NO: 7443 - protein, 29 aa, Artificial Sequence
  Description of Artificial Sequence: Synthetic peptide
DEEEIRTTNPVATEQYGSVSVNLQEENTS

SEQ ID NO: 7444 - protein, 30 aa, Artificial Sequence
  Description of Artificial Sequence: Synthetic polypeptide
DEEEIRTTNPVATEQYGSVCTTNLQRAQND

SEQ ID NO: 7445 - protein, 30 aa, Artificial Sequence
  Description of Artificial Sequence: Synthetic polypeptide
DEEEIRTTNPVATEQYGSVCTTNLQRFQNT

SEQ ID NO: 7446 - protein, 30 aa, Artificial Sequence
  Description of Artificial Sequence: Synthetic polypeptide
DEEEIRTTNPVATEQYGSVDATNDQRGNQI

SEQ ID NO: 7447 - protein, 31 aa, Artificial Sequence
  Description of Artificial Sequence: Synthetic polypeptide
DEEEIRTTNPVATEQYGSVSVNLQLAGNNER

SEQ ID NO: 7448 - protein, 32 aa, Artificial Sequence
  Description of Artificial Sequence: Synthetic polypeptide
DEEEIRTTNPVATEQYGSVSATNQQARDGNER

SEQ ID NO: 7449 - protein, 31 aa, Artificial Sequence
  Description of Artificial Sequence: Synthetic polypeptide
DEEEIRTTNPVATEQYGSVSVNLQREGNPDE

SEQ ID NO: 7450 - protein, 31 aa, Artificial Sequence
  Description of Artificial Sequence: Synthetic polypeptide
DEEEIRTTNPVATEQYGSVSVNLQRGANAQA

SEQ ID NO: 7451 - protein, 28 aa, Artificial Sequence
  Description of Artificial Sequence: Synthetic peptide
DEEEIRTTNPVATEQYGSVCTVLQDGEM

SEQ ID NO: 7452 - protein, 31 aa, Artificial Sequence
  Description of Artificial Sequence: Synthetic polypeptide
DEEEIRTTNPVATEQYGSVSVNLQRGVNNQF

SEQ ID NO: 7453 - protein, 30 aa, Artificial Sequence
  Description of Artificial Sequence: Synthetic polypeptide
DEEEIRTTNPVATEQYGSVSVNLQRILNIE

SEQ ID NO: 7454 - protein, 30 aa, Artificial Sequence
  Description of Artificial Sequence: Synthetic polypeptide
DEEEIRTTNPVATEQYGSVCVNLQRGGDND

SEQ ID NO: 7455 - protein, 30 aa, Artificial Sequence
  Description of Artificial Sequence: Synthetic polypeptide
DEEEIRTTNPVATEQYGSVSVNLQRILNVH

SEQ ID NO: 7456 - protein, 30 aa, Artificial Sequence
  Description of Artificial Sequence: Synthetic polypeptide
DEETIRTTNPVATEQYGYSGSVNLQRGDNR

SEQ ID NO: 7457 - protein, 30 aa, Artificial Sequence
  Description of Artificial Sequence: Synthetic polypeptide
DEETIRTTNPVATEQYGVVVSTNLQPGNQR

SEQ ID NO: 7458 - protein, 30 aa, Artificial Sequence
  Description of Artificial Sequence: Synthetic polypeptide
DEEEIRTTNPVATEQYGSVCWTNLQQGELR

SEQ ID NO: 7459 - protein, 31 aa, Artificial Sequence
  Description of Artificial Sequence: Synthetic polypeptide
DEEEIRTTNPVATEQYGSVSVNLQRMMNERI

SEQ ID NO: 7460 - protein, 31 aa, Artificial Sequence
  Description of Artificial Sequence: Synthetic polypeptide
DEEEIRTTNPVATEQYGSVSVNLQRNMNGRQ

SEQ ID NO: 7461 - protein, 29 aa, Artificial Sequence
  Description of Artificial Sequence: Synthetic peptide
DEEEIRTTNPVATEQYGSVCTVEQGGNFR

SEQ ID NO: 7462 - protein, 30 aa, Artificial Sequence
  Description of Artificial Sequence: Synthetic polypeptide
DEEEIRTTNPVATEQYGSVSATNDQRGPHN

SEQ ID NO: 7463 - protein, 30 aa, Artificial Sequence
  Description of Artificial Sequence: Synthetic polypeptide
DEEEIRTTNPVATEQYGSVSATNDLQRFET

SEQ ID NO: 7464 - protein, 30 aa, Artificial Sequence
  Description of Artificial Sequence: Synthetic polypeptide
DEETIRTTNPVATEQYGSSVSVNLQIGDNR

SEQ ID NO: 7465 - protein, 28 aa, Artificial Sequence
  Description of Artificial Sequence: Synthetic peptide
DEETIRATNPVATEQYGSVSANTQRGNN

SEQ ID NO: 7466 - protein, 30 aa, Artificial Sequence
  Description of Artificial Sequence: Synthetic polypeptide
DEEEIRTTNPVATEQYGSVSVSPNLQRNNQ

SEQ ID NO: 7467 - protein, 30 aa, Artificial Sequence
  Description of Artificial Sequence: Synthetic polypeptide
DEEEIRTTNPVATEQYGSVSVSPNLQRPNI

SEQ ID NO: 7468 - protein, 30 aa, Artificial Sequence
  Description of Artificial Sequence: Synthetic polypeptide
DEEEIRTTNPVATEQYGSVSVSPNLQRVNA

SEQ ID NO: 7469 - protein, 30 aa, Artificial Sequence
  Description of Artificial Sequence: Synthetic polypeptide
DEEEIRTTNPVATEQYGSVDTNLQIRGSQQ

SEQ ID NO: 7470 - protein, 30 aa, Artificial Sequence
  Description of Artificial Sequence: Synthetic polypeptide
DEEEIRTTNPVATEQYGSVSVSQNLQRNNT

SEQ ID NO: 7471 - protein, 30 aa, Artificial Sequence
  Description of Artificial Sequence: Synthetic polypeptide
DEEEIRTTNPVATEQYGSVSVSQNLQRQNI

SEQ ID NO: 7472 - protein, 31 aa, Artificial Sequence
  Description of Artificial Sequence: Synthetic polypeptide
DEEEIRTTNPVATEQYGSVDTNLQRGQNEDD

SEQ ID NO: 7473 - protein, 30 aa, Artificial Sequence
  Description of Artificial Sequence: Synthetic polypeptide
DEEEIRTTNPVATEQYGSVSVSTNLQGNND

SEQ ID NO: 7474 - protein, 30 aa, Artificial Sequence
  Description of Artificial Sequence: Synthetic polypeptide
DEEEIRTTNPVATEQYGSVSATANLVRGEQ

SEQ ID NO: 7475 - protein, 28 aa, Artificial Sequence
  Description of Artificial Sequence: Synthetic peptide
DEESIRTTNPVATEQYGSVSTHETRGNT

SEQ ID NO: 7476 - protein, 32 aa, Artificial Sequence
  Description of Artificial Sequence: Synthetic polypeptide
DEESIRTTNPVATEQYGSVCSTNGLQRGSDNR

SEQ ID NO: 7477 - protein, 30 aa, Artificial Sequence
  Description of Artificial Sequence: Synthetic polypeptide
DEEEIRTTNPVATEQYGSVSATANLERGDS

SEQ ID NO: 7478 - protein, 30 aa, Artificial Sequence
  Description of Artificial Sequence: Synthetic polypeptide
DEEEIRTTNPVATEQYGSVSVSNNLQRVDR

SEQ ID NO: 7479 - protein, 30 aa, Artificial Sequence
  Description of Artificial Sequence: Synthetic polypeptide
DEESIRTTNPVATEQYGESVSINLQWGDNR

SEQ ID NO: 7480 - protein, 31 aa, Artificial Sequence
  Description of Artificial Sequence: Synthetic polypeptide
DEEEIRTTNPVATEQYGSVSVSTNLQRDVNI

SEQ ID NO: 7481 - protein, 28 aa, Artificial Sequence
  Description of Artificial Sequence: Synthetic peptide
DEEEIRTTNPVATEQYGSVSAPLQTSER

SEQ ID NO: 7482 - protein, 31 aa, Artificial Sequence
  Description of Artificial Sequence: Synthetic polypeptide
DEEEIRTTNPVATEQYGSVECTNLQRGNVLS

SEQ ID NO: 7483 - protein, 29 aa, Artificial Sequence
  Description of Artificial Sequence: Synthetic peptide
DEEEIRTTNPVATEQYGSVEENMQRQNRP

SEQ ID NO: 7484 - protein, 31 aa, Artificial Sequence
  Description of Artificial Sequence: Synthetic polypeptide
DEEEIRTTNPVATEQYGSVEETNLEREGENR

SEQ ID NO: 7485 - protein, 32 aa, Artificial Sequence
  Description of Artificial Sequence: Synthetic polypeptide
DEAEIRTTNPVATEQYGSVCSTNLQPRDGDNR

SEQ ID NO: 7486 - protein, 30 aa, Artificial Sequence
  Description of Artificial Sequence: Synthetic polypeptide
DEEEIRTTNPVATEQYGSVEGVDNLQRGER

SEQ ID NO: 7487 - protein, 32 aa, Artificial Sequence
  Description of Artificial Sequence: Synthetic polypeptide
DEAEIRTTNPVATEQYGSVCSTNLQERDGENR

SEQ ID NO: 7488 - protein, 30 aa, Artificial Sequence
  Description of Artificial Sequence: Synthetic polypeptide
DEAEIRTTNPVATEQYGSVCSTNLQDFNRI

SEQ ID NO: 7489 - protein, 30 aa, Artificial Sequence
  Description of Artificial Sequence: Synthetic polypeptide
DEAEIRTTNPVATEQYGSVCSTNGPQRGNQ

SEQ ID NO: 7490 - protein, 30 aa, Artificial Sequence
  Description of Artificial Sequence: Synthetic polypeptide
DEEEIRTTNPVATEQYGSVSVSWNLQRVNT

SEQ ID NO: 7491 - protein, 30 aa, Artificial Sequence
  Description of Artificial Sequence: Synthetic polypeptide
DEEEIRTTNPVATEQYGSVENTNNLQRGIT

SEQ ID NO: 7492 - protein, 29 aa, Artificial Sequence
  Description of Artificial Sequence: Synthetic peptide
DEEEIRTTNPVATEQYGSVSVTADQRGEF

SEQ ID NO: 7493 - protein, 28 aa, Artificial Sequence
  Description of Artificial Sequence: Synthetic peptide
DEESIRTTNPVATEQYGCVSTNIQFGND

SEQ ID NO: 7494 - protein, 30 aa, Artificial Sequence
  Description of Artificial Sequence: Synthetic polypeptide
DEEEIRTTNPVATEQYGSVSVSNNLQRPNI

SEQ ID NO: 7495 - protein, 31 aa, Artificial Sequence
  Description of Artificial Sequence: Synthetic polypeptide
DEAEIRTTNPVATEQYGSVDSTNLQRGSERS

SEQ ID NO: 7496 - protein, 30 aa, Artificial Sequence
  Description of Artificial Sequence: Synthetic polypeptide
DEEEIRTTNPVATEQYGSVDTGLQRGNIQD

SEQ ID NO: 7497 - protein, 30 aa, Artificial Sequence
  Description of Artificial Sequence: Synthetic polypeptide
DEETIRTTNPVATEQYGSSVSSNLQRGDER

SEQ ID NO: 7498 - protein, 30 aa, Artificial Sequence
  Description of Artificial Sequence: Synthetic polypeptide
DEETIRTTNPVATEQYGSSVSGNLQRGDNA

SEQ ID NO: 7499 - protein, 32 aa, Artificial Sequence
  Description of Artificial Sequence: Synthetic polypeptide
DEEEIRTTNPVATEQYGSVDSTENHQRFGNRV

SEQ ID NO: 7500 - protein, 29 aa, Artificial Sequence
  Description of Artificial Sequence: Synthetic peptide
DEAEIRTTNPVATEQYGSVGTNIQRGGNS

SEQ ID NO: 7501 - protein, 32 aa, Artificial Sequence
  Description of Artificial Sequence: Synthetic polypeptide
DEEEIRTTNPVATEQYGSVSATMNGLQRGENV

SEQ ID NO: 7502 - protein, 30 aa, Artificial Sequence
  Description of Artificial Sequence: Synthetic polypeptide
DEETIRTTNPVATEQYGQSVSGNLQREDNR

SEQ ID NO: 7503 - protein, 31 aa, Artificial Sequence
  Description of Artificial Sequence: Synthetic polypeptide
DEEEIRTTNPVATEQYGSVDSTENTQRGDND

SEQ ID NO: 7504 - protein, 31 aa, Artificial Sequence
  Description of Artificial Sequence: Synthetic polypeptide
DEEEIRTTNPVATEQYGSVDSTGNNQRTNRG

SEQ ID NO: 7505 - protein, 32 aa, Artificial Sequence
  Description of Artificial Sequence: Synthetic polypeptide
DEEEIRTTNPVATEQYGSVDSTLEPLVQRGNR

SEQ ID NO: 7506 - protein, 28 aa, Artificial Sequence
  Description of Artificial Sequence: Synthetic peptide
DEETIRTTNPVATEQYGCVSTNQQTGNE

SEQ ID NO: 7507 - protein, 31 aa, Artificial Sequence
  Description of Artificial Sequence: Synthetic polypeptide
DEEEIRTTNPVATEQYGSVSVSFNLQREGNI

SEQ ID NO: 7508 - protein, 31 aa, Artificial Sequence
  Description of Artificial Sequence: Synthetic polypeptide
DEEEIRTTNPVATEQYGSVDSTNDLQQGFRM

SEQ ID NO: 7509 - protein, 29 aa, Artificial Sequence
  Description of Artificial Sequence: Synthetic peptide
DDEEIRYTNPVATEQYGSIVSTNLQNGER

SEQ ID NO: 7510 - protein, 29 aa, Artificial Sequence
  Description of Artificial Sequence: Synthetic peptide
DDEEIRYTNPVATEQYGSQVSTNLQNGTR

SEQ ID NO: 7511 - protein, 30 aa, Artificial Sequence
  Description of Artificial Sequence: Synthetic polypeptide
DEEEIRTTNPVATEQYGSVDSTNLINGGND

SEQ ID NO: 7512 - protein, 29 aa, Artificial Sequence
  Description of Artificial Sequence: Synthetic peptide
DEEEIRTTNPVATEQYGSVDSTNLNTAVR

SEQ ID NO: 7513 - protein, 31 aa, Artificial Sequence
  Description of Artificial Sequence: Synthetic polypeptide
DEEEIRTTNPVATEQYGSVDSTNLQFKGNPL

SEQ ID NO: 7514 - protein, 30 aa, Artificial Sequence
  Description of Artificial Sequence: Synthetic polypeptide
DEEEIRTTNPVATEQYGSVDSTNLQGTSNI

SEQ ID NO: 7515 - protein, 32 aa, Artificial Sequence
  Description of Artificial Sequence: Synthetic polypeptide
DEEEIRTTNPVATEQYGSVDSTNLQHMGSNRF

SEQ ID NO: 7516 - protein, 32 aa, Artificial Sequence
  Description of Artificial Sequence: Synthetic polypeptide
DEEEIRTTNPVATEQYGSVDSTNLQRGENEVI

SEQ ID NO: 7517 - protein, 32 aa, Artificial Sequence
  Description of Artificial Sequence: Synthetic polypeptide
DEEEIRTTNPVATEQYGSVDSTNNLQNGSNRV

SEQ ID NO: 7518 - protein, 30 aa, Artificial Sequence
  Description of Artificial Sequence: Synthetic polypeptide
DEEEIRTTNPVATEQYGSVDSTNTQRGDDD

SEQ ID NO: 7519 - protein, 30 aa, Artificial Sequence
  Description of Artificial Sequence: Synthetic polypeptide
DEEEIRTTNPVATEQYGSVDSTPNHQSGIR

SEQ ID NO: 7520 - protein, 31 aa, Artificial Sequence
  Description of Artificial Sequence: Synthetic polypeptide
DEEEIRTTNPVATEQYGSVSVSLNLQRGVNI

SEQ ID NO: 7521 - protein, 31 aa, Artificial Sequence
  Description of Artificial Sequence: Synthetic polypeptide
DEEEIRTTNPVATEQYGSVDSTVLQNGGNSR

SEQ ID NO: 7522 - protein, 32 aa, Artificial Sequence
  Description of Artificial Sequence: Synthetic polypeptide
DEEEIRTTNPVATEQYGSVDSTVNHQRFGNRV

SEQ ID NO: 7523 - protein, 28 aa, Artificial Sequence
  Description of Artificial Sequence: Synthetic peptide
DEETIRFTNPVATEQYGSVSVNQQRGNL

SEQ ID NO: 7524 - protein, 28 aa, Artificial Sequence
  Description of Artificial Sequence: Synthetic peptide
DEETIRCTNPVATEQYGSVSWNMQRGNL

SEQ ID NO: 7525 - protein, 28 aa, Artificial Sequence
  Description of Artificial Sequence: Synthetic peptide
DEETIRCTNPVATEQYGSVSVNDQRGND

SEQ ID NO: 7526 - protein, 30 aa, Artificial Sequence
  Description of Artificial Sequence: Synthetic polypeptide
DEEEIRTTNPVATEQYGSVSVTALQGGVRD

SEQ ID NO: 7527 - protein, 31 aa, Artificial Sequence
  Description of Artificial Sequence: Synthetic polypeptide
DEEEIRTTNPVATEQYGSVCTPNLQRGNMPD

SEQ ID NO: 7528 - protein, 31 aa, Artificial Sequence
  Description of Artificial Sequence: Synthetic polypeptide
DEEEIRTTNPVATEQYGSVETNLQRMGINIS

SEQ ID NO: 7529 - protein, 30 aa, Artificial Sequence
  Description of Artificial Sequence: Synthetic polypeptide
DEEEIRTTNPVATEQYGSVSANLQQFGNDG

SEQ ID NO: 7530 - protein, 29 aa, Artificial Sequence
  Description of Artificial Sequence: Synthetic peptide
DEEEIATTNPVATEQYGSVATNLQDGNND

SEQ ID NO: 7531 - protein, 31 aa, Artificial Sequence
  Description of Artificial Sequence: Synthetic polypeptide
DEEEIRTTNPVATEQYGSVSWTMTLQRGVDR

SEQ ID NO: 7532 - protein, 29 aa, Artificial Sequence
  Description of Artificial Sequence: Synthetic peptide
DEEEIATTNPVATEQYGSVATNLQAGANE

SEQ ID NO: 7533 - protein, 30 aa, Artificial Sequence
  Description of Artificial Sequence: Synthetic polypeptide
DEEEIATTNPVATEQYGSVATNLQAEGNRD

SEQ ID NO: 7534 - protein, 29 aa, Artificial Sequence
  Description of Artificial Sequence: Synthetic peptide
DEEEIATTNPVATEQYGSVATNLQAEGNL

SEQ ID NO: 7535 - protein, 31 aa, Artificial Sequence
  Description of Artificial Sequence: Synthetic polypeptide
DEEEIRTTNPVATEQYGSVSWTNLQQGGNEL

SEQ ID NO: 7536 - protein, 31 aa, Artificial Sequence
  Description of Artificial Sequence: Synthetic polypeptide
DEEEIRTTNPVATEQYGSVSWTNLQRQNLPD

SEQ ID NO: 7537 - protein, 30 aa, Artificial Sequence
  Description of Artificial Sequence: Synthetic polypeptide
DEEEIRTTNPVATEQYGSVSWTNMLQREGI

SEQ ID NO: 7538 - protein, 31 aa, Artificial Sequence
  Description of Artificial Sequence: Synthetic polypeptide
DEEEIRTTNPVATEQYGSVSWTNNGQRVNTR

SEQ ID NO: 7539 - protein, 30 aa, Artificial Sequence
  Description of Artificial Sequence: Synthetic polypeptide
DEEEIRTTNPVATEQYGSVGATNLQDNNDR

SEQ ID NO: 7540 - protein, 31 aa, Artificial Sequence
  Description of Artificial Sequence: Synthetic polypeptide
DEEEIRTTNPVATEQYGSVSWVNDDQRGNRL

SEQ ID NO: 7541 - protein, 30 aa, Artificial Sequence
  Description of Artificial Sequence: Synthetic polypeptide
DEEEIRTTNPVATEQYGSVSWYLQRSGNNM

SEQ ID NO: 7542 - protein, 29 aa, Artificial Sequence
  Description of Artificial Sequence: Synthetic peptide
DEEEIRTTNPVATEQYGSVSYDLQFGERG

SEQ ID NO: 7543 - protein, 29 aa, Artificial Sequence
  Description of Artificial Sequence: Synthetic peptide
DEEEIATTNPVATEQYGSVATNLQDNGNQ

SEQ ID NO: 7544 - protein, 29 aa, Artificial Sequence
  Description of Artificial Sequence: Synthetic peptide
DEEEIRTTNPVATEQYGSVSYDLQNGERV

SEQ ID NO: 7545 - protein, 29 aa, Artificial Sequence
  Description of Artificial Sequence: Synthetic peptide
DEEEISTTNPVATEEYGVVSTNHQRFGNR

SEQ ID NO: 7546 - protein, 28 aa, Artificial Sequence
  Description of Artificial Sequence: Synthetic peptide
DEEEIAATNPVATEQYGCVATNLQRGNE

SEQ ID NO: 7547 - protein, 30 aa, Artificial Sequence
  Description of Artificial Sequence: Synthetic polypeptide
DEEEISTTNPVATAQYGSVSTNLQRFSNRD

SEQ ID NO: 7548 - protein, 28 aa, Artificial Sequence
  Description of Artificial Sequence: Synthetic peptide
DEEEIAATNPVATEQYGEVATNLQRGNE

SEQ ID NO: 7549 - protein, 28 aa, Artificial Sequence
  Description of Artificial Sequence: Synthetic peptide
DEEEIAATNPVATEQYGEVSTNLQQGNA

SEQ ID NO: 7550 - protein, 30 aa, Artificial Sequence
  Description of Artificial Sequence: Synthetic polypeptide
DEEEIRTTNPVATEQYGSVSYINDLQRVQR

SEQ ID NO: 7551 - protein, 29 aa, Artificial Sequence
  Description of Artificial Sequence: Synthetic peptide
DEEEIATTNPVATEQYGSVATNLDRGNDL

SEQ ID NO: 7552 - protein, 29 aa, Artificial Sequence
  Description of Artificial Sequence: Synthetic peptide
DEEEIRTTNPVATEQYGSVSYLLQNGERI

SEQ ID NO: 7553 - protein, 29 aa, Artificial Sequence
  Description of Artificial Sequence: Synthetic peptide
DEEEIATTNPVATEQYGSVATNLDPDGNR

SEQ ID NO: 7554 - protein, 30 aa, Artificial Sequence
  Description of Artificial Sequence: Synthetic polypeptide
DEEEISTTNPCATEQYGSVPTNLQERGNGR

SEQ ID NO: 7555 - protein, 31 aa, Artificial Sequence
  Description of Artificial Sequence: Synthetic polypeptide
DEEEIRTTNPVATEQYGSVSADLQSRGENNR

SEQ ID NO: 7556 - protein, 31 aa, Artificial Sequence
  Description of Artificial Sequence: Synthetic polypeptide
DEEEIRTTNPVATEQYGSVSYMNLQRMVNVR

SEQ ID NO: 7557 - protein, 30 aa, Artificial Sequence
  Description of Artificial Sequence: Synthetic polypeptide
DEEEISTTNPCATEQYGSVATNLQLRGNGR

SEQ ID NO: 7558 - protein, 28 aa, Artificial Sequence
  Description of Artificial Sequence: Synthetic peptide
DEEEISTTNPVATEQWGSVSTNEMRGNA

SEQ ID NO: 7559 - protein, 30 aa, Artificial Sequence
  Description of Artificial Sequence: Synthetic polypeptide
DEEEIRTTNPVATEQYGSVSADLQNGNERN

SEQ ID NO: 7560 - protein, 31 aa, Artificial Sequence
  Description of Artificial Sequence: Synthetic polypeptide
DEEEIRTTNPVATEQYGSVSWSNLQRGLQRD

SEQ ID NO: 7561 - protein, 30 aa, Artificial Sequence
  Description of Artificial Sequence: Synthetic polypeptide
DEEEIRTTNPVATEQYGSVSAENLMRGEDR

SEQ ID NO: 7562 - protein, 30 aa, Artificial Sequence
  Description of Artificial Sequence: Synthetic polypeptide
DEEEIRTTNPVATEQYGSVSWNLERLNERT

SEQ ID NO: 7563 - protein, 31 aa, Artificial Sequence
  Description of Artificial Sequence: Synthetic polypeptide
DEEEIATTNPVATEQYGSVATNLQRAGENYR

SEQ ID NO: 7564 - protein, 28 aa, Artificial Sequence
  Description of Artificial Sequence: Synthetic peptide
DEEEISTTNPVATEQYGSVATNLQSANM

SEQ ID NO: 7565 - protein, 30 aa, Artificial Sequence
  Description of Artificial Sequence: Synthetic polypeptide
DEEEIRTTNPVATEQYGSVSWNLGRGPIRD

SEQ ID NO: 7566 - protein, 30 aa, Artificial Sequence
  Description of Artificial Sequence: Synthetic polypeptide
DEEEISTTNPVATEQYGSVATNLQQGNSRP

SEQ ID NO: 7567 - protein, 28 aa, Artificial Sequence
  Description of Artificial Sequence: Synthetic peptide
DEEEISTTNPVATEQYGSVATNLQMPNN

SEQ ID NO: 7568 - protein, 30 aa, Artificial Sequence
  Description of Artificial Sequence: Synthetic polypeptide
DEEEISTTNPVATEQYGSVATNLQFGNSRE

SEQ ID NO: 7569 - protein, 30 aa, Artificial Sequence
  Description of Artificial Sequence: Synthetic polypeptide
DEEEISTTNPVATEQYGSVATNLQFGNPRT

SEQ ID NO: 7570 - protein, 31 aa, Artificial Sequence
  Description of Artificial Sequence: Synthetic polypeptide
DEEEISTTNPVATEQYGQSVSTNLQAGSNRF

SEQ ID NO: 7571 - protein, 30 aa, Artificial Sequence
  Description of Artificial Sequence: Synthetic polypeptide
DEEEIATTNPVATEQYGSVATNLQRAEGNN

SEQ ID NO: 7572 - protein, 30 aa, Artificial Sequence
  Description of Artificial Sequence: Synthetic polypeptide
DEEEIRTTNPVATEQYGSVSWNLQDSGNEL

SEQ ID NO: 7573 - protein, 29 aa, Artificial Sequence
  Description of Artificial Sequence: Synthetic peptide
DEEEIRTTNPVATEQYGSVSWNLQGMNTA

SEQ ID NO: 7574 - protein, 29 aa, Artificial Sequence
  Description of Artificial Sequence: Synthetic peptide
DEEEIRTTNPVATEQYGSVSWNLQGTVHR

SEQ ID NO: 7575 - protein, 28 aa, Artificial Sequence
  Description of Artificial Sequence: Synthetic peptide
DEEDIRTTNPVATEQYGSVSTHELRGNP

SEQ ID NO: 7576 - protein, 28 aa, Artificial Sequence
  Description of Artificial Sequence: Synthetic peptide
DEEEISTTNPVATEQYGIVSENLQRGPC

SEQ ID NO: 7577 - protein, 29 aa, Artificial Sequence
  Description of Artificial Sequence: Synthetic peptide
DEEEIATTNPVATEQYGSVATNLQQDGNF

SEQ ID NO: 7578 - protein, 30 aa, Artificial Sequence
  Description of Artificial Sequence: Synthetic polypeptide
DEEEIRTTNPVATEQYGSVSWNLQRGSQAI

SEQ ID NO: 7579 - protein, 30 aa, Artificial Sequence
  Description of Artificial Sequence: Synthetic polypeptide
DEEEIRTTNPVATEQYGSVSWNLQRVENIP

SEQ ID NO: 7580 - protein, 31 aa, Artificial Sequence
  Description of Artificial Sequence: Synthetic polypeptide
DEEEIRTTNPVATEQYGSVFVTELQRGLNRD

SEQ ID NO: 7581 - protein, 31 aa, Artificial Sequence
  Description of Artificial Sequence: Synthetic polypeptide
DEEEIRTTNPVATEQYGSVSWNLQTGQNQRE

SEQ ID NO: 7582 - protein, 28 aa, Artificial Sequence
  Description of Artificial Sequence: Synthetic peptide
DEEEIATTNPVATEQYGSVATNLQHVNM

SEQ ID NO: 7583 - protein, 29 aa, Artificial Sequence
  Description of Artificial Sequence: Synthetic peptide
DEEEIATTNPVATEQYGSVATNLQGGNLP

SEQ ID NO: 7584 - protein, 30 aa, Artificial Sequence
  Description of Artificial Sequence: Synthetic polypeptide
DEEEIATTNPVATEQYGSVATNLQGGNDRY

SEQ ID NO: 7585 - protein, 29 aa, Artificial Sequence
  Description of Artificial Sequence: Synthetic peptide
DDSEIRTTNPVATEQYGSVSTNPLQQGDR

SEQ ID NO: 7586 - protein, 30 aa, Artificial Sequence
  Description of Artificial Sequence: Synthetic polypeptide
DEEEIRTTNPVATEQYGSVSAGLVRMGNER

SEQ ID NO: 7587 - protein, 28 aa, Artificial Sequence
  Description of Artificial Sequence: Synthetic peptide
DEEEIATTNPVATEQYGSVATNLQGDNP

SEQ ID NO: 7588 - protein, 30 aa, Artificial Sequence
  Description of Artificial Sequence: Synthetic polypeptide
DEEEIRTTNPVATEQYGSVSWNMQRDGDSR

SEQ ID NO: 7589 - protein, 30 aa, Artificial Sequence
  Description of Artificial Sequence: Synthetic polypeptide
DEEEIRTTNPVATEQYGSVSAENLQRLNIV

SEQ ID NO: 7590 - protein, 30 aa, Artificial Sequence
  Description of Artificial Sequence: Synthetic polypeptide
DEEEIRTTNPVATEQYGSVSWNLQQGQNAM

SEQ ID NO: 7591 - protein, 30 aa, Artificial Sequence
  Description of Artificial Sequence: Synthetic polypeptide
DEEEIRTTNPVATEQYGSVSYNLEQAQMNR

SEQ ID NO: 7592 - protein, 28 aa, Artificial Sequence
  Description of Artificial Sequence: Synthetic peptide
DEEEIATTNPVATEQYGSVATNGQRINE

SEQ ID NO: 7593 - protein, 30 aa, Artificial Sequence
  Description of Artificial Sequence: Synthetic polypeptide
DEEEIRTTNPVATEQYGSVSYNLQIGQNQG

SEQ ID NO: 7594 - protein, 31 aa, Artificial Sequence
  Description of Artificial Sequence: Synthetic polypeptide
DEEEIRTTNPVATEQYGSVSYTNDQRGIMRI

SEQ ID NO: 7595 - protein, 31 aa, Artificial Sequence
  Description of Artificial Sequence: Synthetic polypeptide
DEEEIRTTNPVATEQYGSVSYTNDQRGVFRD

SEQ ID NO: 7596 - protein, 30 aa, Artificial Sequence
  Description of Artificial Sequence: Synthetic polypeptide
DEEEIRTTNPVATEQYGSVSYTNGIQRGQF

SEQ ID NO: 7597 - protein, 31 aa, Artificial Sequence
  Description of Artificial Sequence: Synthetic polypeptide
DEEEIRTTNPVATEQYGSVSYTNGTQRDGNE

SEQ ID NO: 7598 - protein, 31 aa, Artificial Sequence
  Description of Artificial Sequence: Synthetic polypeptide
DEEEIRTTNPVATEQYGSVSYTNLAFGSNRQ

SEQ ID NO: 7599 - protein, 30 aa, Artificial Sequence
  Description of Artificial Sequence: Synthetic polypeptide
DEEEIRTTNPVATEQYGSVGPTNLQDGNQT

SEQ ID NO: 7600 - protein, 32 aa, Artificial Sequence
  Description of Artificial Sequence: Synthetic polypeptide
DEEEIRTTNPVATEQYGSVSYTNLDQRGDEVR

SEQ ID NO: 7601 - protein, 30 aa, Artificial Sequence
  Description of Artificial Sequence: Synthetic polypeptide
DEEEIRTTNPVATEQYGSVSYTNLIHFGER

SEQ ID NO: 7602 - protein, 31 aa, Artificial Sequence
  Description of Artificial Sequence: Synthetic polypeptide
DEEEIRTTNPVATEQYGSVSYTNLQPTTNRI

SEQ ID NO: 7603 - protein, 31 aa, Artificial Sequence
  Description of Artificial Sequence: Synthetic polypeptide
DEEEIRTTNPVATEQYGSVSYTNLQQGEIPR

SEQ ID NO: 7604 - protein, 31 aa, Artificial Sequence
  Description of Artificial Sequence: Synthetic polypeptide
DEEEIRTTNPVATEQYGSVSYTNLQQGEIVR

SEQ ID NO: 7605 - protein, 30 aa, Artificial Sequence
  Description of Artificial Sequence: Synthetic polypeptide
DEEEIRTTNPVATEQYGSVSYTNMDRGFER

SEQ ID NO: 7606 - protein, 32 aa, Artificial Sequence
  Description of Artificial Sequence: Synthetic polypeptide
DEEEIRTTNPVATEQYGSVGPTNLQRGEENRM

SEQ ID NO: 7607 - protein, 30 aa, Artificial Sequence
  Description of Artificial Sequence: Synthetic polypeptide
DEEEIRTTNPVATEQYGSVSYTNDDRGDNN

SEQ ID NO: 7608 - protein, 30 aa, Artificial Sequence
  Description of Artificial Sequence: Synthetic polypeptide
DEEEIRTTNPVATEQYGSVGPTNLQSGNLT

SEQ ID NO: 7609 - protein, 30 aa, Artificial Sequence
  Description of Artificial Sequence: Synthetic polypeptide
DEEEIRTTNPVATEQYGSVSYTNMHRGDSR

SEQ ID NO: 7610 - protein, 30 aa, Artificial Sequence
  Description of Artificial Sequence: Synthetic polypeptide
DEEEIATTNPVATEQYGSVAITNLQDQGNR

SEQ ID NO: 7611 - protein, 30 aa, Artificial Sequence
  Description of Artificial Sequence: Synthetic polypeptide
DEEEIRTTNPVATEQYGSVSYTPLGVGGNR

SEQ ID NO: 7612 - protein, 33 aa, Artificial Sequence
  Description of Artificial Sequence: Synthetic polypeptide
DEEEIRTTNPVATEQYGSVSYTPNLQRGLNNRV

SEQ ID NO: 7613 - protein, 31 aa, Artificial Sequence
  Description of Artificial Sequence: Synthetic polypeptide
DEEEIRTTNPVATEQYGSVGQTNGQPRGNLR

SEQ ID NO: 7614 - protein, 30 aa, Artificial Sequence
  Description of Artificial Sequence: Synthetic polypeptide
DEEEIRTTNPVATEQYGSVGQTNLQPGNQT

SEQ ID NO: 7615 - protein, 32 aa, Artificial Sequence
  Description of Artificial Sequence: Synthetic polypeptide
DEEEIRTTNPVATEQYGSVSYTTLSQRGNYRE

SEQ ID NO: 7616 - protein, 32 aa, Artificial Sequence
  Description of Artificial Sequence: Synthetic polypeptide
DEEEIRTTNPVATEQYGSVSYTTNLEQRGEPR

SEQ ID NO: 7617 - protein, 31 aa, Artificial Sequence
  Description of Artificial Sequence: Synthetic polypeptide
DEEEIRTTNPVATEQYGSVTCTNLQRNVNER

SEQ ID NO: 7618 - protein, 29 aa, Artificial Sequence
  Description of Artificial Sequence: Synthetic peptide
DEEEIRTTNPVATEQYGSVTDNLQRNNQL

SEQ ID NO: 7619 - protein, 29 aa, Artificial Sequence
  Description of Artificial Sequence: Synthetic peptide
DEEEIRTTNPVATEQYGSVTDSNLQRGDS

SEQ ID NO: 7620 - protein, 30 aa, Artificial Sequence
  Description of Artificial Sequence: Synthetic polypeptide
DEEEIRTTNPVATEQYGSVQTTNLQRFENE

SEQ ID NO: 7621 - protein, 31 aa, Artificial Sequence
  Description of Artificial Sequence: Synthetic polypeptide
DEEEIRTTNPVATEQYGSVQTTNLQRDNIRD

SEQ ID NO: 7622 - protein, 30 aa, Artificial Sequence
  Description of Artificial Sequence: Synthetic polypeptide
DEEEIRTTNPVATEQYGSVGPTNLQTGNSN

SEQ ID NO: 7623 - protein, 29 aa, Artificial Sequence
  Description of Artificial Sequence: Synthetic peptide
DEEEIRTTNPVVTEQYGSVSTNFLGRGGP

SEQ ID NO: 7624 - protein, 29 aa, Artificial Sequence
  Description of Artificial Sequence: Synthetic peptide
DEEEIRTTNPVYTEQYGSVSTNFLERGAP

SEQ ID NO: 7625 - protein, 31 aa, Artificial Sequence
  Description of Artificial Sequence: Synthetic polypeptide
DEEEIRTVNPVATEQFGSVSTNGLQSREGNR

SEQ ID NO: 7626 - protein, 29 aa, Artificial Sequence
  Description of Artificial Sequence: Synthetic peptide
DEEEIATTNPVATEQYGSVATNELQRAER

SEQ ID NO: 7627 - protein, 30 aa, Artificial Sequence
  Description of Artificial Sequence: Synthetic polypeptide
DEEEIRTTNPVATEQYGSVSYNLQREGSPQ

SEQ ID NO: 7628 - protein, 29 aa, Artificial Sequence
  Description of Artificial Sequence: Synthetic peptide
DEEEIATTNPVATEQYGSVATNDQRGPNE

SEQ ID NO: 7629 - protein, 30 aa, Artificial Sequence
  Description of Artificial Sequence: Synthetic polypeptide
DEEEIRTTNPVATEQYGSVSYNLQRGSEMP

SEQ ID NO: 7630 - protein, 30 aa, Artificial Sequence
  Description of Artificial Sequence: Synthetic polypeptide
DEEEIRTTNPVATEQYGSVSYNLQRGSIED

SEQ ID NO: 7631 - protein, 29 aa, Artificial Sequence
  Description of Artificial Sequence: Synthetic peptide
DEAEIRTTNPVATEQYGSCSTNTQRNGPR

SEQ ID NO: 7632 - protein, 29 aa, Artificial Sequence
  Description of Artificial Sequence: Synthetic peptide
DEAEIRTTNPVATEQYGSCSTNPQRHGLR

SEQ ID NO: 7633 - protein, 28 aa, Artificial Sequence
  Description of Artificial Sequence: Synthetic peptide
DEEEIRTVNPVCTEQWGSMSTNLQIGNR

SEQ ID NO: 7634 - protein, 29 aa, Artificial Sequence
  Description of Artificial Sequence: Synthetic peptide
DEEEIRTVNPVAYEPYGGVSTNLQREGNR

SEQ ID NO: 7635 - protein, 30 aa, Artificial Sequence
  Description of Artificial Sequence: Synthetic polypeptide
DEEEIRTTNPVATEQYGSVSYNMQRGANLT

SEQ ID NO: 7636 - protein, 30 aa, Artificial Sequence
  Description of Artificial Sequence: Synthetic polypeptide
DEEEIRTTNPVATEQYGSVSYNVTQSRGNN

SEQ ID NO: 7637 - protein, 29 aa, Artificial Sequence
  Description of Artificial Sequence: Synthetic peptide
DEEEIRTVNPVATEQYGSVSTSNLQRNQE

SEQ ID NO: 7638 - protein, 30 aa, Artificial Sequence
  Description of Artificial Sequence: Synthetic polypeptide
DEEEIATTNPVATEQYGSVASTNLQGEGNY

SEQ ID NO: 7639 - protein, 30 aa, Artificial Sequence
  Description of Artificial Sequence: Synthetic polypeptide
DEEEIRTTNPVATEQYGSVSYNWLQGGNDG

SEQ ID NO: 7640 - protein, 30 aa, Artificial Sequence
  Description of Artificial Sequence: Synthetic polypeptide
DEEEIRTTNPVATEQYGSVSYNWLQNGNAS

SEQ ID NO: 7641 - protein, 28 aa, Artificial Sequence
  Description of Artificial Sequence: Synthetic peptide
DEEEIRTVNPVATEQYGSVSTMLQRNQE

SEQ ID NO: 7642 - protein, 29 aa, Artificial Sequence
  Description of Artificial Sequence: Synthetic peptide
DEEEIRTTNPVATEQYGSVSYPNLQIGDF

SEQ ID NO: 7643 - protein, 28 aa, Artificial Sequence
  Description of Artificial Sequence: Synthetic peptide
DEEEIRTVNPVATEQYGSVSTILQRQPE

SEQ ID NO: 7644 - protein, 28 aa, Artificial Sequence
  Description of Artificial Sequence: Synthetic peptide
DEEEIRTVNPVATEQYGSVSTHLQRNQQ

SEQ ID NO: 7645 - protein, 28 aa, Artificial Sequence
  Description of Artificial Sequence: Synthetic peptide
DEEEIRTVNPVATEQYGSVSTDLQRNVE

SEQ ID NO: 7646 - protein, 29 aa, Artificial Sequence
  Description of Artificial Sequence: Synthetic peptide
DEEEIRTVNPVATEQYGSVSTDLQRNQNE

SEQ ID NO: 7647 - protein, 28 aa, Artificial Sequence
  Description of Artificial Sequence: Synthetic peptide
DEEEIACTNPIATEQYGSVSENLMRGNR

SEQ ID NO: 7648 - protein, 29 aa, Artificial Sequence
  Description of Artificial Sequence: Synthetic peptide
DEEEIRTVNPVATEQYGSVSTALQIGNQE

SEQ ID NO: 7649 - protein, 31 aa, Artificial Sequence
  Description of Artificial Sequence: Synthetic polypeptide
DEEEIRTTNPVATEQYGSVSYTALFQRGNQA

SEQ ID NO: 7650 - protein, 31 aa, Artificial Sequence
  Description of Artificial Sequence: Synthetic polypeptide
DEEEIRTTNPVATEQYGSVSYTENLSTAGNR

SEQ ID NO: 7651 - protein, 31 aa, Artificial Sequence
  Description of Artificial Sequence: Synthetic polypeptide
DEEEIRTTNPVATEQYGSVSYTGNLGRGGNI

SEQ ID NO: 7652 - protein, 32 aa, Artificial Sequence
  Description of Artificial Sequence: Synthetic polypeptide
DEEEIRTTNPVATEQYGSVSYTHELSQRSGNR

SEQ ID NO: 7653 - protein, 28 aa, Artificial Sequence
  Description of Artificial Sequence: Synthetic peptide
DEEEIRTVNPVATEQYGEVSENLQHGNM

SEQ ID NO: 7654 - protein, 28 aa, Artificial Sequence
  Description of Artificial Sequence: Synthetic peptide
DEAEIRTTNPVATEQYGQVSTNLQHGTQ

SEQ ID NO: 7655 - protein, 31 aa, Artificial Sequence
  Description of Artificial Sequence: Synthetic polypeptide
DEEEIATTNPVATEQYGSVATNLQRDGMNPR

SEQ ID NO: 7656 - protein, 30 aa, Artificial Sequence
  Description of Artificial Sequence: Synthetic polypeptide
DEEEIRTTNPVATEQYGSVETNLQRSNENI

SEQ ID NO: 7657 - protein, 30 aa, Artificial Sequence
  Description of Artificial Sequence: Synthetic polypeptide
DEEEIATTNPVATEQYGSVATNLQRDGNPE

SEQ ID NO: 7658 - protein, 30 aa, Artificial Sequence
  Description of Artificial Sequence: Synthetic polypeptide
DEEEIRTTNPVATEQYGSVSWNLDRINSRS

SEQ ID NO: 7659 - protein, 31 aa, Artificial Sequence
  Description of Artificial Sequence: Synthetic polypeptide
DEEEIRTTNPVATEQYGSVSVTNLQRNQARD

SEQ ID NO: 7660 - protein, 30 aa, Artificial Sequence
  Description of Artificial Sequence: Synthetic polypeptide
DEEEIRTTNPVATEQYGSVSVTNLQSSNDQ

SEQ ID NO: 7661 - protein, 28 aa, Artificial Sequence
  Description of Artificial Sequence: Synthetic peptide
DEEGIRTTNPVATEQYGQVSTNEQFGNE

SEQ ID NO: 7662 - protein, 28 aa, Artificial Sequence
  Description of Artificial Sequence: Synthetic peptide
DEEGIRTTNPVATEQYGNVSTNEQSGNC

SEQ ID NO: 7663 - protein, 28 aa, Artificial Sequence
  Description of Artificial Sequence: Synthetic peptide
DEEGIRTTNPVATEQYGEVSTNFQFGNC

SEQ ID NO: 7664 - protein, 30 aa, Artificial Sequence
  Description of Artificial Sequence: Synthetic polypeptide
DEEEIRTTNPVATEQYGSVSVTNLQVNNDQ

SEQ ID NO: 7665 - protein, 30 aa, Artificial Sequence
  Description of Artificial Sequence: Synthetic polypeptide
DEEEIRTTNPVATEQYGSVSANLQHGGNGQ

SEQ ID NO: 7666 - protein, 30 aa, Artificial Sequence
  Description of Artificial Sequence: Synthetic polypeptide
DEEEIRTTNPVATEQYGSVSVTNLTRGEQN

SEQ ID NO: 7667 - protein, 28 aa, Artificial Sequence
  Description of Artificial Sequence: Synthetic peptide
DEEGIRTTNPVATEQYGDVSTNDQFGNT

SEQ ID NO: 7668 - protein, 28 aa, Artificial Sequence
  Description of Artificial Sequence: Synthetic peptide
DEEGIRTTNPVATEQYGCVSTNSQFGNI

SEQ ID NO: 7669 - protein, 28 aa, Artificial Sequence
  Description of Artificial Sequence: Synthetic peptide
DEEGIRTTNPVATEQYGCVSTNGQDGNQ

SEQ ID NO: 7670 - protein, 30 aa, Artificial Sequence
  Description of Artificial Sequence: Synthetic polypeptide
DEEEIRTTNPVATEQYGSVSANLQFGTNIQ

SEQ ID NO: 7671 - protein, 31 aa, Artificial Sequence
  Description of Artificial Sequence: Synthetic polypeptide
DEEEIRTTNPVATEQYGSVSANLQERGEDNM

SEQ ID NO: 7672 - protein, 32 aa, Artificial Sequence
  Description of Artificial Sequence: Synthetic polypeptide
DEEEIRTTNPVATEQYGSVSVTNLQRIGVNEE

SEQ ID NO: 7673 - protein, 29 aa, Artificial Sequence
  Description of Artificial Sequence: Synthetic peptide
DEEGIRTTNPVATECYGQVTTNLQRGSNR

SEQ ID NO: 7674 - protein, 30 aa, Artificial Sequence
  Description of Artificial Sequence: Synthetic polypeptide
DEEEIRTTNPVATEQYGSVSANLQDSGNEG

SEQ ID NO: 7675 - protein, 28 aa, Artificial Sequence
  Description of Artificial Sequence: Synthetic peptide
DEEEVKTTNPVATELYGSVSDNIQRGNR

SEQ ID NO: 7676 - protein, 30 aa, Artificial Sequence
  Description of Artificial Sequence: Synthetic polypeptide
DEEEIRTTNPVATEQYGSVETVLQRGQIRT

SEQ ID NO: 7677 - protein, 30 aa, Artificial Sequence
  Description of Artificial Sequence: Synthetic polypeptide
DEEEIRTTNPVATEQYGSVSANLQDSGDRM

SEQ ID NO: 7678 - protein, 31 aa, Artificial Sequence
  Description of Artificial Sequence: Synthetic polypeptide
DEEEIRTTNPVATEQYGSVETYNDLQRGNQD

SEQ ID NO: 7679 - protein, 31 aa, Artificial Sequence
  Description of Artificial Sequence: Synthetic polypeptide
DEEEIYTTNPVATEQYGSVTSTNLQRLGSNM

SEQ ID NO: 7680 - protein, 31 aa, Artificial Sequence
  Description of Artificial Sequence: Synthetic polypeptide
DEEEIRTTNPVATEQYGSVETYNLQRGVERN

SEQ ID NO: 7681 - protein, 29 aa, Artificial Sequence
  Description of Artificial Sequence: Synthetic peptide
DEEEIRTTNPVATEQYGSVSANLQDDNEH

SEQ ID NO: 7682 - protein, 31 aa, Artificial Sequence
  Description of Artificial Sequence: Synthetic polypeptide
DEEEIRTTNPVATEQYGSVSANLNRGNTLRQ

SEQ ID NO: 7683 - protein, 30 aa, Artificial Sequence
  Description of Artificial Sequence: Synthetic polypeptide
DEEEIRTTNPVATEQYGSVEVTNNQRGNQE

SEQ ID NO: 7684 - protein, 30 aa, Artificial Sequence
  Description of Artificial Sequence: Synthetic polypeptide
DEEEIRTTNPVATEQYGSVEWTNGLQRGLL

SEQ ID NO: 7685 - protein, 31 aa, Artificial Sequence
  Description of Artificial Sequence: Synthetic polypeptide
DEEEIRTTNPVATEQYGSVSVTQLQREGNHN

SEQ ID NO: 7686 - protein, 31 aa, Artificial Sequence
  Description of Artificial Sequence: Synthetic polypeptide
DEEEIVTTNPVATEQYGSVSTNTLQERMGNL

SEQ ID NO: 7687 - protein, 29 aa, Artificial Sequence
  Description of Artificial Sequence: Synthetic peptide
DEEEIRTTNPVATEQYGSVSANLQEENEL

SEQ ID NO: 7688 - protein, 32 aa, Artificial Sequence
  Description of Artificial Sequence: Synthetic polypeptide
DEEEIRTTNPVATEQYGSVSVTQNDLQRGLAR

SEQ ID NO: 7689 - protein, 32 aa, Artificial Sequence
  Description of Artificial Sequence: Synthetic polypeptide
DEEEIRTTNPVATEQYGSVSVTNLQRIGVNDE

SEQ ID NO: 7690 - protein, 30 aa, Artificial Sequence
  Description of Artificial Sequence: Synthetic polypeptide
DEEEIRTTNPVATEQYGSVETTLQRGNLGQ

SEQ ID NO: 7691 - protein, 28 aa, Artificial Sequence
  Description of Artificial Sequence: Synthetic peptide
DEEIIRTTNPVATEQYGEVSTNQQNGNL

SEQ ID NO: 7692 - protein, 28 aa, Artificial Sequence
  Description of Artificial Sequence: Synthetic peptide
DEEIIRTTNPVATEQYGCVSTNVQNGNS

SEQ ID NO: 7693 - protein, 28 aa, Artificial Sequence
  Description of Artificial Sequence: Synthetic peptide
DEEIIRTTNPVATEQYGCVSTNPQTGNM

SEQ ID NO: 7694 - protein, 28 aa, Artificial Sequence
  Description of Artificial Sequence: Synthetic peptide
DEEIIRTTNPVATEQYGCVSTNHQHGNC

SEQ ID NO: 7695 - protein, 28 aa, Artificial Sequence
  Description of Artificial Sequence: Synthetic peptide
DEEIIRTTNPVATEQYGCVSTNAQHGNE

SEQ ID NO: 7696 - protein, 29 aa, Artificial Sequence
  Description of Artificial Sequence: Synthetic peptide
DEEEIRTTNPVATEQYGSVETNLQVVNLE

SEQ ID NO: 7697 - protein, 28 aa, Artificial Sequence
  Description of Artificial Sequence: Synthetic peptide
DEEIIRCTNPVATEQYGSVSWNEQRGNL

SEQ ID NO: 7698 - protein, 28 aa, Artificial Sequence
  Description of Artificial Sequence: Synthetic peptide
DEAEIRTTNPVATEQYGSTSTNLQHGAI

SEQ ID NO: 7699 - protein, 29 aa, Artificial Sequence
  Description of Artificial Sequence: Synthetic peptide
DEEEIRTTNPVATEQYGSVETNLTRGVPN

SEQ ID NO: 7700 - protein, 32 aa, Artificial Sequence
  Description of Artificial Sequence: Synthetic polypeptide
DEEEIRTTNPVATEQYGSVSVTNLNRIGNIRD

SEQ ID NO: 7701 - protein, 28 aa, Artificial Sequence
  Description of Artificial Sequence: Synthetic peptide
DEEHIRTTNPVATEQYGCVSTNDQFGNC

SEQ ID NO: 7702 - protein, 31 aa, Artificial Sequence
  Description of Artificial Sequence: Synthetic polypeptide
DEEEIRTTNPVATEQYGSVSVTNLPQRMGQQ

SEQ ID NO: 7703 - protein, 31 aa, Artificial Sequence
  Description of Artificial Sequence: Synthetic polypeptide
DEEEIRTTNPVATEQYGSVSVTNLQAGFNTQ

SEQ ID NO: 7704 - protein, 30 aa, Artificial Sequence
  Description of Artificial Sequence: Synthetic polypeptide
DEEGIRTTNPVATEQYGSVSTNLADTGQNR

SEQ ID NO: 7705 - protein, 32 aa, Artificial Sequence
  Description of Artificial Sequence: Synthetic polypeptide
DEEEIRTTNPVATEQYGSVSVTNLQHGDNQRD

SEQ ID NO: 7706 - protein, 30 aa, Artificial Sequence
  Description of Artificial Sequence: Synthetic polypeptide
DEEEIRTTNPVATEQYGSVSVTNLQMGVLQ

SEQ ID NO: 7707 - protein, 28 aa, Artificial Sequence
  Description of Artificial Sequence: Synthetic peptide
DEEEIRTTNPVATEQYGSVETSLQISNE

SEQ ID NO: 7708 - protein, 30 aa, Artificial Sequence
  Description of Artificial Sequence: Synthetic polypeptide
DEEEIRTTNPVATEQYGSVETSNLQRGLQQ

SEQ ID NO: 7709 - protein, 30 aa, Artificial Sequence
  Description of Artificial Sequence: Synthetic polypeptide
DEEEIRTTNPVATEQYGSVETSTLQRGNNP

SEQ ID NO: 7710 - protein, 30 aa, Artificial Sequence
  Description of Artificial Sequence: Synthetic polypeptide
DEEEIRTTNPVATEQYGSVSVTNLQNGDFE

SEQ ID NO: 7711 - protein, 29 aa, Artificial Sequence
  Description of Artificial Sequence: Synthetic peptide
DDMEIRTTNPVATEQYGSVSTNELQGGVR

SEQ ID NO: 7712 - protein, 29 aa, Artificial Sequence
  Description of Artificial Sequence: Synthetic peptide
DDMEIRTTNPVATEQYGSVSTNNLQLGER

SEQ ID NO: 7713 - protein, 30 aa, Artificial Sequence
  Description of Artificial Sequence: Synthetic polypeptide
DEEEIRTTNPVATEQYGSVSANLQNFGGND

SEQ ID NO: 7714 - protein, 28 aa, Artificial Sequence
  Description of Artificial Sequence: Synthetic peptide
DEEEIRTTNPVATEQYGSVETTLQNGIS

SEQ ID NO: 7715 - protein, 30 aa, Artificial Sequence
  Description of Artificial Sequence: Synthetic polypeptide
DEEGIRTTNPVATEQYGSVSTNLVDNGNNR

SEQ ID NO: 7716 - protein, 30 aa, Artificial Sequence
  Description of Artificial Sequence: Synthetic polypeptide
DEEGIRTTNPVATEQYGSVSTNLTFNGQNR

SEQ ID NO: 7717 - protein, 30 aa, Artificial Sequence
  Description of Artificial Sequence: Synthetic polypeptide
DEEGIRTTNPVATEQYGSVSTNLRENGQNR

SEQ ID NO: 7718 - protein, 31 aa, Artificial Sequence
  Description of Artificial Sequence: Synthetic polypeptide
DEEGIRTTNPVATEQYGSVSTNLQDNNGQNR

SEQ ID NO: 7719 - protein, 30 aa, Artificial Sequence
  Description of Artificial Sequence: Synthetic polypeptide
DEEEIRTTNPVATEQYGSVSVTNLQIGIGV

SEQ ID NO: 7720 - protein, 30 aa, Artificial Sequence
  Description of Artificial Sequence: Synthetic polypeptide
DEEEIRTTNPVATEQYGSVSVTSLQMGDNH

SEQ ID NO: 7721 - protein, 29 aa, Artificial Sequence
  Description of Artificial Sequence: Synthetic peptide
DEEEIRTTNPVATEQYGSVFNTELQRVNQ

SEQ ID NO: 7722 - protein, 32 aa, Artificial Sequence
  Description of Artificial Sequence: Synthetic polypeptide
DEEEIRTTNPVATEQYGSVSVTSNLQRGLVRI

SEQ ID NO: 7723 - protein, 30 aa, Artificial Sequence
  Description of Artificial Sequence: Synthetic polypeptide
DEEEISTTNPVATEQYGSVSTNLQHGNNPI

SEQ ID NO: 7724 - protein, 30 aa, Artificial Sequence
  Description of Artificial Sequence: Synthetic polypeptide
DEEEISTTNPVATEQYGSVSTNLQGNMENR

SEQ ID NO: 7725 - protein, 31 aa, Artificial Sequence
  Description of Artificial Sequence: Synthetic polypeptide
DEEEISTTNPVATEQYGSVSTNLFQNGSNRQ

SEQ ID NO: 7726 - protein, 29 aa, Artificial Sequence
  Description of Artificial Sequence: Synthetic peptide
DEEEISTTNPVATEQYGSVSTNLEIGMER

SEQ ID NO: 7727 - protein, 29 aa, Artificial Sequence
  Description of Artificial Sequence: Synthetic peptide
DEEEISTTNPVATEQYGSVSTNHQRGVQI

SEQ ID NO: 7728 - protein, 29 aa, Artificial Sequence
  Description of Artificial Sequence: Synthetic peptide
DEEEISTTNPVATEQYGSVSTNGQRGILE

SEQ ID NO: 7729 - protein, 31 aa, Artificial Sequence
  Description of Artificial Sequence: Synthetic polypeptide
DEEEIRTTNPVATEQYGSVSWENLQRTSNRD

SEQ ID NO: 7730 - protein, 30 aa, Artificial Sequence
  Description of Artificial Sequence: Synthetic polypeptide
DEEEIRTTNPVATEQYGSVSWENLQYDNRS

SEQ ID NO: 7731 - protein, 30 aa, Artificial Sequence
  Description of Artificial Sequence: Synthetic polypeptide
DEEEISTTNPVATEQYGSVSTGNLQGNGND

SEQ ID NO: 7732 - protein, 30 aa, Artificial Sequence
  Description of Artificial Sequence: Synthetic polypeptide
DEEEIRTTNPVATEQYGSVSAMNLQRLNNT

SEQ ID NO: 7733 - protein, 29 aa, Artificial Sequence
  Description of Artificial Sequence: Synthetic peptide
DEEEISTTNPVATEQYGSVSTGLQRGEDQ

SEQ ID NO: 7734 - protein, 30 aa, Artificial Sequence
  Description of Artificial Sequence: Synthetic polypeptide
DEEEISTTNPVATEQYGSVSMTYLQSGNRS

SEQ ID NO: 7735 - protein, 31 aa, Artificial Sequence
  Description of Artificial Sequence: Synthetic polypeptide
DEEEISTTNPVATEQYGSVSMTNLQRFGNLV

SEQ ID NO: 7736 - protein, 29 aa, Artificial Sequence
  Description of Artificial Sequence: Synthetic peptide
DEEEIRTTNPVATEQYGSVSWDNLNRGDT

SEQ ID NO: 7737 - protein, 31 aa, Artificial Sequence
  Description of Artificial Sequence: Synthetic polypeptide
DEEEISTTNPVATEQYGSVSMTNLQRFGNDG

SEQ ID NO: 7738 - protein, 31 aa, Artificial Sequence
  Description of Artificial Sequence: Synthetic polypeptide
DEEEIRTTNPVATEQYGSVSWMNLEQRGEDR

SEQ ID NO: 7739 - protein, 30 aa, Artificial Sequence
  Description of Artificial Sequence: Synthetic polypeptide
DEEEISTTNPVATEQYGSVSCTNLQNGSNE

SEQ ID NO: 7740 - protein, 28 aa, Artificial Sequence
  Description of Artificial Sequence: Synthetic peptide
DEEEIRTTNPVATEQYGSVSALLNRINS

SEQ ID NO: 7741 - protein, 29 aa, Artificial Sequence
  Description of Artificial Sequence: Synthetic peptide
DEEEIRTTNPVATEQYGSVSWNATQQGNE

SEQ ID NO: 7742 - protein, 28 aa, Artificial Sequence
  Description of Artificial Sequence: Synthetic peptide
DEEEIATTNPVATEQYGSVATNLQYANQ

SEQ ID NO: 7743 - protein, 29 aa, Artificial Sequence
  Description of Artificial Sequence: Synthetic peptide
DEEEIRTTNPVATEQYGSVSWNDDQQGNI

SEQ ID NO: 7744 - protein, 30 aa, Artificial Sequence
  Description of Artificial Sequence: Synthetic polypeptide
DEEEIRTTNPVATEQYGSVSWNDLQNGNDE

SEQ ID NO: 7745 - protein, 30 aa, Artificial Sequence
  Description of Artificial Sequence: Synthetic polypeptide
DEEEIATTNPVATEQYGSVATNLQRTGNSM

SEQ ID NO: 7746 - protein, 28 aa, Artificial Sequence
  Description of Artificial Sequence: Synthetic peptide
DEEEIATTNPVATEQYGSVATNLQREVG

SEQ ID NO: 7747 - protein, 32 aa, Artificial Sequence
  Description of Artificial Sequence: Synthetic polypeptide
DEEEISTTNPVATEQYGSVCSTMNLQRGNSNR

SEQ ID NO: 7748 - protein, 30 aa, Artificial Sequence
  Description of Artificial Sequence: Synthetic polypeptide
DEEEIATTNPVATEQYGSVATNLQREGNAQ

SEQ ID NO: 7749 - protein, 28 aa, Artificial Sequence
  Description of Artificial Sequence: Synthetic peptide
DEEEIATTNPVATEQYGSVATNLQREGH

SEQ ID NO: 7750 - protein, 30 aa, Artificial Sequence
  Description of Artificial Sequence: Synthetic polypeptide
DEEEIRTTNPVATEQYGSVSWNLDRINIRT

SEQ ID NO: 7751 - protein, 31 aa, Artificial Sequence
  Description of Artificial Sequence: Synthetic polypeptide
DEEEISTTNPVATEQYGSVSLNLQRTGGNRT

SEQ ID NO: 7752 - protein, 30 aa, Artificial Sequence
  Description of Artificial Sequence: Synthetic polypeptide
DEEEISTTNPVATEQYGSVSTNLQQFGNNC

SEQ ID NO: 7753 - protein, 31 aa, Artificial Sequence
  Description of Artificial Sequence: Synthetic polypeptide
DEEEISTTNPVATEQYGSVSTNLQRGSQNFI

SEQ ID NO: 7754 - protein, 30 aa, Artificial Sequence
  Description of Artificial Sequence: Synthetic polypeptide
DEEEISTTNPVATEQYGSVSTNLQRSSNPQ

SEQ ID NO: 7755 - protein, 29 aa, Artificial Sequence
  Description of Artificial Sequence: Synthetic peptide
DEEEIVTTNPVATEQYGSVATNLQEHGNQ

SEQ ID NO: 7756 - protein, 29 aa, Artificial Sequence
  Description of Artificial Sequence: Synthetic peptide
DEEEIRTTNPVATEQYGSVSANLIDRNND

SEQ ID NO: 7757 - protein, 31 aa, Artificial Sequence
  Description of Artificial Sequence: Synthetic polypeptide
DEEEIRTTNPVATEQYGSVSANLERGENGRE

SEQ ID NO: 7758 - protein, 31 aa, Artificial Sequence
  Description of Artificial Sequence: Synthetic polypeptide
DEEEIRTTNPVATEQYGSVSANLERGENERM

SEQ ID NO: 7759 - protein, 30 aa, Artificial Sequence
  Description of Artificial Sequence: Synthetic polypeptide
DEEEIRTTNPVATEQYGSVSANLDRINERV

SEQ ID NO: 7760 - protein, 32 aa, Artificial Sequence
  Description of Artificial Sequence: Synthetic polypeptide
DEEEIRTTNPVATEQYGSVFSTNDQERGGNPR

SEQ ID NO: 7761 - protein, 30 aa, Artificial Sequence
  Description of Artificial Sequence: Synthetic polypeptide
DEEEIRTTNPVATEQYGSVFSTNLERNNEG

SEQ ID NO: 7762 - protein, 31 aa, Artificial Sequence
  Description of Artificial Sequence: Synthetic polypeptide
DEEEITTTNPVATEQYGSVSTNTLQERQGNL

SEQ ID NO: 7763 - protein, 30 aa, Artificial Sequence
  Description of Artificial Sequence: Synthetic polypeptide
DEEEIRTTNPVATEQYGSVSVTVGLQRGIN

SEQ ID NO: 7764 - protein, 29 aa, Artificial Sequence
  Description of Artificial Sequence: Synthetic peptide
DEEEIATTNPVATEQYGSVATTDQRGSNR

SEQ ID NO: 7765 - protein, 29 aa, Artificial Sequence
  Description of Artificial Sequence: Synthetic peptide
DEEEISTTNPVAYEQYGWVSCTNLQSGNR

SEQ ID NO: 7766 - protein, 30 aa, Artificial Sequence
  Description of Artificial Sequence: Synthetic polypeptide
DEEEISTTNPVAYEQYGSVSTNLQRGDNQM

SEQ ID NO: 7767 - protein, 31 aa, Artificial Sequence
  Description of Artificial Sequence: Synthetic polypeptide
DEEEIRTTNPVATEQYGSVFSTNPQNFGSNR

SEQ ID NO: 7768 - protein, 28 aa, Artificial Sequence
  Description of Artificial Sequence: Synthetic peptide
DEEEIRTTNPVATEQYGSVSANHQRDAE

SEQ ID NO: 7769 - protein, 30 aa, Artificial Sequence
  Description of Artificial Sequence: Synthetic polypeptide
DEEEIRTTNPVATEQYGSVSVTVSLQRGVE

SEQ ID NO: 7770 - protein, 28 aa, Artificial Sequence
  Description of Artificial Sequence: Synthetic peptide
DEEEIRTTNPVATEQYGSVSANDQRDEE

SEQ ID NO: 7771 - protein, 31 aa, Artificial Sequence
  Description of Artificial Sequence: Synthetic polypeptide
DEEEIRTTNPVATEQYGSVSVTYLQSGENRI

SEQ ID NO: 7772 - protein, 29 aa, Artificial Sequence
  Description of Artificial Sequence: Synthetic peptide
DEEEIRTTNPVATEQYGSVFTDLQRGEEM

SEQ ID NO: 7773 - protein, 29 aa, Artificial Sequence
  Description of Artificial Sequence: Synthetic peptide
DEEEIRTTNPVATEQYGSVFTDWLQFGER

SEQ ID NO: 7774 - protein, 32 aa, Artificial Sequence
  Description of Artificial Sequence: Synthetic polypeptide
DEEEISTTNPVATEQYGSVVYSTNLQRGGNRD

SEQ ID NO: 7775 - protein, 31 aa, Artificial Sequence
  Description of Artificial Sequence: Synthetic polypeptide
DEEEISTTNPVATEQYGSVSVTNLQNLGSNR

SEQ ID NO: 7776 - protein, 30 aa, Artificial Sequence
  Description of Artificial Sequence: Synthetic polypeptide
DEEEISTTNPVATEQYGSVSTYLQRMGSNF

SEQ ID NO: 7777 - protein, 30 aa, Artificial Sequence
  Description of Artificial Sequence: Synthetic polypeptide
DEEEISTTNPVATEQYGSVSTYLQRMGSNA

SEQ ID NO: 7778 - protein, 30 aa, Artificial Sequence
  Description of Artificial Sequence: Synthetic polypeptide
DEEEISTTNPVATEQYGSVSTTNLQQGSNV

SEQ ID NO: 7779 - protein, 29 aa, Artificial Sequence
  Description of Artificial Sequence: Synthetic peptide
DEEEIRTTNPVATEQYGSVSVVLQNGERN

SEQ ID NO: 7780 - protein, 31 aa, Artificial Sequence
  Description of Artificial Sequence: Synthetic polypeptide
DEEEISTTNPVATEQYGSVSTNQLQERMGNL

SEQ ID NO: 7781 - protein, 29 aa, Artificial Sequence
  Description of Artificial Sequence: Synthetic peptide
DEEEISTTNPVATEQYGSVSTNPQRGQLF

SEQ ID NO: 7782 - protein, 31 aa, Artificial Sequence
  Description of Artificial Sequence: Synthetic polypeptide
DEEEISTTNPVATEQYGSVSTNLVQHGGNRP

SEQ ID NO: 7783 - protein, 30 aa, Artificial Sequence
  Description of Artificial Sequence: Synthetic polypeptide
DEEEISTTNPVATEQYGSVSTNLQSSNNRE

SEQ ID NO: 7784 - protein, 30 aa, Artificial Sequence
  Description of Artificial Sequence: Synthetic polypeptide
DEEEIATTNPVATEQYGSVATNLQRDNDRV

SEQ ID NO: 7785 - protein, 30 aa, Artificial Sequence
  Description of Artificial Sequence: Synthetic polypeptide
DEEEIRTTNPVATEQYGSVSVNGLQRGLEF

SEQ ID NO: 7786 - protein, 31 aa, Artificial Sequence
  Description of Artificial Sequence: Synthetic polypeptide
DEEEIRTTNPVATEQYGSVCTPNLQRGNDSM

SEQ ID NO: 7787 - protein, 30 aa, Artificial Sequence
  Description of Artificial Sequence: Synthetic polypeptide
DEEEIRTTNPVATEQYGSVSVNFNLQRENI

SEQ ID NO: 7788 - protein, 30 aa, Artificial Sequence
  Description of Artificial Sequence: Synthetic polypeptide
DEEEIRTTNPVATEQYGSVSTWLDRGEQRE

SEQ ID NO: 7789 - protein, 30 aa, Artificial Sequence
  Description of Artificial Sequence: Synthetic polypeptide
DEEEIRTTNPVATEQYGSVCSTNNLQDGEM

SEQ ID NO: 7790 - protein, 28 aa, Artificial Sequence
  Description of Artificial Sequence: Synthetic peptide
DDEEIRSTNPVATEQYGSSSTNAQRGNN

SEQ ID NO: 7791 - protein, 30 aa, Artificial Sequence
  Description of Artificial Sequence: Synthetic polypeptide
DEGEIRTTNPVATEQYGSVTTNLQRGGNPE

SEQ ID NO: 7792 - protein, 29 aa, Artificial Sequence
  Description of Artificial Sequence: Synthetic peptide
DEGEIRTTNPVATEQYGSVSYNLFRNMNR

SEQ ID NO: 7793 - protein, 30 aa, Artificial Sequence
  Description of Artificial Sequence: Synthetic polypeptide
DEAEIRTTNPVATEQYGSVSTGNHQMEGNR

SEQ ID NO: 7794 - protein, 30 aa, Artificial Sequence
  Description of Artificial Sequence: Synthetic polypeptide
DDEEIRSTNPVATEQYGSVSTNLQPRTGQR

SEQ ID NO: 7795 - protein, 30 aa, Artificial Sequence
  Description of Artificial Sequence: Synthetic polypeptide
DEAEIRTTNPVATEQYGSVSTENLQDGNKN

SEQ ID NO: 7796 - protein, 30 aa, Artificial Sequence
  Description of Artificial Sequence: Synthetic polypeptide
DEAEIRTTNPVATEQYGSVSTENDQIGENR

SEQ ID NO: 7797 - protein, 31 aa, Artificial Sequence
  Description of Artificial Sequence: Synthetic polypeptide
DEGEIRTTNPVATEQYGSVSTNLQREGNSQE

SEQ ID NO: 7798 - protein, 30 aa, Artificial Sequence
  Description of Artificial Sequence: Synthetic polypeptide
DEGEIRTTNPVATEQYGSVSTNLQMGDNPA

SEQ ID NO: 7799 - protein, 30 aa, Artificial Sequence
  Description of Artificial Sequence: Synthetic polypeptide
DEGEIRTTNPVATEQYGSVSTNLQGGGNEH

SEQ ID NO: 7800 - protein, 30 aa, Artificial Sequence
  Description of Artificial Sequence: Synthetic polypeptide
DEGEIRTTNPVATEQYGSVSTNLQGGENQQ

SEQ ID NO: 7801 - protein, 29 aa, Artificial Sequence
  Description of Artificial Sequence: Synthetic peptide
DEEEIRTTNPVATEQYGSVSTWHQTGSNA

SEQ ID NO: 7802 - protein, 30 aa, Artificial Sequence
  Description of Artificial Sequence: Synthetic polypeptide
DEGEIRTTNPVATEQYGSVSTNLQEMGERL

SEQ ID NO: 7803 - protein, 30 aa, Artificial Sequence
  Description of Artificial Sequence: Synthetic polypeptide
DEGEIRTTNPVATEQYGSVSTNLDGNNGNR

SEQ ID NO: 7804 - protein, 31 aa, Artificial Sequence
  Description of Artificial Sequence: Synthetic polypeptide
DEEEIRTTNPVATEQYGSVCSTNNQLDGNRN

SEQ ID NO: 7805 - protein, 29 aa, Artificial Sequence
  Description of Artificial Sequence: Synthetic peptide
DEEEIRTTNPVATEQYGSVSTWLQPRTDD

SEQ ID NO: 7806 - protein, 30 aa, Artificial Sequence
  Description of Artificial Sequence: Synthetic polypeptide
DEGEIRTTNPVATEQYGSVSTELSMRGNNR

SEQ ID NO: 7807 - protein, 28 aa, Artificial Sequence
  Description of Artificial Sequence: Synthetic peptide
DEGEIRTTNPVATEQYGSVSTDMQRGDN

SEQ ID NO: 7808 - protein, 28 aa, Artificial Sequence
  Description of Artificial Sequence: Synthetic peptide
DEGEIRTTNPVATEQYGSVSTDIQRGDV

SEQ ID NO: 7809 - protein, 29 aa, Artificial Sequence
  Description of Artificial Sequence: Synthetic peptide
DEGEIRTTNPVATEQYGSVSQTALERMNR

SEQ ID NO: 7810 - protein, 29 aa, Artificial Sequence
  Description of Artificial Sequence: Synthetic peptide
DEGEIRTTNPVATEQYGSVSQNLNRNMNR

SEQ ID NO: 7811 - protein, 30 aa, Artificial Sequence
  Description of Artificial Sequence: Synthetic polypeptide
DEGEIRTTNPVATEQYGSVSDNDQRGENRD

SEQ ID NO: 7812 - protein, 28 aa, Artificial Sequence
  Description of Artificial Sequence: Synthetic peptide
DEGEIRTTNPVATEQYGSVQTSLIRSNR

SEQ ID NO: 7813 - protein, 31 aa, Artificial Sequence
  Description of Artificial Sequence: Synthetic polypeptide
DEEEIATTNPVATEQYGSVSATNNLQVGNRP

SEQ ID NO: 7814 - protein, 28 aa, Artificial Sequence
  Description of Artificial Sequence: Synthetic peptide
DEGEIRTTNPVATEQYGSVQTQLARMNR

SEQ ID NO: 7815 - protein, 28 aa, Artificial Sequence
  Description of Artificial Sequence: Synthetic peptide
DEGEIRTTNPVATEQYGSVQTPLIRVNR

SEQ ID NO: 7816 - protein, 29 aa, Artificial Sequence
  Description of Artificial Sequence: Synthetic peptide
DEGEIRTTNPVATEQYGSVSTNLNAGNMQ

SEQ ID NO: 7817 - protein, 28 aa, Artificial Sequence
  Description of Artificial Sequence: Synthetic peptide
DEGEIRTTNPVATEQYGSVQTHLTRMNR

SEQ ID NO: 7818 - protein, 28 aa, Artificial Sequence
  Description of Artificial Sequence: Synthetic peptide
DEGEIRTTNPVATEQYGSVVTALHRMNR

SEQ ID NO: 7819 - protein, 28 aa, Artificial Sequence
  Description of Artificial Sequence: Synthetic peptide
DEGEIRTTNPVATEQYGSVVTNLQHGQE

SEQ ID NO: 7820 - protein, 31 aa, Artificial Sequence
  Description of Artificial Sequence: Synthetic polypeptide
DEEEIRTTNPVATEQYGSVSCTHELQREGNS

SEQ ID NO: 7821 - protein, 30 aa, Artificial Sequence
  Description of Artificial Sequence: Synthetic polypeptide
DEEEIRTTNPVATEQYGSVCSTNLQVNNDA

SEQ ID NO: 7822 - protein, 28 aa, Artificial Sequence
  Description of Artificial Sequence: Synthetic peptide
DEGTIRTTNPVATEQYGSWSTNLIIGNR

SEQ ID NO: 7823 - protein, 28 aa, Artificial Sequence
  Description of Artificial Sequence: Synthetic peptide
DEGSIRTTNPVATEQYGSTSTNLIIGNR

SEQ ID NO: 7824 - protein, 28 aa, Artificial Sequence
  Description of Artificial Sequence: Synthetic peptide
DEGQIRTTNPVATEQYGSFSTNLIQGNR

SEQ ID NO: 7825 - protein, 28 aa, Artificial Sequence
  Description of Artificial Sequence: Synthetic peptide
DEGNIRTTNPVATEQYGSFSTNLNIGNR

SEQ ID NO: 7826 - protein, 28 aa, Artificial Sequence
  Description of Artificial Sequence: Synthetic peptide
DEGMIRTTNPVATEQYGSISTNLDIGNR

SEQ ID NO: 7827 - protein, 30 aa, Artificial Sequence
  Description of Artificial Sequence: Synthetic polypeptide
DEEEIRTTNPVATEQYGSVSTVPLQTFGNV

SEQ ID NO: 7828 - protein, 28 aa, Artificial Sequence
  Description of Artificial Sequence: Synthetic peptide
DEGMIRTTNPVATEQYGSESTNLIVGNR

SEQ ID NO: 7829 - protein, 31 aa, Artificial Sequence
  Description of Artificial Sequence: Synthetic polypeptide
DEEEIRTTNPVATEQYGSVCSTNLQYLSNRT

SEQ ID NO: 7830 - protein, 28 aa, Artificial Sequence
  Description of Artificial Sequence: Synthetic peptide
DEGHIRTTNPVATEQYGSTSTNLIIGNR

SEQ ID NO: 7831 - protein, 28 aa, Artificial Sequence
  Description of Artificial Sequence: Synthetic peptide
DDEEIRCTNPVATEQYGNVSENLMRGNR

SEQ ID NO: 7832 - protein, 30 aa, Artificial Sequence
  Description of Artificial Sequence: Synthetic polypeptide
DEEEIRTTNPVATEQYGSVSTVSQDRSGDR

SEQ ID NO: 7833 - protein, 28 aa, Artificial Sequence
  Description of Artificial Sequence: Synthetic peptide
DEGEIRTTNPVATEQYGSVVTALIRPNR

SEQ ID NO: 7834 - protein, 30 aa, Artificial Sequence
  Description of Artificial Sequence: Synthetic polypeptide
DEEEIRTTNPVATEQYGSVSTVTLQNGNFT

SEQ ID NO: 7835 - protein, 32 aa, Artificial Sequence
  Description of Artificial Sequence: Synthetic polypeptide
DEEEIRTTNPVATEQYGSVSCTGNLSQRGNYE

SEQ ID NO: 7836 - protein, 30 aa, Artificial Sequence
  Description of Artificial Sequence: Synthetic polypeptide
DEGEIRTTNPVAYEQYGSVSTNDQRGNDRV

SEQ ID NO: 7837 - protein, 29 aa, Artificial Sequence
  Description of Artificial Sequence: Synthetic peptide
DDEEIRCTNPVATEQYGSVSSTNDQRGNN

SEQ ID NO: 7838 - protein, 31 aa, Artificial Sequence
  Description of Artificial Sequence: Synthetic polypeptide
DEEEIRTTNPVATEQYGSVSCTGNLQETGND

SEQ ID NO: 7839 - protein, 30 aa, Artificial Sequence
  Description of Artificial Sequence: Synthetic polypeptide
DEEEIATTNPVATEQYGSVSETNLQDGNGD

SEQ ID NO: 7840 - protein, 32 aa, Artificial Sequence
  Description of Artificial Sequence: Synthetic polypeptide
DEEEIRTTNPVATEQYGSVSTVYLEQRSGNRP

SEQ ID NO: 7841 - protein, 30 aa, Artificial Sequence
  Description of Artificial Sequence: Synthetic polypeptide
DEEEIRTTNPVATEQYGSVSTVYLQNVNRF

SEQ ID NO: 7842 - protein, 31 aa, Artificial Sequence
  Description of Artificial Sequence: Synthetic polypeptide
DEEEIRTTNPVATEQYGSVSTVYLQRNANRE

SEQ ID NO: 7843 - protein, 30 aa, Artificial Sequence
  Description of Artificial Sequence: Synthetic polypeptide
DEEEIRTTNPVATEQYGSVSTWDDQRNNMR

SEQ ID NO: 7844 - protein, 30 aa, Artificial Sequence
  Description of Artificial Sequence: Synthetic polypeptide
DEEEIRTTNPVATEQYGSVSTWDLQDGNQD

SEQ ID NO: 7845 - protein, 30 aa, Artificial Sequence
  Description of Artificial Sequence: Synthetic polypeptide
DEEEIRTTNPVATEQYGSVSTWDNQSRGER

SEQ ID NO: 7846 - protein, 29 aa, Artificial Sequence
  Description of Artificial Sequence: Synthetic peptide
DEEEIRTTNPVATEQYGSVSTWDQRINQG

SEQ ID NO: 7847 - protein, 28 aa, Artificial Sequence
  Description of Artificial Sequence: Synthetic peptide
DEGEIRTTNPVATEQYGSVWTELIRMNR

SEQ ID NO: 7848 - protein, 30 aa, Artificial Sequence
  Description of Artificial Sequence: Synthetic polypeptide
DEEEIRTTNPVATEQYGSVCSTNLTGSPNR

SEQ ID NO: 7849 - protein, 28 aa, Artificial Sequence
  Description of Artificial Sequence: Synthetic peptide
DEGEIRTTNPVATEQYGSVQTDLIRDNR

SEQ ID NO: 7850 - protein, 29 aa, Artificial Sequence
  Description of Artificial Sequence: Synthetic peptide
DEGEIRTTNPVATEQYGSVQTALNRVGNR

SEQ ID NO: 7851 - protein, 28 aa, Artificial Sequence
  Description of Artificial Sequence: Synthetic peptide
DEGEIRTTNPVATEQYGSVQTALLRENR

SEQ ID NO: 7852 - protein, 29 aa, Artificial Sequence
  Description of Artificial Sequence: Synthetic peptide
DEGEIRTTNPVATEQYGSISTNTQREGIR

SEQ ID NO: 7853 - protein, 30 aa, Artificial Sequence
  Description of Artificial Sequence: Synthetic polypeptide
DEEEIRTTNPVATEQYGSVCSTNQQPREND

SEQ ID NO: 7854 - protein, 29 aa, Artificial Sequence
  Description of Artificial Sequence: Synthetic peptide
DEGEIRTTNPVATEQYGSCSTNLQNGNDF

SEQ ID NO: 7855 - protein, 29 aa, Artificial Sequence
  Description of Artificial Sequence: Synthetic peptide
DEGEIRTTNPVATEQYGSASTNHQREGLR

SEQ ID NO: 7856 - protein, 29 aa, Artificial Sequence
  Description of Artificial Sequence: Synthetic peptide
DEEEIATTNPVATEQYGSVSAGNLQRGDP

SEQ ID NO: 7857 - protein, 29 aa, Artificial Sequence
  Description of Artificial Sequence: Synthetic peptide
DEGEIRTTNPVATEQYGEVSTNLQIGGNM

SEQ ID NO: 7858 - protein, 28 aa, Artificial Sequence
  Description of Artificial Sequence: Synthetic peptide
DEGEIRTTNPVATEQYGEVSENLQRGDG

SEQ ID NO: 7859 - protein, 31 aa, Artificial Sequence
  Description of Artificial Sequence: Synthetic polypeptide
DEEEIRTTNPVATEQYGSVCSTNVIQQDGNR

SEQ ID NO: 7860 - protein, 29 aa, Artificial Sequence
  Description of Artificial Sequence: Synthetic peptide
DEEEIATTNPVATEQYGSVPTNSLQREER

SEQ ID NO: 7861 - protein, 31 aa, Artificial Sequence
  Description of Artificial Sequence: Synthetic polypeptide
DEEEIRTTNPVATEQYGSVCSTNWIQDCGNR

SEQ ID NO: 7862 - protein, 31 aa, Artificial Sequence
  Description of Artificial Sequence: Synthetic polypeptide
DEEEIATTNPVATEQYGSVPSTNHSQRPGNR

SEQ ID NO: 7863 - protein, 31 aa, Artificial Sequence
  Description of Artificial Sequence: Synthetic polypeptide
DEEEIRTTNPVATEQYGSVSTWNLQSGSNNV

SEQ ID NO: 7864 - protein, 31 aa, Artificial Sequence
  Description of Artificial Sequence: Synthetic polypeptide
DEEEIRTTNPVATEQYGSVSTWNLQVGNNNA

SEQ ID NO: 7865 - protein, 29 aa, Artificial Sequence
  Description of Artificial Sequence: Synthetic peptide
DEGEIRTTNPVATEQYGSISTNTQREGMR

SEQ ID NO: 7866 - protein, 28 aa, Artificial Sequence
  Description of Artificial Sequence: Synthetic peptide
DEGEIRTTNPVATELYGSVSVNLQTGNF

SEQ ID NO: 7867 - protein, 29 aa, Artificial Sequence
  Description of Artificial Sequence: Synthetic peptide
DEGEIRTTNPVATEHYGSVSTNLQGGNND

SEQ ID NO: 7868 - protein, 31 aa, Artificial Sequence
  Description of Artificial Sequence: Synthetic polypeptide
DEEEIATTNPVATEQYGSVNSTGNLQAGNGR

SEQ ID NO: 7869 - protein, 29 aa, Artificial Sequence
  Description of Artificial Sequence: Synthetic peptide
DEEEIRTTNPVATEQYGSVSTWVSQRTNV

SEQ ID NO: 7870 - protein, 31 aa, Artificial Sequence
  Description of Artificial Sequence: Synthetic polypeptide
DEEEIRTTNPVATEQYGSVCSTPLQRGGNED

SEQ ID NO: 7871 - protein, 30 aa, Artificial Sequence
  Description of Artificial Sequence: Synthetic polypeptide
DEEEIATTNPVATEQYGSVGVTNLQRGGNL

SEQ ID NO: 7872 - protein, 30 aa, Artificial Sequence
  Description of Artificial Sequence: Synthetic polypeptide
DEEEIRTTNPVATEQYGSVCSTPLQRGSEV

SEQ ID NO: 7873 - protein, 31 aa, Artificial Sequence
  Description of Artificial Sequence: Synthetic polypeptide
DEAEIRTTNPVATEQYGSVSQTNLGQGSGNR

SEQ ID NO: 7874 - protein, 29 aa, Artificial Sequence
  Description of Artificial Sequence: Synthetic peptide
DEAEIRTTNPVATEQYGSVSQTILQRGDH

SEQ ID NO: 7875 - protein, 28 aa, Artificial Sequence
  Description of Artificial Sequence: Synthetic peptide
DEGEIRATNPVAYEQYGSVSTNLDRGDR

SEQ ID NO: 7876 - protein, 30 aa, Artificial Sequence
  Description of Artificial Sequence: Synthetic polypeptide
DEEEIRTTNPVATEQYGSVSTYDQRGDNSE

SEQ ID NO: 7877 - protein, 30 aa, Artificial Sequence
  Description of Artificial Sequence: Synthetic polypeptide
DEEEIRTTNPVATEQYGSVSTYEQDEGNER

SEQ ID NO: 7878 - protein, 30 aa, Artificial Sequence
  Description of Artificial Sequence: Synthetic polypeptide
DEEEIRTTNPVATEQYGSVSTYGLQERVFR

SEQ ID NO: 7879 - protein, 29 aa, Artificial Sequence
  Description of Artificial Sequence: Synthetic peptide
DEEEIATTNPVATEQYGSVCTNLQGGDVR

SEQ ID NO: 7880 - protein, 28 aa, Artificial Sequence
  Description of Artificial Sequence: Synthetic peptide
DEGEIRTTNPVATEIYGSVSNNLQRGDV

SEQ ID NO: 7881 - protein, 31 aa, Artificial Sequence
  Description of Artificial Sequence: Synthetic polypeptide
DEEEIRTTNPVATEQYGSVCSTNQQDDGNRI

SEQ ID NO: 7882 - protein, 32 aa, Artificial Sequence
  Description of Artificial Sequence: Synthetic polypeptide
DEGEIRTTNPVATEQYGSTVPSTNLSQRGDNR

SEQ ID NO: 7883 - protein, 30 aa, Artificial Sequence
  Description of Artificial Sequence: Synthetic polypeptide
DEAEIRTTNPVATEQYGSVSSTNLQDGNPS

SEQ ID NO: 7884 - protein, 29 aa, Artificial Sequence
  Description of Artificial Sequence: Synthetic peptide
DEAEIRTTNPVATEQYGSVSTDLQRPNED

SEQ ID NO: 7885 - protein, 28 aa, Artificial Sequence
  Description of Artificial Sequence: Synthetic peptide
DEGEIRTTNPVATEQYGSVQTALGRENR

SEQ ID NO: 7886 - protein, 30 aa, Artificial Sequence
  Description of Artificial Sequence: Synthetic polypeptide
DEEEIRTTNPVATEQYGSVSTWNDEERENR

SEQ ID NO: 7887 - protein, 30 aa, Artificial Sequence
  Description of Artificial Sequence: Synthetic polypeptide
DEEEIRTTNPVATEQYGSVSCTEDLERGNE

SEQ ID NO: 7888 - protein, 30 aa, Artificial Sequence
  Description of Artificial Sequence: Synthetic polypeptide
DEEEIRTTNPVATEQYGSVSTWNDPQDGNE

SEQ ID NO: 7889 - protein, 28 aa, Artificial Sequence
  Description of Artificial Sequence: Synthetic peptide
DEGEIRTTNPVATEQYGSVGTALNRMNR

SEQ ID NO: 7890 - protein, 30 aa, Artificial Sequence
  Description of Artificial Sequence: Synthetic polypeptide
DEEEIRTTNPVATEQYGSVSTWNDQFGNVT

SEQ ID NO: 7891 - protein, 29 aa, Artificial Sequence
  Description of Artificial Sequence: Synthetic peptide
DEGEIRTTNPVATEQYGSVETNLQRGEGI

SEQ ID NO: 7892 - protein, 29 aa, Artificial Sequence
  Description of Artificial Sequence: Synthetic peptide
DEGEIRTTNPVATEQYGSVCTNLTQREER

SEQ ID NO: 7893 - protein, 31 aa, Artificial Sequence
  Description of Artificial Sequence: Synthetic polypeptide
DEGEIRTTNPVATEQYGSVCTNLQRGENERP

SEQ ID NO: 7894 - protein, 29 aa, Artificial Sequence
  Description of Artificial Sequence: Synthetic peptide
DEAEIRTTNPVATEQYGSVSTALQSGNME

SEQ ID NO: 7895 - protein, 30 aa, Artificial Sequence
  Description of Artificial Sequence: Synthetic polypeptide
DEEEIRTTNPVATEQYGSVSTWNLDMRGEQ

SEQ ID NO: 7896 - protein, 28 aa, Artificial Sequence
  Description of Artificial Sequence: Synthetic peptide
DEGEIRTTNPVATEQYGSVCTALIRNNR

SEQ ID NO: 7897 - protein, 30 aa, Artificial Sequence
  Description of Artificial Sequence: Synthetic polypeptide
DEEEIRTTNPVATEQYGSVSTWNLDQSGQE

SEQ ID NO: 7898 - protein, 31 aa, Artificial Sequence
  Description of Artificial Sequence: Synthetic polypeptide
DEEEIRTTNPVATEQYGSVCSTNPQRFGNDA

SEQ ID NO: 7899 - protein, 29 aa, Artificial Sequence
  Description of Artificial Sequence: Synthetic peptide
DEEEIATTNPVATEQYGSVSANQLQDGNQ

SEQ ID NO: 7900 - protein, 30 aa, Artificial Sequence
  Description of Artificial Sequence: Synthetic polypeptide
DEEEIRTTNPVATEQYGSVSTWNLPQTGQE

SEQ ID NO: 7901 - protein, 29 aa, Artificial Sequence
  Description of Artificial Sequence: Synthetic peptide
DEGEIRTTNPVATEQYGSVATNLVRGNQV

SEQ ID NO: 7902 - protein, 29 aa, Artificial Sequence
  Description of Artificial Sequence: Synthetic peptide
DEGEIRTTNPVATEQYGSVATNLTRDGNH

SEQ ID NO: 7903 - protein, 29 aa, Artificial Sequence
  Description of Artificial Sequence: Synthetic peptide
DEGEIRTTNPVATEQYGSVATNLQERGDH

SEQ ID NO: 7904 - protein, 29 aa, Artificial Sequence
  Description of Artificial Sequence: Synthetic peptide
DEGEIRTTNPVATEQYGSVATNLDRGNSM

SEQ ID NO: 7905 - protein, 28 aa, Artificial Sequence
  Description of Artificial Sequence: Synthetic peptide
DEGEIRTTNPVATEQYGSVATALTRENR

SEQ ID NO: 7906 - protein, 30 aa, Artificial Sequence
  Description of Artificial Sequence: Synthetic polypeptide
DEAEIRTTNPVATEQYGSVSSTNNNQRGNE

SEQ ID NO: 7907 - protein, 30 aa, Artificial Sequence
  Description of Artificial Sequence: Synthetic polypeptide
DEEEIRTTNPVATEQYGSVCSTNPQRGPSM

SEQ ID NO: 7908 - protein, 30 aa, Artificial Sequence
  Description of Artificial Sequence: Synthetic polypeptide
DEAEIRTTNPVATEQYGSVSSTNLQTGNMG

SEQ ID NO: 7909 - protein, 30 aa, Artificial Sequence
  Description of Artificial Sequence: Synthetic polypeptide
DEAEIRTTNPVATEQYGSVSSTNLQQAGNT

SEQ ID NO: 7910 - protein, 30 aa, Artificial Sequence
  Description of Artificial Sequence: Synthetic polypeptide
DEAEIRTTNPVATEQYGSVSSTNLQLGNSD

SEQ ID NO: 7911 - protein, 30 aa, Artificial Sequence
  Description of Artificial Sequence: Synthetic polypeptide
DEAEIRTTNPVATEQYGSVSSTNLQFGNAQ

SEQ ID NO: 7912 - protein, 30 aa, Artificial Sequence
  Description of Artificial Sequence: Synthetic polypeptide
DEEEIRTTNPVATEQYGSVCSTNPQWDGNA

SEQ ID NO: 7913 - protein, 31 aa, Artificial Sequence
  Description of Artificial Sequence: Synthetic polypeptide
DEEEIRTTNPVATEQYGSVSCTHLTQRSQNR

SEQ ID NO: 7914 - protein, 29 aa, Artificial Sequence
  Description of Artificial Sequence: Synthetic peptide
DEEEIATTNPVATEQYGSVCTNLQDGPER

SEQ ID NO: 7915 - protein, 29 aa, Artificial Sequence
  Description of Artificial Sequence: Synthetic peptide
DEAEIRTTNPVATEQYGSVSTNAGQMNNR

SEQ ID NO: 7916 - protein, 29 aa, Artificial Sequence
  Description of Artificial Sequence: Synthetic peptide
DEAEIRTTNPVATEQYGSVSTNANDRGNE

SEQ ID NO: 7917 - protein, 31 aa, Artificial Sequence
  Description of Artificial Sequence: Synthetic polypeptide
DEAEIRTTNPVATEQYGSVSTNLQHGDNGRE

SEQ ID NO: 7918 - protein, 31 aa, Artificial Sequence
  Description of Artificial Sequence: Synthetic polypeptide
DEEEIRTTNPVATEQYGSVSCTNDQNVGNNR

SEQ ID NO: 7919 - protein, 29 aa, Artificial Sequence
  Description of Artificial Sequence: Synthetic peptide
DEAEIRTTNPVATEQYGSVSTNLQGQGDV

SEQ ID NO: 7920 - protein, 30 aa, Artificial Sequence
  Description of Artificial Sequence: Synthetic polypeptide
DEEEIATTNPVATEQYGSVSTDSLGQSGNR

SEQ ID NO: 7921 - protein, 30 aa, Artificial Sequence
  Description of Artificial Sequence: Synthetic polypeptide
DEEEIATTNPVATEQYGSVSTDNLQHGNQH

SEQ ID NO: 7922 - protein, 30 aa, Artificial Sequence
  Description of Artificial Sequence: Synthetic polypeptide
DEEEIATTNPVATEQYGSVSTDNLQHGNIM

SEQ ID NO: 7923 - protein, 28 aa, Artificial Sequence
  Description of Artificial Sequence: Synthetic peptide
DEHEIRTTNPVATDQYGSVQTQLQRGNQ

SEQ ID NO: 7924 - protein, 28 aa, Artificial Sequence
  Description of Artificial Sequence: Synthetic peptide
DEHEIRTTNPVATDQYGSVNTYLQRGNP

SEQ ID NO: 7925 - protein, 30 aa, Artificial Sequence
  Description of Artificial Sequence: Synthetic polypeptide
DEEEIATTNPVATEQYGSVSTDLSQSRGDR

SEQ ID NO: 7926 - protein, 31 aa, Artificial Sequence
  Description of Artificial Sequence: Synthetic polypeptide
DEAEIRTTNPVATEQYGSVSTNLQGPGDNNR

SEQ ID NO: 7927 - protein, 30 aa, Artificial Sequence
  Description of Artificial Sequence: Synthetic polypeptide
DEEEIRTTNPVATEQYGSVSCTNDPQRGDF

SEQ ID NO: 7928 - protein, 28 aa, Artificial Sequence
  Description of Artificial Sequence: Synthetic peptide
DEHEIRTTNPVATDQYGSVNTQLQRGNT

SEQ ID NO: 7929 - protein, 28 aa, Artificial Sequence
  Description of Artificial Sequence: Synthetic peptide
DEHEIRTTNPVATDQYGSVNTDLQRGNG

SEQ ID NO: 7930 - protein, 32 aa, Artificial Sequence
  Description of Artificial Sequence: Synthetic polypeptide
DEEEIRTTNPVATEQYGSVCSTNLELRGNERG

SEQ ID NO: 7931 - protein, 30 aa, Artificial Sequence
  Description of Artificial Sequence: Synthetic polypeptide
DEAEIRTTNPVATEQYGSVSTNLQGMGNEK

SEQ ID NO: 7932 - protein, 28 aa, Artificial Sequence
  Description of Artificial Sequence: Synthetic peptide
DEHEIRTTNPVATDQYGSVGTELQRGNL

SEQ ID NO: 7933 - protein, 28 aa, Artificial Sequence
  Description of Artificial Sequence: Synthetic peptide
DEHEIRTTNPVATDQYGSVATSLQRGND

SEQ ID NO: 7934 - protein, 28 aa, Artificial Sequence
  Description of Artificial Sequence: Synthetic peptide
DEHEIRTTNPVATDQYGSVATLLQRGND

SEQ ID NO: 7935 - protein, 30 aa, Artificial Sequence
  Description of Artificial Sequence: Synthetic polypeptide
DEAEIRTTNPVATEQYGSVSTNLQGGGNNS

SEQ ID NO: 7936 - protein, 30 aa, Artificial Sequence
  Description of Artificial Sequence: Synthetic polypeptide
DEEEIATTNPVATEQYGSVSTALSQAGNYR

SEQ ID NO: 7937 - protein, 30 aa, Artificial Sequence
  Description of Artificial Sequence: Synthetic polypeptide
DEEEIRTTNPVATEQYGSVCSTNLERFNDG

SEQ ID NO: 7938 - protein, 30 aa, Artificial Sequence
  Description of Artificial Sequence: Synthetic polypeptide
DEEEIRTTNPVATEQYGSVCSTNLERGDEM

SEQ ID NO: 7939 - protein, 30 aa, Artificial Sequence
  Description of Artificial Sequence: Synthetic polypeptide
DEEEIRTTNPVATEQYGSVCSTNLETGEDR

SEQ ID NO: 7940 - protein, 31 aa, Artificial Sequence
  Description of Artificial Sequence: Synthetic polypeptide
DEEEIRTTNPVATEQYGSVCSTNLHQRGSSD

SEQ ID NO: 7941 - protein, 30 aa, Artificial Sequence
  Description of Artificial Sequence: Synthetic polypeptide
DEAEIRTTNPVATEQYGSVSTNLQGDGMNG

SEQ ID NO: 7942 - protein, 29 aa, Artificial Sequence
  Description of Artificial Sequence: Synthetic peptide
DEAEIRTTNPVATEQYGSVSTNLQFGGDT

SEQ ID NO: 7943 - protein, 31 aa, Artificial Sequence
  Description of Artificial Sequence: Synthetic polypeptide
DEAEIRTTNPVATEQYGSVSTNLQERNGEPR

SEQ ID NO: 7944 - protein, 31 aa, Artificial Sequence
  Description of Artificial Sequence: Synthetic polypeptide
DEAEIRTTNPVATEQYGSVSTNLQDNGQNMR

SEQ ID NO: 7945 - protein, 28 aa, Artificial Sequence
  Description of Artificial Sequence: Synthetic peptide
DEHEIRTTNPVATDQYGSVHTVLQRGND

SEQ ID NO: 7946 - protein, 30 aa, Artificial Sequence
  Description of Artificial Sequence: Synthetic polypeptide
DEAEIRTTNPVATEQYGSVSTNLQAQGNEM

SEQ ID NO: 7947 - protein, 30 aa, Artificial Sequence
  Description of Artificial Sequence: Synthetic polypeptide
DEHEIRTTNPVATEAYGSVSTNLQGDGNTR

SEQ ID NO: 7948 - protein, 31 aa, Artificial Sequence
  Description of Artificial Sequence: Synthetic polypeptide
DEEEIATTNPVATEQYGSVSTENLGDRGNSR

SEQ ID NO: 7949 - protein, 30 aa, Artificial Sequence
  Description of Artificial Sequence: Synthetic polypeptide
DEEEIATTNPVATEQYGSVSTGNGQDGNSR

SEQ ID NO: 7950 - protein, 30 aa, Artificial Sequence
  Description of Artificial Sequence: Synthetic polypeptide
DEHEIRTTNPVATEIYGSVSTNLQRGNGDQ

SEQ ID NO: 7951 - protein, 29 aa, Artificial Sequence
  Description of Artificial Sequence: Synthetic peptide
DEHEIRTTNPVATEIYGSVSTNLQGEGNS

SEQ ID NO: 7952 - protein, 30 aa, Artificial Sequence
  Description of Artificial Sequence: Synthetic polypeptide
DEHEIRTTNPVATEIYGSVSTNGQRGDDNR

SEQ ID NO: 7953 - protein, 30 aa, Artificial Sequence
  Description of Artificial Sequence: Synthetic polypeptide
DEAEIRTTNPVATEQYGSVSTNLQNRENQV

SEQ ID NO: 7954 - protein, 30 aa, Artificial Sequence
  Description of Artificial Sequence: Synthetic polypeptide
DEAEIRTTNPVATEQYGSVSTNLQNRENEQ

SEQ ID NO: 7955 - protein, 29 aa, Artificial Sequence
  Description of Artificial Sequence: Synthetic peptide
DEHEIRTTNPVATEHYGSVSTNLQNGNED

SEQ ID NO: 7956 - protein, 29 aa, Artificial Sequence
  Description of Artificial Sequence: Synthetic peptide
DEHEIRTTNPVATEHYGSVSTNLQFGNND

SEQ ID NO: 7957 - protein, 30 aa, Artificial Sequence
  Description of Artificial Sequence: Synthetic polypeptide
DEAEIRTTNPVATEQYGSVSTNLQNGDNNM

SEQ ID NO: 7958 - protein, 31 aa, Artificial Sequence
  Description of Artificial Sequence: Synthetic polypeptide
DEAEIRTTNPVATEQYGSVSTNLQNDSGNTR

SEQ ID NO: 7959 - protein, 29 aa, Artificial Sequence
  Description of Artificial Sequence: Synthetic peptide
DEHEIRTTNPVATEGYGSVTTNLQRGENE

SEQ ID NO: 7960 - protein, 29 aa, Artificial Sequence
  Description of Artificial Sequence: Synthetic peptide
DEHEIRTTNPVATEGYGSVSTNVQAGNER

SEQ ID NO: 7961 - protein, 30 aa, Artificial Sequence
  Description of Artificial Sequence: Synthetic polypeptide
DEHEIRTTNPVATEGYGSVSTNLQIGGNTR

SEQ ID NO: 7962 - protein, 30 aa, Artificial Sequence
  Description of Artificial Sequence: Synthetic polypeptide
DEAEIRTTNPVATEQYGSVSTNLQHQGDNS

SEQ ID NO: 7963 - protein, 29 aa, Artificial Sequence
  Description of Artificial Sequence: Synthetic peptide
DEEEIATTNPVATEQYGSVSTGLETGNDR

SEQ ID NO: 7964 - protein, 31 aa, Artificial Sequence
  Description of Artificial Sequence: Synthetic polypeptide
DEAEIRTTNPVATEQYGSVSTNLQNDEGNNR

SEQ ID NO: 7965 - protein, 30 aa, Artificial Sequence
  Description of Artificial Sequence: Synthetic polypeptide
DEHEIRTTNPVATEEYGSVSTNLQREGNEM

SEQ ID NO: 7966 - protein, 30 aa, Artificial Sequence
  Description of Artificial Sequence: Synthetic polypeptide
DEAEIRTTNPVATEQYGSVSTNLQMSGNAS

SEQ ID NO: 7967 - protein, 31 aa, Artificial Sequence
  Description of Artificial Sequence: Synthetic polypeptide
DEEEIRTTNPVATEQYGSVCSTNLELRGEAR

SEQ ID NO: 7968 - protein, 29 aa, Artificial Sequence
  Description of Artificial Sequence: Synthetic peptide
DEHEIRTTNPVATECYGSVSTNMQRGDRM

SEQ ID NO: 7969 - protein, 30 aa, Artificial Sequence
  Description of Artificial Sequence: Synthetic polypeptide
DEAEIRTTNPVATEQYGSVSTNLQMGGENK

SEQ ID NO: 7970 - protein, 31 aa, Artificial Sequence
  Description of Artificial Sequence: Synthetic polypeptide
DEAEIRTTNPVATEQYGSVSTNLQMDGGNNR

SEQ ID NO: 7971 - protein, 30 aa, Artificial Sequence
  Description of Artificial Sequence: Synthetic polypeptide
DEAEIRTTNPVATEQYGSVSTNLQLIGNQS

SEQ ID NO: 7972 - protein, 30 aa, Artificial Sequence
  Description of Artificial Sequence: Synthetic polypeptide
DEAEIRTTNPVATEQYGSVSTNLQLGLNEA

SEQ ID NO: 7973 - protein, 29 aa, Artificial Sequence
  Description of Artificial Sequence: Synthetic peptide
DEAEIRTTNPVATEQYGSVSTNLQKGMGG

SEQ ID NO: 7974 - protein, 30 aa, Artificial Sequence
  Description of Artificial Sequence: Synthetic polypeptide
DEAEIRTTNPVATEQYGSVSTNLQKGDNGM

SEQ ID NO: 7975 - protein, 29 aa, Artificial Sequence
  Description of Artificial Sequence: Synthetic peptide
DEAEIRTTNPVATEQYGSVSTNLQIGGEM

SEQ ID NO: 7976 - protein, 30 aa, Artificial Sequence
  Description of Artificial Sequence: Synthetic polypeptide
DEAEIRTTNPVATEQYGSVSTNLQHQNDER

SEQ ID NO: 7977 - protein, 29 aa, Artificial Sequence
  Description of Artificial Sequence: Synthetic peptide
DEEEIATTNPVATEQYGSVSTGLERGNAE

SEQ ID NO: 7978 - protein, 29 aa, Artificial Sequence
  Description of Artificial Sequence: Synthetic peptide
DEAEIRTTNPVATEQYGSVSTNLQAQGDT

SEQ ID NO: 7979 - protein, 31 aa, Artificial Sequence
  Description of Artificial Sequence: Synthetic polypeptide
DEAEIRTTNPVATEQYGSVSTNLQAGENARE

SEQ ID NO: 7980 - protein, 30 aa, Artificial Sequence
  Description of Artificial Sequence: Synthetic polypeptide
DEAEIRTTNPVATEQYGSVSTNLQAGDNNP

SEQ ID NO: 7981 - protein, 30 aa, Artificial Sequence
  Description of Artificial Sequence: Synthetic polypeptide
DEAEIRTTNPVATEQYGSVSTNLEQAGNEN

SEQ ID NO: 7982 - protein, 31 aa, Artificial Sequence
  Description of Artificial Sequence: Synthetic polypeptide
DEEEIRTTNPVATEQYGSVCSTNLQQQENRL

SEQ ID NO: 7983 - protein, 30 aa, Artificial Sequence
  Description of Artificial Sequence: Synthetic polypeptide
DEAEIRTTNPVATEQYGSVSTNLEKDGNTR

SEQ ID NO: 7984 - protein, 32 aa, Artificial Sequence
  Description of Artificial Sequence: Synthetic polypeptide
DEEEIRTTNPVATEQYGSVCSTNLQRFGSNNE

SEQ ID NO: 7985 - protein, 31 aa, Artificial Sequence
  Description of Artificial Sequence: Synthetic polypeptide
DEEEIRTTNPVATEQYGSVCSTNLQRFNSDF

SEQ ID NO: 7986 - protein, 30 aa, Artificial Sequence
  Description of Artificial Sequence: Synthetic polypeptide
DEAEIRTTNPVATEQYGSVSTNLDRGNENG

SEQ ID NO: 7987 - protein, 30 aa, Artificial Sequence
  Description of Artificial Sequence: Synthetic polypeptide
DEAEIRTTNPVATEQYGSVSTNLDQGGMNN

SEQ ID NO: 7988 - protein, 30 aa, Artificial Sequence
  Description of Artificial Sequence: Synthetic polypeptide
DEAEIRTTNPVATEQYGSVSTNIQTNLGNR

SEQ ID NO: 7989 - protein, 32 aa, Artificial Sequence
  Description of Artificial Sequence: Synthetic polypeptide
DEEEIRTTNPVATEQYGSVCSTNLQRIGSNAI

SEQ ID NO: 7990 - protein, 30 aa, Artificial Sequence
  Description of Artificial Sequence: Synthetic polypeptide
DEEEIRTTNPVATEQYGSVCSTNLQRMEFG

SEQ ID NO: 7991 - protein, 31 aa, Artificial Sequence
  Description of Artificial Sequence: Synthetic polypeptide
DEEEIRTTNPVATEQYGSVCSTNLQRQGGLG

SEQ ID NO: 7992 - protein, 29 aa, Artificial Sequence
  Description of Artificial Sequence: Synthetic peptide
DEAEIRTTNPVATEQYGSVSTNHQGGNTT

SEQ ID NO: 7993 - protein, 30 aa, Artificial Sequence
  Description of Artificial Sequence: Synthetic polypeptide
DEEEIATTNPVATEQYGSVSQTNLQDGNQQ

SEQ ID NO: 7994 - protein, 30 aa, Artificial Sequence
  Description of Artificial Sequence: Synthetic polypeptide
DEAEIRTTNPVATEQYGSVSTNLEQEGNSG

SEQ ID NO: 7995 - protein, 29 aa, Artificial Sequence
  Description of Artificial Sequence: Synthetic peptide
DEAEIRTTNPVATEQYGSVSTNHQAGNNK

SEQ ID NO: 7996 - protein, 29 aa, Artificial Sequence
  Description of Artificial Sequence: Synthetic peptide
DEAEIRTTNPVATEQYGSVSTNHNQGGNM

SEQ ID NO: 7997 - protein, 32 aa, Artificial Sequence
  Description of Artificial Sequence: Synthetic polypeptide
DEEEIRTTNPVATEQYGSVSCTLNALQRGGSR

SEQ ID NO: 7998 - protein, 30 aa, Artificial Sequence
  Description of Artificial Sequence: Synthetic polypeptide
DEAEIRTTNPVATEQYGSVSTNGPRMGDNR

SEQ ID NO: 7999 - protein, 31 aa, Artificial Sequence
  Description of Artificial Sequence: Synthetic polypeptide
DEEEIATTNPVATEQYGSVSPTNLQERQPNR

SEQ ID NO: 8000 - protein, 28 aa, Artificial Sequence
  Description of Artificial Sequence: Synthetic peptide
DEGYIRTTNPVATEQYGSTSTNLINGNR

SEQ ID NO: 8001 - protein, 28 aa, Artificial Sequence
  Description of Artificial Sequence: Synthetic peptide
DEGYIRTTNPVATEQYGSASTNLDIGNR

SEQ ID NO: 8002 - protein, 28 aa, Artificial Sequence
  Description of Artificial Sequence: Synthetic peptide
DEGVIRTTNPVATEQYGTVETNPQRGNR

SEQ ID NO: 8003 - protein, 29 aa, Artificial Sequence
  Description of Artificial Sequence: Synthetic peptide
DEAEIRTTNPVATEQYGSVSTNGGQERNR

SEQ ID NO: 8004 - protein, 30 aa, Artificial Sequence
  Description of Artificial Sequence: Synthetic polypeptide
DDEEIRATNPVATEQYGSVSTNLQARTGQR

SEQ ID NO: 8005 - protein, 30 aa, Artificial Sequence
  Description of Artificial Sequence: Synthetic polypeptide
DEAEIRTTNPVATEQYGSVSTNDQRGENTQ

SEQ ID NO: 8006 - protein, 29 aa, Artificial Sequence
  Description of Artificial Sequence: Synthetic peptide
DEEEIATTNPVATEQYGSVSNNDLQNGNM

SEQ ID NO: 8007 - protein, 31 aa, Artificial Sequence
  Description of Artificial Sequence: Synthetic polypeptide
DEEEIRTTNPVATEQYGSVCSTNLQSSGNFP

SEQ ID NO: 8008 - protein, 30 aa, Artificial Sequence
  Description of Artificial Sequence: Synthetic polypeptide
DEEEIRTTNPVATEQYGSVSCTILQRQDRI

SEQ ID NO: 8009 - protein, 31 aa, Artificial Sequence
  Description of Artificial Sequence: Synthetic polypeptide
DEEEIATTNPVATEQYGSVSQNLQRGANERG

SEQ ID NO: 8010 - protein, 31 aa, Artificial Sequence
  Description of Artificial Sequence: Synthetic polypeptide
DEEEIRTTNPVATEQYGSVCSTNLQQGANNE

SEQ ID NO: 8011 - protein, 30 aa, Artificial Sequence
  Description of Artificial Sequence: Synthetic polypeptide
DEEEIRTTNPVATEQYGSVCSTNLQPEGAQ

SEQ ID NO: 8012 - protein, 31 aa, Artificial Sequence
  Description of Artificial Sequence: Synthetic polypeptide
DEEEIRTTNPVATEQYGSVCSTNLQNQGNMD

SEQ ID NO: 8013 - protein, 29 aa, Artificial Sequence
  Description of Artificial Sequence: Synthetic peptide
DEAEIRTTNPVATEQYGSVSTNLQADGTT

SEQ ID NO: 8014 - protein, 30 aa, Artificial Sequence
  Description of Artificial Sequence: Synthetic polypeptide
DEAEIRTTNPVATEQYGSVSTNLPQDGDMR

SEQ ID NO: 8015 - protein, 32 aa, Artificial Sequence
  Description of Artificial Sequence: Synthetic polypeptide
DEEEIRTTNPVATEQYGSVCSTNLQDDDGNRV

SEQ ID NO: 8016 - protein, 30 aa, Artificial Sequence
  Description of Artificial Sequence: Synthetic polypeptide
DEEEIRTTNPVATEQYGSVCSTNLQDHNDN

SEQ ID NO: 8017 - protein, 31 aa, Artificial Sequence
  Description of Artificial Sequence: Synthetic polypeptide
DEEEIRTTNPVATEQYGSVSCTNALTMPGNR

SEQ ID NO: 8018 - protein, 31 aa, Artificial Sequence
  Description of Artificial Sequence: Synthetic polypeptide
DEEEIRTTNPVATEQYGSVCSTNLQDNENRW

SEQ ID NO: 8019 - protein, 31 aa, Artificial Sequence
  Description of Artificial Sequence: Synthetic polypeptide
DEEEIRTTNPVATEQYGSVCSTNLQDNGDRG

SEQ ID NO: 8020 - protein, 33 aa, Artificial Sequence
  Description of Artificial Sequence: Synthetic polypeptide
DEEEIRTTNPVATEQYGSVSCTNALQNRNVGNR

SEQ ID NO: 8021 - protein, 32 aa, Artificial Sequence
  Description of Artificial Sequence: Synthetic polypeptide
DEEEIRTTNPVATEQYGSVSCTNALMRGGNQR

SEQ ID NO: 8022 - protein, 31 aa, Artificial Sequence
  Description of Artificial Sequence: Synthetic polypeptide
DEEEIRTTNPVATEQYGSVCSTNLQFLSNRT

SEQ ID NO: 8023 - protein, 28 aa, Artificial Sequence
  Description of Artificial Sequence: Synthetic peptide
DEHEICTTNPVATEQYGSVSTNIQHGNE

SEQ ID NO: 8024 - protein, 31 aa, Artificial Sequence
  Description of Artificial Sequence: Synthetic polypeptide
DEAEIRTTNPVATEQYGSVSTNLNQDGQNER

SEQ ID NO: 8025 - protein, 31 aa, Artificial Sequence
  Description of Artificial Sequence: Synthetic polypeptide
DEEEIRTTNPVATEQYGSVCSTNLQGGETRS

SEQ ID NO: 8026 - protein, 30 aa, Artificial Sequence
  Description of Artificial Sequence: Synthetic polypeptide
DEAEIRTTNPVATEQYGSVSTNLNQDGGNM

SEQ ID NO: 8027 - protein, 32 aa, Artificial Sequence
  Description of Artificial Sequence: Synthetic polypeptide
DEEEIRTTNPVATEQYGSVCSTNLQHGGENRS

SEQ ID NO: 8028 - protein, 31 aa, Artificial Sequence
  Description of Artificial Sequence: Synthetic polypeptide
DEEEIRTTNPVATEQYGSVCSTNLQHIENRV

SEQ ID NO: 8029 - protein, 31 aa, Artificial Sequence
  Description of Artificial Sequence: Synthetic polypeptide
DEEEIRTTNPVATEQYGSVCSTNLQHNENRL

SEQ ID NO: 8030 - protein, 31 aa, Artificial Sequence
  Description of Artificial Sequence: Synthetic polypeptide
DEEEIRTTNPVATEQYGSVCSTNLQHNNNRS

SEQ ID NO: 8031 - protein, 30 aa, Artificial Sequence
  Description of Artificial Sequence: Synthetic polypeptide
DEAEIRTTNPVATEQYGSVSTNLMQDGDKR

SEQ ID NO: 8032 - protein, 32 aa, Artificial Sequence
  Description of Artificial Sequence: Synthetic polypeptide
DEEEIRTTNPVATEQYGSVCSTNLQNAGSNRQ

SEQ ID NO: 8033 - protein, 30 aa, Artificial Sequence
  Description of Artificial Sequence: Synthetic polypeptide
DEAEIRTTNPVATEQYGSVSTNLGQSGNDA

SEQ ID NO: 8034 - protein, 28 aa, Artificial Sequence
  Description of Artificial Sequence: Synthetic peptide
DEHEIATTNPVATEQYGSVSTNQQFGNM

SEQ ID NO: 8035 - protein, 30 aa, Artificial Sequence
  Description of Artificial Sequence: Synthetic polypeptide
DEHEIATTNPVATEQYGSVSTNLQRGEDNA

SEQ ID NO: 8036 - protein, 29 aa, Artificial Sequence
  Description of Artificial Sequence: Synthetic peptide
DEHEIATTNPVATEQYGSVSTNLQRDNHE

SEQ ID NO: 8037 - protein, 30 aa, Artificial Sequence
  Description of Artificial Sequence: Synthetic polypeptide
DEAEIRTTNPVATEQYGSVSTNLGEGGINR

SEQ ID NO: 8038 - protein, 32 aa, Artificial Sequence
  Description of Artificial Sequence: Synthetic polypeptide
DEEEIRTTNPVATEQYGSVCSTNLQNNGSNRP

SEQ ID NO: 8039 - protein, 29 aa, Artificial Sequence
  Description of Artificial Sequence: Synthetic peptide
DEHEIATTNPVATEQYGSVSTNLERGESR

SEQ ID NO: 8040 - protein, 30 aa, Artificial Sequence
  Description of Artificial Sequence: Synthetic polypeptide
DEEEIRTTNPVATEQYGSVCSTNLQNNNSF

SEQ ID NO: 8041 - protein, 31 aa, Artificial Sequence
  Description of Artificial Sequence: Synthetic polypeptide
DEEEIATTNPVATEQYGSVSSTNLQRTGMER

SEQ ID NO: 8042 - protein, 29 aa, Artificial Sequence
  Description of Artificial Sequence: Synthetic peptide
DEEEIATTNPVATEQYGSVSKTNQQDGNG

SEQ ID NO: 8043 - protein, 29 aa, Artificial Sequence
  Description of Artificial Sequence: Synthetic peptide
DEAEIRTTNPVATEQYGSVSPTQLQRGDE

SEQ ID NO: 8044 - protein, 31 aa, Artificial Sequence
  Description of Artificial Sequence: Synthetic polypeptide
DEEEIRTTNPVATEQYGSVCSTTELQRNNRY

SEQ ID NO: 8045 - protein, 29 aa, Artificial Sequence
  Description of Artificial Sequence: Synthetic peptide
DEEEIRTTNPVATEQYGSVSTYHQYGSNT

SEQ ID NO: 8046 - protein, 30 aa, Artificial Sequence
  Description of Artificial Sequence: Synthetic polypeptide
DEEEIRTTNPVATEQYGSVCTNLQPRVNQY

SEQ ID NO: 8047 - protein, 31 aa, Artificial Sequence
  Description of Artificial Sequence: Synthetic polypeptide
DEEEIRTTNPVATEQYGSVCTNLQQDGNQRH

SEQ ID NO: 8048 - protein, 29 aa, Artificial Sequence
  Description of Artificial Sequence: Synthetic peptide
DEEEIRTTNPVATEQYGSVSCEDLQEGND

SEQ ID NO: 8049 - protein, 29 aa, Artificial Sequence
  Description of Artificial Sequence: Synthetic peptide
DEEEIRTTNPVATEQYGSVCTNLQQGEIQ

SEQ ID NO: 8050 - protein, 30 aa, Artificial Sequence
  Description of Artificial Sequence: Synthetic polypeptide
DDEEIRTTNPVATEQYGSVCSTNLGQSGNQ

SEQ ID NO: 8051 - protein, 30 aa, Artificial Sequence
  Description of Artificial Sequence: Synthetic polypeptide
DDEEIRTTNPVATEQYGSVCSTNLNQAGNA

SEQ ID NO: 8052 - protein, 30 aa, Artificial Sequence
  Description of Artificial Sequence: Synthetic polypeptide
DDEEIRTTNPVATEQYGSVCSVTNLQRQNA

SEQ ID NO: 8053 - protein, 31 aa, Artificial Sequence
  Description of Artificial Sequence: Synthetic polypeptide
DEEEIRTTNPVATEQYGSVCTNLQQGENPRD

SEQ ID NO: 8054 - protein, 30 aa, Artificial Sequence
  Description of Artificial Sequence: Synthetic polypeptide
DEEEIRTTNPVATEQYGSVCTNLQQRMNLL

SEQ ID NO: 8055 - protein, 29 aa, Artificial Sequence
  Description of Artificial Sequence: Synthetic peptide
DEEEIRTTNPVATEQYGSVSVDNLERNQR

SEQ ID NO: 8056 - protein, 30 aa, Artificial Sequence
  Description of Artificial Sequence: Synthetic polypeptide
DEEYIRTTNPVATEQYGSVSTNLDNNGQNR

SEQ ID NO: 8057 - protein, 28 aa, Artificial Sequence
  Description of Artificial Sequence: Synthetic peptide
DEEYIRTTNPVATEQYGCVSTNEQFGNC

SEQ ID NO: 8058 - protein, 30 aa, Artificial Sequence
  Description of Artificial Sequence: Synthetic polypeptide
DEEEIRTTNPVATEQYGSVCTNLQREDGDE

SEQ ID NO: 8059 - protein, 30 aa, Artificial Sequence
  Description of Artificial Sequence: Synthetic polypeptide
DEEEIRTTNPVATEQYGSVCTNLQPRQNED

SEQ ID NO: 8060 - protein, 29 aa, Artificial Sequence
  Description of Artificial Sequence: Synthetic peptide
DEEEIRTTNPVATEQYGSVSCDLQNGERP

SEQ ID NO: 8061 - protein, 30 aa, Artificial Sequence
  Description of Artificial Sequence: Synthetic polypeptide
DEEEIRTTNPVATEQYGSVCTNLQRGELSM

SEQ ID NO: 8062 - protein, 31 aa, Artificial Sequence
  Description of Artificial Sequence: Synthetic polypeptide
DEEEIRTTNPVATEQYGSVSVDNLQRQGNVE

SEQ ID NO: 8063 - protein, 30 aa, Artificial Sequence
  Description of Artificial Sequence: Synthetic polypeptide
DEEEIRTTNPVATEQYGSVCTNLQRGQLMA

SEQ ID NO: 8064 - protein, 31 aa, Artificial Sequence
  Description of Artificial Sequence: Synthetic polypeptide
DEEEIRTTNPVATEQYGSVCTNLQRNGDNQA

SEQ ID NO: 8065 - protein, 30 aa, Artificial Sequence
  Description of Artificial Sequence: Synthetic polypeptide
DEEEIRTTNPVATEQYGSVCTNLQRNHDRA

SEQ ID NO: 8066 - protein, 30 aa, Artificial Sequence
  Description of Artificial Sequence: Synthetic polypeptide
DEEEIRTTNPVATEQYGSVCTNLQRNPENI

SEQ ID NO: 8067 - protein, 29 aa, Artificial Sequence
  Description of Artificial Sequence: Synthetic peptide
DEEVIRTTNPVAYEQYGEEVSTNLQIGNR

SEQ ID NO: 8068 - protein, 30 aa, Artificial Sequence
  Description of Artificial Sequence: Synthetic polypeptide
DEEEIRTTNPVATEQYGSVCTNLQRPGTHQ

SEQ ID NO: 8069 - protein, 28 aa, Artificial Sequence
  Description of Artificial Sequence: Synthetic peptide
DEEEIRTTNPVATEQYGSVSCDLDRGDV

SEQ ID NO: 8070 - protein, 30 aa, Artificial Sequence
  Description of Artificial Sequence: Synthetic polypeptide
DEEEIRTTNPVATEQYGSVSVEDNLQRVNI

SEQ ID NO: 8071 - protein, 29 aa, Artificial Sequence
  Description of Artificial Sequence: Synthetic peptide
DEEEIRTTNPVATEQYGSVCTNLQRPLQT

SEQ ID NO: 8072 - protein, 29 aa, Artificial Sequence
  Description of Artificial Sequence: Synthetic peptide
DEEVIRTTNPVATEQYSEIVSTNLQIGNR

SEQ ID NO: 8073 - protein, 29 aa, Artificial Sequence
  Description of Artificial Sequence: Synthetic peptide
DEEEIRTTNPVATEQYGSVCTNLQRPPET

SEQ ID NO: 8074 - protein, 30 aa, Artificial Sequence
  Description of Artificial Sequence: Synthetic polypeptide
DEEEIRTTNPVATEQYGSVCTNLQREHNQL

SEQ ID NO: 8075 - protein, 30 aa, Artificial Sequence
  Description of Artificial Sequence: Synthetic polypeptide
DEEEIRTTNPVATEQYGSVCTNLQRPQLGR

SEQ ID NO: 8076 - protein, 31 aa, Artificial Sequence
  Description of Artificial Sequence: Synthetic polypeptide
DEEEIRTTNPVATEQYGSVCTNLQNREGPDR

SEQ ID NO: 8077 - protein, 28 aa, Artificial Sequence
  Description of Artificial Sequence: Synthetic peptide
DEFEICTTNPVATEQYGSVSTNLMAGNH

SEQ ID NO: 8078 - protein, 31 aa, Artificial Sequence
  Description of Artificial Sequence: Synthetic polypeptide
DEEEIRTTNPVATEQYGSVCTNLNRNGDNMR

SEQ ID NO: 8079 - protein, 31 aa, Artificial Sequence
  Description of Artificial Sequence: Synthetic polypeptide
DEEEIRTTNPVATEQYGSVSTYNLSNNMGNR

SEQ ID NO: 8080 - protein, 30 aa, Artificial Sequence
  Description of Artificial Sequence: Synthetic polypeptide
DEEEIRTTNPVATEQYGSVCTNLNRVGSND

SEQ ID NO: 8081 - protein, 30 aa, Artificial Sequence
  Description of Artificial Sequence: Synthetic polypeptide
DEEEIRTTNPVATEQYGSVCTNLPQTDGNN

SEQ ID NO: 8082 - protein, 30 aa, Artificial Sequence
  Description of Artificial Sequence: Synthetic polypeptide
DEEEIRTTNPVATEQYGSVCTNLQAGEPRY

SEQ ID NO: 8083 - protein, 30 aa, Artificial Sequence
  Description of Artificial Sequence: Synthetic polypeptide
DEEEIRTTNPVATEQYGSVCTNLQAGVEHR

SEQ ID NO: 8084 - protein, 31 aa, Artificial Sequence
  Description of Artificial Sequence: Synthetic polypeptide
DEEEIRTTNPVATEQYGSVCTNLQARPGDSR

SEQ ID NO: 8085 - protein, 31 aa, Artificial Sequence
  Description of Artificial Sequence: Synthetic polypeptide
DEEEIRTTNPVATEQYGSVCTNLQDDGNGRA

SEQ ID NO: 8086 - protein, 30 aa, Artificial Sequence
  Description of Artificial Sequence: Synthetic polypeptide
DEEEIRTTNPVATEQYGSVCTNLQDDNQRH

SEQ ID NO: 8087 - protein, 29 aa, Artificial Sequence
  Description of Artificial Sequence: Synthetic peptide
DEEEIRTTNPVATEQYGSVCTNLQDGGMN

SEQ ID NO: 8088 - protein, 29 aa, Artificial Sequence
  Description of Artificial Sequence: Synthetic peptide
DEEEIRTTNPVATEQYGSVCTNLQDGHTD

SEQ ID NO: 8089 - protein, 32 aa, Artificial Sequence
  Description of Artificial Sequence: Synthetic polypeptide
DEEEIRTTNPVATEQYGSVSCIGNELQRVGNR

SEQ ID NO: 8090 - protein, 31 aa, Artificial Sequence
  Description of Artificial Sequence: Synthetic polypeptide
DEEEIRTTNPVATEQYGSVSCICLSQRGGNR

SEQ ID NO: 8091 - protein, 29 aa, Artificial Sequence
  Description of Artificial Sequence: Synthetic peptide
DEAEIRTTNPVATEQYGSVPATNLSRGNE

SEQ ID NO: 8092 - protein, 30 aa, Artificial Sequence
  Description of Artificial Sequence: Synthetic polypeptide
DEEEIRTTNPVATEQYGSVSTYPQNFGNRF

SEQ ID NO: 8093 - protein, 30 aa, Artificial Sequence
  Description of Artificial Sequence: Synthetic polypeptide
DEEEIRTTNPVATEQYGSVCTNLQDQNDRN

SEQ ID NO: 8094 - protein, 30 aa, Artificial Sequence
  Description of Artificial Sequence: Synthetic polypeptide
DEEEIRTTNPVATEQYGSVCTNLQDRHNDD

SEQ ID NO: 8095 - protein, 29 aa, Artificial Sequence
  Description of Artificial Sequence: Synthetic peptide
DEAEIRTTNPVATEQYGSVPTNLQTGNDE

SEQ ID NO: 8096 - protein, 31 aa, Artificial Sequence
  Description of Artificial Sequence: Synthetic polypeptide
DEEEIATTNPVATEQYGSVCATNLQDRGNRS

SEQ ID NO: 8097 - protein, 30 aa, Artificial Sequence
  Description of Artificial Sequence: Synthetic polypeptide
DEEEIRTTNPVATEQYGSVCTNLQEDGNSL

SEQ ID NO: 8098 - protein, 30 aa, Artificial Sequence
  Description of Artificial Sequence: Synthetic polypeptide
DEEEIRTTNPVATEQYGSVSTYTQEGGSNR

SEQ ID NO: 8099 - protein, 29 aa, Artificial Sequence
  Description of Artificial Sequence: Synthetic peptide
DEEEIRTTNPVATEQYGSVCTNLQEGDIE

SEQ ID NO: 8100 - protein, 29 aa, Artificial Sequence
  Description of Artificial Sequence: Synthetic peptide
DEEEIRTTNPVATEQYGSVSTYVDQRFNV

SEQ ID NO: 8101 - protein, 30 aa, Artificial Sequence
  Description of Artificial Sequence: Synthetic polypeptide
DEEEIRTTNPVATEQYGSVSVAMNLQRVNI

SEQ ID NO: 8102 - protein, 30 aa, Artificial Sequence
  Description of Artificial Sequence: Synthetic polypeptide
DEEEIRTTNPVATEQYGSVCTNLQHDNERN

SEQ ID NO: 8103 - protein, 29 aa, Artificial Sequence
  Description of Artificial Sequence: Synthetic peptide
DEEEIRTTNPVATEQYGSVSVANLERGEF

SEQ ID NO: 8104 - protein, 29 aa, Artificial Sequence
  Description of Artificial Sequence: Synthetic peptide
DEEEIRTTNPVATEQYGSVCTNLQHGEQF

SEQ ID NO: 8105 - protein, 29 aa, Artificial Sequence
  Description of Artificial Sequence: Synthetic peptide
DEEEIRTTNPVATEQYGSVSVANLERTLR

SEQ ID NO: 8106 - protein, 31 aa, Artificial Sequence
  Description of Artificial Sequence: Synthetic polypeptide
DEEEIRTTNPVATEQYGSVSCHNMLQRVDNR

SEQ ID NO: 8107 - protein, 28 aa, Artificial Sequence
  Description of Artificial Sequence: Synthetic peptide
DEEVIRTTNPVATEQYGSVSTYELRGNT

SEQ ID NO: 8108 - protein, 30 aa, Artificial Sequence
  Description of Artificial Sequence: Synthetic polypeptide
DEEEIRTTNPVATEQYGSVCTNLQRTENQE

SEQ ID NO: 8109 - protein, 30 aa, Artificial Sequence
  Description of Artificial Sequence: Synthetic polypeptide
DEEEIRTTNPVATEQYGSVCTNLQRTLNAN

SEQ ID NO: 8110 - protein, 30 aa, Artificial Sequence
  Description of Artificial Sequence: Synthetic polypeptide
DEEEIRTTNPVATEQYGSVCTNLVEARGNA

SEQ ID NO: 8111 - protein, 30 aa, Artificial Sequence
  Description of Artificial Sequence: Synthetic polypeptide
DEEEIRTTNPVATEQYGSVSVHENLQRVNI

SEQ ID NO: 8112 - protein, 31 aa, Artificial Sequence
  Description of Artificial Sequence: Synthetic polypeptide
DEEEIRTTNPVATEQYGSVSCANLQVGNIRD

SEQ ID NO: 8113 - protein, 31 aa, Artificial Sequence
  Description of Artificial Sequence: Synthetic polypeptide
DEEEIRTTNPVATEQYGSVCTNLVQRAGNGI

SEQ ID NO: 8114 - protein, 29 aa, Artificial Sequence
  Description of Artificial Sequence: Synthetic peptide
DEEEIRTTNPVATEQYGSVCTNMQEQGNM

SEQ ID NO: 8115 - protein, 30 aa, Artificial Sequence
  Description of Artificial Sequence: Synthetic polypeptide
DEEVIRTTNPVATEQYGSCSTNLQDNGMNR

SEQ ID NO: 8116 - protein, 29 aa, Artificial Sequence
  Description of Artificial Sequence: Synthetic peptide
DEEEIRTTNPVATEQYGSVSAVVGQRGTR

SEQ ID NO: 8117 - protein, 29 aa, Artificial Sequence
  Description of Artificial Sequence: Synthetic peptide
DEEEIRTTNPVATEQYGSVSAVNLQNANS

SEQ ID NO: 8118 - protein, 28 aa, Artificial Sequence
  Description of Artificial Sequence: Synthetic peptide
DEEVIRTTNPVATEQYGLVSTNQQFGNG

SEQ ID NO: 8119 - protein, 30 aa, Artificial Sequence
  Description of Artificial Sequence: Synthetic polypeptide
DEEVIRTTNPVATEQYGESVSINLQRGDNM

SEQ ID NO: 8120 - protein, 29 aa, Artificial Sequence
  Description of Artificial Sequence: Synthetic peptide
DEEEIRTTNPVATEQYGSVCTNMQRGEEY

SEQ ID NO: 8121 - protein, 28 aa, Artificial Sequence
  Description of Artificial Sequence: Synthetic peptide
DEEVIRTTNPVATEQYGCVSTNWQFGNT

SEQ ID NO: 8122 - protein, 28 aa, Artificial Sequence
  Description of Artificial Sequence: Synthetic peptide
DEEVIRTTNPVATEQYGCVSTNPQYGNE

SEQ ID NO: 8123 - protein, 30 aa, Artificial Sequence
  Description of Artificial Sequence: Synthetic polypeptide
DEEEIRTTNPVATEQYGSVCTNLVDDGDNR

SEQ ID NO: 8124 - protein, 29 aa, Artificial Sequence
  Description of Artificial Sequence: Synthetic peptide
DEEEIRTTNPVATEQYGSVCTNMQRGEYE

SEQ ID NO: 8125 - protein, 29 aa, Artificial Sequence
  Description of Artificial Sequence: Synthetic peptide
DEEEIRTTNPVATEQYGSVCTNQQEHGNQ

SEQ ID NO: 8126 - protein, 30 aa, Artificial Sequence
  Description of Artificial Sequence: Synthetic polypeptide
DDEEIRTTNPVATEQYGSVSTENLQHLGNM

SEQ ID NO: 8127 - protein, 28 aa, Artificial Sequence
  Description of Artificial Sequence: Synthetic peptide
DEEVIRTTNPVATEQYGCVSTNAQFGNL

SEQ ID NO: 8128 - protein, 31 aa, Artificial Sequence
  Description of Artificial Sequence: Synthetic polypeptide
DEEEIRTTNPVATEQYGSVSVMNLQPRGDRS

SEQ ID NO: 8129 - protein, 30 aa, Artificial Sequence
  Description of Artificial Sequence: Synthetic polypeptide
DDEEIRTTNPVATEQYGSVSTGNLTRGSNT

SEQ ID NO: 8130 - protein, 30 aa, Artificial Sequence
  Description of Artificial Sequence: Synthetic polypeptide
DEEEIRTTNPVATEQYGSVCTNSLQRNIER

SEQ ID NO: 8131 - protein, 30 aa, Artificial Sequence
  Description of Artificial Sequence: Synthetic polypeptide
DEEVIRTTNPVATEQWYGEVSTPLQRHGNR

SEQ ID NO: 8132 - protein, 30 aa, Artificial Sequence
  Description of Artificial Sequence: Synthetic polypeptide
DEEEIRTTNPVATEQYGSVSVNANLQRVNE

SEQ ID NO: 8133 - protein, 29 aa, Artificial Sequence
  Description of Artificial Sequence: Synthetic peptide
DEEEIRTTNPVATEQYGSVSVNDDLRGNQ

SEQ ID NO: 8134 - protein, 30 aa, Artificial Sequence
  Description of Artificial Sequence: Synthetic polypeptide
DEEEIRTTNPVATEQYGSVCTNVLVRGNED

SEQ ID NO: 8135 - protein, 29 aa, Artificial Sequence
  Description of Artificial Sequence: Synthetic peptide
DEEVIRTTNPVATEGYGNVATNLQRGDNR

SEQ ID NO: 8136 - protein, 30 aa, Artificial Sequence
  Description of Artificial Sequence: Synthetic polypeptide
DEEEIRTTNPVATEQYGSVSVNDNLQRVNI

SEQ ID NO: 8137 - protein, 30 aa, Artificial Sequence
  Description of Artificial Sequence: Synthetic polypeptide
DEEEIRTTNPVATEQYGSVCTPNLQHGNAQ

SEQ ID NO: 8138 - protein, 29 aa, Artificial Sequence
  Description of Artificial Sequence: Synthetic peptide
DEEEIRTTNPVATEQYGSVCTNPQEAGNS

SEQ ID NO: 8139 - protein, 29 aa, Artificial Sequence
  Description of Artificial Sequence: Synthetic peptide
DEEEIRTTNPVATEQYGSVCTNLTRGDDI

SEQ ID NO: 8140 - protein, 30 aa, Artificial Sequence
  Description of Artificial Sequence: Synthetic polypeptide
DEEEIRTTNPVATEQYGSVCTNLTEDRGNE

SEQ ID NO: 8141 - protein, 30 aa, Artificial Sequence
  Description of Artificial Sequence: Synthetic polypeptide
DEEVIRTTNPVATEQYGSVSTNLADSGQNR

SEQ ID NO: 8142 - protein, 31 aa, Artificial Sequence
  Description of Artificial Sequence: Synthetic polypeptide
DEEEIRTTNPVATEQYGSVCTNLQRVGDNAD

SEQ ID NO: 8143 - protein, 30 aa, Artificial Sequence
  Description of Artificial Sequence: Synthetic polypeptide
DEEVIRTTNPVATEQYGSVSTNLVDEGQNR

SEQ ID NO: 8144 - protein, 31 aa, Artificial Sequence
  Description of Artificial Sequence: Synthetic polypeptide
DEEEIRTTNPVATEQYGSVSCCNELQTVGNR

SEQ ID NO: 8145 - protein, 30 aa, Artificial Sequence
  Description of Artificial Sequence: Synthetic polypeptide
DEEVIRTTNPVATEQYGSVSTNLTDNGDNR

SEQ ID NO: 8146 - protein, 30 aa, Artificial Sequence
  Description of Artificial Sequence: Synthetic polypeptide
DEEVIRTTNPVATEQYGSVSTNLRTEGQNR

SEQ ID NO: 8147 - protein, 30 aa, Artificial Sequence
  Description of Artificial Sequence: Synthetic polypeptide
DEEVIRTTNPVATEQYGSVSTNLRDPGTNR

SEQ ID NO: 8148 - protein, 29 aa, Artificial Sequence
  Description of Artificial Sequence: Synthetic peptide
DEEEIRTTNPVATEQYGSVSVENLERQTR

SEQ ID NO: 8149 - protein, 29 aa, Artificial Sequence
  Description of Artificial Sequence: Synthetic peptide
DEEEIRTTNPVATEQYGSVSVEPNQRGDR

SEQ ID NO: 8150 - protein, 30 aa, Artificial Sequence
  Description of Artificial Sequence: Synthetic polypeptide
DEEVIRTTNPVATEQYGSVSTNLRANGNNR

SEQ ID NO: 8151 - protein, 31 aa, Artificial Sequence
  Description of Artificial Sequence: Synthetic polypeptide
DEEVIRTTNPVATEQYGSVSTNLQINGQNGR

SEQ ID NO: 8152 - protein, 30 aa, Artificial Sequence
  Description of Artificial Sequence: Synthetic polypeptide
DEEVIRTTNPVATEQYGSVSTNLQGFGSNQ

SEQ ID NO: 8153 - protein, 31 aa, Artificial Sequence
  Description of Artificial Sequence: Synthetic polypeptide
DEEEIRTTNPVATEQYGSVCTNLQVRNGDDR

SEQ ID NO: 8154 - protein, 30 aa, Artificial Sequence
  Description of Artificial Sequence: Synthetic polypeptide
DEEVIRTTNPVATEQYGSVSTNLQDNGQTR

SEQ ID NO: 8155 - protein, 31 aa, Artificial Sequence
  Description of Artificial Sequence: Synthetic polypeptide
DEEVIRTTNPVATEQYGSVSTNLQDAGQNRV

SEQ ID NO: 8156 - protein, 30 aa, Artificial Sequence
  Description of Artificial Sequence: Synthetic polypeptide
DEEVIRTTNPVATEQYGSVSTNLPDNGANR

SEQ ID NO: 8157 - protein, 30 aa, Artificial Sequence
  Description of Artificial Sequence: Synthetic polypeptide
DEEVIRTTNPVATEQYGSVSTNLPANGQNR

SEQ ID NO: 8158 - protein, 30 aa, Artificial Sequence
  Description of Artificial Sequence: Synthetic polypeptide
DEEVIRTTNPVATEQYGSVSTNLNDNGSNR

SEQ ID NO: 8159 - protein, 30 aa, Artificial Sequence
  Description of Artificial Sequence: Synthetic polypeptide
DEEVIRTTNPVATEQYGSVSTNLNDDGQNR

SEQ ID NO: 8160 - protein, 30 aa, Artificial Sequence
  Description of Artificial Sequence: Synthetic polypeptide
DEEVIRTTNPVATEQYGSVSTNLMGNGQNR

SEQ ID NO: 8161 - protein, 30 aa, Artificial Sequence
  Description of Artificial Sequence: Synthetic polypeptide
DEEVIRTTNPVATEQYGSVSTNLHDNGENR

SEQ ID NO: 8162 - protein, 29 aa, Artificial Sequence
  Description of Artificial Sequence: Synthetic peptide
DEEEIRTTNPVATEQYGSVCTNLSRNENE

SEQ ID NO: 8163 - protein, 30 aa, Artificial Sequence
  Description of Artificial Sequence: Synthetic polypeptide
DEEVIRTTNPVATEQYGSVSTNLFDMGQNR

SEQ ID NO: 8164 - protein, 30 aa, Artificial Sequence
  Description of Artificial Sequence: Synthetic polypeptide
DEEVIRTTNPVATEQYGSVSTNLEFNGVNR

SEQ ID NO: 8165 - protein, 30 aa, Artificial Sequence
  Description of Artificial Sequence: Synthetic polypeptide
DEEEIRTTNPVATEQYGSVSCANLTTTGNR

SEQ ID NO: 8166 - protein, 30 aa, Artificial Sequence
  Description of Artificial Sequence: Synthetic polypeptide
DEEEIRTTNPVATEQYGSVSVGNLSQAENR

SEQ ID NO: 8167 - protein, 30 aa, Artificial Sequence
  Description of Artificial Sequence: Synthetic polypeptide
DEEVIRTTNPVATEQYGSVSTNLEDIGFNR

SEQ ID NO: 8168 - protein, 30 aa, Artificial Sequence
  Description of Artificial Sequence: Synthetic polypeptide
DEEVIRTTNPVATEQYGSVSTNLDMNGPNR

SEQ ID NO: 8169 - protein, 30 aa, Artificial Sequence
  Description of Artificial Sequence: Synthetic polypeptide
DEEVIRTTNPVATEQYGSVSTNLDENGNGR

SEQ ID NO: 8170 - protein, 30 aa, Artificial Sequence
  Description of Artificial Sequence: Synthetic polypeptide
DEEVIRTTNPVATEQYGSVSTNLDDGGVNR

SEQ ID NO: 8171 - protein, 29 aa, Artificial Sequence
  Description of Artificial Sequence: Synthetic peptide
DEFEIRTTNPVATEHYGSVSTNGQGGANR

SEQ ID NO: 8172 - protein, 29 aa, Artificial Sequence
  Description of Artificial Sequence: Synthetic peptide
DEFEIRTTNPVATEQYGCVSTNGQRGMNE

SEQ ID NO: 8173 - protein, 29 aa, Artificial Sequence
  Description of Artificial Sequence: Synthetic peptide
DEAEIRTTNPVATEQYGSVSANEQERGNN

SEQ ID NO: 8174 - protein, 29 aa, Artificial Sequence
  Description of Artificial Sequence: Synthetic peptide
DEAEIRTTNPVATEQYGSVSANLDRNMNR

SEQ ID NO: 8175 - protein, 30 aa, Artificial Sequence
  Description of Artificial Sequence: Synthetic polypeptide
DEAEIRTTNPVATEQYGSVSNNLQKGGNDR

SEQ ID NO: 8176 - protein, 29 aa, Artificial Sequence
  Description of Artificial Sequence: Synthetic peptide
DEAEIRTTNPVATEQYGSVSNNLQHGNAG

SEQ ID NO: 8177 - protein, 29 aa, Artificial Sequence
  Description of Artificial Sequence: Synthetic peptide
DEAEIRTTNPVATEQYGSVSNNLQGGNTQ

SEQ ID NO: 8178 - protein, 30 aa, Artificial Sequence
  Description of Artificial Sequence: Synthetic polypeptide
DEEEIRTTNPVATEQYGSVSCNLSQSGGTR

SEQ ID NO: 8179 - protein, 30 aa, Artificial Sequence
  Description of Artificial Sequence: Synthetic polypeptide
DEEEIRTTNPVATEQYGSVSTYNDLQNVNS

SEQ ID NO: 8180 - protein, 31 aa, Artificial Sequence
  Description of Artificial Sequence: Synthetic polypeptide
DEEEIRTTNPVATEQYGSVSTYNDQLGSNMR

SEQ ID NO: 8181 - protein, 30 aa, Artificial Sequence
  Description of Artificial Sequence: Synthetic polypeptide
DEEEIRTTNPVATEQYGSVSTYNLDEAGNT

SEQ ID NO: 8182 - protein, 29 aa, Artificial Sequence
  Description of Artificial Sequence: Synthetic peptide
DEAEIRTTNPVATEQYGSVSMNEQDRGNE

SEQ ID NO: 8183 - protein, 30 aa, Artificial Sequence
  Description of Artificial Sequence: Synthetic polypeptide
DEEEIRTTNPVATEQYGSVCSWNLQLGLRE

SEQ ID NO: 8184 - protein, 30 aa, Artificial Sequence
  Description of Artificial Sequence: Synthetic polypeptide
DEAEIRTTNPVATEQYGSVSMANLQDGNRN

SEQ ID NO: 8185 - protein, 30 aa, Artificial Sequence
  Description of Artificial Sequence: Synthetic polypeptide
DEEEIRTTNPVATEQYGSVSTYNLDRSNND

SEQ ID NO: 8186 - protein, 31 aa, Artificial Sequence
  Description of Artificial Sequence: Synthetic polypeptide
DEEEIRTTNPVATEQYGSVSTYNLEQIGFNE

SEQ ID NO: 8187 - protein, 30 aa, Artificial Sequence
  Description of Artificial Sequence: Synthetic polypeptide
DEAEIRTTNPVATEQYGSVSKTNGDRGNDR

SEQ ID NO: 8188 - protein, 29 aa, Artificial Sequence
  Description of Artificial Sequence: Synthetic peptide
DEAEIRTTNPVATEQYGSVSNTELQRGDI

SEQ ID NO: 8189 - protein, 31 aa, Artificial Sequence
  Description of Artificial Sequence: Synthetic polypeptide
DEAEIRTTNPVATEQYGSVSITNLTQGMGNR

SEQ ID NO: 8190 - protein, 32 aa, Artificial Sequence
  Description of Artificial Sequence: Synthetic polypeptide
DEEEIRTTNPVATEQYGSVCSYTNELQNGGNR

SEQ ID NO: 8191 - protein, 30 aa, Artificial Sequence
  Description of Artificial Sequence: Synthetic polypeptide
DEAEIRTTNPVATEQYGSVSHTNLQMEGNE

SEQ ID NO: 8192 - protein, 31 aa, Artificial Sequence
  Description of Artificial Sequence: Synthetic polypeptide
DEEEIRTTNPVATEQYGSVCSYTNLFQSGNQ

SEQ ID NO: 8193 - protein, 29 aa, Artificial Sequence
  Description of Artificial Sequence: Synthetic peptide
DEAEIRTTNPVATEQYGSVSHPNLDNGNR

SEQ ID NO: 8194 - protein, 30 aa, Artificial Sequence
  Description of Artificial Sequence: Synthetic polypeptide
DEEEIRTTNPVATEQYGSVCTDNIQEGNER

SEQ ID NO: 8195 - protein, 31 aa, Artificial Sequence
  Description of Artificial Sequence: Synthetic polypeptide
DEEEIRTTNPVATEQYGSVCTDNLQEGDNMR

SEQ ID NO: 8196 - protein, 30 aa, Artificial Sequence
  Description of Artificial Sequence: Synthetic polypeptide
DEEEIRTTNPVATEQYGSVCTDNLQHGNVP

SEQ ID NO: 8197 - protein, 30 aa, Artificial Sequence
  Description of Artificial Sequence: Synthetic polypeptide
DEEEIRTTNPVATEQYGSVCTELQRGEVNM

SEQ ID NO: 8198 - protein, 29 aa, Artificial Sequence
  Description of Artificial Sequence: Synthetic peptide
DEEEIRTTNPVATEQYGSVCTELQRGPQY

SEQ ID NO: 8199 - protein, 30 aa, Artificial Sequence
  Description of Artificial Sequence: Synthetic polypeptide
DEEEIRTTNPVATEQYGSVCTELQTREGNN

SEQ ID NO: 8200 - protein, 30 aa, Artificial Sequence
  Description of Artificial Sequence: Synthetic polypeptide
DEAEIRTTNPVATEQYGSVSGTNLEQTGNI

SEQ ID NO: 8201 - protein, 28 aa, Artificial Sequence
  Description of Artificial Sequence: Synthetic peptide
DEGCIRTTNPVATEQYGSMSTNLIIGNR

SEQ ID NO: 8202 - protein, 30 aa, Artificial Sequence
  Description of Artificial Sequence: Synthetic polypeptide
DEEEIRTTNPVATEQYGSVCTGLQPRGVER

SEQ ID NO: 8203 - protein, 30 aa, Artificial Sequence
  Description of Artificial Sequence: Synthetic polypeptide
DEAEIRTTNPVATEQYGSVSITNLQQEGNH

SEQ ID NO: 8204 - protein, 30 aa, Artificial Sequence
  Description of Artificial Sequence: Synthetic polypeptide
DEAEIRTTNPVATEQYGSVSNTNLQQGNSQ

SEQ ID NO: 8205 - protein, 31 aa, Artificial Sequence
  Description of Artificial Sequence: Synthetic polypeptide
DEEEIRTTNPVATEQYGSVSCPNLQQGNIRQ

SEQ ID NO: 8206 - protein, 31 aa, Artificial Sequence
  Description of Artificial Sequence: Synthetic polypeptide
DEEEIRTTNPVATEQYGSVCSVNLQREGGGR

SEQ ID NO: 8207 - protein, 32 aa, Artificial Sequence
  Description of Artificial Sequence: Synthetic polypeptide
DEEEIRTTNPVATEQYGSVSCSGNLQRSGNRN

SEQ ID NO: 8208 - protein, 31 aa, Artificial Sequence
  Description of Artificial Sequence: Synthetic polypeptide
DEEEIRTTNPVATEQYGSVCSTTLQRVGNDD

SEQ ID NO: 8209 - protein, 31 aa, Artificial Sequence
  Description of Artificial Sequence: Synthetic polypeptide
DEAEIRTTNPVATEQYGSVSPTNLQTRGGDR

SEQ ID NO: 8210 - protein, 30 aa, Artificial Sequence
  Description of Artificial Sequence: Synthetic polypeptide
DEEEIRTTNPVATEQYGSVSTYILQPMGNG

SEQ ID NO: 8211 - protein, 30 aa, Artificial Sequence
  Description of Artificial Sequence: Synthetic polypeptide
DEEEIRTTNPVATEQYGSVSTYLEQPRNNF

SEQ ID NO: 8212 - protein, 30 aa, Artificial Sequence
  Description of Artificial Sequence: Synthetic polypeptide
DEEEIRTTNPVATEQYGSVCSTTNLQGGPI

SEQ ID NO: 8213 - protein, 30 aa, Artificial Sequence
  Description of Artificial Sequence: Synthetic polypeptide
DEEEIATTNPVATEQYGSVCSTVDQRGNER

SEQ ID NO: 8214 - protein, 31 aa, Artificial Sequence
  Description of Artificial Sequence: Synthetic polypeptide
DEEEIRTTNPVATEQYGSVCSTTNPQRVNRG

SEQ ID NO: 8215 - protein, 28 aa, Artificial Sequence
  Description of Artificial Sequence: Synthetic peptide
DEGEIATTNPVATEQYGVVSTNLQAGPR

SEQ ID NO: 8216 - protein, 30 aa, Artificial Sequence
  Description of Artificial Sequence: Synthetic polypeptide
DEEEIRTTNPVATEQYGSVSTYLMEGENRI

SEQ ID NO: 8217 - protein, 28 aa, Artificial Sequence
  Description of Artificial Sequence: Synthetic peptide
DEGEIATTNPVATEQYGSVSTNLGMGND

SEQ ID NO: 8218 - protein, 28 aa, Artificial Sequence
  Description of Artificial Sequence: Synthetic peptide
DEGEIATTNPVATEQYGSVSANLQQGNL

SEQ ID NO: 8219 - protein, 31 aa, Artificial Sequence
  Description of Artificial Sequence: Synthetic polypeptide
DEEEIRTTNPVATEQYGSVSTYLQDRGEQRS

SEQ ID NO: 8220 - protein, 28 aa, Artificial Sequence
  Description of Artificial Sequence: Synthetic peptide
DEGEIATTNPVATEQYGSVCTNLQDGND

SEQ ID NO: 8221 - protein, 32 aa, Artificial Sequence
  Description of Artificial Sequence: Synthetic polypeptide
DEEEIRTTNPVATEQYGSVSTYLQERFGSNTR

SEQ ID NO: 8222 - protein, 31 aa, Artificial Sequence
  Description of Artificial Sequence: Synthetic polypeptide
DEEEIRTTNPVATEQYGSVSTYLQERGGNFQ

SEQ ID NO: 8223 - protein, 30 aa, Artificial Sequence
  Description of Artificial Sequence: Synthetic polypeptide
DEEEIRTTNPVATEQYGSVSTYLQFEGNQV

SEQ ID NO: 8224 - protein, 29 aa, Artificial Sequence
  Description of Artificial Sequence: Synthetic peptide
DEEEIRTTNPVATEQYGSVSTYLQFENVN

SEQ ID NO: 8225 - protein, 30 aa, Artificial Sequence
  Description of Artificial Sequence: Synthetic polypeptide
DEEEIRTTNPVATEQYGSVSTYLQGGNSFF

SEQ ID NO: 8226 - protein, 30 aa, Artificial Sequence
  Description of Artificial Sequence: Synthetic polypeptide
DEEEIRTTNPVATEQYGSVSTYLQLGGINS

SEQ ID NO: 8227 - protein, 31 aa, Artificial Sequence
  Description of Artificial Sequence: Synthetic polypeptide
DEEEIATTNPVATEQYGSVCSTNLQRGISNQ

SEQ ID NO: 8228 - protein, 30 aa, Artificial Sequence
  Description of Artificial Sequence: Synthetic polypeptide
DEEEIATTNPVATEQYGSVCSTNLQAEGNW

SEQ ID NO: 8229 - protein, 31 aa, Artificial Sequence
  Description of Artificial Sequence: Synthetic polypeptide
DEEEIRTTNPVATEQYGSVCSTYLQRAILNR

SEQ ID NO: 8230 - protein, 30 aa, Artificial Sequence
  Description of Artificial Sequence: Synthetic polypeptide
DEEEIRTTNPVATEQYGSVSTYLQRLVNSD

SEQ ID NO: 8231 - protein, 28 aa, Artificial Sequence
  Description of Artificial Sequence: Synthetic peptide
DEGEIATTNPVATEQYGSVATNGQRGNE

SEQ ID NO: 8232 - protein, 30 aa, Artificial Sequence
  Description of Artificial Sequence: Synthetic polypeptide
DEEEIRTTNPVATEQYGSVSTYLQSGSVTR

SEQ ID NO: 8233 - protein, 32 aa, Artificial Sequence
  Description of Artificial Sequence: Synthetic polypeptide
DEEEIRTTNPVATEQYGSVCSTYNDLQRGNMS

SEQ ID NO: 8234 - protein, 30 aa, Artificial Sequence
  Description of Artificial Sequence: Synthetic polypeptide
DEEEIRTTNPVATEQYGSVSTYLQTRGEEI

SEQ ID NO: 8235 - protein, 31 aa, Artificial Sequence
  Description of Artificial Sequence: Synthetic polypeptide
DEEEIRTTNPVATEQYGSVSTYLQVRGSNQQ

SEQ ID NO: 8236 - protein, 30 aa, Artificial Sequence
  Description of Artificial Sequence: Synthetic polypeptide
DEEEIRTTNPVATEQYGSVCTGLQRGNGTD

SEQ ID NO: 8237 - protein, 30 aa, Artificial Sequence
  Description of Artificial Sequence: Synthetic polypeptide
DEAEIRTTNPVATEQYGNVSTNLQWDGNGR

SEQ ID NO: 8238 - protein, 31 aa, Artificial Sequence
  Description of Artificial Sequence: Synthetic polypeptide
DEEEIRTTNPVATEQYGSVSTYNLFQTGFNE

SEQ ID NO: 8239 - protein, 28 aa, Artificial Sequence
  Description of Artificial Sequence: Synthetic peptide
DEGAIRTTNPVATEQYGSWSTNLIGGNR

SEQ ID NO: 8240 - protein, 31 aa, Artificial Sequence
  Description of Artificial Sequence: Synthetic polypeptide
DEEEIRTTNPVATEQYGSVCTNLDQAGMNRN

SEQ ID NO: 8241 - protein, 29 aa, Artificial Sequence
  Description of Artificial Sequence: Synthetic peptide
DEEEIRTTNPVATEQYGSVCTNLDRNHNY

SEQ ID NO: 8242 - protein, 30 aa, Artificial Sequence
  Description of Artificial Sequence: Synthetic polypeptide
DEEEIRTTNPVATEQYGSVCTNLEDRGGNQ

SEQ ID NO: 8243 - protein, 31 aa, Artificial Sequence
  Description of Artificial Sequence: Synthetic polypeptide
DEEEIRTTNPVATEQYGSVSCINLQRGSNQM

SEQ ID NO: 8244 - protein, 30 aa, Artificial Sequence
  Description of Artificial Sequence: Synthetic polypeptide
DEEEIRTTNPVATEQYGSVCTNLEIRPGNH

SEQ ID NO: 8245 - protein, 30 aa, Artificial Sequence
  Description of Artificial Sequence: Synthetic polypeptide
DEEEIRTTNPVATEQYGSVCTNLEQLEGNN

SEQ ID NO: 8246 - protein, 30 aa, Artificial Sequence
  Description of Artificial Sequence: Synthetic polypeptide
DEAEIRTTNPVATEQYGSVSCINLQNGNNR

SEQ ID NO: 8247 - protein, 31 aa, Artificial Sequence
  Description of Artificial Sequence: Synthetic polypeptide
DEEEIRTTNPVATEQYGSVCTNLEQRDGMGR

SEQ ID NO: 8248 - protein, 30 aa, Artificial Sequence
  Description of Artificial Sequence: Synthetic polypeptide
DEAEIRTTNPVATEQYGSVSCANLSQRVNR

SEQ ID NO: 8249 - protein, 30 aa, Artificial Sequence
  Description of Artificial Sequence: Synthetic polypeptide
DDEEIRTTNPVATEQYGCVDSTNLQRGNDA

SEQ ID NO: 8250 - protein, 30 aa, Artificial Sequence
  Description of Artificial Sequence: Synthetic polypeptide
DDEEIRTTNPVATEQYGCVISTNLQRGNIL

SEQ ID NO: 8251 - protein, 30 aa, Artificial Sequence
  Description of Artificial Sequence: Synthetic polypeptide
DDEEIRTTNPVATEQYGCVSTENLQFGNRN

SEQ ID NO: 8252 - protein, 29 aa, Artificial Sequence
  Description of Artificial Sequence: Synthetic peptide
DEEEIRTTNPVATEQYGSVCTNLERGDFY

SEQ ID NO: 8253 - protein, 29 aa, Artificial Sequence
  Description of Artificial Sequence: Synthetic peptide
DEEEIRTTNPVATEQYGSVSCMSQRGENN

SEQ ID NO: 8254 - protein, 30 aa, Artificial Sequence
  Description of Artificial Sequence: Synthetic polypeptide
DEEEIRTTNPVATEQYGSVCTNLEVQGGNL

SEQ ID NO: 8255 - protein, 30 aa, Artificial Sequence
  Description of Artificial Sequence: Synthetic polypeptide
DDEEIRTTNPVATEQYGCVSTNNLQFGNRN

SEQ ID NO: 8256 - protein, 30 aa, Artificial Sequence
  Description of Artificial Sequence: Synthetic polypeptide
DEAEIRTTNPVATEQYGSVSATNLQQGNPN

SEQ ID NO: 8257 - protein, 30 aa, Artificial Sequence
  Description of Artificial Sequence: Synthetic polypeptide
DEAEIRTTNPVATEQYGSVSANQDQDRGNR

SEQ ID NO: 8258 - protein, 29 aa, Artificial Sequence
  Description of Artificial Sequence: Synthetic peptide
DEEEIRTTNPVATEQYGSVCTNLFRGDEN

SEQ ID NO: 8259 - protein, 29 aa, Artificial Sequence
  Description of Artificial Sequence: Synthetic peptide
DEFEIRTTNPVATEWYGSVSTNLQGGGNE

SEQ ID NO: 8260 - protein, 28 aa, Artificial Sequence
  Description of Artificial Sequence: Synthetic peptide
DEFEIRTTNPVATEQYGVVSTPLQRSND

SEQ ID NO: 8261 - protein, 30 aa, Artificial Sequence
  Description of Artificial Sequence: Synthetic polypeptide
DEAEIRTTNPVATEQYGSVSANLQQAGNER

SEQ ID NO: 8262 - protein, 31 aa, Artificial Sequence
  Description of Artificial Sequence: Synthetic polypeptide
DEFEIRTTNPVATEQYGSVSTNLQGIGQNRT

SEQ ID NO: 8263 - protein, 30 aa, Artificial Sequence
  Description of Artificial Sequence: Synthetic polypeptide
DEFEIRTTNPVATEQYGSVSTNLQGGHNNQ

SEQ ID NO: 8264 - protein, 30 aa, Artificial Sequence
  Description of Artificial Sequence: Synthetic polypeptide
DEFEIRTTNPVATEQYGSVSTNLQDGGNNN

SEQ ID NO: 8265 - protein, 30 aa, Artificial Sequence
  Description of Artificial Sequence: Synthetic polypeptide
DEFEIRTTNPVATEQYGSVSTNGQRGGDER

SEQ ID NO: 8266 - protein, 30 aa, Artificial Sequence
  Description of Artificial Sequence: Synthetic polypeptide
DEFEIRTTNPVATEQYGSVSTDLEQHGGNR

SEQ ID NO: 8267 - protein, 31 aa, Artificial Sequence
  Description of Artificial Sequence: Synthetic polypeptide
DEFEIRTTNPVATEQYGSVDSTNLQRGGERL

SEQ ID NO: 8268 - protein, 30 aa, Artificial Sequence
  Description of Artificial Sequence: Synthetic polypeptide
DEEEIRTTNPVATEQYGSVCTNLEVREGNI

SEQ ID NO: 8269 - protein, 30 aa, Artificial Sequence
  Description of Artificial Sequence: Synthetic polypeptide
DEEEIRTTNPVATEQYGSVCTNLDDAGDNR

SEQ ID NO: 8270 - protein, 29 aa, Artificial Sequence
  Description of Artificial Sequence: Synthetic peptide
DEEEIRTTNPVATEQYGSVCTNLAREMNS

SEQ ID NO: 8271 - protein, 31 aa, Artificial Sequence
  Description of Artificial Sequence: Synthetic polypeptide
DEEEIRTTNPVATEQYGSVSCNDLQERSGER

SEQ ID NO: 8272 - protein, 30 aa, Artificial Sequence
  Description of Artificial Sequence: Synthetic polypeptide
DEEEIRTTNPVATEQYGSVCTLLQPGNERS

SEQ ID NO: 8273 - protein, 30 aa, Artificial Sequence
  Description of Artificial Sequence: Synthetic polypeptide
DEEEIRTTNPVATEQYGSVSCNIEQDRGDR

SEQ ID NO: 8274 - protein, 29 aa, Artificial Sequence
  Description of Artificial Sequence: Synthetic peptide
DEGAIRTTNPVATEQYGSVFSTNLDDGNR

SEQ ID NO: 8275 - protein, 28 aa, Artificial Sequence
  Description of Artificial Sequence: Synthetic peptide
DEGAIRTTNPVATEQYGSSSTNLIQGNR

SEQ ID NO: 8276 - protein, 28 aa, Artificial Sequence
  Description of Artificial Sequence: Synthetic peptide
DEGAIRTTNPVATEQYGSISTNLDGGNR

SEQ ID NO: 8277 - protein, 29 aa, Artificial Sequence
  Description of Artificial Sequence: Synthetic peptide
DEEEIRTTNPVATEQYGSVSCNHSQSGTR

SEQ ID NO: 8278 - protein, 32 aa, Artificial Sequence
  Description of Artificial Sequence: Synthetic polypeptide
DEEEIRTTNPVATEQYGSVSCNHALSQRGGNR

SEQ ID NO: 8279 - protein, 29 aa, Artificial Sequence
  Description of Artificial Sequence: Synthetic peptide
DEGAIRTTNPVATEQYGSFSTNLQENGNR

SEQ ID NO: 8280 - protein, 28 aa, Artificial Sequence
  Description of Artificial Sequence: Synthetic peptide
DEGAIRTTNPVATEQYGSFSTNLPQGNR

SEQ ID NO: 8281 - protein, 28 aa, Artificial Sequence
  Description of Artificial Sequence: Synthetic peptide
DEGAIRTTNPVATEQYGSFSTNLALGNR

SEQ ID NO: 8282 - protein, 30 aa, Artificial Sequence
  Description of Artificial Sequence: Synthetic polypeptide
DEAEIRTTNPVATEQYGSVSETNLQQSGNE

SEQ ID NO: 8283 - protein, 30 aa, Artificial Sequence
  Description of Artificial Sequence: Synthetic polypeptide
DEAEIRTTNPVATEQYGSVSENLQVGGNSR

SEQ ID NO: 8284 - protein, 29 aa, Artificial Sequence
  Description of Artificial Sequence: Synthetic peptide
DEAEIRTTNPVATEQYGSVSENLQGGNFN

SEQ ID NO: 8285 - protein, 30 aa, Artificial Sequence
  Description of Artificial Sequence: Synthetic polypeptide
DEAEIRTTNPVATEQYGSVSENLNDRGNRD

SEQ ID NO: 8286 - protein, 31 aa, Artificial Sequence
  Description of Artificial Sequence: Synthetic polypeptide
DEEEIRTTNPVATEQYGSVSCNEPQDREGNR

SEQ ID NO: 8287 - protein, 29 aa, Artificial Sequence
  Description of Artificial Sequence: Synthetic peptide
DEEEIRTTNPVATEQYGSVCTNAQPAGND

SEQ ID NO: 8288 - protein, 28 aa, Artificial Sequence
  Description of Artificial Sequence: Synthetic peptide
DEGAIRTTNPVATEQYGSCSTNLINGNR

SEQ ID NO: 8289 - protein, 29 aa, Artificial Sequence
  Description of Artificial Sequence: Synthetic peptide
DEGAIRTTNPVATEQYGSASTNLQIGGNR

SEQ ID NO: 8290 - protein, 30 aa, Artificial Sequence
  Description of Artificial Sequence: Synthetic polypeptide
DEAEIRTTNPVATEQYGSVSENIPQDRGNR

SEQ ID NO: 8291 - protein, 30 aa, Artificial Sequence
  Description of Artificial Sequence: Synthetic polypeptide
DEEEIRTTNPVATEQYGSVSTYNLNRSENH

SEQ ID NO: 8292 - protein, 30 aa, Artificial Sequence
  Description of Artificial Sequence: Synthetic polypeptide
DEEEIRTTNPVATEQYGSVCTNDLERGNQD

SEQ ID NO: 8293 - protein, 30 aa, Artificial Sequence
  Description of Artificial Sequence: Synthetic polypeptide
DEEEIRTTNPVATEQYGSVCTNDQDEGTNR

SEQ ID NO: 8294 - protein, 31 aa, Artificial Sequence
  Description of Artificial Sequence: Synthetic polypeptide
DEEEIRTTNPVATEQYGSVSTYNLQNANGNQ

SEQ ID NO: 8295 - protein, 30 aa, Artificial Sequence
  Description of Artificial Sequence: Synthetic polypeptide
DEEEIRTTNPVATEQYGSVCTNDQPLGDNR

SEQ ID NO: 8296 - protein, 30 aa, Artificial Sequence
  Description of Artificial Sequence: Synthetic polypeptide
DEEEIRTTNPVATEQYGSVSTYNLQNVNGG

SEQ ID NO: 8297 - protein, 29 aa, Artificial Sequence
  Description of Artificial Sequence: Synthetic peptide
DEEEIRTTNPVATEQYGSVCTNEQGMGND

SEQ ID NO: 8298 - protein, 29 aa, Artificial Sequence
  Description of Artificial Sequence: Synthetic peptide
DEAEIRTTNPVATEQYGSVSDQNLDPGNR

SEQ ID NO: 8299 - protein, 30 aa, Artificial Sequence
  Description of Artificial Sequence: Synthetic polypeptide
DEEEIRTTNPVATEQYGSVCTNGQNQGTNR

SEQ ID NO: 8300 - protein, 28 aa, Artificial Sequence
  Description of Artificial Sequence: Synthetic peptide
DEEEIRTTNPVATEQYGSVCTNGQRSEM

SEQ ID NO: 8301 - protein, 30 aa, Artificial Sequence
  Description of Artificial Sequence: Synthetic polypeptide
DEEEIRTTNPVATEQYGSVCTHLSQRGGNY

SEQ ID NO: 8302 - protein, 28 aa, Artificial Sequence
  Description of Artificial Sequence: Synthetic peptide
DEHEIRTTNPVATENYGEVSTNLQTGNA

SEQ ID NO: 8303 - protein, 30 aa, Artificial Sequence
  Description of Artificial Sequence: Synthetic polypeptide
DEAEIRTTNPVATEQYGNVSTNLQSGGNQR

SEQ ID NO: 8304 - protein, 29 aa, Artificial Sequence
  Description of Artificial Sequence: Synthetic peptide
DEEEIRTTNPVSTEQYGSVSTVNLQGNQT

SEQ ID NO: 8305 - protein, 29 aa, Artificial Sequence
  Description of Artificial Sequence: Synthetic peptide
DEEEIRTTNPVATEQYGSVPTLLQRGPIT

SEQ ID NO: 8306 - protein, 30 aa, Artificial Sequence
  Description of Artificial Sequence: Synthetic polypeptide
DEEEIRTTNPVATEQYGVVSVTNLNRGVNA

SEQ ID NO: 8307 - protein, 31 aa, Artificial Sequence
  Description of Artificial Sequence: Synthetic polypeptide
DEEEIRTTNPVATEQYGVVSVTNLNQQGENR

SEQ ID NO: 8308 - protein, 29 aa, Artificial Sequence
  Description of Artificial Sequence: Synthetic peptide
DEEEIRTTNPVATEQYGSVPTLLQRGMEE

SEQ ID NO: 8309 - protein, 30 aa, Artificial Sequence
  Description of Artificial Sequence: Synthetic polypeptide
DEEEIRTTNPVATEQYGVVSVTNLNPGDNR

SEQ ID NO: 8310 - protein, 31 aa, Artificial Sequence
  Description of Artificial Sequence: Synthetic polypeptide
DEEEIRTTNPVATEQYGSVNPTNLDQRGDRL

SEQ ID NO: 8311 - protein, 28 aa, Artificial Sequence
  Description of Artificial Sequence: Synthetic peptide
DEEEIATTNPTATEQYGSVSTNLQNGDG

SEQ ID NO: 8312 - protein, 30 aa, Artificial Sequence
  Description of Artificial Sequence: Synthetic polypeptide
DEEEIRTTNPVATEQYGSVPTGNLQRQINE

SEQ ID NO: 8313 - protein, 30 aa, Artificial Sequence
  Description of Artificial Sequence: Synthetic polypeptide
DEEEIRTTNPVATEQYGSVPTGNLQRGEQG

SEQ ID NO: 8314 - protein, 29 aa, Artificial Sequence
  Description of Artificial Sequence: Synthetic peptide
DEEEIRTTNPVATEQYGSVYFTDEQRGTR

SEQ ID NO: 8315 - protein, 30 aa, Artificial Sequence
  Description of Artificial Sequence: Synthetic polypeptide
DEEEIRTTNPVATEQYGSVPTGNLQRGDSQ

SEQ ID NO: 8316 - protein, 31 aa, Artificial Sequence
  Description of Artificial Sequence: Synthetic polypeptide
DEEEIRTTNPVATEQYGSVPTENLQRNVNVR

SEQ ID NO: 8317 - protein, 28 aa, Artificial Sequence
  Description of Artificial Sequence: Synthetic peptide
DEEEIRTTNPVATEQYGSVYINQDRGDR

SEQ ID NO: 8318 - protein, 29 aa, Artificial Sequence
  Description of Artificial Sequence: Synthetic peptide
DEEEIRTTNPVATEQYGSVPTLLQRGQQG

SEQ ID NO: 8319 - protein, 29 aa, Artificial Sequence
  Description of Artificial Sequence: Synthetic peptide
DEEEIRTTNPVATEQYGSVYITNDQFGNN

SEQ ID NO: 8320 - protein, 28 aa, Artificial Sequence
  Description of Artificial Sequence: Synthetic peptide
DEEEIRTTNPVATEQYGVVSTYLTHGDR

SEQ ID NO: 8321 - protein, 30 aa, Artificial Sequence
  Description of Artificial Sequence: Synthetic polypeptide
DEEEIRTTNPVATEQYGVVSTVNLQVNGND

SEQ ID NO: 8322 - protein, 30 aa, Artificial Sequence
  Description of Artificial Sequence: Synthetic polypeptide
DEEEIRTTNPVATEQYGSVPTALQRGVNQQ

SEQ ID NO: 8323 - protein, 31 aa, Artificial Sequence
  Description of Artificial Sequence: Synthetic polypeptide
DEEEIRTTNPVATEQYGSVPSWTNLQRGMQD

SEQ ID NO: 8324 - protein, 32 aa, Artificial Sequence
  Description of Artificial Sequence: Synthetic polypeptide
DEEEIRTTNPVATEQYGSVPSVTNELAQKGNR

SEQ ID NO: 8325 - protein, 30 aa, Artificial Sequence
  Description of Artificial Sequence: Synthetic polypeptide
DEEEIATTNPMATEQYGSVPTNLQLRGNGR

SEQ ID NO: 8326 - protein, 30 aa, Artificial Sequence
  Description of Artificial Sequence: Synthetic polypeptide
DEEEIATTNPMATEQYGSVPTNLQHRGNMR

SEQ ID NO: 8327 - protein, 29 aa, Artificial Sequence
  Description of Artificial Sequence: Synthetic peptide
DEEEIRTTNPVATEQYGSVNSENLENQNR

SEQ ID NO: 8328 - protein, 31 aa, Artificial Sequence
  Description of Artificial Sequence: Synthetic polypeptide
DEEEIRTTNPVATEQYGSVPSTTLQRGVTVR

SEQ ID NO: 8329 - protein, 31 aa, Artificial Sequence
  Description of Artificial Sequence: Synthetic polypeptide
DEEEIRTTNPVATEQYGSVYLTNLERGNSRS

SEQ ID NO: 8330 - protein, 32 aa, Artificial Sequence
  Description of Artificial Sequence: Synthetic polypeptide
DEEEIRTTNPVATEQYGSVPSTPNLQRGNQFM

SEQ ID NO: 8331 - protein, 30 aa, Artificial Sequence
  Description of Artificial Sequence: Synthetic polypeptide
DEEEIRTTNPVATEQYGVVSTTNLVQGGND

SEQ ID NO: 8332 - protein, 29 aa, Artificial Sequence
  Description of Artificial Sequence: Synthetic peptide
DEEEIRTTNPVATEQYGVVSTTNLQQGIG

SEQ ID NO: 8333 - protein, 29 aa, Artificial Sequence
  Description of Artificial Sequence: Synthetic peptide
DEEEIRTTNPVATEQYGSVYITSLQRTNQ

SEQ ID NO: 8334 - protein, 31 aa, Artificial Sequence
  Description of Artificial Sequence: Synthetic polypeptide
DEEEIRTTNPVATEQYGSVPSTNNIQVIGNR

SEQ ID NO: 8335 - protein, 29 aa, Artificial Sequence
  Description of Artificial Sequence: Synthetic peptide
DEEEIRTTNPVATEQYGSVPTLLQRGVIG

SEQ ID NO: 8336 - protein, 29 aa, Artificial Sequence
  Description of Artificial Sequence: Synthetic peptide
DEEEIRTTNPVATEQYGSVYATNGQRVQR

SEQ ID NO: 8337 - protein, 30 aa, Artificial Sequence
  Description of Artificial Sequence: Synthetic polypeptide
DEEEIRTTNPVATEQYGYTYSTNVLQRGER

SEQ ID NO: 8338 - protein, 30 aa, Artificial Sequence
  Description of Artificial Sequence: Synthetic polypeptide
DEEEIATTNPVATEAYGSVSYNLQRDGENR

SEQ ID NO: 8339 - protein, 31 aa, Artificial Sequence
  Description of Artificial Sequence: Synthetic polypeptide
DEEEIRTTNPVATEQYGYTVSTNEQLQRGNQ

SEQ ID NO: 8340 - protein, 30 aa, Artificial Sequence
  Description of Artificial Sequence: Synthetic polypeptide
DEEEIRTTNPVATEQYGYTVSTNENQRGNA

SEQ ID NO: 8341 - protein, 31 aa, Artificial Sequence
  Description of Artificial Sequence: Synthetic polypeptide
DEEEIRTTNPVATEQYGYTTSTNELQRGDNR

SEQ ID NO: 8342 - protein, 30 aa, Artificial Sequence
  Description of Artificial Sequence: Synthetic polypeptide
DEEEIRTTNPVATEQYGYTSSTNELQSGNR

SEQ ID NO: 8343 - protein, 30 aa, Artificial Sequence
  Description of Artificial Sequence: Synthetic polypeptide
DEEEIRTTNPVATEQYGYTNSTNELQGGNR

SEQ ID NO: 8344 - protein, 31 aa, Artificial Sequence
  Description of Artificial Sequence: Synthetic polypeptide
DEEEIATTNPVATEAYGSVSTLNLSQRPGNR

SEQ ID NO: 8345 - protein, 30 aa, Artificial Sequence
  Description of Artificial Sequence: Synthetic polypeptide
DEEEIRTTNPVATEQYGSVPTNLLRVENER

SEQ ID NO: 8346 - protein, 30 aa, Artificial Sequence
  Description of Artificial Sequence: Synthetic polypeptide
DEEEIRTTNPVATEQYGYTISTNGLQNGNR

SEQ ID NO: 8347 - protein, 29 aa, Artificial Sequence
  Description of Artificial Sequence: Synthetic peptide
DEEEIATTNPVATEAYGSVATNLQGGNQR

SEQ ID NO: 8348 - protein, 30 aa, Artificial Sequence
  Description of Artificial Sequence: Synthetic polypeptide
DEEEIRTTNPVATEQYGYTISTNDLQDGNR

SEQ ID NO: 8349 - protein, 29 aa, Artificial Sequence
  Description of Artificial Sequence: Synthetic peptide
DEEEIRTTNPVATEQYGSVWTNDDRGFSR

SEQ ID NO: 8350 - protein, 29 aa, Artificial Sequence
  Description of Artificial Sequence: Synthetic peptide
DEEEIRTTNPVATEQYGSVPTNAQRNNEE

SEQ ID NO: 8351 - protein, 28 aa, Artificial Sequence
  Description of Artificial Sequence: Synthetic peptide
DEEEIRTTNPVATEQYGSVPTNLHNGEE

SEQ ID NO: 8352 - protein, 31 aa, Artificial Sequence
  Description of Artificial Sequence: Synthetic polypeptide
DEEEIRTTNPVATEQYGYSVSTNGQRGEVRF

SEQ ID NO: 8353 - protein, 31 aa, Artificial Sequence
  Description of Artificial Sequence: Synthetic polypeptide
DEEEIRTTNPVATEQYGYSVSTNEQRGEGRN

SEQ ID NO: 8354 - protein, 30 aa, Artificial Sequence
  Description of Artificial Sequence: Synthetic polypeptide
DEEEIRTTNPVATEQYGSVPTNLERAENER

SEQ ID NO: 8355 - protein, 30 aa, Artificial Sequence
  Description of Artificial Sequence: Synthetic polypeptide
DEEEIRTTNPVATEQYGYIISTNEQQRGNR

SEQ ID NO: 8356 - protein, 32 aa, Artificial Sequence
  Description of Artificial Sequence: Synthetic polypeptide
DEEEIRTTNPVATEQYGWVPSTPNLSQRGNRA

SEQ ID NO: 8357 - protein, 31 aa, Artificial Sequence
  Description of Artificial Sequence: Synthetic polypeptide
DEEEIRTTNPVATEQYGWTISTNELQRGNDR

SEQ ID NO: 8358 - protein, 29 aa, Artificial Sequence
  Description of Artificial Sequence: Synthetic peptide
DEEEIRTTNPVATEQYGSVPTNLEERGVN

SEQ ID NO: 8359 - protein, 29 aa, Artificial Sequence
  Description of Artificial Sequence: Synthetic peptide
DEEEIRTTNPVATEQYGSVWTNMLVNGER

SEQ ID NO: 8360 - protein, 30 aa, Artificial Sequence
  Description of Artificial Sequence: Synthetic polypeptide
DEEEIRTTNPVATEQYGSVPTNLDRGLERV

SEQ ID NO: 8361 - protein, 31 aa, Artificial Sequence
  Description of Artificial Sequence: Synthetic polypeptide
DEEEIRTTNPVATEQYGSVWTNNLQRGSERE

SEQ ID NO: 8362 - protein, 29 aa, Artificial Sequence
  Description of Artificial Sequence: Synthetic peptide
DEEEIRTTNPVATEQYGSVWTQLQEGDDR

SEQ ID NO: 8363 - protein, 31 aa, Artificial Sequence
  Description of Artificial Sequence: Synthetic polypeptide
DEEEIRTTNPVATEQYGVVTISTNALQRGND

SEQ ID NO: 8364 - protein, 30 aa, Artificial Sequence
  Description of Artificial Sequence: Synthetic polypeptide
DEEEIRTTNPVATEQYGSVWTTLSQRGGNE

SEQ ID NO: 8365 - protein, 31 aa, Artificial Sequence
  Description of Artificial Sequence: Synthetic polypeptide
DEEEIRTTNPVATEQYGYSVSTNQQRGEQRM

SEQ ID NO: 8366 - protein, 29 aa, Artificial Sequence
  Description of Artificial Sequence: Synthetic peptide
DEEEIATTNPIATEQYGSVSATDLMRGNR

SEQ ID NO: 8367 - protein, 31 aa, Artificial Sequence
  Description of Artificial Sequence: Synthetic polypeptide
DEEEIRTTNPVATEQYGVVSTSTNLQRGNQS

SEQ ID NO: 8368 - protein, 30 aa, Artificial Sequence
  Description of Artificial Sequence: Synthetic polypeptide
DEEEIRTTNPVATEQYGSVNSGTMLQIGER

SEQ ID NO: 8369 - protein, 30 aa, Artificial Sequence
  Description of Artificial Sequence: Synthetic polypeptide
DEEEIRTTNPVATEQYGVVSTNLQFEEGNA

SEQ ID NO: 8370 - protein, 29 aa, Artificial Sequence
  Description of Artificial Sequence: Synthetic peptide
DEEEIRTTNPVATEQYGVVSTNLQAGGED

SEQ ID NO: 8371 - protein, 30 aa, Artificial Sequence
  Description of Artificial Sequence: Synthetic polypeptide
DEEEIRTTNPVATEQYGVVSTNLPQIGNVN

SEQ ID NO: 8372 - protein, 30 aa, Artificial Sequence
  Description of Artificial Sequence: Synthetic polypeptide
DEEEIRTTNPVATEQYGVVSTNHQRGNTQI

SEQ ID NO: 8373 - protein, 30 aa, Artificial Sequence
  Description of Artificial Sequence: Synthetic polypeptide
DEEEIRTTNPVATEQYGVVSTNGQHEGDNR

SEQ ID NO: 8374 - protein, 29 aa, Artificial Sequence
  Description of Artificial Sequence: Synthetic peptide
DEEEIRTTNPVATEQYGVVSTNGQGGNID

SEQ ID NO: 8375 - protein, 31 aa, Artificial Sequence
  Description of Artificial Sequence: Synthetic polypeptide
DEEEIRTTNPVATEQYGSVNSPTELQRGNLP

SEQ ID NO: 8376 - protein, 31 aa, Artificial Sequence
  Description of Artificial Sequence: Synthetic polypeptide
DEEEIRTTNPVATEQYGSVNSPTGLQRGNVL

SEQ ID NO: 8377 - protein, 30 aa, Artificial Sequence
  Description of Artificial Sequence: Synthetic polypeptide
DEEEIRTTNPVATEQYGVVSTNDQRMGNQI

SEQ ID NO: 8378 - protein, 33 aa, Artificial Sequence
  Description of Artificial Sequence: Synthetic polypeptide
DEEEIRTTNPVATEQYGSVYSDTNLQERGSNDR

SEQ ID NO: 8379 - protein, 30 aa, Artificial Sequence
  Description of Artificial Sequence: Synthetic polypeptide
DEEEIRTTNPVATEQYGVVSTNDIQRGTDR

SEQ ID NO: 8380 - protein, 31 aa, Artificial Sequence
  Description of Artificial Sequence: Synthetic polypeptide
DEEEIRTTNPVATEQYGSVPSTDLSQRGGNA

SEQ ID NO: 8381 - protein, 31 aa, Artificial Sequence
  Description of Artificial Sequence: Synthetic polypeptide
DEEEIRTTNPVATEQYGSVPSPTNLQRETRI

SEQ ID NO: 8382 - protein, 30 aa, Artificial Sequence
  Description of Artificial Sequence: Synthetic polypeptide
DEEEIRTTNPVATEQYGVVSTNLQGDGNNM

SEQ ID NO: 8383 - protein, 30 aa, Artificial Sequence
  Description of Artificial Sequence: Synthetic polypeptide
DEEEIRTTNPVATEQYGSVYSPNSLDRGER

SEQ ID NO: 8384 - protein, 30 aa, Artificial Sequence
  Description of Artificial Sequence: Synthetic polypeptide
DEEEIRTTNPVATEQYGSVYSSELQSGNRM

SEQ ID NO: 8385 - protein, 31 aa, Artificial Sequence
  Description of Artificial Sequence: Synthetic polypeptide
DEEEIRTTNPVATEQYGSVNSTDLVQRGNEQ

SEQ ID NO: 8386 - protein, 32 aa, Artificial Sequence
  Description of Artificial Sequence: Synthetic polypeptide
DEEEIRTTNPVATEQYGSVNSTDNEQRAGDNR

SEQ ID NO: 8387 - protein, 30 aa, Artificial Sequence
  Description of Artificial Sequence: Synthetic polypeptide
DEEEIRTTNPVATEQYGSVNSTGLNQRGEV

SEQ ID NO: 8388 - protein, 30 aa, Artificial Sequence
  Description of Artificial Sequence: Synthetic polypeptide
DEEEIRTTNPVATEQYGSVYSTGNPQVGER

SEQ ID NO: 8389 - protein, 29 aa, Artificial Sequence
  Description of Artificial Sequence: Synthetic peptide
DEEEIRTTNPVATEQYGVVSTMNHQHGNT

SEQ ID NO: 8390 - protein, 31 aa, Artificial Sequence
  Description of Artificial Sequence: Synthetic polypeptide
DEEEIRTTNPVATEQYGSVYSTNAIQVNGNR

SEQ ID NO: 8391 - protein, 31 aa, Artificial Sequence
  Description of Artificial Sequence: Synthetic polypeptide
DEEEIRTTNPVATEQYGSVNSTGNLQNGTND

SEQ ID NO: 8392 - protein, 31 aa, Artificial Sequence
  Description of Artificial Sequence: Synthetic polypeptide
DEEEIRTTNPVATEQYGSVNSTGNLQQTGNE

SEQ ID NO: 8393 - protein, 30 aa, Artificial Sequence
  Description of Artificial Sequence: Synthetic polypeptide
DEEEIRTTNPVATEQYGVVSTLNLQQIGND

SEQ ID NO: 8394 - protein, 31 aa, Artificial Sequence
  Description of Artificial Sequence: Synthetic polypeptide
DEEEIRTTNPVATEQYGSVNSTHLQRVGEGR

SEQ ID NO: 8395 - protein, 30 aa, Artificial Sequence
  Description of Artificial Sequence: Synthetic polypeptide
DEEEIRTTNPVATEQYGSVNSTLNQQEGER

SEQ ID NO: 8396 - protein, 31 aa, Artificial Sequence
  Description of Artificial Sequence: Synthetic polypeptide
DEEEIRTTNPVATEQYGVVSTGNLQRGNDFE

SEQ ID NO: 8397 - protein, 30 aa, Artificial Sequence
  Description of Artificial Sequence: Synthetic polypeptide
DEEEIRTTNPVATEQYGSVNSTDLQQGNGD

SEQ ID NO: 8398 - protein, 30 aa, Artificial Sequence
  Description of Artificial Sequence: Synthetic polypeptide
DEEEIRTTNPVATEQYGVVSTNLQGGGNFD

SEQ ID NO: 8399 - protein, 30 aa, Artificial Sequence
  Description of Artificial Sequence: Synthetic polypeptide
DEEEIRTTNPVATEQYGVVSTNLQGGNGNA

SEQ ID NO: 8400 - protein, 30 aa, Artificial Sequence
  Description of Artificial Sequence: Synthetic polypeptide
DEEEIRTTNPVATEQYGVVSTNLQKDGNSD

SEQ ID NO: 8401 - protein, 32 aa, Artificial Sequence
  Description of Artificial Sequence: Synthetic polypeptide
DEEEIRTTNPVATEQYGSVPSTNLQFMGSNRE

SEQ ID NO: 8402 - protein, 31 aa, Artificial Sequence
  Description of Artificial Sequence: Synthetic polypeptide
DEEEIRTTNPVATEQYGSVNSGTNLDRGNND

SEQ ID NO: 8403 - protein, 30 aa, Artificial Sequence
  Description of Artificial Sequence: Synthetic polypeptide
DEEEIRTTNPVATEQYGSVPSTNHSQQGSR

SEQ ID NO: 8404 - protein, 30 aa, Artificial Sequence
  Description of Artificial Sequence: Synthetic polypeptide
DEEEIRTTNPVATEQYGSVNSINLQNGGNF

SEQ ID NO: 8405 - protein, 31 aa, Artificial Sequence
  Description of Artificial Sequence: Synthetic polypeptide
DEEEIRTTNPVATEQYGSVPSTNDSQFTGNR

SEQ ID NO: 8406 - protein, 32 aa, Artificial Sequence
  Description of Artificial Sequence: Synthetic polypeptide
DEEEIRTTNPVATEQYGSVPSTNALGRGGGNR

SEQ ID NO: 8407 - protein, 30 aa, Artificial Sequence
  Description of Artificial Sequence: Synthetic polypeptide
DEEEIRTTNPVATEQYGVVSTSLQSFGNRA

SEQ ID NO: 8408 - protein, 30 aa, Artificial Sequence
  Description of Artificial Sequence: Synthetic polypeptide
DEEEIRTTNPVATEQYGSVYPTNLQRIQNI

SEQ ID NO: 8409 - protein, 31 aa, Artificial Sequence
  Description of Artificial Sequence: Synthetic polypeptide
DEEEIRTTNPVATEQYGSVPSTNAIQVDGNR

SEQ ID NO: 8410 - protein, 30 aa, Artificial Sequence
  Description of Artificial Sequence: Synthetic polypeptide
DEEEIRTTNPVATEQYGSVNSNTMLQDGTR

SEQ ID NO: 8411 - protein, 31 aa, Artificial Sequence
  Description of Artificial Sequence: Synthetic polypeptide
DEEEIRTTNPVATEQYGSVNSPNGLQRGNLY

SEQ ID NO: 8412 - protein, 29 aa, Artificial Sequence
  Description of Artificial Sequence: Synthetic peptide
DEEEIRTTNPVATEQYGSVNSPNIQGGNG

SEQ ID NO: 8413 - protein, 29 aa, Artificial Sequence
  Description of Artificial Sequence: Synthetic peptide
DEEEIRTTNPVATEQYGVVSTPNLQTFNQ

SEQ ID NO: 8414 - protein, 31 aa, Artificial Sequence
  Description of Artificial Sequence: Synthetic polypeptide
DEEEIRTTNPVATEQYGVVSTPNLQRGNPFE

SEQ ID NO: 8415 - protein, 28 aa, Artificial Sequence
  Description of Artificial Sequence: Synthetic peptide
DEAEIRATNPVATEQYGSVSSNLQSGNP

SEQ ID NO: 8416 - protein, 30 aa, Artificial Sequence
  Description of Artificial Sequence: Synthetic polypeptide
DEEEIRTTNPVATEQYGVVSTNNQRGSNVA

SEQ ID NO: 8417 - protein, 30 aa, Artificial Sequence
  Description of Artificial Sequence: Synthetic polypeptide
DEEEIRTTNPVATEQYGVVSTNNQRFGNQS

SEQ ID NO: 8418 - protein, 28 aa, Artificial Sequence
  Description of Artificial Sequence: Synthetic peptide
DEAEIRATNPVATEQYGSVSQNLQDGNA

SEQ ID NO: 8419 - protein, 29 aa, Artificial Sequence
  Description of Artificial Sequence: Synthetic peptide
DEEEIRTTNPVATEQYGVVSTNNDQGGNV

SEQ ID NO: 8420 - protein, 28 aa, Artificial Sequence
  Description of Artificial Sequence: Synthetic peptide
DEAEIRATNPVATEQYGSVSGNLQHGNH

SEQ ID NO: 8421 - protein, 30 aa, Artificial Sequence
  Description of Artificial Sequence: Synthetic polypeptide
DEEEIRTTNPVATEQYGVVSTNLQVGENLL

SEQ ID NO: 8422 - protein, 30 aa, Artificial Sequence
  Description of Artificial Sequence: Synthetic polypeptide
DEEEIRTTNPVATEQYGVVSTNLQTMGNGD

SEQ ID NO: 8423 - protein, 30 aa, Artificial Sequence
  Description of Artificial Sequence: Synthetic polypeptide
DEEEIRTTNPVATEQYGVVSTNLQTGGNAN

SEQ ID NO: 8424 - protein, 30 aa, Artificial Sequence
  Description of Artificial Sequence: Synthetic polypeptide
DEEEIRTTNPVATEQYGVVSTNLQSGDNDK

SEQ ID NO: 8425 - protein, 31 aa, Artificial Sequence
  Description of Artificial Sequence: Synthetic polypeptide
DEEEIRTTNPVATEQYGVVSTNLQRSGENGN

SEQ ID NO: 8426 - protein, 30 aa, Artificial Sequence
  Description of Artificial Sequence: Synthetic polypeptide
DEEEIRTTNPVATEQYGVVSTNLQRGAEFG

SEQ ID NO: 8427 - protein, 30 aa, Artificial Sequence
  Description of Artificial Sequence: Synthetic polypeptide
DEEEIRTTNPVATEQYGVVSTNLQQGGNDL

SEQ ID NO: 8428 - protein, 30 aa, Artificial Sequence
  Description of Artificial Sequence: Synthetic polypeptide
DEEEIRTTNPVATEQYGVVSTNLQPDGNEL

SEQ ID NO: 8429 - protein, 30 aa, Artificial Sequence
  Description of Artificial Sequence: Synthetic polypeptide
DEEEIRTTNPVATEQYGVVSTNLQNGDNDN

SEQ ID NO: 8430 - protein, 30 aa, Artificial Sequence
  Description of Artificial Sequence: Synthetic polypeptide
DEEEIRTTNPVATEQYGSVWTILQEVGNDR

SEQ ID NO: 8431 - protein, 31 aa, Artificial Sequence
  Description of Artificial Sequence: Synthetic polypeptide
DEEEIRTTNPVATEQYGSVYSTNCIQSKGNR

SEQ ID NO: 8432 - protein, 29 aa, Artificial Sequence
  Description of Artificial Sequence: Synthetic peptide
DEEEIRTTNPVATEQYGSVWTGLQTGSQR

SEQ ID NO: 8433 - protein, 31 aa, Artificial Sequence
  Description of Artificial Sequence: Synthetic polypeptide
DEEEIRTTNPVATEQYGYVSCTNLQRTGGNQ

SEQ ID NO: 8434 - protein, 31 aa, Artificial Sequence
  Description of Artificial Sequence: Synthetic polypeptide
DEEEIRTTNPVATETYGSVSTNLQRGNTNTD

SEQ ID NO: 8435 - protein, 28 aa, Artificial Sequence
  Description of Artificial Sequence: Synthetic peptide
DEAEIRTTNPVAAEQYGSISTNLERNNR

SEQ ID NO: 8436 - protein, 31 aa, Artificial Sequence
  Description of Artificial Sequence: Synthetic polypeptide
DEEEIRTTNPVATEQYGSVMTNNLQRGGERP

SEQ ID NO: 8437 - protein, 30 aa, Artificial Sequence
  Description of Artificial Sequence: Synthetic polypeptide
DEEEIRTTNPVATEQYGSVVTNPDREGNRN

SEQ ID NO: 8438 - protein, 28 aa, Artificial Sequence
  Description of Artificial Sequence: Synthetic peptide
DEAEIATTNPVATEGYGSVSTNLTRGNI

SEQ ID NO: 8439 - protein, 28 aa, Artificial Sequence
  Description of Artificial Sequence: Synthetic peptide
DEAEIATTNPVATEGYGSVSTQLQNGNR

SEQ ID NO: 8440 - protein, 30 aa, Artificial Sequence
  Description of Artificial Sequence: Synthetic polypeptide
DEEEIRTTNPVATETYGSVSTNLQQDGNNE

SEQ ID NO: 8441 - protein, 30 aa, Artificial Sequence
  Description of Artificial Sequence: Synthetic polypeptide
DEEEIRTTNPVATETYGSVSTNLQPGGNEQ

SEQ ID NO: 8442 - protein, 30 aa, Artificial Sequence
  Description of Artificial Sequence: Synthetic polypeptide
DEEEIRTTNPVATETYGSVSTNLQEGGNAM

SEQ ID NO: 8443 - protein, 30 aa, Artificial Sequence
  Description of Artificial Sequence: Synthetic polypeptide
DEEEIATTNPVATEHYGSVSTNLQQGNERM

SEQ ID NO: 8444 - protein, 30 aa, Artificial Sequence
  Description of Artificial Sequence: Synthetic polypeptide
DEEEIRTTNPVATEQYGSVVTNQDRPGNRD

SEQ ID NO: 8445 - protein, 30 aa, Artificial Sequence
  Description of Artificial Sequence: Synthetic polypeptide
DEEEIATTNPVATEHYGSVSTNLQQGNDRY

SEQ ID NO: 8446 - protein, 29 aa, Artificial Sequence
  Description of Artificial Sequence: Synthetic peptide
DEAEIATTNPVATEHYGSVSTNLQRDGNI

SEQ ID NO: 8447 - protein, 30 aa, Artificial Sequence
  Description of Artificial Sequence: Synthetic polypeptide
DEEEIRTTNPVATETYGSVSTNLQSIGNNI

SEQ ID NO: 8448 - protein, 29 aa, Artificial Sequence
  Description of Artificial Sequence: Synthetic peptide
DEEEIRTTNPVATEQYGSVVTNTQRLNEE

SEQ ID NO: 8449 - protein, 30 aa, Artificial Sequence
  Description of Artificial Sequence: Synthetic polypeptide
DEEEIRTTNPVATETYGSVSTNLIRGNGNL

SEQ ID NO: 8450 - protein, 29 aa, Artificial Sequence
  Description of Artificial Sequence: Synthetic peptide
DEEEIRTTNPVATEQYGSVVTQLQVGDVR

SEQ ID NO: 8451 - protein, 29 aa, Artificial Sequence
  Description of Artificial Sequence: Synthetic peptide
DEEEIATTNPVATEHYGSVSTNLQMDGNA

SEQ ID NO: 8452 - protein, 30 aa, Artificial Sequence
  Description of Artificial Sequence: Synthetic polypeptide
DEEEIRTTNPVATEQYGSVVTSLERGNERN

SEQ ID NO: 8453 - protein, 29 aa, Artificial Sequence
  Description of Artificial Sequence: Synthetic peptide
DEEEIATTNPVATEHYGSVSTNLQHGGNH

SEQ ID NO: 8454 - protein, 29 aa, Artificial Sequence
  Description of Artificial Sequence: Synthetic peptide
DEEEIRTTNPVATETYGSVSTELQRGEVN

SEQ ID NO: 8455 - protein, 29 aa, Artificial Sequence
  Description of Artificial Sequence: Synthetic peptide
DEEEIRTTNPVATEQYGSVVTVNQRGNNL

SEQ ID NO: 8456 - protein, 30 aa, Artificial Sequence
  Description of Artificial Sequence: Synthetic polypeptide
DEEEIATTNPVATEHYGSVSTNLQDGNERN

SEQ ID NO: 8457 - protein, 30 aa, Artificial Sequence
  Description of Artificial Sequence: Synthetic polypeptide
DEEEIATTNPVATEHYGSVSENLQREGENR

SEQ ID NO: 8458 - protein, 30 aa, Artificial Sequence
  Description of Artificial Sequence: Synthetic polypeptide
DEEEIRTTNPVATEQYGSVMTPNLQPSDNR

SEQ ID NO: 8459 - protein, 30 aa, Artificial Sequence
  Description of Artificial Sequence: Synthetic polypeptide
DEEEIRTTNPVATEQYGSVMTVNLQIGENV

SEQ ID NO: 8460 - protein, 28 aa, Artificial Sequence
  Description of Artificial Sequence: Synthetic peptide
DEEEIRTTNPVATEQYGSVPTYLQANNQ

SEQ ID NO: 8461 - protein, 29 aa, Artificial Sequence
  Description of Artificial Sequence: Synthetic peptide
DEEEIRTTNPVATEQYGSVPTWLQRENID

SEQ ID NO: 8462 - protein, 30 aa, Artificial Sequence
  Description of Artificial Sequence: Synthetic polypeptide
DEEEIRTTNPVATEQYGSVPVTNLSQAGNQ

SEQ ID NO: 8463 - protein, 31 aa, Artificial Sequence
  Description of Artificial Sequence: Synthetic polypeptide
DEEEIRTTNPVATEQYGSVVVSTHLSQRGNT

SEQ ID NO: 8464 - protein, 29 aa, Artificial Sequence
  Description of Artificial Sequence: Synthetic peptide
DEEEIRTTNPVATEQYGSVVTNMLHNGER

SEQ ID NO: 8465 - protein, 30 aa, Artificial Sequence
  Description of Artificial Sequence: Synthetic polypeptide
DEEEIRTTNPVATETYGSVSTNLVQQEGNF

SEQ ID NO: 8466 - protein, 29 aa, Artificial Sequence
  Description of Artificial Sequence: Synthetic peptide
DEEEIRTTNPVATEYYGSVSTELQRGEDA

SEQ ID NO: 8467 - protein, 30 aa, Artificial Sequence
  Description of Artificial Sequence: Synthetic polypeptide
DEEEIRTTNPVATEQYGSVVTNDQVRGIDR

SEQ ID NO: 8468 - protein, 29 aa, Artificial Sequence
  Description of Artificial Sequence: Synthetic peptide
DEEEIRTTNPVATEQYGSVVTNEQHAGND

SEQ ID NO: 8469 - protein, 30 aa, Artificial Sequence
  Description of Artificial Sequence: Synthetic polypeptide
DEEEIRTTNPVATEQYGSVQCTNLQQGELR

SEQ ID NO: 8470 - protein, 31 aa, Artificial Sequence
  Description of Artificial Sequence: Synthetic polypeptide
DEEEIRTTNPVATEYYGSVPSTELSQRGGNR

SEQ ID NO: 8471 - protein, 29 aa, Artificial Sequence
  Description of Artificial Sequence: Synthetic peptide
DEEEIATTNPVATENYGSVSTNLQVQGNQ

SEQ ID NO: 8472 - protein, 30 aa, Artificial Sequence
  Description of Artificial Sequence: Synthetic polypeptide
DEEEIRTTNPVATEQYGSVVTNLDQNGNVE

SEQ ID NO: 8473 - protein, 30 aa, Artificial Sequence
  Description of Artificial Sequence: Synthetic polypeptide
DEEEIRTTNPVATEQYGSVVTNLERFENER

SEQ ID NO: 8474 - protein, 29 aa, Artificial Sequence
  Description of Artificial Sequence: Synthetic peptide
DEEEIATTNPVATENYGSVSTNLQQGNDT

SEQ ID NO: 8475 - protein, 29 aa, Artificial Sequence
  Description of Artificial Sequence: Synthetic peptide
DEEEIRTTNPVATEQYGSVVTNLERGEDN

SEQ ID NO: 8476 - protein, 29 aa, Artificial Sequence
  Description of Artificial Sequence: Synthetic peptide
DEEEIRTTNPVATEQYGSVVTNLIASGNI

SEQ ID NO: 8477 - protein, 30 aa, Artificial Sequence
  Description of Artificial Sequence: Synthetic polypeptide
DEEEIRTTNPVATEWYGSVSTSNLQGGGDR

SEQ ID NO: 8478 - protein, 28 aa, Artificial Sequence
  Description of Artificial Sequence: Synthetic peptide
DEAEIRTTNPVAIEQYGSISTNLERENR

SEQ ID NO: 8479 - protein, 30 aa, Artificial Sequence
  Description of Artificial Sequence: Synthetic polypeptide
DEEEIRTTNPVATETYGSVSTNLVQNGGNL

SEQ ID NO: 8480 - protein, 30 aa, Artificial Sequence
  Description of Artificial Sequence: Synthetic polypeptide
DEEEIRTTNPVATEWYGSVSTNLQMDGNNS

SEQ ID NO: 8481 - protein, 31 aa, Artificial Sequence
  Description of Artificial Sequence: Synthetic polypeptide
DEEEIRTTNPVATEVYGSVSTQNGLQNDGNR

SEQ ID NO: 8482 - protein, 30 aa, Artificial Sequence
  Description of Artificial Sequence: Synthetic polypeptide
DEEEIRTTNPVATEVYGSVSTPNLQLNGNV

SEQ ID NO: 8483 - protein, 30 aa, Artificial Sequence
  Description of Artificial Sequence: Synthetic polypeptide
DEEEIRTTNPVATEVYGSVSTNLQLTGNNS

SEQ ID NO: 8484 - protein, 30 aa, Artificial Sequence
  Description of Artificial Sequence: Synthetic polypeptide
DEEEIRTTNPVATEVYGSVSTNLQEGGNAV

SEQ ID NO: 8485 - protein, 30 aa, Artificial Sequence
  Description of Artificial Sequence: Synthetic polypeptide
DEEEIRTTNPVATEVYGSVSTNLQDGNEAD

SEQ ID NO: 8486 - protein, 29 aa, Artificial Sequence
  Description of Artificial Sequence: Synthetic peptide
DEEEIRTTNPVATEVYGSVSTNLGFNGNG

SEQ ID NO: 8487 - protein, 29 aa, Artificial Sequence
  Description of Artificial Sequence: Synthetic peptide
DEEEIRTTNPVATEVYGSVSTNLEDDGNG

SEQ ID NO: 8488 - protein, 29 aa, Artificial Sequence
  Description of Artificial Sequence: Synthetic peptide
DEEEIATTNPVATEIYGSVSTNMQRGNLD

SEQ ID NO: 8489 - protein, 29 aa, Artificial Sequence
  Description of Artificial Sequence: Synthetic peptide
DEEEIATTNPVATEIYGSVSTNLQQGNDQ

SEQ ID NO: 8490 - protein, 30 aa, Artificial Sequence
  Description of Artificial Sequence: Synthetic polypeptide
DEEEIRTTNPVATEQYGSVQCTGLQRTNRN

SEQ ID NO: 8491 - protein, 30 aa, Artificial Sequence
  Description of Artificial Sequence: Synthetic polypeptide
DEEEIRTTNPVATEVYGSVDDTNLTRGGNR

SEQ ID NO: 8492 - protein, 29 aa, Artificial Sequence
  Description of Artificial Sequence: Synthetic peptide
DEEEIATTNPVATEIYGSVSTNLQHGGNK

SEQ ID NO: 8493 - protein, 28 aa, Artificial Sequence
  Description of Artificial Sequence: Synthetic peptide
DEAEIATTNPVATEAYGSVSTNPQRGNM

SEQ ID NO: 8494 - protein, 31 aa, Artificial Sequence
  Description of Artificial Sequence: Synthetic polypeptide
DEEEIRTTNPVATEVYGSVSTSNDLQGGGNR

SEQ ID NO: 8495 - protein, 30 aa, Artificial Sequence
  Description of Artificial Sequence: Synthetic polypeptide
DEEEIRTTNPVATEQYGSVPTVLQRGLNIE

SEQ ID NO: 8496 - protein, 29 aa, Artificial Sequence
  Description of Artificial Sequence: Synthetic peptide
DEEEIATTNPVATEGYGSVSTNLQIDGNL

SEQ ID NO: 8497 - protein, 29 aa, Artificial Sequence
  Description of Artificial Sequence: Synthetic peptide
DEEEIATTNPVATEGYGSVSTNGQRGPNF

SEQ ID NO: 8498 - protein, 30 aa, Artificial Sequence
  Description of Artificial Sequence: Synthetic polypeptide
DEEEIRTTNPVATERYGSVSTGLSQPGTNR

SEQ ID NO: 8499 - protein, 31 aa, Artificial Sequence
  Description of Artificial Sequence: Synthetic polypeptide
DEEEIRTTNPVATERYGSVSTAMLSQRTGNR

SEQ ID NO: 8500 - protein, 30 aa, Artificial Sequence
  Description of Artificial Sequence: Synthetic polypeptide
DEEEIRTTNPVATERYGSVSCTNLSDGGNR

SEQ ID NO: 8501 - protein, 30 aa, Artificial Sequence
  Description of Artificial Sequence: Synthetic polypeptide
DEEEIRTTNPVATEQYGSVPTNNEQDGNER

SEQ ID NO: 8502 - protein, 28 aa, Artificial Sequence
  Description of Artificial Sequence: Synthetic peptide
DEEEIRTTNPVATEQYGSVPTNMTGGNM

SEQ ID NO: 8503 - protein, 29 aa, Artificial Sequence
  Description of Artificial Sequence: Synthetic peptide
DEEEIRTTNPVATEQYGSVPTNLVPGEQR

SEQ ID NO: 8504 - protein, 31 aa, Artificial Sequence
  Description of Artificial Sequence: Synthetic polypeptide
DEEEIRTTNPVATEQYGSVPTNLSQPNGANR

SEQ ID NO: 8505 - protein, 28 aa, Artificial Sequence
  Description of Artificial Sequence: Synthetic peptide
DEEEIATTNPVATECYGSVSTDLERGNL

SEQ ID NO: 8506 - protein, 30 aa, Artificial Sequence
  Description of Artificial Sequence: Synthetic polypeptide
DEEEIRTTNPVATERYGCVSTNLSTRGNMR

SEQ ID NO: 8507 - protein, 29 aa, Artificial Sequence
  Description of Artificial Sequence: Synthetic peptide
DEEEIRTTNPVATEQYWGSVSENDQDGNP

SEQ ID NO: 8508 - protein, 30 aa, Artificial Sequence
  Description of Artificial Sequence: Synthetic polypeptide
DEEEIRTTNPVATEQYGSVNGTNLQGGNTN

SEQ ID NO: 8509 - protein, 30 aa, Artificial Sequence
  Description of Artificial Sequence: Synthetic polypeptide
DEEEIRTTNPVATEQYGSVPTNLQRGAILN

SEQ ID NO: 8510 - protein, 30 aa, Artificial Sequence
  Description of Artificial Sequence: Synthetic polypeptide
DEEEIRTTNPVATEQYGYVSTNLQTGGNND

SEQ ID NO: 8511 - protein, 29 aa, Artificial Sequence
  Description of Artificial Sequence: Synthetic peptide
DEEEIRTTNPVATEQYGSVPTNNLQRNEQ

SEQ ID NO: 8512 - protein, 30 aa, Artificial Sequence
  Description of Artificial Sequence: Synthetic polypeptide
DEEEIRTTNPVATEQYGYVSTNLQRFSDRD

SEQ ID NO: 8513 - protein, 29 aa, Artificial Sequence
  Description of Artificial Sequence: Synthetic peptide
DEAEIATTNPVATEQYGEVSTNLQRGNSM

SEQ ID NO: 8514 - protein, 31 aa, Artificial Sequence
  Description of Artificial Sequence: Synthetic polypeptide
DEEEIRTTNPVATEQYGSVNGTNLQRQMQNR

SEQ ID NO: 8515 - protein, 30 aa, Artificial Sequence
  Description of Artificial Sequence: Synthetic polypeptide
DEEEIRTTNPVATEQYGYVSTNLQHGNQDD

SEQ ID NO: 8516 - protein, 30 aa, Artificial Sequence
  Description of Artificial Sequence: Synthetic polypeptide
DEEEIRTTNPVATEQYGYVSTNLQHGNNNN

SEQ ID NO: 8517 - protein, 30 aa, Artificial Sequence
  Description of Artificial Sequence: Synthetic polypeptide
DEEEIRTTNPVATEQYGYVSTNLQHGGNEE

SEQ ID NO: 8518 - protein, 30 aa, Artificial Sequence
  Description of Artificial Sequence: Synthetic polypeptide
DEEEIRTTNPVATEQYGYVSTNLQGGNTGN

SEQ ID NO: 8519 - protein, 30 aa, Artificial Sequence
  Description of Artificial Sequence: Synthetic polypeptide
DEEEIRTTNPVATEQYGYVSTNLQGGNANN

SEQ ID NO: 8520 - protein, 30 aa, Artificial Sequence
  Description of Artificial Sequence: Synthetic polypeptide
DEEEIRTTNPVATEQYGYVSTNLQFNGNLQ

SEQ ID NO: 8521 - protein, 30 aa, Artificial Sequence
  Description of Artificial Sequence: Synthetic polypeptide
DEEEIRTTNPVATEQYGYVSTGNGGQTGNR

SEQ ID NO: 8522 - protein, 31 aa, Artificial Sequence
  Description of Artificial Sequence: Synthetic polypeptide
DEEEIRTTNPVATEQYGSVNLTNLQNGENRI

SEQ ID NO: 8523 - protein, 29 aa, Artificial Sequence
  Description of Artificial Sequence: Synthetic peptide
DEEEIRTTNPVATEQYGSVNMTNDQDGND

SEQ ID NO: 8524 - protein, 30 aa, Artificial Sequence
  Description of Artificial Sequence: Synthetic polypeptide
DEEEIRTTNPVATEQYGYVSNTNLQDGNGT

SEQ ID NO: 8525 - protein, 30 aa, Artificial Sequence
  Description of Artificial Sequence: Synthetic polypeptide
DEEEIRTTNPVATEQYGYVSITNLNRGMND

SEQ ID NO: 8526 - protein, 29 aa, Artificial Sequence
  Description of Artificial Sequence: Synthetic peptide
DEEEIRTTNPVATEQYGSVPTNLQIGTQG

SEQ ID NO: 8527 - protein, 29 aa, Artificial Sequence
  Description of Artificial Sequence: Synthetic peptide
DEEEIRTTNPVATEQYGSVPTNPQRGEQY

SEQ ID NO: 8528 - protein, 29 aa, Artificial Sequence
  Description of Artificial Sequence: Synthetic peptide
DEEEIATTNPVATECYGSVSTNLQGGNDA

SEQ ID NO: 8529 - protein, 28 aa, Artificial Sequence
  Description of Artificial Sequence: Synthetic peptide
DEAEIATTNPVATEQYGAVSTNLQNGPR

SEQ ID NO: 8530 - protein, 29 aa, Artificial Sequence
  Description of Artificial Sequence: Synthetic peptide
DEEEIRTTNPVATEQYGSVPTVLQDLGER

SEQ ID NO: 8531 - protein, 30 aa, Artificial Sequence
  Description of Artificial Sequence: Synthetic polypeptide
DEEEIRTTNPVATEQYGSVPTTNLQRGDQN

SEQ ID NO: 8532 - protein, 29 aa, Artificial Sequence
  Description of Artificial Sequence: Synthetic peptide
DEEEIRTTNPVATESYGSVSTNLVPEGNG

SEQ ID NO: 8533 - protein, 30 aa, Artificial Sequence
  Description of Artificial Sequence: Synthetic polypeptide
DEEEIRTTNPVATESYGSVSTNLQSSGNGE

SEQ ID NO: 8534 - protein, 30 aa, Artificial Sequence
  Description of Artificial Sequence: Synthetic polypeptide
DEEEIRTTNPVATEQYGSVWETNLVRSGNQ

SEQ ID NO: 8535 - protein, 30 aa, Artificial Sequence
  Description of Artificial Sequence: Synthetic polypeptide
DEEEIRTTNPVATESYGSVSTNLQNTGENG

SEQ ID NO: 8536 - protein, 30 aa, Artificial Sequence
  Description of Artificial Sequence: Synthetic polypeptide
DEEEIRTTNPVATESYGSVSTNLQMDGNEN

SEQ ID NO: 8537 - protein, 30 aa, Artificial Sequence
  Description of Artificial Sequence: Synthetic polypeptide
DEEEIRTTNPVATESYGSVSTNLQGDGNGS

SEQ ID NO: 8538 - protein, 29 aa, Artificial Sequence
  Description of Artificial Sequence: Synthetic peptide
DEEEIRTTNPVATEQYGSVPTSLQRGTQI

SEQ ID NO: 8539 - protein, 30 aa, Artificial Sequence
  Description of Artificial Sequence: Synthetic polypeptide
DEEEIRTTNPVATESYGSVSTNLNQDGNLQ

SEQ ID NO: 8540 - protein, 29 aa, Artificial Sequence
  Description of Artificial Sequence: Synthetic peptide
DEEEIRTTNPVATESYGSVSTNLEPQGNQ

SEQ ID NO: 8541 - protein, 29 aa, Artificial Sequence
  Description of Artificial Sequence: Synthetic peptide
DEEEIRTTNPVATEQYGSVNCTNLQSGDD

SEQ ID NO: 8542 - protein, 30 aa, Artificial Sequence
  Description of Artificial Sequence: Synthetic polypeptide
DEEEIATTNPVATEEYGSVSTNLQREGNSN

SEQ ID NO: 8543 - protein, 30 aa, Artificial Sequence
  Description of Artificial Sequence: Synthetic polypeptide
DEEEIRTTNPVATESYGSVNSTNLQGGGNT

SEQ ID NO: 8544 - protein, 29 aa, Artificial Sequence
  Description of Artificial Sequence: Synthetic peptide
DEEEIRTTNPVATESYGSVCSTYEQNGNR

SEQ ID NO: 8545 - protein, 30 aa, Artificial Sequence
  Description of Artificial Sequence: Synthetic polypeptide
DEEEIRTTNPVATESYGSVCFTNLTRMGNR

SEQ ID NO: 8546 - protein, 28 aa, Artificial Sequence
  Description of Artificial Sequence: Synthetic peptide
DEEEIRTTNPVATESYGSVATNLQRHEM

SEQ ID NO: 8547 - protein, 30 aa, Artificial Sequence
  Description of Artificial Sequence: Synthetic polypeptide
DEEEIRTTNPVATESYGSVATNLQDRGNDT

SEQ ID NO: 8548 - protein, 30 aa, Artificial Sequence
  Description of Artificial Sequence: Synthetic polypeptide
DEEEIATTNPVATEEYGSVSTNLQGEGNDR

SEQ ID NO: 8549 - protein, 30 aa, Artificial Sequence
  Description of Artificial Sequence: Synthetic polypeptide
DEEEIRTTNPVATEQYGSVWPTDNLQVGQR

SEQ ID NO: 8550 - protein, 29 aa, Artificial Sequence
  Description of Artificial Sequence: Synthetic peptide
DEEEIATTNPVATEEYGSVATNLQSGNMR

SEQ ID NO: 8551 - protein, 31 aa, Artificial Sequence
  Description of Artificial Sequence: Synthetic polypeptide
DEEEIRTTNPVATEQYGSVNDTNLQTGENRL

SEQ ID NO: 8552 - protein, 30 aa, Artificial Sequence
  Description of Artificial Sequence: Synthetic polypeptide
DEEEIRTTNPVATEQYGSVNENLQRDIDNR

SEQ ID NO: 8553 - protein, 30 aa, Artificial Sequence
  Description of Artificial Sequence: Synthetic polypeptide
DEEEIRTTNPVATEQYGSVWPTNEPQRGQR

SEQ ID NO: 8554 - protein, 29 aa, Artificial Sequence
  Description of Artificial Sequence: Synthetic peptide
DEEEIATTNPVATECYGSVSTNLQSGGNM

SEQ ID NO: 8555 - protein, 29 aa, Artificial Sequence
  Description of Artificial Sequence: Synthetic peptide
DEEEIATTNPVATECYGSVSTNLQQGNES

SEQ ID NO: 8556 - protein, 28 aa, Artificial Sequence
  Description of Artificial Sequence: Synthetic peptide
DEAEIATTNPVATEQYGAVSTNLQHGGR

SEQ ID NO: 8557 - protein, 29 aa, Artificial Sequence
  Description of Artificial Sequence: Synthetic peptide
DEEEIATTNPVATECYGSVSTNLQQGNDT

SEQ ID NO: 8558 - protein, 29 aa, Artificial Sequence
  Description of Artificial Sequence: Synthetic peptide
DEEEIRTTNPVATEQYGSVPTPALQRNNN

SEQ ID NO: 8559 - protein, 28 aa, Artificial Sequence
  Description of Artificial Sequence: Synthetic peptide
DEAEIRTTNNVAYDQYGSVSTNLQRGDR

SEQ ID NO: 8560 - protein, 29 aa, Artificial Sequence
  Description of Artificial Sequence: Synthetic peptide
DEEEIRTTNPVATEYYGSVSTNDTRGGND

SEQ ID NO: 8561 - protein, 31 aa, Artificial Sequence
  Description of Artificial Sequence: Synthetic polypeptide
DEEEIRTTNPVATEQYGSVYSTNCIQVLGNR

SEQ ID NO: 8562 - protein, 31 aa, Artificial Sequence
  Description of Artificial Sequence: Synthetic polypeptide
DEEEIRTTNPVATEQYGSVYSTNDEQKDGNR

SEQ ID NO: 8563 - protein, 32 aa, Artificial Sequence
  Description of Artificial Sequence: Synthetic polypeptide
DEEEIRTTNPVATEQYGSVNSTTNLQRGGNGN

SEQ ID NO: 8564 - protein, 29 aa, Artificial Sequence
  Description of Artificial Sequence: Synthetic peptide
DEEEIRTTNPVATEQYGTVSTNDQTRDNS

SEQ ID NO: 8565 - protein, 30 aa, Artificial Sequence
  Description of Artificial Sequence: Synthetic polypeptide
DEEEIRTTNPVATEQYGTVSTNAQGGQNRQ

SEQ ID NO: 8566 - protein, 30 aa, Artificial Sequence
  Description of Artificial Sequence: Synthetic polypeptide
DEEEIRTTNPVATEQYGTVSTGNLSQTVNR

SEQ ID NO: 8567 - protein, 28 aa, Artificial Sequence
  Description of Artificial Sequence: Synthetic peptide
DEEEIRTTNPVATEQYGTVSTEVQSGNL

SEQ ID NO: 8568 - protein, 29 aa, Artificial Sequence
  Description of Artificial Sequence: Synthetic peptide
DEEEIRTTNPVATEQYGTVSTELQGNLNR

SEQ ID NO: 8569 - protein, 30 aa, Artificial Sequence
  Description of Artificial Sequence: Synthetic polypeptide
DEEEIRTTNPVATEQYGTVSTEELQFGNRS

SEQ ID NO: 8570 - protein, 31 aa, Artificial Sequence
  Description of Artificial Sequence: Synthetic polypeptide
DEEEIRTTNPVATEQYGSVPSANLQRGVQRL

SEQ ID NO: 8571 - protein, 30 aa, Artificial Sequence
  Description of Artificial Sequence: Synthetic polypeptide
DEEEIRTTNPVATEQYGTVSTALLQFGNRT

SEQ ID NO: 8572 - protein, 30 aa, Artificial Sequence
  Description of Artificial Sequence: Synthetic polypeptide
DEEEIRTTNPVATEQYGTVSSTNLQIGNDS

SEQ ID NO: 8573 - protein, 30 aa, Artificial Sequence
  Description of Artificial Sequence: Synthetic polypeptide
DEEEIRTTNPVATEQYGSVNSTWLPQRGEE

SEQ ID NO: 8574 - protein, 30 aa, Artificial Sequence
  Description of Artificial Sequence: Synthetic polypeptide
DEEEIRTTNPVATEQYGTVSNTSLQFGNRS

SEQ ID NO: 8575 - protein, 30 aa, Artificial Sequence
  Description of Artificial Sequence: Synthetic polypeptide
DEEEIRTTNPVATEQYGTVSIENLNRGMNR

SEQ ID NO: 8576 - protein, 30 aa, Artificial Sequence
  Description of Artificial Sequence: Synthetic polypeptide
DEEEIRTTNPVATEQYGTVSTNIQHDGNNR

SEQ ID NO: 8577 - protein, 28 aa, Artificial Sequence
  Description of Artificial Sequence: Synthetic peptide
DEEEIACTNPVATEQYGVVSTNLQQGNV

SEQ ID NO: 8578 - protein, 29 aa, Artificial Sequence
  Description of Artificial Sequence: Synthetic peptide
DEEEIRTTNPVATEQYGTVSENLQHGDRE

SEQ ID NO: 8579 - protein, 30 aa, Artificial Sequence
  Description of Artificial Sequence: Synthetic polypeptide
DEEEIRTTNPVATEQYGTVSATNLARGNEV

SEQ ID NO: 8580 - protein, 28 aa, Artificial Sequence
  Description of Artificial Sequence: Synthetic peptide
DEAEICTTNPVATEPYGSVSTNLTRGNV

SEQ ID NO: 8581 - protein, 30 aa, Artificial Sequence
  Description of Artificial Sequence: Synthetic polypeptide
DEEEIRTTNPVATEQYGSVPPTNLQIGQVR

SEQ ID NO: 8582 - protein, 31 aa, Artificial Sequence
  Description of Artificial Sequence: Synthetic polypeptide
DEEEIRTTNPVATEQYGTVDSTPNLQRGQRG

SEQ ID NO: 8583 - protein, 31 aa, Artificial Sequence
  Description of Artificial Sequence: Synthetic polypeptide
DEEEIRTTNPVATEQYGSVYTVNLQRGSERP

SEQ ID NO: 8584 - protein, 30 aa, Artificial Sequence
  Description of Artificial Sequence: Synthetic polypeptide
DEEEIRTTNPVATEQYGSVPPTNLQFGPVR

SEQ ID NO: 8585 - protein, 30 aa, Artificial Sequence
  Description of Artificial Sequence: Synthetic polypeptide
DEEEIRTTNPVATEQYGTVCSTNTQSGNRS

SEQ ID NO: 8586 - protein, 32 aa, Artificial Sequence
  Description of Artificial Sequence: Synthetic polypeptide
DEEEIRTTNPVATEQYGTVCSTNPLQRGGNRS

SEQ ID NO: 8587 - protein, 30 aa, Artificial Sequence
  Description of Artificial Sequence: Synthetic polypeptide
DEEEIRTTNPVATEQYGTVCSTNLQSGDDR

SEQ ID NO: 8588 - protein, 28 aa, Artificial Sequence
  Description of Artificial Sequence: Synthetic peptide
DEEEIRTTNPVATEQYGSVPPNLERESR

SEQ ID NO: 8589 - protein, 29 aa, Artificial Sequence
  Description of Artificial Sequence: Synthetic peptide
DEEEIRTTNPVATEQYGSVPPNELQGLNR

SEQ ID NO: 8590 - protein, 30 aa, Artificial Sequence
  Description of Artificial Sequence: Synthetic polypeptide
DEEEIRTTNPVATEQYGSVNTELQRFGNFQ

SEQ ID NO: 8591 - protein, 30 aa, Artificial Sequence
  Description of Artificial Sequence: Synthetic polypeptide
DEEEIRTTNPVATEQYGTVSGTNLQSGNGT

SEQ ID NO: 8592 - protein, 31 aa, Artificial Sequence
  Description of Artificial Sequence: Synthetic polypeptide
DEEEIRTTNPVATEQYGTVATNLSQRPGTNR

SEQ ID NO: 8593 - protein, 30 aa, Artificial Sequence
  Description of Artificial Sequence: Synthetic polypeptide
DEEEIRTTNPVATEQYGTVSTNLQAEGNES

SEQ ID NO: 8594 - protein, 29 aa, Artificial Sequence
  Description of Artificial Sequence: Synthetic peptide
DEEEIRTTNPVATEQYGTVSTNLQDGESD

SEQ ID NO: 8595 - protein, 29 aa, Artificial Sequence
  Description of Artificial Sequence: Synthetic peptide
DEEEIRTTNPVATEQYGSVYTNNDRGQSR

SEQ ID NO: 8596 - protein, 31 aa, Artificial Sequence
  Description of Artificial Sequence: Synthetic polypeptide
DEEEIRTTNPVATEQYGTVTSTNLQFGGNRS

SEQ ID NO: 8597 - protein, 32 aa, Artificial Sequence
  Description of Artificial Sequence: Synthetic polypeptide
DEEEIRTTNPVATEQYGSVPSCTNELQDGGNR

SEQ ID NO: 8598 - protein, 28 aa, Artificial Sequence
  Description of Artificial Sequence: Synthetic peptide
DEAEICTTNPVATEQYGSVSTNLMYGNQ

SEQ ID NO: 8599 - protein, 31 aa, Artificial Sequence
  Description of Artificial Sequence: Synthetic polypeptide
DEEEIRTTNPVATEQYGTVTISTNQLQRGNE

SEQ ID NO: 8600 - protein, 31 aa, Artificial Sequence
  Description of Artificial Sequence: Synthetic polypeptide
DEEEIRTTNPVATEQYGTVSWTNLNRGMNVR

SEQ ID NO: 8601 - protein, 31 aa, Artificial Sequence
  Description of Artificial Sequence: Synthetic polypeptide
DEEEIRTTNPVATEQYGTVSWTNLNRGGMNR

SEQ ID NO: 8602 - protein, 30 aa, Artificial Sequence
  Description of Artificial Sequence: Synthetic polypeptide
DEEEIRTTNPVATEQYGTVSWSNLNRGMNR

SEQ ID NO: 8603 - protein, 31 aa, Artificial Sequence
  Description of Artificial Sequence: Synthetic polypeptide
DEEEIRTTNPVATEQYGSVYTNNLEQRTGVR

SEQ ID NO: 8604 - protein, 30 aa, Artificial Sequence
  Description of Artificial Sequence: Synthetic polypeptide
DEEEIRTTNPVATEQYGTVSVNNLNRGMNR

SEQ ID NO: 8605 - protein, 30 aa, Artificial Sequence
  Description of Artificial Sequence: Synthetic polypeptide
DEAEICTTNPVATEQYGSVSTNDQREGNER

SEQ ID NO: 8606 - protein, 30 aa, Artificial Sequence
  Description of Artificial Sequence: Synthetic polypeptide
DEEEIRTTNPVATEQYGTVSTVNLQGGNEN

SEQ ID NO: 8607 - protein, 30 aa, Artificial Sequence
  Description of Artificial Sequence: Synthetic polypeptide
DEEEIRTTNPVATEQYGTVSTTNLQQGNEQ

SEQ ID NO: 8608 - protein, 30 aa, Artificial Sequence
  Description of Artificial Sequence: Synthetic polypeptide
DEEEIRTTNPVATEQYGTVSTNLQAGGNTH

SEQ ID NO: 8609 - protein, 29 aa, Artificial Sequence
  Description of Artificial Sequence: Synthetic peptide
DEEEIRTTNPVATEQYGSVYTPLQNMGER

SEQ ID NO: 8610 - protein, 30 aa, Artificial Sequence
  Description of Artificial Sequence: Synthetic polypeptide
DEEEIRTTNPVATEQYGTVSTQNLQFGNSN

SEQ ID NO: 8611 - protein, 29 aa, Artificial Sequence
  Description of Artificial Sequence: Synthetic peptide
DEEEIRTTNPVATEQYGSVYTSLQGGNES

SEQ ID NO: 8612 - protein, 29 aa, Artificial Sequence
  Description of Artificial Sequence: Synthetic peptide
DEEEIRTTNPVATEQYGSVYTSLQNMGNI

SEQ ID NO: 8613 - protein, 30 aa, Artificial Sequence
  Description of Artificial Sequence: Synthetic polypeptide
DEEEIRTTNPVATEQYGTVSTNLQRDDNDQ

SEQ ID NO: 8614 - protein, 30 aa, Artificial Sequence
  Description of Artificial Sequence: Synthetic polypeptide
DEEEIRTTNPVATEQYGTVSTNLQHQGNDS

SEQ ID NO: 8615 - protein, 30 aa, Artificial Sequence
  Description of Artificial Sequence: Synthetic polypeptide
DEEEIRTTNPVATEQYGTVSTNLQGDGNMS

SEQ ID NO: 8616 - protein, 32 aa, Artificial Sequence
  Description of Artificial Sequence: Synthetic polypeptide
DEEEIRTTNPVATEQYGSVNSTTNLQMRGEND

SEQ ID NO: 8617 - protein, 30 aa, Artificial Sequence
  Description of Artificial Sequence: Synthetic polypeptide
DEEEIRTTNPVATEQYGTVSTNLQFTGNET

SEQ ID NO: 8618 - protein, 31 aa, Artificial Sequence
  Description of Artificial Sequence: Synthetic polypeptide
DEEEIRTTNPVATEQYGTVSTNLQFGQSNRE

SEQ ID NO: 8619 - protein, 30 aa, Artificial Sequence
  Description of Artificial Sequence: Synthetic polypeptide
DEEEIRTTNPVATEQYGTVSTNLQFGNSDD

SEQ ID NO: 8620 - protein, 30 aa, Artificial Sequence
  Description of Artificial Sequence: Synthetic polypeptide
DEEEIRTTNPVATEQYGTVSTNLQEMGNMD

SEQ ID NO: 8621 - protein, 29 aa, Artificial Sequence
  Description of Artificial Sequence: Synthetic peptide
DEEEIRTTNPVATEQYGTVSTNLQDGSDA

SEQ ID NO: 8622 - protein, 30 aa, Artificial Sequence
  Description of Artificial Sequence: Synthetic polypeptide
DEEEIRTTNPVATEQYGTVSTNLQDGGNDG

SEQ ID NO: 8623 - protein, 30 aa, Artificial Sequence
  Description of Artificial Sequence: Synthetic polypeptide
DEEEIRTTNPVATEQYGSVNSTTLQRGIET

SEQ ID NO: 8624 - protein, 29 aa, Artificial Sequence
  Description of Artificial Sequence: Synthetic peptide
DEEEIRTTNPVATEQYGTVACTNLGRSNR

SEQ ID NO: 8625 - protein, 29 aa, Artificial Sequence
  Description of Artificial Sequence: Synthetic peptide
DEEEIRTTNPVATEQYGSVNTEMIQRGQR

SEQ ID NO: 8626 - protein, 31 aa, Artificial Sequence
  Description of Artificial Sequence: Synthetic polypeptide
DEEEIRTTNPVATEQYGSVNTENALQRGNMD

SEQ ID NO: 8627 - protein, 30 aa, Artificial Sequence
  Description of Artificial Sequence: Synthetic polypeptide
DEEEIRTTNPVATEQYGSVNTNLQVEAGND

SEQ ID NO: 8628 - protein, 29 aa, Artificial Sequence
  Description of Artificial Sequence: Synthetic peptide
DEEEIRTTNPVATEQYGSVNTNLQVGEMI

SEQ ID NO: 8629 - protein, 31 aa, Artificial Sequence
  Description of Artificial Sequence: Synthetic polypeptide
DEEEIRTTNPVATEQYGSYVSTENLQVGNDQ

SEQ ID NO: 8630 - protein, 30 aa, Artificial Sequence
  Description of Artificial Sequence: Synthetic polypeptide
DEEEIRTTNPVATEQYGSVPATNDQRGGER

SEQ ID NO: 8631 - protein, 28 aa, Artificial Sequence
  Description of Artificial Sequence: Synthetic peptide
DEEEIRTTNPVATEQYGSVNTNYQFSER

SEQ ID NO: 8632 - protein, 29 aa, Artificial Sequence
  Description of Artificial Sequence: Synthetic peptide
DEEEIRTTNPVATEQYGSVPANLTRGERG

SEQ ID NO: 8633 - protein, 32 aa, Artificial Sequence
  Description of Artificial Sequence: Synthetic polypeptide
DEEEIRTTNPVATEQYGSYTISTNELQMRGNR

SEQ ID NO: 8634 - protein, 31 aa, Artificial Sequence
  Description of Artificial Sequence: Synthetic polypeptide
DEEEIRTTNPVATEQYGSYTISTNDDQRGNR

SEQ ID NO: 8635 - protein, 29 aa, Artificial Sequence
  Description of Artificial Sequence: Synthetic peptide
DEEEIRTTNPVATEQYGSVNTQLQPGDQR

SEQ ID NO: 8636 - protein, 29 aa, Artificial Sequence
  Description of Artificial Sequence: Synthetic peptide
DEEEIRTTNPVATEQYGSYSVNDQRGNEK

SEQ ID NO: 8637 - protein, 29 aa, Artificial Sequence
  Description of Artificial Sequence: Synthetic peptide
DEEEIRTTNPVATEQYGSYSVNDQRGDER

SEQ ID NO: 8638 - protein, 28 aa, Artificial Sequence
  Description of Artificial Sequence: Synthetic peptide
DEEEIRTTNPVATEQYGSYSTVYQMGER

SEQ ID NO: 8639 - protein, 30 aa, Artificial Sequence
  Description of Artificial Sequence: Synthetic polypeptide
DEEEIRTTNPVATEQYGSYSTQNLQRGIVP

SEQ ID NO: 8640 - protein, 30 aa, Artificial Sequence
  Description of Artificial Sequence: Synthetic polypeptide
DEEEIRTTNPVATEQYGSYVSTNTDQRGSQ

SEQ ID NO: 8641 - protein, 28 aa, Artificial Sequence
  Description of Artificial Sequence: Synthetic peptide
DEEEIRTTNPVATEQYGSYSTQLERIDR

SEQ ID NO: 8642 - protein, 29 aa, Artificial Sequence
  Description of Artificial Sequence: Synthetic peptide
DEEEIRTTNPVATEQYGSYSTNLQRLLHD

SEQ ID NO: 8643 - protein, 29 aa, Artificial Sequence
  Description of Artificial Sequence: Synthetic peptide
DEEEIRTTNPVATEQYGSYSTNLQRLIMP

SEQ ID NO: 8644 - protein, 29 aa, Artificial Sequence
  Description of Artificial Sequence: Synthetic peptide
DEEEIRTTNPVATEQYGSYSTNLQRIIED

SEQ ID NO: 8645 - protein, 30 aa, Artificial Sequence
  Description of Artificial Sequence: Synthetic polypeptide
DEEEIRTTNPVATEQYGSYSTNLQQLLNNR

SEQ ID NO: 8646 - protein, 28 aa, Artificial Sequence
  Description of Artificial Sequence: Synthetic peptide
DEEEIRTTNPVATEQYGSYSEIEQQGNR

SEQ ID NO: 8647 - protein, 29 aa, Artificial Sequence
  Description of Artificial Sequence: Synthetic peptide
DEEEIRTTNPVATEQYGSYSTNLGRGAQD

SEQ ID NO: 8648 - protein, 29 aa, Artificial Sequence
  Description of Artificial Sequence: Synthetic peptide
DEEEIRTTNPVATEQYGSYSTNLERINWN

SEQ ID NO: 8649 - protein, 29 aa, Artificial Sequence
  Description of Artificial Sequence: Synthetic peptide
DEEEIRTTNPVATEQYGSYSFNDQRGSER

SEQ ID NO: 8650 - protein, 29 aa, Artificial Sequence
  Description of Artificial Sequence: Synthetic peptide
DEEEIRTTNPVATEQYGSYSTILQRGETG

SEQ ID NO: 8651 - protein, 28 aa, Artificial Sequence
  Description of Artificial Sequence: Synthetic peptide
DEEEIRTTNPVATEQYGSYSTHLQRPET

SEQ ID NO: 8652 - protein, 30 aa, Artificial Sequence
  Description of Artificial Sequence: Synthetic polypeptide
DEEEIRTTNPVATEQYGSYSTHLQRGNIDF

SEQ ID NO: 8653 - protein, 30 aa, Artificial Sequence
  Description of Artificial Sequence: Synthetic polypeptide
DEEEIRTTNPVATEQYGSYSTGLQRDNIRD

SEQ ID NO: 8654 - protein, 30 aa, Artificial Sequence
  Description of Artificial Sequence: Synthetic polypeptide
DEEEIRTTNPVATEQYGSYSTDLQRGNIQW

SEQ ID NO: 8655 - protein, 30 aa, Artificial Sequence
  Description of Artificial Sequence: Synthetic polypeptide
DEEEIRTTNPVATEQYGSVNTTNDQRDNER

SEQ ID NO: 8656 - protein, 31 aa, Artificial Sequence
  Description of Artificial Sequence: Synthetic polypeptide
DEEEIRTTNPVATEQYGSYVSTTLQREVVNR

SEQ ID NO: 8657 - protein, 30 aa, Artificial Sequence
  Description of Artificial Sequence: Synthetic polypeptide
DEEEIRTTNPVATEQYGSVNTNLQPDQGND

SEQ ID NO: 8658 - protein, 29 aa, Artificial Sequence
  Description of Artificial Sequence: Synthetic peptide
DEEEIRTTNPVATEQYGSVNTNLQNIGEP

SEQ ID NO: 8659 - protein, 30 aa, Artificial Sequence
  Description of Artificial Sequence: Synthetic polypeptide
DEEEIRTTNPVATEQYGSWSCPNILQRDNR

SEQ ID NO: 8660 - protein, 30 aa, Artificial Sequence
  Description of Artificial Sequence: Synthetic polypeptide
DEEEIRTTNPVATEQYGTTISDNELQRGNR

SEQ ID NO: 8661 - protein, 29 aa, Artificial Sequence
  Description of Artificial Sequence: Synthetic peptide
DEEEIACTNPVATEQYGSVSENLMRGNDR

SEQ ID NO: 8662 - protein, 30 aa, Artificial Sequence
  Description of Artificial Sequence: Synthetic polypeptide
DEEEIRTTNPVATEQYGSWSENNMLQRENR

SEQ ID NO: 8663 - protein, 31 aa, Artificial Sequence
  Description of Artificial Sequence: Synthetic polypeptide
DEEEIRTTNPVATEQYGTTASTNHLQRGGNR

SEQ ID NO: 8664 - protein, 30 aa, Artificial Sequence
  Description of Artificial Sequence: Synthetic polypeptide
DEEEIRTTNPVATEQYGTSVSTNLARGSEQ

SEQ ID NO: 8665 - protein, 32 aa, Artificial Sequence
  Description of Artificial Sequence: Synthetic polypeptide
DEEEIRTTNPVATEQYGTSVCSTNWLQRGNDS

SEQ ID NO: 8666 - protein, 32 aa, Artificial Sequence
  Description of Artificial Sequence: Synthetic polypeptide
DEEEIRTTNPVATEQYGTSVCSTNPLQRGNAP

SEQ ID NO: 8667 - protein, 29 aa, Artificial Sequence
  Description of Artificial Sequence: Synthetic peptide
DEEEIRTTNPVATEQYGSVNTMLQRGLQT

SEQ ID NO: 8668 - protein, 30 aa, Artificial Sequence
  Description of Artificial Sequence: Synthetic polypeptide
DEEEIRTTNPVATEQYGSWSLMNTLQRDNR

SEQ ID NO: 8669 - protein, 30 aa, Artificial Sequence
  Description of Artificial Sequence: Synthetic polypeptide
DEEEIRTTNPVATEQYGSVPFTNLSQHGNK

SEQ ID NO: 8670 - protein, 30 aa, Artificial Sequence
  Description of Artificial Sequence: Synthetic polypeptide
DEEEIRTTNPVATEQYGSVNTNDQRENYRE

SEQ ID NO: 8671 - protein, 30 aa, Artificial Sequence
  Description of Artificial Sequence: Synthetic polypeptide
DEEEIRTTNPVATEQYGSVNTNENRSGNRF

SEQ ID NO: 8672 - protein, 28 aa, Artificial Sequence
  Description of Artificial Sequence: Synthetic peptide
DEEEIRTTNPVATEQYGSVNTNHQLSER

SEQ ID NO: 8673 - protein, 29 aa, Artificial Sequence
  Description of Artificial Sequence: Synthetic peptide
DEEEIRTTNPVATEQYGSVNTNHSQRVNH

SEQ ID NO: 8674 - protein, 28 aa, Artificial Sequence
  Description of Artificial Sequence: Synthetic peptide
DEEEIRTTNPVATEQYGSVNTNLAGGEE

SEQ ID NO: 8675 - protein, 29 aa, Artificial Sequence
  Description of Artificial Sequence: Synthetic peptide
DEEEIRTTNPVATEQYGSVNTNLDNRENE

SEQ ID NO: 8676 - protein, 30 aa, Artificial Sequence
  Description of Artificial Sequence: Synthetic polypeptide
DEEEIRTTNPVATEQYGSVNTNLDQGGNQI

SEQ ID NO: 8677 - protein, 29 aa, Artificial Sequence
  Description of Artificial Sequence: Synthetic peptide
DEEEIRTTNPVATEQYGSVNTNLEQLQER

SEQ ID NO: 8678 - protein, 29 aa, Artificial Sequence
  Description of Artificial Sequence: Synthetic peptide
DEEEIRTTNPVATEQYGSVNTNLGLGERN

SEQ ID NO: 8679 - protein, 30 aa, Artificial Sequence
  Description of Artificial Sequence: Synthetic polypeptide
DEEEIRTTNPVATEQYGSWSNMNMLQRDNR

SEQ ID NO: 8680 - protein, 31 aa, Artificial Sequence
  Description of Artificial Sequence: Synthetic polypeptide
DEEEIRTTNPVATEQYGSVPATNLQDRGDRE

SEQ ID NO: 8681 - protein, 30 aa, Artificial Sequence
  Description of Artificial Sequence: Synthetic polypeptide
DEEEIRTTNPVATEQYGSWSSPNDLQRDNR

SEQ ID NO: 8682 - protein, 31 aa, Artificial Sequence
  Description of Artificial Sequence: Synthetic polypeptide
DEEEIRTTNPVATEQYGSVNTNLPQRGNQFD

SEQ ID NO: 8683 - protein, 29 aa, Artificial Sequence
  Description of Artificial Sequence: Synthetic peptide
DEEEIRTTNPVATEQYGSVNTNLQAGEDP

SEQ ID NO: 8684 - protein, 29 aa, Artificial Sequence
  Description of Artificial Sequence: Synthetic peptide
DEEEIRTTNPVATEQYGSVNTNLQDGEMP

SEQ ID NO: 8685 - protein, 30 aa, Artificial Sequence
  Description of Artificial Sequence: Synthetic polypeptide
DEEEIRTTNPVATEQYGSVNTNLQFTGNNE

SEQ ID NO: 8686 - protein, 29 aa, Artificial Sequence
  Description of Artificial Sequence: Synthetic peptide
DEEEIRTTNPVATEQYGSVNTNLQGPHDR

SEQ ID NO: 8687 - protein, 30 aa, Artificial Sequence
  Description of Artificial Sequence: Synthetic polypeptide
DEEEIRTTNPVATEQYGSVNTNLQMGGDDR

SEQ ID NO: 8688 - protein, 29 aa, Artificial Sequence
  Description of Artificial Sequence: Synthetic peptide
DEEEIRTTNPVATEQYGSVNSTNTQEGDP

SEQ ID NO: 8689 - protein, 31 aa, Artificial Sequence
  Description of Artificial Sequence: Synthetic polypeptide
DEEEIRTTNPVATEQYGSVYSTNCQQGGGNR

SEQ ID NO: 8690 - protein, 31 aa, Artificial Sequence
  Description of Artificial Sequence: Synthetic polypeptide
DEEEIRTTNPVATEQYGSVNSTNTIQTHGNR

SEQ ID NO: 8691 - protein, 31 aa, Artificial Sequence
  Description of Artificial Sequence: Synthetic polypeptide
DEEEIRTTNPVATEQYGSVNSTNQQDRGPQR

SEQ ID NO: 8692 - protein, 31 aa, Artificial Sequence
  Description of Artificial Sequence: Synthetic polypeptide
DEEEIRTTNPVATEQYGSVYSTTNDLQNDNR

SEQ ID NO: 8693 - protein, 30 aa, Artificial Sequence
  Description of Artificial Sequence: Synthetic polypeptide
DEAEIATTNPVATEQYGSVSTNLDQQGNER

SEQ ID NO: 8694 - protein, 28 aa, Artificial Sequence
  Description of Artificial Sequence: Synthetic peptide
DEAEIATTNPVATEQYGSVSTNLQDGDI

SEQ ID NO: 8695 - protein, 31 aa, Artificial Sequence
  Description of Artificial Sequence: Synthetic polypeptide
DEEEIRTTNPVATEQYGSVYSYELQRGGNRN

SEQ ID NO: 8696 - protein, 31 aa, Artificial Sequence
  Description of Artificial Sequence: Synthetic polypeptide
DEEEIRTTNPVATEQYGSVYSYNCIQRDGNR

SEQ ID NO: 8697 - protein, 29 aa, Artificial Sequence
  Description of Artificial Sequence: Synthetic peptide
DEEEIRTTNPVATEQYGSVYTDEQSGNFR

SEQ ID NO: 8698 - protein, 31 aa, Artificial Sequence
  Description of Artificial Sequence: Synthetic polypeptide
DEEEIRTTNPVATEQYGSVNSTNDEQEGNNR

SEQ ID NO: 8699 - protein, 31 aa, Artificial Sequence
  Description of Artificial Sequence: Synthetic polypeptide
DEEEIRTTNPVATEQYGSVYTDNDLQRGNSD

SEQ ID NO: 8700 - protein, 30 aa, Artificial Sequence
  Description of Artificial Sequence: Synthetic polypeptide
DEEEIRTTNPVATEQYGSVYTENLQRPLNL

SEQ ID NO: 8701 - protein, 29 aa, Artificial Sequence
  Description of Artificial Sequence: Synthetic peptide
DEAEIATTNPVATEQYGSVSTNLQRANHQ

SEQ ID NO: 8702 - protein, 30 aa, Artificial Sequence
  Description of Artificial Sequence: Synthetic polypeptide
DEAEIATTNPVATEQYGSVSTNLQREENRI

SEQ ID NO: 8703 - protein, 29 aa, Artificial Sequence
  Description of Artificial Sequence: Synthetic peptide
DEAEIATTNPVATEQYGSVSTNLQRENHE

SEQ ID NO: 8704 - protein, 29 aa, Artificial Sequence
  Description of Artificial Sequence: Synthetic peptide
DEAEIATTNPVATEQYGSVSTNLQRENQM

SEQ ID NO: 8705 - protein, 31 aa, Artificial Sequence
  Description of Artificial Sequence: Synthetic polypeptide
DEEEIRTTNPVATEQYGVVSITNLNRGMNQR

SEQ ID NO: 8706 - protein, 30 aa, Artificial Sequence
  Description of Artificial Sequence: Synthetic polypeptide
DEAEIATTNPVATEQYGSVSTNLQRGENME

SEQ ID NO: 8707 - protein, 29 aa, Artificial Sequence
  Description of Artificial Sequence: Synthetic peptide
DEAEIATTNPVATEQYGSVSTNLQRQNMD

SEQ ID NO: 8708 - protein, 28 aa, Artificial Sequence
  Description of Artificial Sequence: Synthetic peptide
DEAEIATTNPVATEQYGSVSTNLQVGDV

SEQ ID NO: 8709 - protein, 28 aa, Artificial Sequence
  Description of Artificial Sequence: Synthetic peptide
DEAEIATTNPVATEQYGSVSTNLQVGMQ

SEQ ID NO: 8710 - protein, 32 aa, Artificial Sequence
  Description of Artificial Sequence: Synthetic polypeptide
DEEEIRTTNPVATEQYGSVPSENLQRTGGNTR

SEQ ID NO: 8711 - protein, 29 aa, Artificial Sequence
  Description of Artificial Sequence: Synthetic peptide
DEAEIATTNPVATEQYGSVSTNPQDTGNR

SEQ ID NO: 8712 - protein, 31 aa, Artificial Sequence
  Description of Artificial Sequence: Synthetic polypeptide
DEEEIRTTNPVATEQYGSVNSTNDQFGNDNR

SEQ ID NO: 8713 - protein, 31 aa, Artificial Sequence
  Description of Artificial Sequence: Synthetic polypeptide
DEEEIRTTNPVATEQYGVVSFTNLNRGMNNR

SEQ ID NO: 8714 - protein, 31 aa, Artificial Sequence
  Description of Artificial Sequence: Synthetic polypeptide
DEEEIRTTNPVATEQYGSVYTNDIQRDGDNR

SEQ ID NO: 8715 - protein, 31 aa, Artificial Sequence
  Description of Artificial Sequence: Synthetic polypeptide
DEEEIRTTNPVATEQYGSVNSTNDQRGGNDN

SEQ ID NO: 8716 - protein, 31 aa, Artificial Sequence
  Description of Artificial Sequence: Synthetic polypeptide
DEEEIRTTNPVATEQYGSVNSTNDQRGQNDD

SEQ ID NO: 8717 - protein, 30 aa, Artificial Sequence
  Description of Artificial Sequence: Synthetic polypeptide
DEEEIRTTNPVATEQYGVVSDNLPQDRGNQ

SEQ ID NO: 8718 - protein, 30 aa, Artificial Sequence
  Description of Artificial Sequence: Synthetic polypeptide
DEEEIRTTNPVATEQYGSVYTNDLQVGSRM

SEQ ID NO: 8719 - protein, 29 aa, Artificial Sequence
  Description of Artificial Sequence: Synthetic peptide
DEEEIRTTNPVATEQYGSVYTNDQRGDGK

SEQ ID NO: 8720 - protein, 29 aa, Artificial Sequence
  Description of Artificial Sequence: Synthetic peptide
DEAEIATTNPVATEQYGSVSTNLQRPNEE

SEQ ID NO: 8721 - protein, 31 aa, Artificial Sequence
  Description of Artificial Sequence: Synthetic polypeptide
DEEEIRTTNPVATEQYGVVSCNLSQRVGNNR

SEQ ID NO: 8722 - protein, 31 aa, Artificial Sequence
  Description of Artificial Sequence: Synthetic polypeptide
DEEEIRTTNPVATEQYGVVSLGTNLNRGMNR

SEQ ID NO: 8723 - protein, 30 aa, Artificial Sequence
  Description of Artificial Sequence: Synthetic polypeptide
DEEEIRTTNPVATEQYGSVYSTNPQRMENM

SEQ ID NO: 8724 - protein, 31 aa, Artificial Sequence
  Description of Artificial Sequence: Synthetic polypeptide
DEEEIRTTNPVATEQYGSVYSTNDIQGIGNR

SEQ ID NO: 8725 - protein, 31 aa, Artificial Sequence
  Description of Artificial Sequence: Synthetic polypeptide
DEEEIRTTNPVATEQYGSVYSTNDIQGYGNR

SEQ ID NO: 8726 - protein, 31 aa, Artificial Sequence
  Description of Artificial Sequence: Synthetic polypeptide
DEEEIRTTNPVATEQYGSVYSTNDIQKGDNR

SEQ ID NO: 8727 - protein, 30 aa, Artificial Sequence
  Description of Artificial Sequence: Synthetic polypeptide
DEEEIRTTNPVATEQYGVVSTELQYGGSNR

SEQ ID NO: 8728 - protein, 31 aa, Artificial Sequence
  Description of Artificial Sequence: Synthetic polypeptide
DEEEIRTTNPVATEQYGSVYSTNDNQESGNR

SEQ ID NO: 8729 - protein, 30 aa, Artificial Sequence
  Description of Artificial Sequence: Synthetic polypeptide
DEEEIRTTNPVATEQYGVVSTELQAFGNRV

SEQ ID NO: 8730 - protein, 31 aa, Artificial Sequence
  Description of Artificial Sequence: Synthetic polypeptide
DEEEIRTTNPVATEQYGSVYSTNDPQRGNQS

SEQ ID NO: 8731 - protein, 31 aa, Artificial Sequence
  Description of Artificial Sequence: Synthetic polypeptide
DEEEIRTTNPVATEQYGSVYSTNEHQQEGNR

SEQ ID NO: 8732 - protein, 31 aa, Artificial Sequence
  Description of Artificial Sequence: Synthetic polypeptide
DEEEIRTTNPVATEQYGSVYSTNEIQVEGNR

SEQ ID NO: 8733 - protein, 30 aa, Artificial Sequence
  Description of Artificial Sequence: Synthetic polypeptide
DEEEIRTTNPVATEQYGSVNSTNAQTGNDE

SEQ ID NO: 8734 - protein, 31 aa, Artificial Sequence
  Description of Artificial Sequence: Synthetic polypeptide
DEEEIRTTNPVATEQYGSVYSTNIIQKEGNR

SEQ ID NO: 8735 - protein, 29 aa, Artificial Sequence
  Description of Artificial Sequence: Synthetic peptide
DEEEIRTTNPVATEQYGSVPSNLQRGEEL

SEQ ID NO: 8736 - protein, 30 aa, Artificial Sequence
  Description of Artificial Sequence: Synthetic polypeptide
DEEEIRTTNPVATEQYGSVYSTNLERFNEY

SEQ ID NO: 8737 - protein, 31 aa, Artificial Sequence
  Description of Artificial Sequence: Synthetic polypeptide
DEEEIRTTNPVATEQYGSVYSTNQIQFNGNR

SEQ ID NO: 8738 - protein, 30 aa, Artificial Sequence
  Description of Artificial Sequence: Synthetic polypeptide
DEEEIRTTNPVATEQYGVVSSVNLNRGDNR

SEQ ID NO: 8739 - protein, 28 aa, Artificial Sequence
  Description of Artificial Sequence: Synthetic peptide
DEEEIRTTNPVATEQYGSVPSNLERGLQ

SEQ ID NO: 8740 - protein, 31 aa, Artificial Sequence
  Description of Artificial Sequence: Synthetic polypeptide
DEEEIRTTNPVATEQYGSVYSTNMIQMIGNR

SEQ ID NO: 8741 - protein, 28 aa, Artificial Sequence
  Description of Artificial Sequence: Synthetic peptide
DEEEIASVNPVATEQYGSVSTNLQSGNQ

SEQ ID NO: 8742 - protein, 31 aa, Artificial Sequence
  Description of Artificial Sequence: Synthetic polypeptide
DEEEIRTTNPVATEQYGSVYSTNNIQKGGNR

SEQ ID NO: 8743 - protein, 30 aa, Artificial Sequence
  Description of Artificial Sequence: Synthetic polypeptide
DEEEIRTTNPVATEQYGVVSSTNLNRGSNM

SEQ ID NO: 8744 - protein, 29 aa, Artificial Sequence
  Description of Artificial Sequence: Synthetic peptide
DEEEIRTTNPVATEQYGVVSSTNDQGGNG

SEQ ID NO: 8745 - protein, 31 aa, Artificial Sequence
  Description of Artificial Sequence: Synthetic polypeptide
DEEEIRTTNPVATEQYGSVYSTNNQQSIGNR

SEQ ID NO: 8746 - protein, 31 aa, Artificial Sequence
  Description of Artificial Sequence: Synthetic polypeptide
DEEEIRTTNPVATEQYGSVYSTNPEQTGGNR

SEQ ID NO: 8747 - protein, 31 aa, Artificial Sequence
  Description of Artificial Sequence: Synthetic polypeptide
DEEEIRTTNPVATEQYGSVYSTNPIQKVGNR

SEQ ID NO: 8748 - protein, 28 aa, Artificial Sequence
  Description of Artificial Sequence: Synthetic peptide
DEAEIGTTNPVATEQYGSVSTNLNYGNT

SEQ ID NO: 8749 - protein, 30 aa, Artificial Sequence
  Description of Artificial Sequence: Synthetic polypeptide
DEEEIRTTNPVATEQYGVVSNTNLNGGENR

SEQ ID NO: 8750 - protein, 31 aa, Artificial Sequence
  Description of Artificial Sequence: Synthetic polypeptide
DEEEIRTTNPVATEQYGSVYSTNPPQENGNR

SEQ ID NO: 8751 - protein, 31 aa, Artificial Sequence
  Description of Artificial Sequence: Synthetic polypeptide
DEEEIRTTNPVATEQYGSVYSTNPQNGNGRL

SEQ ID NO: 8752 - protein, 30 aa, Artificial Sequence
  Description of Artificial Sequence: Synthetic polypeptide
DEEEIRTTNPVATEQYGSVYSTNLQTLNLP

SEQ ID NO: 8753 - protein, 29 aa, Artificial Sequence
  Description of Artificial Sequence: Synthetic peptide
DEEEIRTTNPVATEQYGSVYTNDQRGKSS

SEQ ID NO: 8754 - protein, 30 aa, Artificial Sequence
  Description of Artificial Sequence: Synthetic polypeptide
DEEEIRTTNPVATEQYGSVYTNEQRAGLER

SEQ ID NO: 8755 - protein, 30 aa, Artificial Sequence
  Description of Artificial Sequence: Synthetic polypeptide
DEEEIRTTNPVATEQYGVVGSTNLQQGNLF

SEQ ID NO: 8756 - protein, 30 aa, Artificial Sequence
  Description of Artificial Sequence: Synthetic polypeptide
DEEEIRTTNPVATEQYGSVNSTNLQNNDER

SEQ ID NO: 8757 - protein, 30 aa, Artificial Sequence
  Description of Artificial Sequence: Synthetic polypeptide
DEEEIRTTNPVATEQYGSVYTNLQRGLQIQ

SEQ ID NO: 8758 - protein, 30 aa, Artificial Sequence
  Description of Artificial Sequence: Synthetic polypeptide
DEEEIRTTNPVATEQYGVTISTVELQRGNR

SEQ ID NO: 8759 - protein, 30 aa, Artificial Sequence
  Description of Artificial Sequence: Synthetic polypeptide
DEEEIRTTNPVATEQYGVTISTNELQRGNS

SEQ ID NO: 8760 - protein, 31 aa, Artificial Sequence
  Description of Artificial Sequence: Synthetic polypeptide
DEEEIRTTNPVATEQYGVTISDTNELQRGNR

SEQ ID NO: 8761 - protein, 31 aa, Artificial Sequence
  Description of Artificial Sequence: Synthetic polypeptide
DEEEIRTTNPVATEQYGSVYTNLQRGQLLRG

SEQ ID NO: 8762 - protein, 30 aa, Artificial Sequence
  Description of Artificial Sequence: Synthetic polypeptide
DEEEIRTTNPVATEQYGVSVSTNPQYLGNA

SEQ ID NO: 8763 - protein, 30 aa, Artificial Sequence
  Description of Artificial Sequence: Synthetic polypeptide
DEEEIRTTNPVATEQYGVSVSTNHQPFGNA

SEQ ID NO: 8764 - protein, 30 aa, Artificial Sequence
  Description of Artificial Sequence: Synthetic polypeptide
DEEEIRTTNPVATEQYGSVNSTNLQNNSER

SEQ ID NO: 8765 - protein, 30 aa, Artificial Sequence
  Description of Artificial Sequence: Synthetic polypeptide
DEEEIRTTNPVATEQYGSVNSTNLQPEGVT

SEQ ID NO: 8766 - protein, 30 aa, Artificial Sequence
  Description of Artificial Sequence: Synthetic polypeptide
DEEEIRTTNPVATEQYGSVYTNLQRSLNDE

SEQ ID NO: 8767 - protein, 30 aa, Artificial Sequence
  Description of Artificial Sequence: Synthetic polypeptide
DEEEIRTTNPVATEQYGSVNSTNLQQGFED

SEQ ID NO: 8768 - protein, 31 aa, Artificial Sequence
  Description of Artificial Sequence: Synthetic polypeptide
DEEEIRTTNPVATEQYGSVNSTNLQQGMNGD

SEQ ID NO: 8769 - protein, 30 aa, Artificial Sequence
  Description of Artificial Sequence: Synthetic polypeptide
DEEEIRTTNPVATEQYGSVYTNLQRGEAVD

SEQ ID NO: 8770 - protein, 31 aa, Artificial Sequence
  Description of Artificial Sequence: Synthetic polypeptide
DEEEIRTTNPVATEQYGSVNSTNLQRGDEMD

SEQ ID NO: 8771 - protein, 31 aa, Artificial Sequence
  Description of Artificial Sequence: Synthetic polypeptide
DEEEIRTTNPVATEQYGSVNSTNLQRGQELQ

SEQ ID NO: 8772 - protein, 31 aa, Artificial Sequence
  Description of Artificial Sequence: Synthetic polypeptide
DEEEIRTTNPVATEQYGSVNSTNLQRGVELD

SEQ ID NO: 8773 - protein, 32 aa, Artificial Sequence
  Description of Artificial Sequence: Synthetic polypeptide
DEEEIRTTNPVATEQYGSVPSCTNLGRGGDNR

SEQ ID NO: 8774 - protein, 30 aa, Artificial Sequence
  Description of Artificial Sequence: Synthetic polypeptide
DEEEIRTTNPVATEQYGSVNSTNLQTFGDD

SEQ ID NO: 8775 - protein, 29 aa, Artificial Sequence
  Description of Artificial Sequence: Synthetic peptide
DEEEIRTTNPVATEQYGSVYTNLQTVNLD

SEQ ID NO: 8776 - protein, 31 aa, Artificial Sequence
  Description of Artificial Sequence: Synthetic polypeptide
DEEEIRTTNPVATEQYGSVNSTNLTRGENVV

SEQ ID NO: 8777 - protein, 31 aa, Artificial Sequence
  Description of Artificial Sequence: Synthetic polypeptide
DEEEIRTTNPVATEQYGSVNSTNLVRGDNTS

SEQ ID NO: 8778 - protein, 29 aa, Artificial Sequence
  Description of Artificial Sequence: Synthetic peptide
DEAEICTTNPVATEQYGSVSTNLQRMNDL

SEQ ID NO: 8779 - protein, 31 aa, Artificial Sequence
  Description of Artificial Sequence: Synthetic polypeptide
DEEEIRTTNPVATEQYGTVYSTNLQFSGNRM

SEQ ID NO: 8780 - protein, 30 aa, Artificial Sequence
  Description of Artificial Sequence: Synthetic polypeptide
DEEEIRTTNPVATEQYGSVYTNLQVVEGNF

SEQ ID NO: 8781 - protein, 31 aa, Artificial Sequence
  Description of Artificial Sequence: Synthetic polypeptide
DEEEIRTTNPVATEQYGSVNSTNPQREGNDD

SEQ ID NO: 8782 - protein, 31 aa, Artificial Sequence
  Description of Artificial Sequence: Synthetic polypeptide
DEEEIRTTNPVATEQYGSVNSTNPQRSGNYF

SEQ ID NO: 8783 - protein, 32 aa, Artificial Sequence
  Description of Artificial Sequence: Synthetic polypeptide
DEEEIRTTNPVATEQYGSVPSCTNELQRGNVS

SEQ ID NO: 8784 - protein, 30 aa, Artificial Sequence
  Description of Artificial Sequence: Synthetic polypeptide
DEEEIRTTNPVATEQYGSVYTNLQRTLNDG

SEQ ID NO: 8785 - protein, 30 aa, Artificial Sequence
  Description of Artificial Sequence: Synthetic polypeptide
DEEEIRTTNPVATEQYGSVNSTNLQNFGEA

SEQ ID NO: 8786 - protein, 31 aa, Artificial Sequence
  Description of Artificial Sequence: Synthetic polypeptide
DEEEIRTTNPVATEQYGSVNSTNLQMNGNIM

SEQ ID NO: 8787 - protein, 30 aa, Artificial Sequence
  Description of Artificial Sequence: Synthetic polypeptide
DEEEIRTTNPVATEQYGSVYTNLQRELNPG

SEQ ID NO: 8788 - protein, 30 aa, Artificial Sequence
  Description of Artificial Sequence: Synthetic polypeptide
DEEEIRTTNPVATEQYGVVGSTNLQQGNGA

SEQ ID NO: 8789 - protein, 31 aa, Artificial Sequence
  Description of Artificial Sequence: Synthetic polypeptide
DEEEIRTTNPVATEQYGVVDSTPNLQYGNRI

SEQ ID NO: 8790 - protein, 30 aa, Artificial Sequence
  Description of Artificial Sequence: Synthetic polypeptide
DEEEIRTTNPVATEQYGSVYTNLDIGNERF

SEQ ID NO: 8791 - protein, 28 aa, Artificial Sequence
  Description of Artificial Sequence: Synthetic peptide
DEAEIATTNPVATEQYGTVSTNLQNGDR

SEQ ID NO: 8792 - protein, 32 aa, Artificial Sequence
  Description of Artificial Sequence: Synthetic polypeptide
DEEEIRTTNPVATEQYGSVYTNLDQRIGENRD

SEQ ID NO: 8793 - protein, 29 aa, Artificial Sequence
  Description of Artificial Sequence: Synthetic peptide
DEEEIRTTNPVATEQYGSVYTNLEGDMNR

SEQ ID NO: 8794 - protein, 29 aa, Artificial Sequence
  Description of Artificial Sequence: Synthetic peptide
DEAEIATTNPVATEQYGWVSTNLQRGNVE

SEQ ID NO: 8795 - protein, 29 aa, Artificial Sequence
  Description of Artificial Sequence: Synthetic peptide
DEEEIRTTNPVATEQYGSVYTNLEGGSNA

SEQ ID NO: 8796 - protein, 30 aa, Artificial Sequence
  Description of Artificial Sequence: Synthetic polypeptide
DEEEIRTTNPVATEQYGSVNSTNEQRVEER

SEQ ID NO: 8797 - protein, 29 aa, Artificial Sequence
  Description of Artificial Sequence: Synthetic peptide
DEEEIRTTNPVATEQYGSVYTNLIRNNEQ

SEQ ID NO: 8798 - protein, 28 aa, Artificial Sequence
  Description of Artificial Sequence: Synthetic peptide
DEEEIRTTNPVATEQYGSVYTNLIRTEN

SEQ ID NO: 8799 - protein, 29 aa, Artificial Sequence
  Description of Artificial Sequence: Synthetic peptide
DEEEIRTTNPVATEQYGVVCSTNLQRFEQ

SEQ ID NO: 8800 - protein, 30 aa, Artificial Sequence
  Description of Artificial Sequence: Synthetic polypeptide
DEEEIRTTNPVATEQYGSVYTNLNQLGNVE

SEQ ID NO: 8801 - protein, 31 aa, Artificial Sequence
  Description of Artificial Sequence: Synthetic polypeptide
DEEEIRTTNPVATEQYGSVYTNLNQRGNVMV

SEQ ID NO: 8802 - protein, 30 aa, Artificial Sequence
  Description of Artificial Sequence: Synthetic polypeptide
DEEEIRTTNPVATEQYGSVNSTNHQRLNIG

SEQ ID NO: 8803 - protein, 29 aa, Artificial Sequence
  Description of Artificial Sequence: Synthetic peptide
DEEEIRTTNPVATEQYGSVYTNLQIENNE

SEQ ID NO: 8804 - protein, 30 aa, Artificial Sequence
  Description of Artificial Sequence: Synthetic polypeptide
DEEEIRTTNPVATEQYGVVCSTNDPQRGNI

SEQ ID NO: 8805 - protein, 29 aa, Artificial Sequence
  Description of Artificial Sequence: Synthetic peptide
DEEEIRTTNPVATEQYGSVNSTNIQGGDE

SEQ ID NO: 8806 - protein, 29 aa, Artificial Sequence
  Description of Artificial Sequence: Synthetic peptide
DEEEIRTTNPVATEQYGSVYTNLQIVNLE

SEQ ID NO: 8807 - protein, 31 aa, Artificial Sequence
  Description of Artificial Sequence: Synthetic polypeptide
DEEEIRTTNPVATEQYGSVPSCTNSQRGNNN

SEQ ID NO: 8808 - protein, 31 aa, Artificial Sequence
  Description of Artificial Sequence: Synthetic polypeptide
DEEEIRTTNPVATEQYGSVPSCTNQQRGNNY

SEQ ID NO: 8809 - protein, 30 aa, Artificial Sequence
  Description of Artificial Sequence: Synthetic polypeptide
DEEEIRTTNPVATEQYGSVYTNLQLTGLRE

SEQ ID NO: 8810 - protein, 32 aa, Artificial Sequence
  Description of Artificial Sequence: Synthetic polypeptide
DEEEIRTTNPVATEQYGSVNSTNLDQRGNNSL

SEQ ID NO: 8811 - protein, 30 aa, Artificial Sequence
  Description of Artificial Sequence: Synthetic polypeptide
DEEEIRTTNPVATEQYGSVYTNLQQEGLRD

SEQ ID NO: 8812 - protein, 29 aa, Artificial Sequence
  Description of Artificial Sequence: Synthetic peptide
DEEEIASTNPVATEQYGSVATNLQRGDRQ

SEQ ID NO: 8813 - protein, 30 aa, Artificial Sequence
  Description of Artificial Sequence: Synthetic polypeptide
DEEEIRTTNPVATEQYGSVNSTNLGDGINM

SEQ ID NO: 8814 - protein, 31 aa, Artificial Sequence
  Description of Artificial Sequence: Synthetic polypeptide
DEEEIRTTNPVATEQYGSVNSTNLLQIGNGD

SEQ ID NO: 8815 - protein, 32 aa, Artificial Sequence
  Description of Artificial Sequence: Synthetic polypeptide
DEEEIRTTNPVATEQYGSVNSTNLLQRQNERL

SEQ ID NO: 8816 - protein, 30 aa, Artificial Sequence
  Description of Artificial Sequence: Synthetic polypeptide
DEEEIRTTNPVATEQYGSVYTNLQRELNLG

SEQ ID NO: 8817 - protein, 32 aa, Artificial Sequence
  Description of Artificial Sequence: Synthetic polypeptide
DEEEIRTTNPVATEQYGSVNSTNSLDRGENRQ

SEQ ID NO: 8818 - protein, 29 aa, Artificial Sequence
  Description of Artificial Sequence: Synthetic peptide
DEEEIRTTNPVATEYYGSVSTNDTRGSND

SEQ ID NO: 8819 - protein, 30 aa, Artificial Sequence
  Description of Artificial Sequence: Synthetic polypeptide
DEEEIRTTNPVATEYYGSVSTNLQGDGNNQ

SEQ ID NO: 8820 - protein, 30 aa, Artificial Sequence
  Description of Artificial Sequence: Synthetic polypeptide
DEEEIRTTNPVATEYYGSVSTNLQGGNGDN

SEQ ID NO: 8821 - protein, 30 aa, Artificial Sequence
  Description of Artificial Sequence: Synthetic polypeptide
DEEEIRTTNPVAYEQYGSVSTSNDQQGNQR

SEQ ID NO: 8822 - protein, 31 aa, Artificial Sequence
  Description of Artificial Sequence: Synthetic polypeptide
DEEEIRTTNPVAYEQYGSVSTQNLSIRGTNR

SEQ ID NO: 8823 - protein, 31 aa, Artificial Sequence
  Description of Artificial Sequence: Synthetic polypeptide
DEEEIRTTNPVATEQYGSVQTDNLQRGVNEM

SEQ ID NO: 8824 - protein, 29 aa, Artificial Sequence
  Description of Artificial Sequence: Synthetic peptide
DEEEIRTTNPVAYEQYGSVSTNPQNFGND

SEQ ID NO: 8825 - protein, 29 aa, Artificial Sequence
  Description of Artificial Sequence: Synthetic peptide
DEEEIRTTNPVATEQYGSVQTDLQRGIDM

SEQ ID NO: 8826 - protein, 29 aa, Artificial Sequence
  Description of Artificial Sequence: Synthetic peptide
DEEEIRTTNPVATEQYGSVQTDLQRFDRF

SEQ ID NO: 8827 - protein, 31 aa, Artificial Sequence
  Description of Artificial Sequence: Synthetic polypeptide
DEEEIRTTNPVAYEQYGSVSTNMLSQNRGPR

SEQ ID NO: 8828 - protein, 31 aa, Artificial Sequence
  Description of Artificial Sequence: Synthetic polypeptide
DEEEIRTTNPVAYEQYGSVSTNLSQRVGNEA

SEQ ID NO: 8829 - protein, 32 aa, Artificial Sequence
  Description of Artificial Sequence: Synthetic polypeptide
DEEEIRTTNPVAYEQYGSVSTNLSQERTGNDR

SEQ ID NO: 8830 - protein, 31 aa, Artificial Sequence
  Description of Artificial Sequence: Synthetic polypeptide
DEEEIRTTNPVAYEQYGSVSTNEWQRGGNRP

SEQ ID NO: 8831 - protein, 31 aa, Artificial Sequence
  Description of Artificial Sequence: Synthetic polypeptide
DEEEIRTTNPVAYEQYGSVSTNEDQRGGNRT

SEQ ID NO: 8832 - protein, 29 aa, Artificial Sequence
  Description of Artificial Sequence: Synthetic peptide
DEAEIRTTNPVATEQYGCVETVNLQFGNR

SEQ ID NO: 8833 - protein, 29 aa, Artificial Sequence
  Description of Artificial Sequence: Synthetic peptide
DEEEIRTTNPVAYEQYGSVSTNDQSGNAD

SEQ ID NO: 8834 - protein, 30 aa, Artificial Sequence
  Description of Artificial Sequence: Synthetic polypeptide
DEEEIRTTNPVAYEQYGSVSVTNVQTTGNR

SEQ ID NO: 8835 - protein, 29 aa, Artificial Sequence
  Description of Artificial Sequence: Synthetic peptide
DEEEIRTTNPVAYEQYGSVSTNDQPGNDS

SEQ ID NO: 8836 - protein, 30 aa, Artificial Sequence
  Description of Artificial Sequence: Synthetic polypeptide
DEEEIRTTNPVAYEQYGSVSTLNDQEGNHR

SEQ ID NO: 8837 - protein, 31 aa, Artificial Sequence
  Description of Artificial Sequence: Synthetic polypeptide
DEEEIRTTNPVAYEQYGSVSTINSLQRGGPR

SEQ ID NO: 8838 - protein, 30 aa, Artificial Sequence
  Description of Artificial Sequence: Synthetic polypeptide
DEEEIRTTNPVAYEQYGSVSTIALPQHGNR

SEQ ID NO: 8839 - protein, 31 aa, Artificial Sequence
  Description of Artificial Sequence: Synthetic polypeptide
DEEEIRTTNPVAYEQYGSVSTGNMLQRGGTR

SEQ ID NO: 8840 - protein, 32 aa, Artificial Sequence
  Description of Artificial Sequence: Synthetic polypeptide
DEEEIRTTNPVAYEQYGSVSTGNLQRTSGNTR

SEQ ID NO: 8841 - protein, 32 aa, Artificial Sequence
  Description of Artificial Sequence: Synthetic polypeptide
DEEEIRTTNPVAYEQYGSVSTGNLQRPVGNRW

SEQ ID NO: 8842 - protein, 29 aa, Artificial Sequence
  Description of Artificial Sequence: Synthetic peptide
DEEEIRTTNPVATEQYGSVHTNLEGENFR

SEQ ID NO: 8843 - protein, 32 aa, Artificial Sequence
  Description of Artificial Sequence: Synthetic polypeptide
DEEEIRTTNPVAYEQYGSVSSTNELSQRGNRL

SEQ ID NO: 8844 - protein, 30 aa, Artificial Sequence
  Description of Artificial Sequence: Synthetic polypeptide
DEEEIRTTNPVATEQYGSVTSTMNLTNGNL

SEQ ID NO: 8845 - protein, 31 aa, Artificial Sequence
  Description of Artificial Sequence: Synthetic polypeptide
DEEEIRTTNPVAYEQYGSVSMTELQRGSENR

SEQ ID NO: 8846 - protein, 29 aa, Artificial Sequence
  Description of Artificial Sequence: Synthetic peptide
DEEEIRTTNPVAYEQYGSVSLNHSQRENR

SEQ ID NO: 8847 - protein, 29 aa, Artificial Sequence
  Description of Artificial Sequence: Synthetic peptide
DEEEIRTTNPVATEQYGSVHTNLQDDILR

SEQ ID NO: 8848 - protein, 30 aa, Artificial Sequence
  Description of Artificial Sequence: Synthetic polypeptide
DEEEIRTTNPVATEQYGSVHTNLQNGIVFR

SEQ ID NO: 8849 - protein, 32 aa, Artificial Sequence
  Description of Artificial Sequence: Synthetic polypeptide
DEEEIRTTNPVAYEQYGSVSTLNLQRTDGNTR

SEQ ID NO: 8850 - protein, 29 aa, Artificial Sequence
  Description of Artificial Sequence: Synthetic peptide
DEEEIRTTNPVAYEQYGSVSDNLSQPGGR

SEQ ID NO: 8851 - protein, 30 aa, Artificial Sequence
  Description of Artificial Sequence: Synthetic polypeptide
DEEEIRTTNPVATEQYGSVQTGNLQRTENQ

SEQ ID NO: 8852 - protein, 29 aa, Artificial Sequence
  Description of Artificial Sequence: Synthetic peptide
DEEEIRTTNPVATEQYGSVQTILQRGLQI

SEQ ID NO: 8853 - protein, 29 aa, Artificial Sequence
  Description of Artificial Sequence: Synthetic peptide
DEEEIRTTNPVATEQYGSVGTDLQRGEDQ

SEQ ID NO: 8854 - protein, 31 aa, Artificial Sequence
  Description of Artificial Sequence: Synthetic polypeptide
DEEEIRTTNPVATEQYGSVTSTENDQRGMND

SEQ ID NO: 8855 - protein, 29 aa, Artificial Sequence
  Description of Artificial Sequence: Synthetic peptide
DEAEIRTTNPVATEQYGCVSTNLERGQER

SEQ ID NO: 8856 - protein, 30 aa, Artificial Sequence
  Description of Artificial Sequence: Synthetic polypeptide
DEEEIRTTNPVATEQYGSVGTMNMLQRNNL

SEQ ID NO: 8857 - protein, 29 aa, Artificial Sequence
  Description of Artificial Sequence: Synthetic peptide
DEEEIRTTNPVATEQYGSVGTNEQEGGNQ

SEQ ID NO: 8858 - protein, 29 aa, Artificial Sequence
  Description of Artificial Sequence: Synthetic peptide
DEEEIRTTNPVATEQYGSVGTNGQTDINR

SEQ ID NO: 8859 - protein, 30 aa, Artificial Sequence
  Description of Artificial Sequence: Synthetic polypeptide
DEEEIRTTNPVATEQYGSVGTNLAQTGGNF

SEQ ID NO: 8860 - protein, 30 aa, Artificial Sequence
  Description of Artificial Sequence: Synthetic polypeptide
DEEEIRTTNPVATEQYGSVGTNLDRMENRV

SEQ ID NO: 8861 - protein, 30 aa, Artificial Sequence
  Description of Artificial Sequence: Synthetic polypeptide
DEEEIRTTNPVAYEQYGTVSTNLSQFGNRG

SEQ ID NO: 8862 - protein, 29 aa, Artificial Sequence
  Description of Artificial Sequence: Synthetic peptide
DEEEIRTTNPVAYEQYGTVSCANLQSGNR

SEQ ID NO: 8863 - protein, 31 aa, Artificial Sequence
  Description of Artificial Sequence: Synthetic polypeptide
DEEEIRTTNPVAYEQYGTVCSTNLQRGNPRS

SEQ ID NO: 8864 - protein, 28 aa, Artificial Sequence
  Description of Artificial Sequence: Synthetic peptide
DEAEIRTTNPVATEQYGCVSTNGQHGND

SEQ ID NO: 8865 - protein, 28 aa, Artificial Sequence
  Description of Artificial Sequence: Synthetic peptide
DEAEIRTTNPVATEQYGCVSTNEQSGNI

SEQ ID NO: 8866 - protein, 30 aa, Artificial Sequence
  Description of Artificial Sequence: Synthetic polypeptide
DEEEIRTTNPVAYEQYGSVSYTNTQRGNQG

SEQ ID NO: 8867 - protein, 32 aa, Artificial Sequence
  Description of Artificial Sequence: Synthetic polypeptide
DEEEIRTTNPVATEQYGSVTSTENHQRFGNRG

SEQ ID NO: 8868 - protein, 31 aa, Artificial Sequence
  Description of Artificial Sequence: Synthetic polypeptide
DEEEIRTTNPVATEQYGSVGTNLQRGTQNMT

SEQ ID NO: 8869 - protein, 30 aa, Artificial Sequence
  Description of Artificial Sequence: Synthetic polypeptide
DEEEIRTTNPVATEQYGSVGTNLQSGGTNP

SEQ ID NO: 8870 - protein, 30 aa, Artificial Sequence
  Description of Artificial Sequence: Synthetic polypeptide
DEEEIRTTNPVATEQYGSVGTNLQTIGNLP

SEQ ID NO: 8871 - protein, 30 aa, Artificial Sequence
  Description of Artificial Sequence: Synthetic polypeptide
DEEEIRTTNPVATEQYGSVGTNLVQDGGNE

SEQ ID NO: 8872 - protein, 30 aa, Artificial Sequence
  Description of Artificial Sequence: Synthetic polypeptide
DEEEIRTTNPVAYEQYGSVYSTNLQFGSQR

SEQ ID NO: 8873 - protein, 29 aa, Artificial Sequence
  Description of Artificial Sequence: Synthetic peptide
DEEEIRTTNPVATEQYGSVQTNAQTGNFE

SEQ ID NO: 8874 - protein, 31 aa, Artificial Sequence
  Description of Artificial Sequence: Synthetic polypeptide
DEEEIRTTNPVATEQYGSVGTTNELQRGGER

SEQ ID NO: 8875 - protein, 31 aa, Artificial Sequence
  Description of Artificial Sequence: Synthetic polypeptide
DEEEIRTTNPVAYEQYGSVVSVTNLARTGNR

SEQ ID NO: 8876 - protein, 29 aa, Artificial Sequence
  Description of Artificial Sequence: Synthetic peptide
DEEEIRTTNPVATEQYGSVGTTNLQRVEG

SEQ ID NO: 8877 - protein, 29 aa, Artificial Sequence
  Description of Artificial Sequence: Synthetic peptide
DEEEIRTTNPVATEQYGSVQTMTLQRNNN

SEQ ID NO: 8878 - protein, 28 aa, Artificial Sequence
  Description of Artificial Sequence: Synthetic peptide
DEEEIRTTNPVATEQYGSVGVNLQDGTQ

SEQ ID NO: 8879 - protein, 29 aa, Artificial Sequence
  Description of Artificial Sequence: Synthetic peptide
DEEEIRTTNPVATEQYGSVQTMLQRGQQT

SEQ ID NO: 8880 - protein, 29 aa, Artificial Sequence
  Description of Artificial Sequence: Synthetic peptide
DEEEIRTTNPVATEQYGSVQTLLQRVDRS

SEQ ID NO: 8881 - protein, 31 aa, Artificial Sequence
  Description of Artificial Sequence: Synthetic polypeptide
DEEEIRTTNPVATEQYGSVTSTENHQRGSNQ

SEQ ID NO: 8882 - protein, 31 aa, Artificial Sequence
  Description of Artificial Sequence: Synthetic polypeptide
DEEEIRTTNPVAYEQYGSVSCTPELQRGNYR

SEQ ID NO: 8883 - protein, 30 aa, Artificial Sequence
  Description of Artificial Sequence: Synthetic polypeptide
DEEEIRTTNPVAYEQYGSVSCTNLQMGGNL

SEQ ID NO: 8884 - protein, 30 aa, Artificial Sequence
  Description of Artificial Sequence: Synthetic polypeptide
DEEEIRTTNPVATEQYGSVHTNLQREVNIF

SEQ ID NO: 8885 - protein, 29 aa, Artificial Sequence
  Description of Artificial Sequence: Synthetic peptide
DEEEIATTNPVATEQYGNVSTNFEQMGNR

SEQ ID NO: 8886 - protein, 29 aa, Artificial Sequence
  Description of Artificial Sequence: Synthetic peptide
DEEEIATTNPVATEQYGNVSTNEEQAGNR

SEQ ID NO: 8887 - protein, 32 aa, Artificial Sequence
  Description of Artificial Sequence: Synthetic polypeptide
DEEEIRTTNPVATEQYGSVTSTNLQRIGSNNQ

SEQ ID NO: 8888 - protein, 30 aa, Artificial Sequence
  Description of Artificial Sequence: Synthetic polypeptide
DEEEIRTTNPVATEQYGSVIDTNLVRGMMR

SEQ ID NO: 8889 - protein, 30 aa, Artificial Sequence
  Description of Artificial Sequence: Synthetic polypeptide
DEEEIRTTNPVAYEQYGSVATNLSQRGNSE

SEQ ID NO: 8890 - protein, 31 aa, Artificial Sequence
  Description of Artificial Sequence: Synthetic polypeptide
DEEEIRTTNPVAYEQYGSVATNLSQREGTNR

SEQ ID NO: 8891 - protein, 29 aa, Artificial Sequence
  Description of Artificial Sequence: Synthetic peptide
DEEEIATTNPVATEQYGIVSTNLQNGNST

SEQ ID NO: 8892 - protein, 29 aa, Artificial Sequence
  Description of Artificial Sequence: Synthetic peptide
DEEEIATTNPVATEQYGHVSTNIQNGNER

SEQ ID NO: 8893 - protein, 30 aa, Artificial Sequence
  Description of Artificial Sequence: Synthetic polypeptide
DEEEIATTNPVATEQYGGVSTNLQRGDTDR

SEQ ID NO: 8894 - protein, 29 aa, Artificial Sequence
  Description of Artificial Sequence: Synthetic peptide
DEEEIRTTNPVAYEQYGSVATNLQRVNDS

SEQ ID NO: 8895 - protein, 30 aa, Artificial Sequence
  Description of Artificial Sequence: Synthetic polypeptide
DEEEIRTTNPVAYEQYGSVATNLQRVGNQE

SEQ ID NO: 8896 - protein, 29 aa, Artificial Sequence
  Description of Artificial Sequence: Synthetic peptide
DEEEIRTTNPVAYEQYGSVATNLQRINVA

SEQ ID NO: 8897 - protein, 31 aa, Artificial Sequence
  Description of Artificial Sequence: Synthetic polypeptide
DEEEIRTTNPVATEQYGSVTSTNLVQNGNQA

SEQ ID NO: 8898 - protein, 29 aa, Artificial Sequence
  Description of Artificial Sequence: Synthetic peptide
DEEEIATTNPVATEQYGNVSTNLQGDGNS

SEQ ID NO: 8899 - protein, 31 aa, Artificial Sequence
  Description of Artificial Sequence: Synthetic polypeptide
DEEEIATTNPVATEQYGEVSTNLQRGDGQNR

SEQ ID NO: 8900 - protein, 31 aa, Artificial Sequence
  Description of Artificial Sequence: Synthetic polypeptide
DEEEIRTTNPVATEQYGSVTSTNPQRLGNDI

SEQ ID NO: 8901 - protein, 30 aa, Artificial Sequence
  Description of Artificial Sequence: Synthetic polypeptide
DEEEIRTTNPVATEQYGSVTSTQNEQGGND

SEQ ID NO: 8902 - protein, 30 aa, Artificial Sequence
  Description of Artificial Sequence: Synthetic polypeptide
DEEEIRTTNPVATEQYGSVTSTQNLIQGNL

SEQ ID NO: 8903 - protein, 33 aa, Artificial Sequence
  Description of Artificial Sequence: Synthetic polypeptide
DEEEIRTTNPVATEQYGSVTSTTENLSQRTGNR

SEQ ID NO: 8904 - protein, 29 aa, Artificial Sequence
  Description of Artificial Sequence: Synthetic peptide
DEEEIRTTNPVAYEQYGSVATNLETGNDR

SEQ ID NO: 8905 - protein, 30 aa, Artificial Sequence
  Description of Artificial Sequence: Synthetic polypeptide
DEEEIRTTNPVATEQYGSVIETGLQRGPER

SEQ ID NO: 8906 - protein, 30 aa, Artificial Sequence
  Description of Artificial Sequence: Synthetic polypeptide
DEEEIRTTNPVATEQYGSVQSTPDLQRGVT

SEQ ID NO: 8907 - protein, 31 aa, Artificial Sequence
  Description of Artificial Sequence: Synthetic polypeptide
DEEEIRTTNPVATEQYGSVTSTTNLQRGFGT

SEQ ID NO: 8908 - protein, 30 aa, Artificial Sequence
  Description of Artificial Sequence: Synthetic polypeptide
DEEEIRTTNPVAYEQYGSVAPTNLQRNNRM

SEQ ID NO: 8909 - protein, 31 aa, Artificial Sequence
  Description of Artificial Sequence: Synthetic polypeptide
DEEEIRTTNPVATEQYGSVIETNLQEGQNDR

SEQ ID NO: 8910 - protein, 31 aa, Artificial Sequence
  Description of Artificial Sequence: Synthetic polypeptide
DEEEIRTTNPVATEQYGSVIETNLQFGENDR

SEQ ID NO: 8911 - protein, 30 aa, Artificial Sequence
  Description of Artificial Sequence: Synthetic polypeptide
DEEEIRTTNPVATEQYGSVQSTPDLQRGEQ

SEQ ID NO: 8912 - protein, 30 aa, Artificial Sequence
  Description of Artificial Sequence: Synthetic polypeptide
DEEEIRTTNPVATEQYGSVIETTLQRLNRN

SEQ ID NO: 8913 - protein, 30 aa, Artificial Sequence
  Description of Artificial Sequence: Synthetic polypeptide
DEEEIRTTNPVATEQYGSVTSTNPQRFNDT

SEQ ID NO: 8914 - protein, 29 aa, Artificial Sequence
  Description of Artificial Sequence: Synthetic peptide
DEEEIRTTNPVAYEQYGSVCTNLQAGDPR

SEQ ID NO: 8915 - protein, 31 aa, Artificial Sequence
  Description of Artificial Sequence: Synthetic polypeptide
DEEEIRTTNPVAYEQYGSVCTNMLQRVGNNR

SEQ ID NO: 8916 - protein, 31 aa, Artificial Sequence
  Description of Artificial Sequence: Synthetic polypeptide
DEEEIRTTNPVATEQYGSVTSTNLQQTEGNV

SEQ ID NO: 8917 - protein, 30 aa, Artificial Sequence
  Description of Artificial Sequence: Synthetic polypeptide
DEEEIRTTNPVATEQYGSVHTNLQREVNVD

SEQ ID NO: 8918 - protein, 31 aa, Artificial Sequence
  Description of Artificial Sequence: Synthetic polypeptide
DEEEIRTTNPVATEQYGSVTSTNDQRDNNRA

SEQ ID NO: 8919 - protein, 30 aa, Artificial Sequence
  Description of Artificial Sequence: Synthetic polypeptide
DEEEIRTTNPVATEQYGSVTSTNLDRGTEQ

SEQ ID NO: 8920 - protein, 31 aa, Artificial Sequence
  Description of Artificial Sequence: Synthetic polypeptide
DEEEIRTTNPVAYEQYGSVSCAPNLQRTGNR

SEQ ID NO: 8921 - protein, 30 aa, Artificial Sequence
  Description of Artificial Sequence: Synthetic polypeptide
DEEEIRTTNPVATEQYGSVTSTNLEDGDND

SEQ ID NO: 8922 - protein, 31 aa, Artificial Sequence
  Description of Artificial Sequence: Synthetic polypeptide
DEEEIRTTNPVAYEQYGSVQSTNELPQRGDR

SEQ ID NO: 8923 - protein, 30 aa, Artificial Sequence
  Description of Artificial Sequence: Synthetic polypeptide
DEEEIRTTNPVATEQYGSVHTNLQRPQMQR

SEQ ID NO: 8924 - protein, 31 aa, Artificial Sequence
  Description of Artificial Sequence: Synthetic polypeptide
DEEEIRTTNPVATEQYGSVTSTNLFQNGNQV

SEQ ID NO: 8925 - protein, 30 aa, Artificial Sequence
  Description of Artificial Sequence: Synthetic polypeptide
DEEEIRTTNPVAYEQYGSVPTNLSQRGNPA

SEQ ID NO: 8926 - protein, 30 aa, Artificial Sequence
  Description of Artificial Sequence: Synthetic polypeptide
DEEEIRTTNPVATEQYGSVHTTNLQRGQQQ

SEQ ID NO: 8927 - protein, 30 aa, Artificial Sequence
  Description of Artificial Sequence: Synthetic polypeptide
DEEEIRTTNPVATEQYGSVHTVNGVQRGNG

SEQ ID NO: 8928 - protein, 29 aa, Artificial Sequence
  Description of Artificial Sequence: Synthetic peptide
DEEEIRTTNPVATEQYGSVIANLGRGVRV

SEQ ID NO: 8929 - protein, 31 aa, Artificial Sequence
  Description of Artificial Sequence: Synthetic polypeptide
DEEEIRTTNPVATEQYGSVTSTNLGQEDHNR

SEQ ID NO: 8930 - protein, 30 aa, Artificial Sequence
  Description of Artificial Sequence: Synthetic polypeptide
DEEEIRTTNPVATEQYGSVTSTNLILGNFT

SEQ ID NO: 8931 - protein, 30 aa, Artificial Sequence
  Description of Artificial Sequence: Synthetic polypeptide
DEEEIRTTNPVAYEQYGSVPSTNLQGGENS

SEQ ID NO: 8932 - protein, 30 aa, Artificial Sequence
  Description of Artificial Sequence: Synthetic polypeptide
DEEEIRTTNPVAYEQYGSVPSTNLQAGLNQ

SEQ ID NO: 8933 - protein, 31 aa, Artificial Sequence
  Description of Artificial Sequence: Synthetic polypeptide
DEEEIRTTNPVATEQYGSVTSTNLNQLGNIQ

SEQ ID NO: 8934 - protein, 31 aa, Artificial Sequence
  Description of Artificial Sequence: Synthetic polypeptide
DEEEIRTTNPVATEQYGSVTSTNLNQNGNIM

SEQ ID NO: 8935 - protein, 31 aa, Artificial Sequence
  Description of Artificial Sequence: Synthetic polypeptide
DEEEIRTTNPVATEQYGSVTSTNLPQEIGNN

SEQ ID NO: 8936 - protein, 30 aa, Artificial Sequence
  Description of Artificial Sequence: Synthetic polypeptide
DEEEIRTTNPVATEQYGSVTSTNLQAGDQQ

SEQ ID NO: 8937 - protein, 31 aa, Artificial Sequence
  Description of Artificial Sequence: Synthetic polypeptide
DEEEIRTTNPVATEQYGSVQSTVLQRGNFQN

SEQ ID NO: 8938 - protein, 31 aa, Artificial Sequence
  Description of Artificial Sequence: Synthetic polypeptide
DEEEIRTTNPVATEQYGSVTSTNLQLGGNEG

SEQ ID NO: 8939 - protein, 31 aa, Artificial Sequence
  Description of Artificial Sequence: Synthetic polypeptide
DEEEIRTTNPVATEQYGSVTSTNLQNGGNMD

SEQ ID NO: 8940 - protein, 31 aa, Artificial Sequence
  Description of Artificial Sequence: Synthetic polypeptide
DEEEIRTTNPVATEQYGSVTSTNLQNGIDNE

SEQ ID NO: 8941 - protein, 31 aa, Artificial Sequence
  Description of Artificial Sequence: Synthetic polypeptide
DEEEIRTTNPVATEQYGSVTSTNLQPTGGNN

SEQ ID NO: 8942 - protein, 30 aa, Artificial Sequence
  Description of Artificial Sequence: Synthetic polypeptide
DEEEIATTNPVATEQYGNVSVTNLQRVGNP

SEQ ID NO: 8943 - protein, 30 aa, Artificial Sequence
  Description of Artificial Sequence: Synthetic polypeptide
DEEEIRTTNPVAYEQYGSVFTNLSQRGNDT

SEQ ID NO: 8944 - protein, 31 aa, Artificial Sequence
  Description of Artificial Sequence: Synthetic polypeptide
DEEEIRTTNPVATEQYGSVTSTNLQPTGINN

SEQ ID NO: 8945 - protein, 30 aa, Artificial Sequence
  Description of Artificial Sequence: Synthetic polypeptide
DEEEIRTTNPVATEQYGSVTSTNLQQGEEM

SEQ ID NO: 8946 - protein, 30 aa, Artificial Sequence
  Description of Artificial Sequence: Synthetic polypeptide
DEEEIRTTNPVATEQYGSVGTALQRFGNIQ

SEQ ID NO: 8947 - protein, 30 aa, Artificial Sequence
  Description of Artificial Sequence: Synthetic polypeptide
DEEEIRTTNPVATEQYGSVQSTPALQRGVV

SEQ ID NO: 8948 - protein, 29 aa, Artificial Sequence
  Description of Artificial Sequence: Synthetic peptide
DEAEIRTTNPVATEQYGCVSTNLQAMGNG

SEQ ID NO: 8949 - protein, 29 aa, Artificial Sequence
  Description of Artificial Sequence: Synthetic peptide
DEAEIRTTNPVATEQYGCVSTNLQGAGNG

SEQ ID NO: 8950 - protein, 29 aa, Artificial Sequence
  Description of Artificial Sequence: Synthetic peptide
DEEEIRTTNPVGTEQYGSVSTNPLGRGEP

SEQ ID NO: 8951 - protein, 29 aa, Artificial Sequence
  Description of Artificial Sequence: Synthetic peptide
DEEEIRTTNPVGTEQYGSVSTNNLERGFE

SEQ ID NO: 8952 - protein, 29 aa, Artificial Sequence
  Description of Artificial Sequence: Synthetic peptide
DEEEIRTTNPVGTEQYGSVSTNLLGRGDV

SEQ ID NO: 8953 - protein, 29 aa, Artificial Sequence
  Description of Artificial Sequence: Synthetic peptide
DEEEIRTTNPVGTEQYGSVSTNILPRGFP

SEQ ID NO: 8954 - protein, 29 aa, Artificial Sequence
  Description of Artificial Sequence: Synthetic peptide
DEAEIRTTNPVATEQYGDVSTNPQQGSNR

SEQ ID NO: 8955 - protein, 29 aa, Artificial Sequence
  Description of Artificial Sequence: Synthetic peptide
DEEEIRTTNPVGTEQYGSVSTNGLGRGKP

SEQ ID NO: 8956 - protein, 29 aa, Artificial Sequence
  Description of Artificial Sequence: Synthetic peptide
DEEEIRTTNPVGTEQYGSVSTNGLGRGFQ

SEQ ID NO: 8957 - protein, 29 aa, Artificial Sequence
  Description of Artificial Sequence: Synthetic peptide
DEAEIRTTNPVATEQYGDVSTNNQSGNNR

SEQ ID NO: 8958 - protein, 29 aa, Artificial Sequence
  Description of Artificial Sequence: Synthetic peptide
DEAEIRTTNPVATEQYGDVSTNLQGGGNG

SEQ ID NO: 8959 - protein, 28 aa, Artificial Sequence
  Description of Artificial Sequence: Synthetic peptide
DEAEIRTTNPVATEQYGDVSTNIQFGNF

SEQ ID NO: 8960 - protein, 30 aa, Artificial Sequence
  Description of Artificial Sequence: Synthetic polypeptide
DEAEIRTTNPVATEQYGDVSTENLQEGGNR

SEQ ID NO: 8961 - protein, 29 aa, Artificial Sequence
  Description of Artificial Sequence: Synthetic peptide
DEEEIRTTNPVGTEQYGSVSTNFLPRGGP

SEQ ID NO: 8962 - protein, 29 aa, Artificial Sequence
  Description of Artificial Sequence: Synthetic peptide
DEEEIRTTNPVGTEQYGSVSTNFLGRGSW

SEQ ID NO: 8963 - protein, 29 aa, Artificial Sequence
  Description of Artificial Sequence: Synthetic peptide
DEEEIRTTNPVGTEQYGSVSTNPLGRGFT

SEQ ID NO: 8964 - protein, 29 aa, Artificial Sequence
  Description of Artificial Sequence: Synthetic peptide
DEEEIRTTNPVGTEQYGSVSTNFLGRGQV

SEQ ID NO: 8965 - protein, 29 aa, Artificial Sequence
  Description of Artificial Sequence: Synthetic peptide
DEEEIRTTNPVGTEQYGSVSTNFLGRGGQ

SEQ ID NO: 8966 - protein, 30 aa, Artificial Sequence
  Description of Artificial Sequence: Synthetic polypeptide
DEEEIRTTNPVATEQYGSVQTNQQRGNISE

SEQ ID NO: 8967 - protein, 29 aa, Artificial Sequence
  Description of Artificial Sequence: Synthetic peptide
DEEEIRTTNPVGTEQYGSVSTNFLERGQP

SEQ ID NO: 8968 - protein, 29 aa, Artificial Sequence
  Description of Artificial Sequence: Synthetic peptide
DEEEIRTTNPVGTEQYGSVSTNFLDRGFA

SEQ ID NO: 8969 - protein, 29 aa, Artificial Sequence
  Description of Artificial Sequence: Synthetic peptide
DEEEIRTTNPVGTEQYGSVSTNELGRGQW

SEQ ID NO: 8970 - protein, 29 aa, Artificial Sequence
  Description of Artificial Sequence: Synthetic peptide
DEEEIRTTNPVGTEQYGSVSTNELGRGMA

SEQ ID NO: 8971 - protein, 30 aa, Artificial Sequence
  Description of Artificial Sequence: Synthetic polypeptide
DEEEIRTTNPVATEQYGSVTPTGNLQRGQD

SEQ ID NO: 8972 - protein, 29 aa, Artificial Sequence
  Description of Artificial Sequence: Synthetic peptide
DEEEIRTTNPVGTEQYGSVSTNDLGRGIG

SEQ ID NO: 8973 - protein, 29 aa, Artificial Sequence
  Description of Artificial Sequence: Synthetic peptide
DEEEIRTTNPVGTEQYGSVSTNDLGRGFN

SEQ ID NO: 8974 - protein, 29 aa, Artificial Sequence
  Description of Artificial Sequence: Synthetic peptide
DEEEIRTTNPVGTEQYGSVSTNDLGRGAP

SEQ ID NO: 8975 - protein, 30 aa, Artificial Sequence
  Description of Artificial Sequence: Synthetic polypeptide
DEEEIRTTNPVATEQYGSVQTNLVRGEEVR

SEQ ID NO: 8976 - protein, 30 aa, Artificial Sequence
  Description of Artificial Sequence: Synthetic polypeptide
DEEEIRTTNPVATEQYGSVTPTNLQGQGER

SEQ ID NO: 8977 - protein, 31 aa, Artificial Sequence
  Description of Artificial Sequence: Synthetic polypeptide
DEEEIRTTNPVATEQYGSVGSTGNLQNGINT

SEQ ID NO: 8978 - protein, 29 aa, Artificial Sequence
  Description of Artificial Sequence: Synthetic peptide
DEEEIRTTNPVGTEQYGSVSTNFLGRGME

SEQ ID NO: 8979 - protein, 31 aa, Artificial Sequence
  Description of Artificial Sequence: Synthetic polypeptide
DEEEIRTTNPVATEQYGSVTPTNMQRGENER

SEQ ID NO: 8980 - protein, 29 aa, Artificial Sequence
  Description of Artificial Sequence: Synthetic peptide
DEEEIRTTNPVGTEQYGSVSTNPLGRGMP

SEQ ID NO: 8981 - protein, 29 aa, Artificial Sequence
  Description of Artificial Sequence: Synthetic peptide
DEEEIRTTNPVGTEQYGSVSTNSLGRGTP

SEQ ID NO: 8982 - protein, 29 aa, Artificial Sequence
  Description of Artificial Sequence: Synthetic peptide
DEEEIRTTNPVSTEQYGSVSTSNLQIGQT

SEQ ID NO: 8983 - protein, 29 aa, Artificial Sequence
  Description of Artificial Sequence: Synthetic peptide
DEEEIRTTNPVSTEQYGSVSTNNLGRGFP

SEQ ID NO: 8984 - protein, 31 aa, Artificial Sequence
  Description of Artificial Sequence: Synthetic polypeptide
DEEEIRTTNPVSTEQYGSVSTNLQERGADRD

SEQ ID NO: 8985 - protein, 29 aa, Artificial Sequence
  Description of Artificial Sequence: Synthetic peptide
DEEEIRTTNPVSTEQYGSVSTNGLGRGFP

SEQ ID NO: 8986 - protein, 29 aa, Artificial Sequence
  Description of Artificial Sequence: Synthetic peptide
DEEEIRTTNPVSTEQYGSVSTNFLPRGDP

SEQ ID NO: 8987 - protein, 29 aa, Artificial Sequence
  Description of Artificial Sequence: Synthetic peptide
DEEEIRTTNPVSTEQYGSVSTNFLGRGFG

SEQ ID NO: 8988 - protein, 29 aa, Artificial Sequence
  Description of Artificial Sequence: Synthetic peptide
DEEEIRTTNPVSTEQYGSVSTDNLQQGTT

SEQ ID NO: 8989 - protein, 31 aa, Artificial Sequence
  Description of Artificial Sequence: Synthetic polypeptide
DEEEIRTTNPVATEQYGSVTETNLQFGENER

SEQ ID NO: 8990 - protein, 30 aa, Artificial Sequence
  Description of Artificial Sequence: Synthetic polypeptide
DEAEIRTTNPVATEQYGKLVSTNLQTGGNR

SEQ ID NO: 8991 - protein, 30 aa, Artificial Sequence
  Description of Artificial Sequence: Synthetic polypeptide
DEEEIRTTNPVATEQYGSVTGTNHERGNRG

SEQ ID NO: 8992 - protein, 29 aa, Artificial Sequence
  Description of Artificial Sequence: Synthetic peptide
DEEEIRTTNPVATEQYGSVTINLQRLNGQ

SEQ ID NO: 8993 - protein, 30 aa, Artificial Sequence
  Description of Artificial Sequence: Synthetic polypeptide
DEEEIRTTNPVSTEQYGSVATNLQRGNLSD

SEQ ID NO: 8994 - protein, 29 aa, Artificial Sequence
  Description of Artificial Sequence: Synthetic peptide
DEEEIRTTNPVATEQYGSVTITNLQSGDV

SEQ ID NO: 8995 - protein, 29 aa, Artificial Sequence
  Description of Artificial Sequence: Synthetic peptide
DEEEIRTTNPVGTEQYGSVSTNQLGRGFV

SEQ ID NO: 8996 - protein, 29 aa, Artificial Sequence
  Description of Artificial Sequence: Synthetic peptide
DEEEIRTTNPVATEQYGSVQTSLQRSERF

SEQ ID NO: 8997 - protein, 29 aa, Artificial Sequence
  Description of Artificial Sequence: Synthetic peptide
DEAEIRTTNPVATEQYGEVSTNLQLGENM

SEQ ID NO: 8998 - protein, 29 aa, Artificial Sequence
  Description of Artificial Sequence: Synthetic peptide
DEAEIRTTNPVATEQYGEVSTNLQIGGNE

SEQ ID NO: 8999 - protein, 30 aa, Artificial Sequence
  Description of Artificial Sequence: Synthetic polypeptide
DEEEIRTTNPVATEQYGSVQTPNGIQRGNG

SEQ ID NO: 9000 - protein, 31 aa, Artificial Sequence
  Description of Artificial Sequence: Synthetic polypeptide
DEEEIRTTNPVATEQYGSVGSNTNLQEGNGG

SEQ ID NO: 9001 - protein, 31 aa, Artificial Sequence
  Description of Artificial Sequence: Synthetic polypeptide
DEEEIATTNPVATEQYGSTVSTNPSQRVGNR

SEQ ID NO: 9002 - protein, 29 aa, Artificial Sequence
  Description of Artificial Sequence: Synthetic peptide
DEEEIRTTNPVSTEIYGSVSDPNLQRGNL

SEQ ID NO: 9003 - protein, 30 aa, Artificial Sequence
  Description of Artificial Sequence: Synthetic polypeptide
DEEEIRTTNPVSTEFYGSVSTMPNLQRGNG

SEQ ID NO: 9004 - protein, 30 aa, Artificial Sequence
  Description of Artificial Sequence: Synthetic polypeptide
DEAEIRTTNPVATEQYGEVSTNLQGDGNER

SEQ ID NO: 9005 - protein, 31 aa, Artificial Sequence
  Description of Artificial Sequence: Synthetic polypeptide
DEEEIRTTNPVATEQYGSVGSNTNLQNGNPG

SEQ ID NO: 9006 - protein, 29 aa, Artificial Sequence
  Description of Artificial Sequence: Synthetic peptide
DEEEIRTTNPVGTETYGSVSSPNLQRGNL

SEQ ID NO: 9007 - protein, 32 aa, Artificial Sequence
  Description of Artificial Sequence: Synthetic polypeptide
DEEEIRTTNPVATEQYGSVGSPTNLQRINERN

SEQ ID NO: 9008 - protein, 29 aa, Artificial Sequence
  Description of Artificial Sequence: Synthetic peptide
DEEEIRTTNPVGTEQYGSVSTNTLGRGVA

SEQ ID NO: 9009 - protein, 29 aa, Artificial Sequence
  Description of Artificial Sequence: Synthetic peptide
DEEEIRTTNPVGTEQYGSVSTNSLTRGSP

SEQ ID NO: 9010 - protein, 31 aa, Artificial Sequence
  Description of Artificial Sequence: Synthetic polypeptide
DEEEIRTTNPVATEQYGSVTMTNLQRNENVR

SEQ ID NO: 9011 - protein, 29 aa, Artificial Sequence
  Description of Artificial Sequence: Synthetic peptide
DEEEIRTTNPVATEQYGSVQTNLQRPVQT

SEQ ID NO: 9012 - protein, 31 aa, Artificial Sequence
  Description of Artificial Sequence: Synthetic polypeptide
DEEEIRTTNPVATEQYGSVQTNLQRMGTPRQ

SEQ ID NO: 9013 - protein, 32 aa, Artificial Sequence
  Description of Artificial Sequence: Synthetic polypeptide
DEEEIRTTNPVATEQYGSVGSTGNLQRGQNIE

SEQ ID NO: 9014 - protein, 30 aa, Artificial Sequence
  Description of Artificial Sequence: Synthetic polypeptide
DEEEIRTTNPVATEQYGSVQTNLIRGQEAR

SEQ ID NO: 9015 - protein, 31 aa, Artificial Sequence
  Description of Artificial Sequence: Synthetic polypeptide
DEEEIRTTNPVATEQYGSVTSNTDLQRGNEQ

SEQ ID NO: 9016 - protein, 30 aa, Artificial Sequence
  Description of Artificial Sequence: Synthetic polypeptide
DEEEIRTTNPVATEQYGSVTSNTELQRGET

SEQ ID NO: 9017 - protein, 32 aa, Artificial Sequence
  Description of Artificial Sequence: Synthetic polypeptide
DEEEIRTTNPVATEQYGSVTSNTFELQRGNRG

SEQ ID NO: 9018 - protein, 33 aa, Artificial Sequence
  Description of Artificial Sequence: Synthetic polypeptide
DEEEIRTTNPVATEQYGSVTSNTNLQERGSNPR

SEQ ID NO: 9019 - protein, 29 aa, Artificial Sequence
  Description of Artificial Sequence: Synthetic peptide
DEEEIRTTNPVCTEHYGSVSGPNLQRGNQ

SEQ ID NO: 9020 - protein, 29 aa, Artificial Sequence
  Description of Artificial Sequence: Synthetic peptide
DEEEIRTTNPVCTEHYGSVSFGNLQRGNL

SEQ ID NO: 9021 - protein, 29 aa, Artificial Sequence
  Description of Artificial Sequence: Synthetic peptide
DEEEIRTTNPVCTEHYGSVSDDNLQRGND

SEQ ID NO: 9022 - protein, 29 aa, Artificial Sequence
  Description of Artificial Sequence: Synthetic peptide
DEEEIRTTNPVCTEHYGSVSAPNLQRGNQ

SEQ ID NO: 9023 - protein, 30 aa, Artificial Sequence
  Description of Artificial Sequence: Synthetic polypeptide
DEEEIRTTNPVATEQYGSVTSTANLFQGNT

SEQ ID NO: 9024 - protein, 30 aa, Artificial Sequence
  Description of Artificial Sequence: Synthetic polypeptide
DEEEIRTTNPVATEQYGSVTSTDLQRGEHN

SEQ ID NO: 9025 - protein, 30 aa, Artificial Sequence
  Description of Artificial Sequence: Synthetic polypeptide
DEEEIRTTNPVATEQYGSVTSTDLVQRGET

SEQ ID NO: 9026 - protein, 29 aa, Artificial Sequence
  Description of Artificial Sequence: Synthetic peptide
DEEEIRTTNPVCTEGYGSVSIPNLQRGNT

SEQ ID NO: 9027 - protein, 31 aa, Artificial Sequence
  Description of Artificial Sequence: Synthetic polypeptide
DEEEIRTTNPVATEQYGSVGSTNLQTFGNED

SEQ ID NO: 9028 - protein, 29 aa, Artificial Sequence
  Description of Artificial Sequence: Synthetic peptide
DEEEIRTTNPVCTEFYGSVSVPNLQRGNA

SEQ ID NO: 9029 - protein, 29 aa, Artificial Sequence
  Description of Artificial Sequence: Synthetic peptide
DEEEIRTTNPVATEQYGSVQTNHQRLNEQ

SEQ ID NO: 9030 - protein, 29 aa, Artificial Sequence
  Description of Artificial Sequence: Synthetic peptide
DEEEIRTTNPVCTECYGSVSMANLQRGNL

SEQ ID NO: 9031 - protein, 29 aa, Artificial Sequence
  Description of Artificial Sequence: Synthetic peptide
DEEEIRTTNPVCTEAYGSVSNPNLQRGNL

SEQ ID NO: 9032 - protein, 31 aa, Artificial Sequence
  Description of Artificial Sequence: Synthetic polypeptide
DEEEIRTTNPVATEQYGSVQTNGQPRGFNRT

SEQ ID NO: 9033 - protein, 29 aa, Artificial Sequence
  Description of Artificial Sequence: Synthetic peptide
DEEEIRTTNPVCTEAYGSVSIPNLQRGNN

SEQ ID NO: 9034 - protein, 29 aa, Artificial Sequence
  Description of Artificial Sequence: Synthetic peptide
DEEEIRTTNPVATEQYGSVQTNEQTGNEY

SEQ ID NO: 9035 - protein, 30 aa, Artificial Sequence
  Description of Artificial Sequence: Synthetic polypeptide
DEEEIRTTNPVATEQYGSVGSTVLQRGTDG

SEQ ID NO: 9036 - protein, 30 aa, Artificial Sequence
  Description of Artificial Sequence: Synthetic polypeptide
DEEEIRTTNPVAYETYGSVSTNLQGGGNRV

SEQ ID NO: 9037 - protein, 30 aa, Artificial Sequence
  Description of Artificial Sequence: Synthetic polypeptide
DEEEIRTTNPVATEQYGSVQTNDQRPNERG

SEQ ID NO: 9038 - protein, 31 aa, Artificial Sequence
  Description of Artificial Sequence: Synthetic polypeptide
DEEEIRTTNPVATEQYGSVGSTVNLQETGNI

SEQ ID NO: 9039 - protein, 30 aa, Artificial Sequence
  Description of Artificial Sequence: Synthetic polypeptide
DEAEIRTTNPVATEQYGCVSTNLQMDGNRP

SEQ ID NO: 9040 - protein, 29 aa, Artificial Sequence
  Description of Artificial Sequence: Synthetic peptide
DEEEIRTTNPVATEQYGSVQTNDFRGQIR

SEQ ID NO: 9041 - protein, 30 aa, Artificial Sequence
  Description of Artificial Sequence: Synthetic polypeptide
DEEEIRTTNPVAYEQYGVVSTNLSQRGNNI

SEQ ID NO: 9042 - protein, 29 aa, Artificial Sequence
  Description of Artificial Sequence: Synthetic peptide
DEEEIRTTNPVCTECYGSVSMPNLQRGNS

SEQ ID NO: 9043 - protein, 30 aa, Artificial Sequence
  Description of Artificial Sequence: Synthetic polypeptide
DEEEIRTTNPVCTEHYGSVSMTNLEQRGND

SEQ ID NO: 9044 - protein, 29 aa, Artificial Sequence
  Description of Artificial Sequence: Synthetic peptide
DEEEIRTTNPVCTEHYGSVSSTNEQRGNL

SEQ ID NO: 9045 - protein, 30 aa, Artificial Sequence
  Description of Artificial Sequence: Synthetic polypeptide
DEEEIRTTNPVCTEHYGSVSTMPNLQRGNK

SEQ ID NO: 9046 - protein, 31 aa, Artificial Sequence
  Description of Artificial Sequence: Synthetic polypeptide
DEEEIRTTNPVATEQYGSVQTNLQRMGEQRP

SEQ ID NO: 9047 - protein, 30 aa, Artificial Sequence
  Description of Artificial Sequence: Synthetic polypeptide
DEEEIRTTNPVATEQYGSVQTNLQRLSERG

SEQ ID NO: 9048 - protein, 30 aa, Artificial Sequence
  Description of Artificial Sequence: Synthetic polypeptide
DEEEIRTTNPVATEQYGSVQTNLQRGLLMQ

SEQ ID NO: 9049 - protein, 30 aa, Artificial Sequence
  Description of Artificial Sequence: Synthetic polypeptide
DEEEIRTTNPVATEQYGSVQTNLQRGLDVP

SEQ ID NO: 9050 - protein, 32 aa, Artificial Sequence
  Description of Artificial Sequence: Synthetic polypeptide
DEEEIRTTNPVATEQYGSVTSDTNLQRGQNVY

SEQ ID NO: 9051 - protein, 29 aa, Artificial Sequence
  Description of Artificial Sequence: Synthetic peptide
DEEEIRTTNPVGTEHYGSVSMPNLQRGNL

SEQ ID NO: 9052 - protein, 30 aa, Artificial Sequence
  Description of Artificial Sequence: Synthetic polypeptide
DEEEIRTTNPVATEQYGSVGSTNLNAGNGD

SEQ ID NO: 9053 - protein, 30 aa, Artificial Sequence
  Description of Artificial Sequence: Synthetic polypeptide
DEEEIRTTNPVATEQYGSVTSETILQRGEQ

SEQ ID NO: 9054 - protein, 29 aa, Artificial Sequence
  Description of Artificial Sequence: Synthetic peptide
DEEEIRTTNPVGTEAYGSVSMENLQRGNL

SEQ ID NO: 9055 - protein, 31 aa, Artificial Sequence
  Description of Artificial Sequence: Synthetic polypeptide
DEEEIRTTNPVATEQYGSVGSTNLQDPGNNT

SEQ ID NO: 9056 - protein, 31 aa, Artificial Sequence
  Description of Artificial Sequence: Synthetic polypeptide
DEEEIRTTNPVATEQYGSVGSTNLQDSGNNM

SEQ ID NO: 9057 - protein, 29 aa, Artificial Sequence
  Description of Artificial Sequence: Synthetic peptide
DEEEIRTTNPVATEQYGSVGSTNLQEVTP

SEQ ID NO: 9058 - protein, 30 aa, Artificial Sequence
  Description of Artificial Sequence: Synthetic polypeptide
DEEEIATTNPVATEQYGSASTNLQRAGEDR

SEQ ID NO: 9059 - protein, 28 aa, Artificial Sequence
  Description of Artificial Sequence: Synthetic peptide
DEEEIRTTNPVCVEQYGSVSTNDQNGNQ

SEQ ID NO: 9060 - protein, 31 aa, Artificial Sequence
  Description of Artificial Sequence: Synthetic polypeptide
DEEEIRTTNPVATEQYGSVQTNLQNRGLMVR

SEQ ID NO: 9061 - protein, 29 aa, Artificial Sequence
  Description of Artificial Sequence: Synthetic peptide
DEEEIRTTNPVCTEQYGVVSDNLPQRGNQ

SEQ ID NO: 9062 - protein, 29 aa, Artificial Sequence
  Description of Artificial Sequence: Synthetic peptide
DEEEIRTTNPVCTEQYGSVSTNLQRTDQM

SEQ ID NO: 9063 - protein, 29 aa, Artificial Sequence
  Description of Artificial Sequence: Synthetic peptide
DEEEIRTTNPVCTEQYGSVSTNLQRPDEH

SEQ ID NO: 9064 - protein, 29 aa, Artificial Sequence
  Description of Artificial Sequence: Synthetic peptide
DEEEIRTTNPVCTEQYGSVSTNLQHDNDP

SEQ ID NO: 9065 - protein, 31 aa, Artificial Sequence
  Description of Artificial Sequence: Synthetic polypeptide
DEEEIRTTNPVCTEQYGSVSTNLQERGNEEV

SEQ ID NO: 9066 - protein, 31 aa, Artificial Sequence
  Description of Artificial Sequence: Synthetic polypeptide
DEEEIRTTNPVCTEQYGSVSCENLQCRGNDR

SEQ ID NO: 9067 - protein, 29 aa, Artificial Sequence
  Description of Artificial Sequence: Synthetic peptide
DEEEIRTTNPVCTEQYGSVATNLQQPGNN

SEQ ID NO: 9068 - protein, 31 aa, Artificial Sequence
  Description of Artificial Sequence: Synthetic polypeptide
DEEEIRTTNPVATEQYGSVGSTNLQMDGNGV

SEQ ID NO: 9069 - protein, 31 aa, Artificial Sequence
  Description of Artificial Sequence: Synthetic polypeptide
DEEEIRTTNPVATEQYGSVGSTNLQMNGNIV

SEQ ID NO: 9070 - protein, 29 aa, Artificial Sequence
  Description of Artificial Sequence: Synthetic peptide
DEEEIRTTNPVATEQYGSVTSNLQRGVDD

SEQ ID NO: 9071 - protein, 29 aa, Artificial Sequence
  Description of Artificial Sequence: Synthetic peptide
DEEEIRTTNPVATEQYGSVQTNLQNNNLL

SEQ ID NO: 9072 - protein, 31 aa, Artificial Sequence
  Description of Artificial Sequence: Synthetic polypeptide
DEEEIRTTNPVATEQYGSVGSTNLQPEGQNI

SEQ ID NO: 9073 - protein, 29 aa, Artificial Sequence
  Description of Artificial Sequence: Synthetic peptide
DEEEIRTTNPVCTEHYGSVSVPNLQRGNV

SEQ ID NO: 9074 - protein, 29 aa, Artificial Sequence
  Description of Artificial Sequence: Synthetic peptide
DEEEIRTTNPVCTEHYGSVSVPNLQRGNK

SEQ ID NO: 9075 - protein, 31 aa, Artificial Sequence
  Description of Artificial Sequence: Synthetic polypeptide
DEEEIRTTNPVATEQYGSVGSTVNLQVGING

SEQ ID NO: 9076 - protein, 31 aa, Artificial Sequence
  Description of Artificial Sequence: Synthetic polypeptide
DEEEIRTTNPVATEQYGSVQSTNVDQRDGNI

SEQ ID NO: 9077 - protein, 31 aa, Artificial Sequence
  Description of Artificial Sequence: Synthetic polypeptide
DEEEIRTTNPVAYEQYGSTVSTPNSLQRGNQ

SEQ ID NO: 9078 - protein, 31 aa, Artificial Sequence
  Description of Artificial Sequence: Synthetic polypeptide
DEEEIRTTNPVATEQYGSVQSTNNQRLGNDV

SEQ ID NO: 9079 - protein, 29 aa, Artificial Sequence
  Description of Artificial Sequence: Synthetic peptide
DEEEIRTTNPVAYEPYGKVSELNLQRGNR

SEQ ID NO: 9080 - protein, 29 aa, Artificial Sequence
  Description of Artificial Sequence: Synthetic peptide
DEEEIRTTNPVATEQYGSVITNLQTLNED

SEQ ID NO: 9081 - protein, 29 aa, Artificial Sequence
  Description of Artificial Sequence: Synthetic peptide
DEEEIRTTNPVATEQYGSVITNLQTLTNT

SEQ ID NO: 9082 - protein, 31 aa, Artificial Sequence
  Description of Artificial Sequence: Synthetic polypeptide
DEEEIRTTNPVATEQYGSVVSTELQPSGNRI

SEQ ID NO: 9083 - protein, 30 aa, Artificial Sequence
  Description of Artificial Sequence: Synthetic polypeptide
DEEEIRTTNPVATEQYGSVITNLVRGGNGD

SEQ ID NO: 9084 - protein, 31 aa, Artificial Sequence
  Description of Artificial Sequence: Synthetic polypeptide
DEEEIRTTNPVATEQYGSVVSTGNLSQRSDR

SEQ ID NO: 9085 - protein, 31 aa, Artificial Sequence
  Description of Artificial Sequence: Synthetic polypeptide
DEEEIRTTNPVATEQYGSVVSTHLQRQGEVR

SEQ ID NO: 9086 - protein, 31 aa, Artificial Sequence
  Description of Artificial Sequence: Synthetic polypeptide
DEEEIRTTNPVATEQYGSVITNMLQQGENER

SEQ ID NO: 9087 - protein, 30 aa, Artificial Sequence
  Description of Artificial Sequence: Synthetic polypeptide
DEEEIRTTNPVATEQYGSVITNMQRGVERI

SEQ ID NO: 9088 - protein, 29 aa, Artificial Sequence
  Description of Artificial Sequence: Synthetic peptide
DEEEIRTTNPVATEQYGSVITNQQGGIDR

SEQ ID NO: 9089 - protein, 28 aa, Artificial Sequence
  Description of Artificial Sequence: Synthetic peptide
DEEEIRTTNPVATEQYGSVITNTQQIER

SEQ ID NO: 9090 - protein, 30 aa, Artificial Sequence
  Description of Artificial Sequence: Synthetic polypeptide
DEEEIRTTNPVATEQYGSVITNTQRDNERA

SEQ ID NO: 9091 - protein, 29 aa, Artificial Sequence
  Description of Artificial Sequence: Synthetic peptide
DEEEIRTTNPVATEQYGSVVSTLLQELDR

SEQ ID NO: 9092 - protein, 28 aa, Artificial Sequence
  Description of Artificial Sequence: Synthetic peptide
DEAEIRTTNPVATEGYGSVSTVLQHGNA

SEQ ID NO: 9093 - protein, 31 aa, Artificial Sequence
  Description of Artificial Sequence: Synthetic polypeptide
DEEEIRTTNPVAYEHYGSVSTNLSQRVGNTR

SEQ ID NO: 9094 - protein, 31 aa, Artificial Sequence
  Description of Artificial Sequence: Synthetic polypeptide
DEEEIRTTNPVATEQYGSVVSTNAIQANGNR

SEQ ID NO: 9095 - protein, 29 aa, Artificial Sequence
  Description of Artificial Sequence: Synthetic peptide
DEEEIRTTNPVAYEHYGSVATNLQRGNAH

SEQ ID NO: 9096 - protein, 30 aa, Artificial Sequence
  Description of Artificial Sequence: Synthetic polypeptide
DEEEIRTTNPVATEQYGSVVSTNDQRGDQD

SEQ ID NO: 9097 - protein, 32 aa, Artificial Sequence
  Description of Artificial Sequence: Synthetic polypeptide
DEEEIRTTNPVATEQYGSVVSTNEIQRGTNRC

SEQ ID NO: 9098 - protein, 31 aa, Artificial Sequence
  Description of Artificial Sequence: Synthetic polypeptide
DEEEIRTTNPVATEQYGSVVSTNEIQYKGNR

SEQ ID NO: 9099 - protein, 31 aa, Artificial Sequence
  Description of Artificial Sequence: Synthetic polypeptide
DEEEIRTTNPVATEQYGSVVSTNELQTTLNR

SEQ ID NO: 9100 - protein, 31 aa, Artificial Sequence
  Description of Artificial Sequence: Synthetic polypeptide
DEEEIRTTNPVATEQYGSVVSTNELSHRGNQ

SEQ ID NO: 9101 - protein, 32 aa, Artificial Sequence
  Description of Artificial Sequence: Synthetic polypeptide
DEEEIRTTNPVATEQYGSVVSTNEQRDGDNSR

SEQ ID NO: 9102 - protein, 28 aa, Artificial Sequence
  Description of Artificial Sequence: Synthetic peptide
DEEEIATTNPVATEQWGQVSTNLQQGNM

SEQ ID NO: 9103 - protein, 31 aa, Artificial Sequence
  Description of Artificial Sequence: Synthetic polypeptide
DEEEIRTTNPVATEQYGSVVSTNEQRGNEDE

SEQ ID NO: 9104 - protein, 29 aa, Artificial Sequence
  Description of Artificial Sequence: Synthetic peptide
DEEEIRTTNPVATEQYGSVITTNEQGGND

SEQ ID NO: 9105 - protein, 32 aa, Artificial Sequence
  Description of Artificial Sequence: Synthetic polypeptide
DEEEIRTTNPVATEQYGSVVSTNLDQRGGNED

SEQ ID NO: 9106 - protein, 30 aa, Artificial Sequence
  Description of Artificial Sequence: Synthetic polypeptide
DEAEIRTTNPVATEEYGSVSTNLQRFGNQN

SEQ ID NO: 9107 - protein, 30 aa, Artificial Sequence
  Description of Artificial Sequence: Synthetic polypeptide
DEEEIRTTNPVAYEHYGSVSTGELSQRGNR

SEQ ID NO: 9108 - protein, 29 aa, Artificial Sequence
  Description of Artificial Sequence: Synthetic peptide
DEEEIRTTNPVAYEAYGSVWTNLSQRGNE

SEQ ID NO: 9109 - protein, 30 aa, Artificial Sequence
  Description of Artificial Sequence: Synthetic polypeptide
DEEEIRTTNPVATEQYGSVQPTGNLQRGVQ

SEQ ID NO: 9110 - protein, 31 aa, Artificial Sequence
  Description of Artificial Sequence: Synthetic polypeptide
DEEEIRTTNPVAYEPYGSVSTNLSQRGGNVR

SEQ ID NO: 9111 - protein, 29 aa, Artificial Sequence
  Description of Artificial Sequence: Synthetic peptide
DEEEIRTTNPVAYEQWGSVSINLSQDGNR

SEQ ID NO: 9112 - protein, 29 aa, Artificial Sequence
  Description of Artificial Sequence: Synthetic peptide
DEEEIRTTNPVATEQYGSVQPTTEQRGVR

SEQ ID NO: 9113 - protein, 32 aa, Artificial Sequence
  Description of Artificial Sequence: Synthetic polypeptide
DEEEIRTTNPVATEQYGSVVSNTNLQLRGENI

SEQ ID NO: 9114 - protein, 31 aa, Artificial Sequence
  Description of Artificial Sequence: Synthetic polypeptide
DEEEIRTTNPVATEQYGSVITHNLQRQGSER

SEQ ID NO: 9115 - protein, 30 aa, Artificial Sequence
  Description of Artificial Sequence: Synthetic polypeptide
DEEEIRTTNPVATEQYGSVITINMEQRGNN

SEQ ID NO: 9116 - protein, 29 aa, Artificial Sequence
  Description of Artificial Sequence: Synthetic peptide
DEEEIRTTNPVATEQYGSVITLLQRENQD

SEQ ID NO: 9117 - protein, 30 aa, Artificial Sequence
  Description of Artificial Sequence: Synthetic polypeptide
DEEEIRTTNPVATEQYGSVITNDQRDNVRS

SEQ ID NO: 9118 - protein, 30 aa, Artificial Sequence
  Description of Artificial Sequence: Synthetic polypeptide
DEEEIRTTNPVATEQYGSVQPTNLQTGNEA

SEQ ID NO: 9119 - protein, 30 aa, Artificial Sequence
  Description of Artificial Sequence: Synthetic polypeptide
DEEEIRTTNPVATEQYGSVVSPMLDQRGLR

SEQ ID NO: 9120 - protein, 30 aa, Artificial Sequence
  Description of Artificial Sequence: Synthetic polypeptide
DEEEIRTTNPVATEQYGSVITNLDQVGNQY

SEQ ID NO: 9121 - protein, 31 aa, Artificial Sequence
  Description of Artificial Sequence: Synthetic polypeptide
DEEEIRTTNPVATEQYGSVVSPTNLQDGGSR

SEQ ID NO: 9122 - protein, 30 aa, Artificial Sequence
  Description of Artificial Sequence: Synthetic polypeptide
DEEEIRTTNPVATEQYGSVITNLEQSEGVR

SEQ ID NO: 9123 - protein, 29 aa, Artificial Sequence
  Description of Artificial Sequence: Synthetic peptide
DEAEIRTTNPVATEIYGSVSTNLQGGGNS

SEQ ID NO: 9124 - protein, 31 aa, Artificial Sequence
  Description of Artificial Sequence: Synthetic polypeptide
DEEEIRTTNPVATEQYGSVITNLQRGVNETD

SEQ ID NO: 9125 - protein, 31 aa, Artificial Sequence
  Description of Artificial Sequence: Synthetic polypeptide
DEEEIRTTNPVATEQYGSVITNLGQERNGTR

SEQ ID NO: 9126 - protein, 30 aa, Artificial Sequence
  Description of Artificial Sequence: Synthetic polypeptide
DEEEIRTTNPVATEQYGSVITNLQDTGINQ

SEQ ID NO: 9127 - protein, 29 aa, Artificial Sequence
  Description of Artificial Sequence: Synthetic peptide
DEEEIRTTNPVATEQYGSVITNLQELNNP

SEQ ID NO: 9128 - protein, 28 aa, Artificial Sequence
  Description of Artificial Sequence: Synthetic peptide
DEEEIATTNPVATEQWGSVSENLQQGPR

SEQ ID NO: 9129 - protein, 30 aa, Artificial Sequence
  Description of Artificial Sequence: Synthetic polypeptide
DEAEIRTTNPVATEIYGSVSDTNLQGFGNR

SEQ ID NO: 9130 - protein, 30 aa, Artificial Sequence
  Description of Artificial Sequence: Synthetic polypeptide
DEEEIRTTNPVATEQYGSVITNLQRGDLAM

SEQ ID NO: 9131 - protein, 31 aa, Artificial Sequence
  Description of Artificial Sequence: Synthetic polypeptide
DEEEIRTTNPVATEQYGSVITNLQRGFNEDD

SEQ ID NO: 9132 - protein, 31 aa, Artificial Sequence
  Description of Artificial Sequence: Synthetic polypeptide
DEEEIRTTNPVATEQYGSVITNLQRGFNELV

SEQ ID NO: 9133 - protein, 31 aa, Artificial Sequence
  Description of Artificial Sequence: Synthetic polypeptide
DEEEIRTTNPVATEQYGSVITNLQRGFNLGE

SEQ ID NO: 9134 - protein, 31 aa, Artificial Sequence
  Description of Artificial Sequence: Synthetic polypeptide
DEEEIRTTNPVATEQYGSVITNLQRGFNTTG

SEQ ID NO: 9135 - protein, 29 aa, Artificial Sequence
  Description of Artificial Sequence: Synthetic peptide
DEEEIRTTNPVAYEPYGTVSTNTQRGTNR

SEQ ID NO: 9136 - protein, 29 aa, Artificial Sequence
  Description of Artificial Sequence: Synthetic peptide
DEAEIRTTNPVATEHYGSVSTNLQQMGNS

SEQ ID NO: 9137 - protein, 31 aa, Artificial Sequence
  Description of Artificial Sequence: Synthetic polypeptide
DEEEIRTTNPVATEQYGSVITNLQRGGNEGG

SEQ ID NO: 9138 - protein, 29 aa, Artificial Sequence
  Description of Artificial Sequence: Synthetic peptide
DEAEIRTTNPVATEHYGSVSTNLQLGGNE

SEQ ID NO: 9139 - protein, 29 aa, Artificial Sequence
  Description of Artificial Sequence: Synthetic peptide
DEEEIRTTNPVATEQYGSVITNLQDGSQG

SEQ ID NO: 9140 - protein, 30 aa, Artificial Sequence
  Description of Artificial Sequence: Synthetic polypeptide
DEAEIRTTNPVATEEYGSVSTNLQREGNAE

SEQ ID NO: 9141 - protein, 30 aa, Artificial Sequence
  Description of Artificial Sequence: Synthetic polypeptide
DEEEIRTTNPVATEQYGSVIVNLIQRENRE

SEQ ID NO: 9142 - protein, 30 aa, Artificial Sequence
  Description of Artificial Sequence: Synthetic polypeptide
DEEEIRTTNPVATEQYGSVQNTNLQRAEND

SEQ ID NO: 9143 - protein, 31 aa, Artificial Sequence
  Description of Artificial Sequence: Synthetic polypeptide
DEEEIRTTNPVAWEQYGSVSTGNLQRGSERM

SEQ ID NO: 9144 - protein, 29 aa, Artificial Sequence
  Description of Artificial Sequence: Synthetic peptide
DEEEIRTTNPVAWEQYGCVSTNMQHGNRQ

SEQ ID NO: 9145 - protein, 29 aa, Artificial Sequence
  Description of Artificial Sequence: Synthetic peptide
DEEEIRTTNPVATEQYGSVLTPTLQRNNQ

SEQ ID NO: 9146 - protein, 30 aa, Artificial Sequence
  Description of Artificial Sequence: Synthetic polypeptide
DEEEIRTTNPVATEQYGSVLTTNLQRSLNL

SEQ ID NO: 9147 - protein, 29 aa, Artificial Sequence
  Description of Artificial Sequence: Synthetic peptide
DEAEEIRCTNPVATEQYGSVATNLQGGNQ

SEQ ID NO: 9148 - protein, 28 aa, Artificial Sequence
  Description of Artificial Sequence: Synthetic peptide
DEAEIRTTNPVATEAYGSVSTVLQNGNM

SEQ ID NO: 9149 - protein, 30 aa, Artificial Sequence
  Description of Artificial Sequence: Synthetic polypeptide
DEAEIRTTNPVATEAYGSVSTNLQREGDHR

SEQ ID NO: 9150 - protein, 28 aa, Artificial Sequence
  Description of Artificial Sequence: Synthetic peptide
DEAEIRTTNPVATEAYGSVSNNLQRGTQ

SEQ ID NO: 9151 - protein, 29 aa, Artificial Sequence
  Description of Artificial Sequence: Synthetic peptide
DEEEIATTNPVATEPYGSVSTNLQSMGNH

SEQ ID NO: 9152 - protein, 29 aa, Artificial Sequence
  Description of Artificial Sequence: Synthetic peptide
DEEEIATTNPVATEPYGSVSTNGNQNGNR

SEQ ID NO: 9153 - protein, 32 aa, Artificial Sequence
  Description of Artificial Sequence: Synthetic polypeptide
DEEEIRTTNPVATEQYGSVVSYTGNLSGRGNR

SEQ ID NO: 9154 - protein, 30 aa, Artificial Sequence
  Description of Artificial Sequence: Synthetic polypeptide
DEEEIRTTNPVATEQYGSVVTAGQRGNERI

SEQ ID NO: 9155 - protein, 29 aa, Artificial Sequence
  Description of Artificial Sequence: Synthetic peptide
DEEEIATTNPVATEPYGSVSTNDQRGPNY

SEQ ID NO: 9156 - protein, 30 aa, Artificial Sequence
  Description of Artificial Sequence: Synthetic polypeptide
DEEEIRTTNPVATEQYGSVLTNLQRGLILE

SEQ ID NO: 9157 - protein, 30 aa, Artificial Sequence
  Description of Artificial Sequence: Synthetic polypeptide
DEEEIRTTNPVATEQYGSVVTALQRGENVQ

SEQ ID NO: 9158 - protein, 28 aa, Artificial Sequence
  Description of Artificial Sequence: Synthetic peptide
DEEEIATTNPVATEPYGSVSANLQHGNY

SEQ ID NO: 9159 - protein, 31 aa, Artificial Sequence
  Description of Artificial Sequence: Synthetic polypeptide
DEEEIRTTNPVATEQYGSVVTDNLQRGVNEF

SEQ ID NO: 9160 - protein, 31 aa, Artificial Sequence
  Description of Artificial Sequence: Synthetic polypeptide
DEEEIRTTNPVATEQYGSVMSTDQQRGNERV

SEQ ID NO: 9161 - protein, 29 aa, Artificial Sequence
  Description of Artificial Sequence: Synthetic peptide
DEEEIRTTNPVATEQYGSVVTGLQRGEDG

SEQ ID NO: 9162 - protein, 30 aa, Artificial Sequence
  Description of Artificial Sequence: Synthetic polypeptide
DEEEIRTTNPVATQQYGSVSTNLEFGSNRA

SEQ ID NO: 9163 - protein, 29 aa, Artificial Sequence
  Description of Artificial Sequence: Synthetic peptide
DEEEIRTTNPVATEQYGSVVTLLDQRENE

SEQ ID NO: 9164 - protein, 31 aa, Artificial Sequence
  Description of Artificial Sequence: Synthetic polypeptide
DEEEIRTTNPVATEQYGSVQCTNLQQGENRQ

SEQ ID NO: 9165 - protein, 29 aa, Artificial Sequence
  Description of Artificial Sequence: Synthetic peptide
DEEEIRTTNPVATEQYGSVVTMNQRGENV

SEQ ID NO: 9166 - protein, 30 aa, Artificial Sequence
  Description of Artificial Sequence: Synthetic polypeptide
DEEEIRTTNPVATEQYGSVVTNDQGRGEER

SEQ ID NO: 9167 - protein, 31 aa, Artificial Sequence
  Description of Artificial Sequence: Synthetic polypeptide
DEEEIRTTNPVATFQYGSVSDTNLQLPNGNR

SEQ ID NO: 9168 - protein, 32 aa, Artificial Sequence
  Description of Artificial Sequence: Synthetic polypeptide
DEEEIRTTNPVATEYYGSVSVTNLSQRGGNRL

SEQ ID NO: 9169 - protein, 30 aa, Artificial Sequence
  Description of Artificial Sequence: Synthetic polypeptide
DEEEIRTTNPVATEYYGSVSTNLQYGNNDI

SEQ ID NO: 9170 - protein, 30 aa, Artificial Sequence
  Description of Artificial Sequence: Synthetic polypeptide
DEEEIRTTNPVATEYYGSVSTNLQSMGNNE

SEQ ID NO: 9171 - protein, 28 aa, Artificial Sequence
  Description of Artificial Sequence: Synthetic peptide
DEEEIATTNPVATEPYGSVSCNLQQGND

SEQ ID NO: 9172 - protein, 30 aa, Artificial Sequence
  Description of Artificial Sequence: Synthetic polypeptide
DEEEIRTTNPVATEQYGSVQITNDQRGNSI

SEQ ID NO: 9173 - protein, 29 aa, Artificial Sequence
  Description of Artificial Sequence: Synthetic peptide
DEEEIRTTNPVATEQYGSVQLNNLQRDNV

SEQ ID NO: 9174 - protein, 32 aa, Artificial Sequence
  Description of Artificial Sequence: Synthetic polypeptide
DEEEIRTTNPVATEQYGSVVSTNYLDQRGDRD

SEQ ID NO: 9175 - protein, 30 aa, Artificial Sequence
  Description of Artificial Sequence: Synthetic polypeptide
DEEEIRTTNPVATEQYGSVIVWDNLQRGDR

SEQ ID NO: 9176 - protein, 30 aa, Artificial Sequence
  Description of Artificial Sequence: Synthetic polypeptide
DEEEIRTTNPVAYEAYGSVSTTPNLVRGNR

SEQ ID NO: 9177 - protein, 30 aa, Artificial Sequence
  Description of Artificial Sequence: Synthetic polypeptide
DEEEIRTTNPVAYEAYGSVSTNMLQRVGNS

SEQ ID NO: 9178 - protein, 28 aa, Artificial Sequence
  Description of Artificial Sequence: Synthetic peptide
DEEEIRTTNPVATEQYGSVQNNLERGLI

SEQ ID NO: 9179 - protein, 31 aa, Artificial Sequence
  Description of Artificial Sequence: Synthetic polypeptide
DEEEIRTTNPVATEQYGSVQLTNLQVGENRL

SEQ ID NO: 9180 - protein, 31 aa, Artificial Sequence
  Description of Artificial Sequence: Synthetic polypeptide
DEEEIRTTNPVAYEAYGSVSTANLQRGGENR

SEQ ID NO: 9181 - protein, 30 aa, Artificial Sequence
  Description of Artificial Sequence: Synthetic polypeptide
DEEEIRTTNPVATEQYGSVVSTNLNDGNTA

SEQ ID NO: 9182 - protein, 31 aa, Artificial Sequence
  Description of Artificial Sequence: Synthetic polypeptide
DEEEIRTTNPVATEQYGSVVSTNLQEDGNDE

SEQ ID NO: 9183 - protein, 30 aa, Artificial Sequence
  Description of Artificial Sequence: Synthetic polypeptide
DEEEIRTTNPVATEQYGSVLMTPLQRGNIL

SEQ ID NO: 9184 - protein, 31 aa, Artificial Sequence
  Description of Artificial Sequence: Synthetic polypeptide
DEEEIRTTNPVATEQYGSVVSTNLQMDSGER

SEQ ID NO: 9185 - protein, 31 aa, Artificial Sequence
  Description of Artificial Sequence: Synthetic polypeptide
DEEEIRTTNPVATEQYGSVVSTNLQMNGDRG

SEQ ID NO: 9186 - protein, 30 aa, Artificial Sequence
  Description of Artificial Sequence: Synthetic polypeptide
DEEEIRTTNPVATEQYGSVVSTNLSQHVNQ

SEQ ID NO: 9187 - protein, 29 aa, Artificial Sequence
  Description of Artificial Sequence: Synthetic peptide
DEEEIRTTNPVATEQYGSVLSNLQRGGLN

SEQ ID NO: 9188 - protein, 30 aa, Artificial Sequence
  Description of Artificial Sequence: Synthetic polypeptide
DEEEIRTTNPVATEQYGSVLSNNSLDRGER

SEQ ID NO: 9189 - protein, 31 aa, Artificial Sequence
  Description of Artificial Sequence: Synthetic polypeptide
DEEEIRTTNPVATEQYGSVVSTNLSQNEGNL

SEQ ID NO: 9190 - protein, 30 aa, Artificial Sequence
  Description of Artificial Sequence: Synthetic polypeptide
DEEEIRTTNPVATEQYGSVLSPMLEQRGVR

SEQ ID NO: 9191 - protein, 31 aa, Artificial Sequence
  Description of Artificial Sequence: Synthetic polypeptide
DEEEIRTTNPVATEQYGSVVSTNLSQTVGND

SEQ ID NO: 9192 - protein, 32 aa, Artificial Sequence
  Description of Artificial Sequence: Synthetic polypeptide
DEEEIRTTNPVATEQYGSVLSTMNLQQGSNRV

SEQ ID NO: 9193 - protein, 32 aa, Artificial Sequence
  Description of Artificial Sequence: Synthetic polypeptide
DEEEIRTTNPVATEQYGSVLSTNDLQRSGENG

SEQ ID NO: 9194 - protein, 31 aa, Artificial Sequence
  Description of Artificial Sequence: Synthetic polypeptide
DEEEIRTTNPVATEQYGSVVSTNMGQPNGNR

SEQ ID NO: 9195 - protein, 33 aa, Artificial Sequence
  Description of Artificial Sequence: Synthetic polypeptide
DEEEIRTTNPVATEQYGSVVSTNMLSQRTGNLR

SEQ ID NO: 9196 - protein, 32 aa, Artificial Sequence
  Description of Artificial Sequence: Synthetic polypeptide
DEEEIRTTNPVATEQYGSVVSTNNLQFGSNRF

SEQ ID NO: 9197 - protein, 30 aa, Artificial Sequence
  Description of Artificial Sequence: Synthetic polypeptide
DEEEIRTTNPVATEQYGSVQLTNDQRGNNM

SEQ ID NO: 9198 - protein, 32 aa, Artificial Sequence
  Description of Artificial Sequence: Synthetic polypeptide
DEEEIRTTNPVATEQYGSVLSTNNLQYGSNRN

SEQ ID NO: 9199 - protein, 31 aa, Artificial Sequence
  Description of Artificial Sequence: Synthetic polypeptide
DEEEIRTTNPVATEQYGSVVSTNSMQNGDNR

SEQ ID NO: 9200 - protein, 32 aa, Artificial Sequence
  Description of Artificial Sequence: Synthetic polypeptide
DEEEIRTTNPVATEQYGSVLSTNVLQREGEND

SEQ ID NO: 9201 - protein, 31 aa, Artificial Sequence
  Description of Artificial Sequence: Synthetic polypeptide
DEEEIRTTNPVATEQYGSVVSTNVQNGSNRF

SEQ ID NO: 9202 - protein, 29 aa, Artificial Sequence
  Description of Artificial Sequence: Synthetic peptide
DEEEIRTTNPVATEQYGSVLTNLIRINED

SEQ ID NO: 9203 - protein, 30 aa, Artificial Sequence
  Description of Artificial Sequence: Synthetic polypeptide
DEEEIRTTNPVAWEQYGVVSTNNQRIGNRP

SEQ ID NO: 9204 - protein, 29 aa, Artificial Sequence
  Description of Artificial Sequence: Synthetic peptide
DEEEIRTTNPVAYEQWGSVSTELQFGGNR

SEQ ID NO: 9205 - protein, 30 aa, Artificial Sequence
  Description of Artificial Sequence: Synthetic polypeptide
DEEEIRTTNPVATEQYGSVITENGQRGNMV

SEQ ID NO: 9206 - protein, 32 aa, Artificial Sequence
  Description of Artificial Sequence: Synthetic polypeptide
DEEEIRTTNPVATEQYGSVVSETNLQPRGEND

SEQ ID NO: 9207 - protein, 31 aa, Artificial Sequence
  Description of Artificial Sequence: Synthetic polypeptide
DEEEIRTTNPVATEQYGSVITDNLQHGENRG

SEQ ID NO: 9208 - protein, 30 aa, Artificial Sequence
  Description of Artificial Sequence: Synthetic polypeptide
DEEEIATTNPVATEQYGCVSTNLQPMGMNR

SEQ ID NO: 9209 - protein, 30 aa, Artificial Sequence
  Description of Artificial Sequence: Synthetic polypeptide
DEEEIATTNPVATEQYGCVSTNLQPMGDNR

SEQ ID NO: 9210 - protein, 30 aa, Artificial Sequence
  Description of Artificial Sequence: Synthetic polypeptide
DEEEIRTTNPVATEQYGSVTTNTGQGGINR

SEQ ID NO: 9211 - protein, 29 aa, Artificial Sequence
  Description of Artificial Sequence: Synthetic peptide
DEEEIRTTNPVATEQYGSVTTNVDRGEIR

SEQ ID NO: 9212 - protein, 29 aa, Artificial Sequence
  Description of Artificial Sequence: Synthetic peptide
DEEEIRTTNPVATEQYGSVTTPLQNFGER

SEQ ID NO: 9213 - protein, 29 aa, Artificial Sequence
  Description of Artificial Sequence: Synthetic peptide
DEEEIRTTNPVATEQYGSVTTPLQPNGER

SEQ ID NO: 9214 - protein, 29 aa, Artificial Sequence
  Description of Artificial Sequence: Synthetic peptide
DEEEIRTTNPVATEQYGSVTTPNLQRNEN

SEQ ID NO: 9215 - protein, 31 aa, Artificial Sequence
  Description of Artificial Sequence: Synthetic polypeptide
DEEEIRTTNPVATEQYGSVTTQDLQREGNER

SEQ ID NO: 9216 - protein, 29 aa, Artificial Sequence
  Description of Artificial Sequence: Synthetic peptide
DEEEIRTTNPVATEQYGSVTTQLQRGEDM

SEQ ID NO: 9217 - protein, 31 aa, Artificial Sequence
  Description of Artificial Sequence: Synthetic polypeptide
DEEEIRTTNPVATEQYGSVTTTNLQRGGNEN

SEQ ID NO: 9218 - protein, 31 aa, Artificial Sequence
  Description of Artificial Sequence: Synthetic polypeptide
DEEEIRTTNPVATEQYGSVTTTNLQRGNNEQ

SEQ ID NO: 9219 - protein, 32 aa, Artificial Sequence
  Description of Artificial Sequence: Synthetic polypeptide
DEEEIRTTNPVATEQYGSVQSTNLQNGDDNDR

SEQ ID NO: 9220 - protein, 30 aa, Artificial Sequence
  Description of Artificial Sequence: Synthetic polypeptide
DEEEIRTTNPVATEQYGSVTVSFNLQRDNI

SEQ ID NO: 9221 - protein, 31 aa, Artificial Sequence
  Description of Artificial Sequence: Synthetic polypeptide
DEEEIRTTNPVATEQYGSVISGTTNLQEGNE

SEQ ID NO: 9222 - protein, 29 aa, Artificial Sequence
  Description of Artificial Sequence: Synthetic peptide
DEEEIRTTNPVATEQYGSVQSTNLQEEAQ

SEQ ID NO: 9223 - protein, 29 aa, Artificial Sequence
  Description of Artificial Sequence: Synthetic peptide
DEEEIATTNPVATEQYGCVCSTNLQYLNR

SEQ ID NO: 9224 - protein, 31 aa, Artificial Sequence
  Description of Artificial Sequence: Synthetic polypeptide
DEEEIRTTNPVATEQYGSVISMTNLQRGIQT

SEQ ID NO: 9225 - protein, 28 aa, Artificial Sequence
  Description of Artificial Sequence: Synthetic peptide
DEEEIRTTNPVATEQYGSVISNIQRGEQ

SEQ ID NO: 9226 - protein, 31 aa, Artificial Sequence
  Description of Artificial Sequence: Synthetic polypeptide
DEEEIRTTNPVATEQYGSVISNTTNLQRGSI

SEQ ID NO: 9227 - protein, 31 aa, Artificial Sequence
  Description of Artificial Sequence: Synthetic polypeptide
DEEEIRTTNPVATEQYGSVTWTDNLQRGDRI

SEQ ID NO: 9228 - protein, 30 aa, Artificial Sequence
  Description of Artificial Sequence: Synthetic polypeptide
DEEEIRTTNPVATEQYGSVQSTNHQGGNFF

SEQ ID NO: 9229 - protein, 28 aa, Artificial Sequence
  Description of Artificial Sequence: Synthetic peptide
DEAEIRTTNPVATEQYGAVSTNLQHGPT

SEQ ID NO: 9230 - protein, 31 aa, Artificial Sequence
  Description of Artificial Sequence: Synthetic polypeptide
DEEEIRTTNPVATEQYGSVQSTNDLQNGNNN

SEQ ID NO: 9231 - protein, 32 aa, Artificial Sequence
  Description of Artificial Sequence: Synthetic polypeptide
DEEEIRTTNPVATEQYGSVQSTNDLDRGFNRI

SEQ ID NO: 9232 - protein, 31 aa, Artificial Sequence
  Description of Artificial Sequence: Synthetic polypeptide
DEEEIRTTNPVATEQYGSVQSTINVLQNGER

SEQ ID NO: 9233 - protein, 30 aa, Artificial Sequence
  Description of Artificial Sequence: Synthetic polypeptide
DEEEIRTTNPVATEQYGSVVGSTVLQDGNF

SEQ ID NO: 9234 - protein, 32 aa, Artificial Sequence
  Description of Artificial Sequence: Synthetic polypeptide
DEEEIRTTNPVATEQYGSVQSTELQRGLNQRV

SEQ ID NO: 9235 - protein, 30 aa, Artificial Sequence
  Description of Artificial Sequence: Synthetic polypeptide
DEEEIRTTNPVATEQYGSVISSNLQGGNQV

SEQ ID NO: 9236 - protein, 32 aa, Artificial Sequence
  Description of Artificial Sequence: Synthetic polypeptide
DEEEIRTTNPVATEQYGSVISITNLQRNNERD

SEQ ID NO: 9237 - protein, 30 aa, Artificial Sequence
  Description of Artificial Sequence: Synthetic polypeptide
DEEEIRTTNPVATEQYGSVTTNLQLEGNND

SEQ ID NO: 9238 - protein, 30 aa, Artificial Sequence
  Description of Artificial Sequence: Synthetic polypeptide
DEEEIRTTNPVATEQYGSVTTNLQGEGGNG

SEQ ID NO: 9239 - protein, 30 aa, Artificial Sequence
  Description of Artificial Sequence: Synthetic polypeptide
DEEEIRTTNPVATEQYGSVTTNLQGDGENQ

SEQ ID NO: 9240 - protein, 30 aa, Artificial Sequence
  Description of Artificial Sequence: Synthetic polypeptide
DEEEIRTTNPVATEQYGSVIGTNLERNNRQ

SEQ ID NO: 9241 - protein, 28 aa, Artificial Sequence
  Description of Artificial Sequence: Synthetic peptide
DEEEIRTTNPVATEQYGSVTTDLQRQEM

SEQ ID NO: 9242 - protein, 30 aa, Artificial Sequence
  Description of Artificial Sequence: Synthetic polypeptide
DEEEIRTTNPVATEQYGSVQSTNNQRETRQ

SEQ ID NO: 9243 - protein, 29 aa, Artificial Sequence
  Description of Artificial Sequence: Synthetic peptide
DEEEIRTTNPVATEQYGSVQSTNLQTEDD

SEQ ID NO: 9244 - protein, 30 aa, Artificial Sequence
  Description of Artificial Sequence: Synthetic polypeptide
DEEEIRTTNPVATEQYGSVQSTNLQSQNIE

SEQ ID NO: 9245 - protein, 30 aa, Artificial Sequence
  Description of Artificial Sequence: Synthetic polypeptide
DEEEIRTTNPVATEQYGSVTTGLQVGNERM

SEQ ID NO: 9246 - protein, 30 aa, Artificial Sequence
  Description of Artificial Sequence: Synthetic polypeptide
DEEEIRTTNPVATEQYGSVILTNLQQQGER

SEQ ID NO: 9247 - protein, 29 aa, Artificial Sequence
  Description of Artificial Sequence: Synthetic peptide
DEEEIRTTNPVATEQYGSVTTLLQRINEE

SEQ ID NO: 9248 - protein, 30 aa, Artificial Sequence
  Description of Artificial Sequence: Synthetic polypeptide
DEEEIRTTNPVATEQYGSVILTNLQRPGGF

SEQ ID NO: 9249 - protein, 31 aa, Artificial Sequence
  Description of Artificial Sequence: Synthetic polypeptide
DEEEIRTTNPVATEQYGSVILTNLTRGNGRN

SEQ ID NO: 9250 - protein, 30 aa, Artificial Sequence
  Description of Artificial Sequence: Synthetic polypeptide
DEEEIRTTNPVATEQYGSVTTNDQPRGQDR

SEQ ID NO: 9251 - protein, 29 aa, Artificial Sequence
  Description of Artificial Sequence: Synthetic peptide
DEEEIRTTNPVATEQYGSVTTNHIDGNRG

SEQ ID NO: 9252 - protein, 30 aa, Artificial Sequence
  Description of Artificial Sequence: Synthetic polypeptide
DEEEIRTTNPVATEQYGSVIMNTLQRGENT

SEQ ID NO: 9253 - protein, 29 aa, Artificial Sequence
  Description of Artificial Sequence: Synthetic peptide
DEEEIRTTNPVATEQYGSVINGLQRGNID

SEQ ID NO: 9254 - protein, 30 aa, Artificial Sequence
  Description of Artificial Sequence: Synthetic polypeptide
DEEEIRTTNPVATEQYGSVINNLEQRENRQ

SEQ ID NO: 9255 - protein, 31 aa, Artificial Sequence
  Description of Artificial Sequence: Synthetic polypeptide
DEEEIRTTNPVATEQYGSVINTDLQRGNVRE

SEQ ID NO: 9256 - protein, 30 aa, Artificial Sequence
  Description of Artificial Sequence: Synthetic polypeptide
DEEEIRTTNPVATEQYGSVIPEMLQARGNR

SEQ ID NO: 9257 - protein, 30 aa, Artificial Sequence
  Description of Artificial Sequence: Synthetic polypeptide
DEEEIRTTNPVATEQYGSVTTNLERDENER

SEQ ID NO: 9258 - protein, 30 aa, Artificial Sequence
  Description of Artificial Sequence: Synthetic polypeptide
DEEEIRTTNPVAYEQYGQVSTNLSQTEGNR

SEQ ID NO: 9259 - protein, 29 aa, Artificial Sequence
  Description of Artificial Sequence: Synthetic peptide
DEEEIRTTNPVATEQYGSVTTNLERGQEN

SEQ ID NO: 9260 - protein, 28 aa, Artificial Sequence
  Description of Artificial Sequence: Synthetic peptide
DEEEIRTTNPVATEQYGSVTTNLERTTE

SEQ ID NO: 9261 - protein, 31 aa, Artificial Sequence
  Description of Artificial Sequence: Synthetic polypeptide
DEEEIRTTNPVATEQYGSVIPPTNLQRGERD

SEQ ID NO: 9262 - protein, 30 aa, Artificial Sequence
  Description of Artificial Sequence: Synthetic polypeptide
DEEEIRTTNPVATEQYGSVIQTNLERVNRD

SEQ ID NO: 9263 - protein, 31 aa, Artificial Sequence
  Description of Artificial Sequence: Synthetic polypeptide
DEEEIRTTNPVATEQYGSVIQTNLQRGNNFE

SEQ ID NO: 9264 - protein, 31 aa, Artificial Sequence
  Description of Artificial Sequence: Synthetic polypeptide
DEEEIRTTNPVATEQYGSVIQTNLQRGVNPQ

SEQ ID NO: 9265 - protein, 29 aa, Artificial Sequence
  Description of Artificial Sequence: Synthetic peptide
DEEEIRTTNPVATEQYGSVISANLTRGEE

SEQ ID NO: 9266 - protein, 33 aa, Artificial Sequence
  Description of Artificial Sequence: Synthetic polypeptide
DEEEIRTTNPVATEQYGSVISCTNMLQRIGNER

SEQ ID NO: 9267 - protein, 30 aa, Artificial Sequence
  Description of Artificial Sequence: Synthetic polypeptide
DEEEIRTTNPVATEQYGSVISEDGLQRGND

SEQ ID NO: 9268 - protein, 30 aa, Artificial Sequence
  Description of Artificial Sequence: Synthetic polypeptide
DEEEIRTTNPVATEQYGSVTTNLQEGGDDR

SEQ ID NO: 9269 - protein, 30 aa, Artificial Sequence
  Description of Artificial Sequence: Synthetic polypeptide
DEEEIRTTNPVATEQYGSVISSNLQQGNEI

SEQ ID NO: 9270 - protein, 30 aa, Artificial Sequence
  Description of Artificial Sequence: Synthetic polypeptide
DEAEIRTTNPVATEQYGNVSTNLQRGQERD

SEQ ID NO: 9271 - protein, 30 aa, Artificial Sequence
  Description of Artificial Sequence: Synthetic polypeptide
DEEEIRTTNPVATEQYGSVVGTNLDQTGNP

SEQ ID NO: 9272 - protein, 33 aa, Artificial Sequence
  Description of Artificial Sequence: Synthetic polypeptide
DEEEIRTTNPVATEQYGSVISSTNLQRVGENNR

SEQ ID NO: 9273 - protein, 30 aa, Artificial Sequence
  Description of Artificial Sequence: Synthetic polypeptide
DEEEIRTTNPVATEQYGSVISTNLTNFGNI

SEQ ID NO: 9274 - protein, 30 aa, Artificial Sequence
  Description of Artificial Sequence: Synthetic polypeptide
DEEEIRTTNPVATEQYGSVISTNMQRENNT

SEQ ID NO: 9275 - protein, 31 aa, Artificial Sequence
  Description of Artificial Sequence: Synthetic polypeptide
DEEEIRTTNPVATEQYGSVISTNNDQRGNTQ

SEQ ID NO: 9276 - protein, 31 aa, Artificial Sequence
  Description of Artificial Sequence: Synthetic polypeptide
DEEEIRTTNPVAYEQYGETVTSTNLQRVGNR

SEQ ID NO: 9277 - protein, 30 aa, Artificial Sequence
  Description of Artificial Sequence: Synthetic polypeptide
DEEEIRTTNPVAYEQYGCVSTNLSQRGSNA

SEQ ID NO: 9278 - protein, 30 aa, Artificial Sequence
  Description of Artificial Sequence: Synthetic polypeptide
DEEEIRTTNPVATEQYGSVISTNNQRGDQS

SEQ ID NO: 9279 - protein, 30 aa, Artificial Sequence
  Description of Artificial Sequence: Synthetic polypeptide
DEEEIRTTNPVATEQYGSVISTNQQNAGNI

SEQ ID NO: 9280 - protein, 31 aa, Artificial Sequence
  Description of Artificial Sequence: Synthetic polypeptide
DEEEIRTTNPVATEQYGSVVQSCTNLQTGNV

SEQ ID NO: 9281 - protein, 31 aa, Artificial Sequence
  Description of Artificial Sequence: Synthetic polypeptide
DEEEIRTTNPVATEQYGSVISTPNLQDGNIA

SEQ ID NO: 9282 - protein, 31 aa, Artificial Sequence
  Description of Artificial Sequence: Synthetic polypeptide
DEEEIRTTNPVATEQYGSVQQTNLQRGNNMG

SEQ ID NO: 9283 - protein, 30 aa, Artificial Sequence
  Description of Artificial Sequence: Synthetic polypeptide
DEEEIATTNPVATEQWGSVSTNLQQGNIRQ

SEQ ID NO: 9284 - protein, 30 aa, Artificial Sequence
  Description of Artificial Sequence: Synthetic polypeptide
DEEEIATTNPVATEQWGSVSTNLQGGNTRQ

SEQ ID NO: 9285 - protein, 28 aa, Artificial Sequence
  Description of Artificial Sequence: Synthetic peptide
DEEEIATTNPVATEQWGSVSTNIQRGDA

SEQ ID NO: 9286 - protein, 30 aa, Artificial Sequence
  Description of Artificial Sequence: Synthetic polypeptide
DEEEIRTTNPVATEQYGSVISTNLQVENIE

SEQ ID NO: 9287 - protein, 31 aa, Artificial Sequence
  Description of Artificial Sequence: Synthetic polypeptide
DEEEIATTNPVATEQWGSVSTNELSQRQGNR

SEQ ID NO: 9288 - protein, 30 aa, Artificial Sequence
  Description of Artificial Sequence: Synthetic polypeptide
DEAEIRTTNPVATEPYGSVSTNLNQDEGNR

SEQ ID NO: 9289 - protein, 31 aa, Artificial Sequence
  Description of Artificial Sequence: Synthetic polypeptide
DEEEIRTTNPVATEQYGSVISTQLQRFGEDR

SEQ ID NO: 9290 - protein, 31 aa, Artificial Sequence
  Description of Artificial Sequence: Synthetic polypeptide
DEEEIRTTNPVATEQYGSVQQTNLQEGQNRL

SEQ ID NO: 9291 - protein, 31 aa, Artificial Sequence
  Description of Artificial Sequence: Synthetic polypeptide
DEEEIRTTNPVATEQYGSVISTRNDLQNGER

SEQ ID NO: 9292 - protein, 32 aa, Artificial Sequence
  Description of Artificial Sequence: Synthetic polypeptide
DEEEIRTTNPVATEQYGSVVSCSNLSQRVGNR

SEQ ID NO: 9293 - protein, 32 aa, Artificial Sequence
  Description of Artificial Sequence: Synthetic polypeptide
DEEEIRTTNPVATEQYGSVVSCTHLAQRVGNR

SEQ ID NO: 9294 - protein, 31 aa, Artificial Sequence
  Description of Artificial Sequence: Synthetic polypeptide
DEEEIRTTNPVATEQYGSVISTTNLQRGIGQ

SEQ ID NO: 9295 - protein, 30 aa, Artificial Sequence
  Description of Artificial Sequence: Synthetic polypeptide
DEEEIRTTNPVATEQYGSVISTVLQNGNFD

SEQ ID NO: 9296 - protein, 31 aa, Artificial Sequence
  Description of Artificial Sequence: Synthetic polypeptide
DEEEIRTTNPVATEQYGSVISTVLQQGNQRQ

SEQ ID NO: 9297 - protein, 32 aa, Artificial Sequence
  Description of Artificial Sequence: Synthetic polypeptide
DEEEIRTTNPVATEQYGSVVSCTNLDQTVGNR

SEQ ID NO: 9298 - protein, 31 aa, Artificial Sequence
  Description of Artificial Sequence: Synthetic polypeptide
DEEEIRTTNPVATEQYGSVVSCTNLQTVGDR

SEQ ID NO: 9299 - protein, 31 aa, Artificial Sequence
  Description of Artificial Sequence: Synthetic polypeptide
DEEEIRTTNPVATEQYGSVISTYLQRGNTQN

SEQ ID NO: 9300 - protein, 29 aa, Artificial Sequence
  Description of Artificial Sequence: Synthetic peptide
DEEEIRTTNPVATEQYGSVITANEQSGNF

SEQ ID NO: 9301 - protein, 30 aa, Artificial Sequence
  Description of Artificial Sequence: Synthetic polypeptide
DEEEIATTNPVATEQWGSVSTDNLQNGNQR

SEQ ID NO: 9302 - protein, 31 aa, Artificial Sequence
  Description of Artificial Sequence: Synthetic polypeptide
DEEEIRTTNPVATEQYGSVISTNLQTGMNTV

SEQ ID NO: 9303 - protein, 30 aa, Artificial Sequence
  Description of Artificial Sequence: Synthetic polypeptide
DEEEIRTTNPVATEQYGSVQSMNDQRGEGR

SEQ ID NO: 9304 - protein, 32 aa, Artificial Sequence
  Description of Artificial Sequence: Synthetic polypeptide
DEEEIRTTNPVATEQYGSVISTNLQIEGNNER

SEQ ID NO: 9305 - protein, 32 aa, Artificial Sequence
  Description of Artificial Sequence: Synthetic polypeptide
DEEEIRTTNPVATEQYGSVQSTDMLQRGNERG

SEQ ID NO: 9306 - protein, 31 aa, Artificial Sequence
  Description of Artificial Sequence: Synthetic polypeptide
DEEEIRTTNPVATEQYGSVISTALQLGNGRQ

SEQ ID NO: 9307 - protein, 30 aa, Artificial Sequence
  Description of Artificial Sequence: Synthetic polypeptide
DEAEIRTTNPVATEQWGEVSTNLQRDGNQR

SEQ ID NO: 9308 - protein, 30 aa, Artificial Sequence
  Description of Artificial Sequence: Synthetic polypeptide
DEEEIRTTNPVATEQYGSVISTDLTQRGEV

SEQ ID NO: 9309 - protein, 31 aa, Artificial Sequence
  Description of Artificial Sequence: Synthetic polypeptide
DEEEIRTTNPVATEQYGSVISTDNVLQNGER

SEQ ID NO: 9310 - protein, 31 aa, Artificial Sequence
  Description of Artificial Sequence: Synthetic polypeptide
DEEEIRTTNPVATEQYGSVVMPTNLQRGLRQ

SEQ ID NO: 9311 - protein, 31 aa, Artificial Sequence
  Description of Artificial Sequence: Synthetic polypeptide
DEEEIRTTNPVATEQYGSVISTELQRGNIQN

SEQ ID NO: 9312 - protein, 31 aa, Artificial Sequence
  Description of Artificial Sequence: Synthetic polypeptide
DEEEIRTTNPVATEQYGSVISTFLQRGNFNN

SEQ ID NO: 9313 - protein, 31 aa, Artificial Sequence
  Description of Artificial Sequence: Synthetic polypeptide
DEEEIRTTNPVATEQYGSVISTGNLQDGNGD

SEQ ID NO: 9314 - protein, 32 aa, Artificial Sequence
  Description of Artificial Sequence: Synthetic polypeptide
DEEEIRTTNPVATEQYGSVISTGNLQRGNTIE

SEQ ID NO: 9315 - protein, 31 aa, Artificial Sequence
  Description of Artificial Sequence: Synthetic polypeptide
DEEEIRTTNPVATEQYGSVISTLLQTGNQRI

SEQ ID NO: 9316 - protein, 30 aa, Artificial Sequence
  Description of Artificial Sequence: Synthetic polypeptide
DEEEIRTTNPVATEQYGSVISTNDQAIGNM

SEQ ID NO: 9317 - protein, 31 aa, Artificial Sequence
  Description of Artificial Sequence: Synthetic polypeptide
DEEEIRTTNPVATEQYGSVISTNDQRGFNHN

SEQ ID NO: 9318 - protein, 30 aa, Artificial Sequence
  Description of Artificial Sequence: Synthetic polypeptide
DEEEIRTTNPVATEQYGSVISTNEQGGGNV

SEQ ID NO: 9319 - protein, 30 aa, Artificial Sequence
  Description of Artificial Sequence: Synthetic polypeptide
DEEEIRTTNPVATEQYGSVISTNEQRTERQ

SEQ ID NO: 9320 - protein, 30 aa, Artificial Sequence
  Description of Artificial Sequence: Synthetic polypeptide
DEEEIRTTNPVATEQYGSVISTNGQRENAI

SEQ ID NO: 9321 - protein, 29 aa, Artificial Sequence
  Description of Artificial Sequence: Synthetic peptide
DEEEIRTTNPVATEQYGSVISTNGQRVVQ

SEQ ID NO: 9322 - protein, 30 aa, Artificial Sequence
  Description of Artificial Sequence: Synthetic polypeptide
DEEEIRTTNPVATEQYGSVISTNHQRLNAT

SEQ ID NO: 9323 - protein, 30 aa, Artificial Sequence
  Description of Artificial Sequence: Synthetic polypeptide
DEEEIRTTNPVATEQYGSVISTNLEELGND

SEQ ID NO: 9324 - protein, 31 aa, Artificial Sequence
  Description of Artificial Sequence: Synthetic polypeptide
DEEEIRTTNPVATEQYGSVISTNLERGNNEM

SEQ ID NO: 9325 - protein, 30 aa, Artificial Sequence
  Description of Artificial Sequence: Synthetic polypeptide
DEEEIRTTNPVATEQYGSVISTNLFEGNTT

SEQ ID NO: 9326 - protein, 30 aa, Artificial Sequence
  Description of Artificial Sequence: Synthetic polypeptide
DEEEIRTTNPVATEQYGSVISTNLFESGND

SEQ ID NO: 9327 - protein, 29 aa, Artificial Sequence
  Description of Artificial Sequence: Synthetic peptide
DEEEIATTNPVATEQYGAVSTNWQGGNER

SEQ ID NO: 9328 - protein, 29 aa, Artificial Sequence
  Description of Artificial Sequence: Synthetic peptide
DDTEIRTTNPVATEQYGSVSTNSLQYGDR

SEQ ID NO: 9329 - protein, 29 aa, Artificial Sequence
  Description of Artificial Sequence: Synthetic peptide
DEEEIATTNPVATEQYGAVSTNTQDGNTR

SEQ ID NO: 9330 - protein, 29 aa, Artificial Sequence
  Description of Artificial Sequence: Synthetic peptide
DEEEIATTNPVATEQYGAVSTNGQPGNAR

SEQ ID NO: 9331 - protein, 30 aa, Artificial Sequence
  Description of Artificial Sequence: Synthetic polypeptide
DEEEIRTTNPVATEQYGSVISTNLIRGFPV

SEQ ID NO: 9332 - protein, 30 aa, Artificial Sequence
  Description of Artificial Sequence: Synthetic polypeptide
DEEEIRTTNPVAYEQYGKVSTYLQERGGNR

SEQ ID NO: 9333 - protein, 31 aa, Artificial Sequence
  Description of Artificial Sequence: Synthetic polypeptide
DEEEIRTTNPVATEQYGSVQSMTNHQRGNQA

SEQ ID NO: 9334 - protein, 30 aa, Artificial Sequence
  Description of Artificial Sequence: Synthetic polypeptide
DEEEIRTTNPVATEQYGSVVGTNLNQNGNT

SEQ ID NO: 9335 - protein, 30 aa, Artificial Sequence
  Description of Artificial Sequence: Synthetic polypeptide
DEVEIRTTNPVATEQYGSVSTNLQIGDGNP

SEQ ID NO: 9336 - protein, 31 aa, Artificial Sequence
  Description of Artificial Sequence: Synthetic polypeptide
DEEEIATTNPVATEQYGSVSTGNLDQRGQNS

SEQ ID NO: 9337 - protein, 30 aa, Artificial Sequence
  Description of Artificial Sequence: Synthetic polypeptide
DEHEIRTTNPVATENYGSVSTNLQTGGNER

SEQ ID NO: 9338 - protein, 30 aa, Artificial Sequence
  Description of Artificial Sequence: Synthetic polypeptide
DESEIRTTNPVATEAYGSVSTNHQRVGNNR

SEQ ID NO: 9339 - protein, 29 aa, Artificial Sequence
  Description of Artificial Sequence: Synthetic peptide
DEEEICTTNPVATEQYGSVCTNHQERGNE

SEQ ID NO: 9340 - protein, 31 aa, Artificial Sequence
  Description of Artificial Sequence: Synthetic polypeptide
DEEEICTTNPVATEQYGSVCSTPNLQDGNER

SEQ ID NO: 9341 - protein, 31 aa, Artificial Sequence
  Description of Artificial Sequence: Synthetic polypeptide
DEEEICTTNPVATEQYGSVCSTNLQRFGSNG

SEQ ID NO: 9342 - protein, 29 aa, Artificial Sequence
  Description of Artificial Sequence: Synthetic peptide
DEEEIRTTNPVATEQYGSVSTPNLERIQF

SEQ ID NO: 9343 - protein, 31 aa, Artificial Sequence
  Description of Artificial Sequence: Synthetic polypeptide
DEEEICTTNPVATEQYGSVCSTNGLQERGNE

SEQ ID NO: 9344 - protein, 30 aa, Artificial Sequence
  Description of Artificial Sequence: Synthetic polypeptide
DEEEIRTTNPVATEQYGSVSTPNLFEAGNA

SEQ ID NO: 9345 - protein, 28 aa, Artificial Sequence
  Description of Artificial Sequence: Synthetic peptide
DESEIRTTNPVATDVYGSVSTNLQRANM

SEQ ID NO: 9346 - protein, 31 aa, Artificial Sequence
  Description of Artificial Sequence: Synthetic polypeptide
DEEEIRTTNPVATEQYGSVSETNLQDTGNGD

SEQ ID NO: 9347 - protein, 30 aa, Artificial Sequence
  Description of Artificial Sequence: Synthetic polypeptide
DEEEIRTTNPVATEQYGSVSETNLQASGDQ

SEQ ID NO: 9348 - protein, 29 aa, Artificial Sequence
  Description of Artificial Sequence: Synthetic peptide
DESEIRTTNPVATDSYGSVSTNLQRGTND

SEQ ID NO: 9349 - protein, 29 aa, Artificial Sequence
  Description of Artificial Sequence: Synthetic peptide
DEEEICTTNPVATEQYGSVCATNLQQPNR

SEQ ID NO: 9350 - protein, 31 aa, Artificial Sequence
  Description of Artificial Sequence: Synthetic polypeptide
DEEEIRTTNPVATEQYGSVSETNLQAGLQRQ

SEQ ID NO: 9351 - protein, 30 aa, Artificial Sequence
  Description of Artificial Sequence: Synthetic polypeptide
DESEIRTTNPVATEAYGSVSTNLQMDGNNR

SEQ ID NO: 9352 - protein, 32 aa, Artificial Sequence
  Description of Artificial Sequence: Synthetic polypeptide
DEEEIRTTNPVATEQYGSTVVSTNLFRGGNNR

SEQ ID NO: 9353 - protein, 28 aa, Artificial Sequence
  Description of Artificial Sequence: Synthetic peptide
DESEIRTTNPVATDQYGSVNTQLQRGNA

SEQ ID NO: 9354 - protein, 29 aa, Artificial Sequence
  Description of Artificial Sequence: Synthetic peptide
DEEEICTTNPVATEQYGSVATNLQSGNPV

SEQ ID NO: 9355 - protein, 30 aa, Artificial Sequence
  Description of Artificial Sequence: Synthetic polypeptide
DEEEIRTTNPVATEQYGSVSTPNLFQNDNP

SEQ ID NO: 9356 - protein, 30 aa, Artificial Sequence
  Description of Artificial Sequence: Synthetic polypeptide
DEEEICTTNPVATEQYGSVATNLQRSNDRQ

SEQ ID NO: 9357 - protein, 30 aa, Artificial Sequence
  Description of Artificial Sequence: Synthetic polypeptide
DEEEIRTTNPVATEQYGSVSETNLIIGNEN

SEQ ID NO: 9358 - protein, 28 aa, Artificial Sequence
  Description of Artificial Sequence: Synthetic peptide
DESEIRTTNPVATDQYGIVSTNLERGNP

SEQ ID NO: 9359 - protein, 28 aa, Artificial Sequence
  Description of Artificial Sequence: Synthetic peptide
DESEIRTTNPVATDHYGSVSTNLQRSNS

SEQ ID NO: 9360 - protein, 31 aa, Artificial Sequence
  Description of Artificial Sequence: Synthetic polypeptide
DEEEIRTTNPVATEQYGSVSETNLEDEGENR

SEQ ID NO: 9361 - protein, 30 aa, Artificial Sequence
  Description of Artificial Sequence: Synthetic polypeptide
DEEEICTTNPVATEQYGSVATNLQRNNLRE

SEQ ID NO: 9362 - protein, 28 aa, Artificial Sequence
  Description of Artificial Sequence: Synthetic peptide
DESEIRTTNPVATCHYGSVSTNLQRVNM

SEQ ID NO: 9363 - protein, 30 aa, Artificial Sequence
  Description of Artificial Sequence: Synthetic polypeptide
DEEEICTTNPVATEQYGSVATNLQRENHRA

SEQ ID NO: 9364 - protein, 28 aa, Artificial Sequence
  Description of Artificial Sequence: Synthetic peptide
DESEIRTTNPVATCEYGSVSTNLQRTNA

SEQ ID NO: 9365 - protein, 28 aa, Artificial Sequence
  Description of Artificial Sequence: Synthetic peptide
DESEIRTTNPVATAPYGSVSTNLQRTNM

SEQ ID NO: 9366 - protein, 28 aa, Artificial Sequence
  Description of Artificial Sequence: Synthetic peptide
DESEIRTTNPVATDQYGSVYTQLQRGND

SEQ ID NO: 9367 - protein, 29 aa, Artificial Sequence
  Description of Artificial Sequence: Synthetic peptide
DEEEICTTNPVATEQYGSVATNLQMGNTE

SEQ ID NO: 9368 - protein, 29 aa, Artificial Sequence
  Description of Artificial Sequence: Synthetic peptide
DESEIRTTNPVATEAYGSVSTNLQTEGNV

SEQ ID NO: 9369 - protein, 29 aa, Artificial Sequence
  Description of Artificial Sequence: Synthetic peptide
DEEEICTTNPVATEQYGSVPTNEQDRGNE

SEQ ID NO: 9370 - protein, 28 aa, Artificial Sequence
  Description of Artificial Sequence: Synthetic peptide
DEEEICTTNPVATEQYGSVSTNDQHADR

SEQ ID NO: 9371 - protein, 31 aa, Artificial Sequence
  Description of Artificial Sequence: Synthetic polypeptide
DEEEICTTNPVATEQYGSVSTNALQERMGNL

SEQ ID NO: 9372 - protein, 29 aa, Artificial Sequence
  Description of Artificial Sequence: Synthetic peptide
DESEIRTTNPVATENYGSVSTNLQRGDDM

SEQ ID NO: 9373 - protein, 30 aa, Artificial Sequence
  Description of Artificial Sequence: Synthetic polypeptide
DESEIRTTNPVATEHYGSVVSTNLQDEGNR

SEQ ID NO: 9374 - protein, 29 aa, Artificial Sequence
  Description of Artificial Sequence: Synthetic peptide
DESEIRTTNPVATEHYGSVSTNLQTDGNE

SEQ ID NO: 9375 - protein, 33 aa, Artificial Sequence
  Description of Artificial Sequence: Synthetic polypeptide
DEEEIRTTNPVATEQYGSTVSTNMLSQRGQSNR

SEQ ID NO: 9376 - protein, 29 aa, Artificial Sequence
  Description of Artificial Sequence: Synthetic peptide
DEEEIRTTNPVATEQYGSVSTPNLDRMSF

SEQ ID NO: 9377 - protein, 29 aa, Artificial Sequence
  Description of Artificial Sequence: Synthetic peptide
DESEIRTTNPVATEFYGSVSTNLQNEGNE

SEQ ID NO: 9378 - protein, 30 aa, Artificial Sequence
  Description of Artificial Sequence: Synthetic polypeptide
DESEIRTTNPVATEEYGSVSTNLQRGNEED

SEQ ID NO: 9379 - protein, 28 aa, Artificial Sequence
  Description of Artificial Sequence: Synthetic peptide
DESEIRTTNPVATEEYGSVSNNLQRGDW

SEQ ID NO: 9380 - protein, 29 aa, Artificial Sequence
  Description of Artificial Sequence: Synthetic peptide
DEEEICTTNPVATEQYGSVSTGLSQSVNR

SEQ ID NO: 9381 - protein, 29 aa, Artificial Sequence
  Description of Artificial Sequence: Synthetic peptide
DEEEICTTNPVATEQYGSVSTGLQYGEND

SEQ ID NO: 9382 - protein, 29 aa, Artificial Sequence
  Description of Artificial Sequence: Synthetic peptide
DEEEICTTNPVATEQYGSVSTGLQQMGNE

SEQ ID NO: 9383 - protein, 30 aa, Artificial Sequence
  Description of Artificial Sequence: Synthetic polypeptide
DEEEICTTNPVATEQYGSVCTNLQRDGERY

SEQ ID NO: 9384 - protein, 29 aa, Artificial Sequence
  Description of Artificial Sequence: Synthetic peptide
DEEEICTTNPVATEQYGSVSTGLQQGMNG

SEQ ID NO: 9385 - protein, 30 aa, Artificial Sequence
  Description of Artificial Sequence: Synthetic polypeptide
DEEEIRTTNPVATEQYGSVSTPNLDVAGNV

SEQ ID NO: 9386 - protein, 32 aa, Artificial Sequence
  Description of Artificial Sequence: Synthetic polypeptide
DEEEIRTTNPVATEQYGSTVSTNWLSQRVGPR

SEQ ID NO: 9387 - protein, 30 aa, Artificial Sequence
  Description of Artificial Sequence: Synthetic polypeptide
DEEEIRTTNPVATEQYGSVSETNLQESGGV

SEQ ID NO: 9388 - protein, 31 aa, Artificial Sequence
  Description of Artificial Sequence: Synthetic polypeptide
DEEEICTTNPVATEQYGSVSTENLGDRGNDR

SEQ ID NO: 9389 - protein, 30 aa, Artificial Sequence
  Description of Artificial Sequence: Synthetic polypeptide
DEEEICTTNPVATEQYGSVSTENLERGNQL

SEQ ID NO: 9390 - protein, 30 aa, Artificial Sequence
  Description of Artificial Sequence: Synthetic polypeptide
DEEEICTTNPVATEQYGSVSTENAGQTGNR

SEQ ID NO: 9391 - protein, 28 aa, Artificial Sequence
  Description of Artificial Sequence: Synthetic peptide
DEEEICTTNPVATEQYGSVSTEGQHGNA

SEQ ID NO: 9392 - protein, 30 aa, Artificial Sequence
  Description of Artificial Sequence: Synthetic polypeptide
DEEEICTTNPVATEQYGSVSTEELQRPNRD

SEQ ID NO: 9393 - protein, 30 aa, Artificial Sequence
  Description of Artificial Sequence: Synthetic polypeptide
DEEEICTTNPVATEQYGSVSTDNLQSDGNS

SEQ ID NO: 9394 - protein, 30 aa, Artificial Sequence
  Description of Artificial Sequence: Synthetic polypeptide
DEEEIRTTNPVATEQYGSVSETNLQENGDG

SEQ ID NO: 9395 - protein, 30 aa, Artificial Sequence
  Description of Artificial Sequence: Synthetic polypeptide
DEEEICTTNPVATEQYGSVSTANLERGNDM

SEQ ID NO: 9396 - protein, 30 aa, Artificial Sequence
  Description of Artificial Sequence: Synthetic polypeptide
DEEEIRTTNPVATEQYGSVSTPNLEGGNHM

SEQ ID NO: 9397 - protein, 29 aa, Artificial Sequence
  Description of Artificial Sequence: Synthetic peptide
DEEEIRTTNPVATEQYGSVSTPNLENGGP

SEQ ID NO: 9398 - protein, 30 aa, Artificial Sequence
  Description of Artificial Sequence: Synthetic polypeptide
DESEIRTTNPVATECYGSVSCNLQDREGNR

SEQ ID NO: 9399 - protein, 28 aa, Artificial Sequence
  Description of Artificial Sequence: Synthetic peptide
DEEEICTTNPVATEQYGSVATNLQIANE

SEQ ID NO: 9400 - protein, 29 aa, Artificial Sequence
  Description of Artificial Sequence: Synthetic peptide
DESEIRTTNPIATEQYGSVSCNLQREGNG

SEQ ID NO: 9401 - protein, 29 aa, Artificial Sequence
  Description of Artificial Sequence: Synthetic peptide
DESEIRTTNPCATEQYGSASTNLQRGEER

SEQ ID NO: 9402 - protein, 29 aa, Artificial Sequence
  Description of Artificial Sequence: Synthetic peptide
DEAEIRTTNPVAYEQYGSVSTENEQRGNQ

SEQ ID NO: 9403 - protein, 32 aa, Artificial Sequence
  Description of Artificial Sequence: Synthetic polypeptide
DEEEIRTTNPVATEQYGSVSETNGLQRGVNEG

SEQ ID NO: 9404 - protein, 30 aa, Artificial Sequence
  Description of Artificial Sequence: Synthetic polypeptide
DEEEICTTNPVATEQYGEVSTNLQNDGINR

SEQ ID NO: 9405 - protein, 28 aa, Artificial Sequence
  Description of Artificial Sequence: Synthetic peptide
DEEEIRTTNPVATEQYGSVAANLQPAER

SEQ ID NO: 9406 - protein, 30 aa, Artificial Sequence
  Description of Artificial Sequence: Synthetic polypeptide
DEEEIRTTNPVATEQYGSVAANLQREGPNN

SEQ ID NO: 9407 - protein, 29 aa, Artificial Sequence
  Description of Artificial Sequence: Synthetic peptide
DESEICTTNPVATEPYGSVSTNLQRGNND

SEQ ID NO: 9408 - protein, 29 aa, Artificial Sequence
  Description of Artificial Sequence: Synthetic peptide
DEEEIRTTNPVATEQYGSVAANLQRENDP

SEQ ID NO: 9409 - protein, 28 aa, Artificial Sequence
  Description of Artificial Sequence: Synthetic peptide
DEAEIRTTNPVAYEQYGSVSENLQNGNE

SEQ ID NO: 9410 - protein, 29 aa, Artificial Sequence
  Description of Artificial Sequence: Synthetic peptide
DESEICTTNPVATEIYGSVSATNLQQGNR

SEQ ID NO: 9411 - protein, 31 aa, Artificial Sequence
  Description of Artificial Sequence: Synthetic polypeptide
DEEEIRTTNPVATEQYGSVAANLQRGVNDRF

SEQ ID NO: 9412 - protein, 28 aa, Artificial Sequence
  Description of Artificial Sequence: Synthetic peptide
DESEICTTNPVATEGYGSVSTNLIRGNQ

SEQ ID NO: 9413 - protein, 29 aa, Artificial Sequence
  Description of Artificial Sequence: Synthetic peptide
DEEEIRTTNPVATEQYGSVAANLQRNNQG

SEQ ID NO: 9414 - protein, 28 aa, Artificial Sequence
  Description of Artificial Sequence: Synthetic peptide
DEEEIRTTNPVATEQYGSVAANLTQGNE

SEQ ID NO: 9415 - protein, 30 aa, Artificial Sequence
  Description of Artificial Sequence: Synthetic polypeptide
DEEEICTTNPVATEQYGEVSTNLQRGDNES

SEQ ID NO: 9416 - protein, 29 aa, Artificial Sequence
  Description of Artificial Sequence: Synthetic peptide
DEEEIRTTNPVATEQYGSVAASNDQSGNR

SEQ ID NO: 9417 - protein, 29 aa, Artificial Sequence
  Description of Artificial Sequence: Synthetic peptide
DEEEIRTTNPVATEQYGSVAATNDIRGER

SEQ ID NO: 9418 - protein, 31 aa, Artificial Sequence
  Description of Artificial Sequence: Synthetic polypeptide
DEEEIRTTNPVATEQYGSVSTPNLNRGGENT

SEQ ID NO: 9419 - protein, 31 aa, Artificial Sequence
  Description of Artificial Sequence: Synthetic polypeptide
DEEEIRTTNPVATEQYGSVAATNLQDRGGRM

SEQ ID NO: 9420 - protein, 30 aa, Artificial Sequence
  Description of Artificial Sequence: Synthetic polypeptide
DEEEIRTTNPVATEQYGSVAATNLQENNSR

SEQ ID NO: 9421 - protein, 31 aa, Artificial Sequence
  Description of Artificial Sequence: Synthetic polypeptide
DEEEIRTTNPVATEQYGSVAATNLQGGDNDR

SEQ ID NO: 9422 - protein, 30 aa, Artificial Sequence
  Description of Artificial Sequence: Synthetic polypeptide
DEEEIRTTNPVATEQYGSVAATNLQGVENR

SEQ ID NO: 9423 - protein, 30 aa, Artificial Sequence
  Description of Artificial Sequence: Synthetic polypeptide
DESEIATTNPVATEQYGSVVSTNLQRTPNR

SEQ ID NO: 9424 - protein, 30 aa, Artificial Sequence
  Description of Artificial Sequence: Synthetic polypeptide
DEEEICTTNPVATEPYGSTSTNLSQREGNR

SEQ ID NO: 9425 - protein, 30 aa, Artificial Sequence
  Description of Artificial Sequence: Synthetic polypeptide
DEEEIRTTNPVATEQYGSVSETNGGQRGVN

SEQ ID NO: 9426 - protein, 31 aa, Artificial Sequence
  Description of Artificial Sequence: Synthetic polypeptide
DEEEIRTTNPVATEQYGSVAATNLQNRGNTT

SEQ ID NO: 9427 - protein, 30 aa, Artificial Sequence
  Description of Artificial Sequence: Synthetic polypeptide
DEEEIRTTNPVATEQYGSVAATNLQRAEPR

SEQ ID NO: 9428 - protein, 31 aa, Artificial Sequence
  Description of Artificial Sequence: Synthetic polypeptide
DEEEICTTNPVATEMYGSVSTNLQERGNERQ

SEQ ID NO: 9429 - protein, 30 aa, Artificial Sequence
  Description of Artificial Sequence: Synthetic polypeptide
DEEEIRTTNPVATEQYGSVACGNLQSTGNR

SEQ ID NO: 9430 - protein, 31 aa, Artificial Sequence
  Description of Artificial Sequence: Synthetic polypeptide
DEEEIRTTNPVATEQYGSVSETNGLDQRGEH

SEQ ID NO: 9431 - protein, 29 aa, Artificial Sequence
  Description of Artificial Sequence: Synthetic peptide
DESEICTTNPVATEQYGSVATNLQERGNQ

SEQ ID NO: 9432 - protein, 30 aa, Artificial Sequence
  Description of Artificial Sequence: Synthetic polypeptide
DEAEIRTTNPVAYEQYGSVSTNELQDGNNR

SEQ ID NO: 9433 - protein, 28 aa, Artificial Sequence
  Description of Artificial Sequence: Synthetic peptide
DESEICTTNPVATEQYGSVGTNLERGNS

SEQ ID NO: 9434 - protein, 29 aa, Artificial Sequence
  Description of Artificial Sequence: Synthetic peptide
DEEEICTTNPVATEQYGSVATNLQFGNEQ

SEQ ID NO: 9435 - protein, 30 aa, Artificial Sequence
  Description of Artificial Sequence: Synthetic polypeptide
DEEEIRTTNPVATEQYGSVSETNLDRQEDR

SEQ ID NO: 9436 - protein, 29 aa, Artificial Sequence
  Description of Artificial Sequence: Synthetic peptide
DEEEICTTNPVATEQYGSVATNLQDGENN

SEQ ID NO: 9437 - protein, 30 aa, Artificial Sequence
  Description of Artificial Sequence: Synthetic polypeptide
DEEEIRTTNPVATEQYGSVSETNLDRIVRM

SEQ ID NO: 9438 - protein, 28 aa, Artificial Sequence
  Description of Artificial Sequence: Synthetic peptide
DESEIRSTNPIATEQYGSVSENLMRGNR

SEQ ID NO: 9439 - protein, 30 aa, Artificial Sequence
  Description of Artificial Sequence: Synthetic polypeptide
DEEEIRTTNPVATEQYGSVSETNLDRAQER

SEQ ID NO: 9440 - protein, 29 aa, Artificial Sequence
  Description of Artificial Sequence: Synthetic peptide
DEEEICTTNPVATEQYGSVATNLQAGNNT

SEQ ID NO: 9441 - protein, 29 aa, Artificial Sequence
  Description of Artificial Sequence: Synthetic peptide
CEEAISTTNPVATEQYGSVTSTNLQAGNR

SEQ ID NO: 9442 - protein, 31 aa, Artificial Sequence
  Description of Artificial Sequence: Synthetic polypeptide
DEEEIRTTNPVATEQYGSVSETNLDQRGVVA

SEQ ID NO: 9443 - protein, 29 aa, Artificial Sequence
  Description of Artificial Sequence: Synthetic peptide
DESEIRCTNPVATEQYGSASTNLQSGDNR

SEQ ID NO: 9444 - protein, 32 aa, Artificial Sequence
  Description of Artificial Sequence: Synthetic polypeptide
DEEEIRTTNPVATEQYGSVSETNLDQRGGEVR

SEQ ID NO: 9445 - protein, 29 aa, Artificial Sequence
  Description of Artificial Sequence: Synthetic peptide
DESEIRCTNPVATECYGSVSCNLQDRGNR

SEQ ID NO: 9446 - protein, 33 aa, Artificial Sequence
  Description of Artificial Sequence: Synthetic polypeptide
DEEEIRTTNPVATEQYGSTVVSTPNLSQRGLNR

SEQ ID NO: 9447 - protein, 30 aa, Artificial Sequence
  Description of Artificial Sequence: Synthetic polypeptide
DEEEIRTTNPVATEQYGSVSTPNLITGNIQ

SEQ ID NO: 9448 - protein, 31 aa, Artificial Sequence
  Description of Artificial Sequence: Synthetic polypeptide
DEEEIRTTNPVATEQYGSVSTPNLMMRGNPV

SEQ ID NO: 9449 - protein, 32 aa, Artificial Sequence
  Description of Artificial Sequence: Synthetic polypeptide
DEEEICTTNPVATEQYGSTVSCTGNLQRVGNR

SEQ ID NO: 9450 - protein, 28 aa, Artificial Sequence
  Description of Artificial Sequence: Synthetic peptide
DESEIRATNPVASEQYGSVSTNLQGGDR

SEQ ID NO: 9451 - protein, 28 aa, Artificial Sequence
  Description of Artificial Sequence: Synthetic peptide
DEEEIRTTNPVATEQYGSVAANLERSSR

SEQ ID NO: 9452 - protein, 28 aa, Artificial Sequence
  Description of Artificial Sequence: Synthetic peptide
DESEIKTTNPVATEQYGSVSTNLMDGNT

SEQ ID NO: 9453 - protein, 30 aa, Artificial Sequence
  Description of Artificial Sequence: Synthetic polypeptide
DEEEIRTTNPVATEQYGSVSETNGVQRGQF

SEQ ID NO: 9454 - protein, 28 aa, Artificial Sequence
  Description of Artificial Sequence: Synthetic peptide
DEAEIRTTNPVAYEQYGSVSYNLQEGNL

SEQ ID NO: 9455 - protein, 28 aa, Artificial Sequence
  Description of Artificial Sequence: Synthetic peptide
DEEEICTTNPVATEQYGSAPTVLQGGNR

SEQ ID NO: 9456 - protein, 29 aa, Artificial Sequence
  Description of Artificial Sequence: Synthetic peptide
DEEEICTTNPVATEQYGNVSTNLQLGNTS

SEQ ID NO: 9457 - protein, 30 aa, Artificial Sequence
  Description of Artificial Sequence: Synthetic polypeptide
DEEEICTTNPVATEQYGNVSTNLGQGDGNR

SEQ ID NO: 9458 - protein, 31 aa, Artificial Sequence
  Description of Artificial Sequence: Synthetic polypeptide
DEEEIRTTNPVATEQYGSVAANLQERGNSRG

SEQ ID NO: 9459 - protein, 29 aa, Artificial Sequence
  Description of Artificial Sequence: Synthetic peptide
DESEICTTNPVATEQYGSVSTNNQRGNDA

SEQ ID NO: 9460 - protein, 28 aa, Artificial Sequence
  Description of Artificial Sequence: Synthetic peptide
DESEICTTNPVATEQYGSVSTNLTTGNT

SEQ ID NO: 9461 - protein, 30 aa, Artificial Sequence
  Description of Artificial Sequence: Synthetic polypeptide
DESEICTTNPVATEQYGSVSTNLSQRGNEW

SEQ ID NO: 9462 - protein, 28 aa, Artificial Sequence
  Description of Artificial Sequence: Synthetic peptide
DESEICTTNPVATEQYGSVSTNLMYGNQ

SEQ ID NO: 9463 - protein, 29 aa, Artificial Sequence
  Description of Artificial Sequence: Synthetic peptide
DEEEICTTNPVATEQYGSVSTNDQRDDNA

SEQ ID NO: 9464 - protein, 31 aa, Artificial Sequence
  Description of Artificial Sequence: Synthetic polypeptide
DEEEIRTTNPVATEQYGSVSTPNLQAGEGNN

SEQ ID NO: 9465 - protein, 31 aa, Artificial Sequence
  Description of Artificial Sequence: Synthetic polypeptide
DEEEIRTTNPVATEQYGSVSETNLQFNGNGQ

SEQ ID NO: 9466 - protein, 29 aa, Artificial Sequence
  Description of Artificial Sequence: Synthetic peptide
DEEEICTTNPVATEQYGSVSTNGQRDGDQ

SEQ ID NO: 9467 - protein, 29 aa, Artificial Sequence
  Description of Artificial Sequence: Synthetic peptide
DESEIRTTNPVATEQYGSVSTNLQGNNQD

SEQ ID NO: 9468 - protein, 30 aa, Artificial Sequence
  Description of Artificial Sequence: Synthetic polypeptide
DESEIRTTNPVATEQYGSVSTNLQGGHNAS

SEQ ID NO: 9469 - protein, 30 aa, Artificial Sequence
  Description of Artificial Sequence: Synthetic polypeptide
DESEIRTTNPVATEQYGSVSTNLQGGGGNS

SEQ ID NO: 9470 - protein, 30 aa, Artificial Sequence
  Description of Artificial Sequence: Synthetic polypeptide
DESEIRTTNPVATEQYGSVSTNLQGEHNQR

SEQ ID NO: 9471 - protein, 30 aa, Artificial Sequence
  Description of Artificial Sequence: Synthetic polypeptide
DESEIRTTNPVATEQYGSVSTNLQEPGNNN

SEQ ID NO: 9472 - protein, 31 aa, Artificial Sequence
  Description of Artificial Sequence: Synthetic polypeptide
DESEIRTTNPVATEQYGSVSTNLQENEGNQR

SEQ ID NO: 9473 - protein, 31 aa, Artificial Sequence
  Description of Artificial Sequence: Synthetic polypeptide
DESEIRTTNPVATEQYGSVSTNLQDSGGNDR

SEQ ID NO: 9474 - protein, 30 aa, Artificial Sequence
  Description of Artificial Sequence: Synthetic polypeptide
DESEIRTTNPVATEQYGSVSTNLQDGNGNE

SEQ ID NO: 9475 - protein, 30 aa, Artificial Sequence
  Description of Artificial Sequence: Synthetic polypeptide
DESEIRTTNPVATEQYGSVSTNLQDGGNNN

SEQ ID NO: 9476 - protein, 30 aa, Artificial Sequence
  Description of Artificial Sequence: Synthetic polypeptide
DESEIRTTNPVATEQYGSVSTNLQDEGNND

SEQ ID NO: 9477 - protein, 30 aa, Artificial Sequence
  Description of Artificial Sequence: Synthetic polypeptide
DESEIRTTNPVATEQYGSVSTNLQASGNAM

SEQ ID NO: 9478 - protein, 30 aa, Artificial Sequence
  Description of Artificial Sequence: Synthetic polypeptide
DESEIRTTNPVATEQYGSVSTNLQAMGEDR

SEQ ID NO: 9479 - protein, 30 aa, Artificial Sequence
  Description of Artificial Sequence: Synthetic polypeptide
DESEIRTTNPVATEQYGSVSTNLQAGGNNA

SEQ ID NO: 9480 - protein, 31 aa, Artificial Sequence
  Description of Artificial Sequence: Synthetic polypeptide
DESEIRTTNPVATEQYGSVSTNLQHAGGNDR

SEQ ID NO: 9481 - protein, 30 aa, Artificial Sequence
  Description of Artificial Sequence: Synthetic polypeptide
DESEIRTTNPVATEQYGSVSTNLDGHEGNR

SEQ ID NO: 9482 - protein, 29 aa, Artificial Sequence
  Description of Artificial Sequence: Synthetic peptide
DESEIRTTNPVATEQYGSVSTNGQGQGDR

SEQ ID NO: 9483 - protein, 30 aa, Artificial Sequence
  Description of Artificial Sequence: Synthetic polypeptide
DESEIRTTNPVATEQYGSVSTNGLERGGNN

SEQ ID NO: 9484 - protein, 29 aa, Artificial Sequence
  Description of Artificial Sequence: Synthetic peptide
DESEIRTTNPVATEQYGSVSTNAQHGNLG

SEQ ID NO: 9485 - protein, 29 aa, Artificial Sequence
  Description of Artificial Sequence: Synthetic peptide
DESEIRTTNPVATEQYGSVSTNAQDGNQE

SEQ ID NO: 9486 - protein, 30 aa, Artificial Sequence
  Description of Artificial Sequence: Synthetic polypeptide
DESEIRTTNPVATEQYGSVSTLNLEQVGNS

SEQ ID NO: 9487 - protein, 31 aa, Artificial Sequence
  Description of Artificial Sequence: Synthetic polypeptide
DEEEIRTTNPVATEQYGSVSTPNDQPGDNDR

SEQ ID NO: 9488 - protein, 29 aa, Artificial Sequence
  Description of Artificial Sequence: Synthetic peptide
DEEEICTTNPVATEQYGSVSTNPQQHGNT

SEQ ID NO: 9489 - protein, 29 aa, Artificial Sequence
  Description of Artificial Sequence: Synthetic peptide
DEEEICTTNPVATEQYGSVSTNPQGNGNH

SEQ ID NO: 9490 - protein, 30 aa, Artificial Sequence
  Description of Artificial Sequence: Synthetic polypeptide
DESEIRTTNPVATEQYGSVSTEYLQNSGNR

SEQ ID NO: 9491 - protein, 30 aa, Artificial Sequence
  Description of Artificial Sequence: Synthetic polypeptide
DESEIRTTNPVATEQYGSVSTENLQAGNFN

SEQ ID NO: 9492 - protein, 29 aa, Artificial Sequence
  Description of Artificial Sequence: Synthetic peptide
DESEIRTTNPVATEQYGSVSTDGQRGMQR

SEQ ID NO: 9493 - protein, 30 aa, Artificial Sequence
  Description of Artificial Sequence: Synthetic polypeptide
DESEIRTTNPVATEQYGSVSTALGQRGERD

SEQ ID NO: 9494 - protein, 31 aa, Artificial Sequence
  Description of Artificial Sequence: Synthetic polypeptide
DESEIRTTNPVATEQYGSVSSVTNLQPGGNR

SEQ ID NO: 9495 - protein, 29 aa, Artificial Sequence
  Description of Artificial Sequence: Synthetic peptide
DESEIRTTNPVATEQYGSVSTNGQHGNDT

SEQ ID NO: 9496 - protein, 30 aa, Artificial Sequence
  Description of Artificial Sequence: Synthetic polypeptide
DEEEIRTTNPVATEQYGSVSTPNDQSGNVT

SEQ ID NO: 9497 - protein, 30 aa, Artificial Sequence
  Description of Artificial Sequence: Synthetic polypeptide
DESEIRTTNPVATEQYGSVSTNLQHEGNEK

SEQ ID NO: 9498 - protein, 30 aa, Artificial Sequence
  Description of Artificial Sequence: Synthetic polypeptide
DESEIRTTNPVATEQYGSVSTNLQHNSNRS

SEQ ID NO: 9499 - protein, 30 aa, Artificial Sequence
  Description of Artificial Sequence: Synthetic polypeptide
DESEIRTTNPVATEQYGSVSTPLSGRGNNR

SEQ ID NO: 9500 - protein, 30 aa, Artificial Sequence
  Description of Artificial Sequence: Synthetic polypeptide
DESEIRTTNPVATEQYGSVSTPLNQRGERN

SEQ ID NO: 9501 - protein, 29 aa, Artificial Sequence
  Description of Artificial Sequence: Synthetic peptide
DESEIRTTNPVATEQYGSVSTPKGQDGNR

SEQ ID NO: 9502 - protein, 29 aa, Artificial Sequence
  Description of Artificial Sequence: Synthetic peptide
DESEIRTTNPVATEQYGSVSTNQQLGNNI

SEQ ID NO: 9503 - protein, 29 aa, Artificial Sequence
  Description of Artificial Sequence: Synthetic peptide
DESEIRTTNPVATEQYGSVSTNQQIGGNV

SEQ ID NO: 9504 - protein, 29 aa, Artificial Sequence
  Description of Artificial Sequence: Synthetic peptide
DESEIRTTNPVATEQYGSVSTNQQDGNQL

SEQ ID NO: 9505 - protein, 30 aa, Artificial Sequence
  Description of Artificial Sequence: Synthetic polypeptide
DESEIRTTNPVATEQYGSVSTNQLGQEGND

SEQ ID NO: 9506 - protein, 29 aa, Artificial Sequence
  Description of Artificial Sequence: Synthetic peptide
DESEIRTTNPVATEQYGSVSTNPDHGNTR

SEQ ID NO: 9507 - protein, 31 aa, Artificial Sequence
  Description of Artificial Sequence: Synthetic polypeptide
DESEIRTTNPVATEQYGSVSTNLSQRVGNPA

SEQ ID NO: 9508 - protein, 30 aa, Artificial Sequence
  Description of Artificial Sequence: Synthetic polypeptide
DESEIRTTNPVATEQYGSVSTNLQSQGNMK

SEQ ID NO: 9509 - protein, 30 aa, Artificial Sequence
  Description of Artificial Sequence: Synthetic polypeptide
DESEIRTTNPVATEQYGSVSTNLQSGDAHR

SEQ ID NO: 9510 - protein, 30 aa, Artificial Sequence
  Description of Artificial Sequence: Synthetic polypeptide
DESEIRTTNPVATEQYGSVSTNLQRGGESN

SEQ ID NO: 9511 - protein, 30 aa, Artificial Sequence
  Description of Artificial Sequence: Synthetic polypeptide
DESEIRTTNPVATEQYGSVSTNLQRGGEGT

SEQ ID NO: 9512 - protein, 30 aa, Artificial Sequence
  Description of Artificial Sequence: Synthetic polypeptide
DESEIRTTNPVATEQYGSVSTNLQHGDGDR

SEQ ID NO: 9513 - protein, 30 aa, Artificial Sequence
  Description of Artificial Sequence: Synthetic polypeptide
DESEIRTTNPVATEQYGSVSTNLQRGGDTN

SEQ ID NO: 9514 - protein, 30 aa, Artificial Sequence
  Description of Artificial Sequence: Synthetic polypeptide
DESEIRTTNPVATEQYGSVSTNLQQNGNAE

SEQ ID NO: 9515 - protein, 30 aa, Artificial Sequence
  Description of Artificial Sequence: Synthetic polypeptide
DESEIRTTNPVATEQYGSVSTNLQQGSNDA

SEQ ID NO: 9516 - protein, 30 aa, Artificial Sequence
  Description of Artificial Sequence: Synthetic polypeptide
DESEIRTTNPVATEQYGSVSTNLQQGGNNA

SEQ ID NO: 9517 - protein, 30 aa, Artificial Sequence
  Description of Artificial Sequence: Synthetic polypeptide
DESEIRTTNPVATEQYGSVSTNLQQGDEIR

SEQ ID NO: 9518 - protein, 31 aa, Artificial Sequence
  Description of Artificial Sequence: Synthetic polypeptide
DESEIRTTNPVATEQYGSVSTNLQPQGDNDR

SEQ ID NO: 9519 - protein, 29 aa, Artificial Sequence
  Description of Artificial Sequence: Synthetic peptide
DESEIRTTNPVATEQYGSVSTNLQNNNQG

SEQ ID NO: 9520 - protein, 29 aa, Artificial Sequence
  Description of Artificial Sequence: Synthetic peptide
DESEIRTTNPVATEQYGSVSTNLQNLNQG

SEQ ID NO: 9521 - protein, 30 aa, Artificial Sequence
  Description of Artificial Sequence: Synthetic polypeptide
DESEIRTTNPVATEQYGSVSTNLQNGGNET

SEQ ID NO: 9522 - protein, 30 aa, Artificial Sequence
  Description of Artificial Sequence: Synthetic polypeptide
DESEIRTTNPVATEQYGSVSTNLQMGDNGE

SEQ ID NO: 9523 - protein, 30 aa, Artificial Sequence
  Description of Artificial Sequence: Synthetic polypeptide
DESEIRTTNPVATEQYGSVSTNLQLGNGMK

SEQ ID NO: 9524 - protein, 30 aa, Artificial Sequence
  Description of Artificial Sequence: Synthetic polypeptide
DESEIRTTNPVATEQYGSVSTNLQIGDMLR

SEQ ID NO: 9525 - protein, 30 aa, Artificial Sequence
  Description of Artificial Sequence: Synthetic polypeptide
DESEIRTTNPVATEQYGSVSTNLQIDGNMT

SEQ ID NO: 9526 - protein, 30 aa, Artificial Sequence
  Description of Artificial Sequence: Synthetic polypeptide
DESEIRTTNPVATEQYGSVSTNLQHQGNDT

SEQ ID NO: 9527 - protein, 30 aa, Artificial Sequence
  Description of Artificial Sequence: Synthetic polypeptide
DESEIRTTNPVATEQYGSVSTNLQQNGNAS

SEQ ID NO: 9528 - protein, 29 aa, Artificial Sequence
  Description of Artificial Sequence: Synthetic peptide
DESEIRTTNPVATEQYGSVSQNLTRNMNR

SEQ ID NO: 9529 - protein, 29 aa, Artificial Sequence
  Description of Artificial Sequence: Synthetic peptide
DESEIRTTNPVATEQYGSVSQNLNRPMNR

SEQ ID NO: 9530 - protein, 29 aa, Artificial Sequence
  Description of Artificial Sequence: Synthetic peptide
DESEIRTTNPVATEQYGSVSQNLFRNENR

SEQ ID NO: 9531 - protein, 30 aa, Artificial Sequence
  Description of Artificial Sequence: Synthetic polypeptide
DEEEICTTNPVATEQYGSVSTNLQGGDNGD

SEQ ID NO: 9532 - protein, 28 aa, Artificial Sequence
  Description of Artificial Sequence: Synthetic peptide
DESEIRTTNPVATEQYGSCSTNLQHGDL

SEQ ID NO: 9533 - protein, 30 aa, Artificial Sequence
  Description of Artificial Sequence: Synthetic polypeptide
DESEIRTTNPVATEQYGNVSTNLQAPGNER

SEQ ID NO: 9534 - protein, 28 aa, Artificial Sequence
  Description of Artificial Sequence: Synthetic peptide
DESEIRTTNPVATEQYGNVSTDLQRPND

SEQ ID NO: 9535 - protein, 28 aa, Artificial Sequence
  Description of Artificial Sequence: Synthetic peptide
DESEIRTTNPVATEQYGMVSTTLQRPND

SEQ ID NO: 9536 - protein, 30 aa, Artificial Sequence
  Description of Artificial Sequence: Synthetic polypeptide
DEEEIRTTNPVATEQYGSVSTPNLDHEGNI

SEQ ID NO: 9537 - protein, 30 aa, Artificial Sequence
  Description of Artificial Sequence: Synthetic polypeptide
DEEEICTTNPVATEQYGSVSTNLQFDGNGN

SEQ ID NO: 9538 - protein, 28 aa, Artificial Sequence
  Description of Artificial Sequence: Synthetic peptide
DESEIRTTNPVATEQYGIVSTNDQKGNQ

SEQ ID NO: 9539 - protein, 29 aa, Artificial Sequence
  Description of Artificial Sequence: Synthetic peptide
DEEEICTTNPVATEQYGSVSTNLQEGMVD

SEQ ID NO: 9540 - protein, 29 aa, Artificial Sequence
  Description of Artificial Sequence: Synthetic peptide
DEEEICTTNPVATEQYGSVSTNLQDLNDE

SEQ ID NO: 9541 - protein, 30 aa, Artificial Sequence
  Description of Artificial Sequence: Synthetic polypeptide
DESEIRTTNPVATEQYGEVSTNLTREGNNR

SEQ ID NO: 9542 - protein, 29 aa, Artificial Sequence
  Description of Artificial Sequence: Synthetic peptide
DESEIRTTNPVATEQYGEVSTNLQLGGNA

SEQ ID NO: 9543 - protein, 29 aa, Artificial Sequence
  Description of Artificial Sequence: Synthetic peptide
DESEIRTTNPVATEQYGEVSTNLGNGDNR

SEQ ID NO: 9544 - protein, 31 aa, Artificial Sequence
  Description of Artificial Sequence: Synthetic polypeptide
DEEEIRTTNPVATEQYGSVSTPNILNQPGNT

SEQ ID NO: 9545 - protein, 29 aa, Artificial Sequence
  Description of Artificial Sequence: Synthetic peptide
DESEIRTTNPVATEQYGETVSTNLQRGDS

SEQ ID NO: 9546 - protein, 30 aa, Artificial Sequence
  Description of Artificial Sequence: Synthetic polypeptide
DESEIRTTNPVATEQYGDVSTNLQRGNNNE

SEQ ID NO: 9547 - protein, 29 aa, Artificial Sequence
  Description of Artificial Sequence: Synthetic peptide
DEEEICTTNPVATEQYGSVSTNLQAEFNE

SEQ ID NO: 9548 - protein, 28 aa, Artificial Sequence
  Description of Artificial Sequence: Synthetic peptide
DESEIRTTNPVATEQYGCVSTNSQSGNS

SEQ ID NO: 9549 - protein, 30 aa, Artificial Sequence
  Description of Artificial Sequence: Synthetic polypeptide
DESEIRTTNPVATEQYGCVSTNLQRSGNQD

SEQ ID NO: 9550 - protein, 30 aa, Artificial Sequence
  Description of Artificial Sequence: Synthetic polypeptide
DEEEICTTNPVATEQYGSVSTNLPRGDNEP

SEQ ID NO: 9551 - protein, 31 aa, Artificial Sequence
  Description of Artificial Sequence: Synthetic polypeptide
DEEEIRTTNPVATEQYGSVSETNLQGTSGNG

SEQ ID NO: 9552 - protein, 30 aa, Artificial Sequence
  Description of Artificial Sequence: Synthetic polypeptide
DEEEICTTNPVATEQYGSVSTNLDRGGNET

SEQ ID NO: 9553 - protein, 30 aa, Artificial Sequence
  Description of Artificial Sequence: Synthetic polypeptide
DEEEICTTNPVATEQYGSVSTNLDRGDNEI

SEQ ID NO: 9554 - protein, 30 aa, Artificial Sequence
  Description of Artificial Sequence: Synthetic polypeptide
DEEEICTTNPVATEQYGSVSTNLDRGDNDP

SEQ ID NO: 9555 - protein, 30 aa, Artificial Sequence
  Description of Artificial Sequence: Synthetic polypeptide
DEEEICTTNPVATEQYGSVSTNLDQGMGAR

SEQ ID NO: 9556 - protein, 29 aa, Artificial Sequence
  Description of Artificial Sequence: Synthetic peptide
DEEEICTTNPVATEQYGSVSTNLDEGNGA

SEQ ID NO: 9557 - protein, 31 aa, Artificial Sequence
  Description of Artificial Sequence: Synthetic polypeptide
DEEEIRTTNPVATEQYGSVSETNLQGIGNIS

SEQ ID NO: 9558 - protein, 29 aa, Artificial Sequence
  Description of Artificial Sequence: Synthetic peptide
DEEEICTTNPVATEQYGSVSTNGTRGGNA

SEQ ID NO: 9559 - protein, 28 aa, Artificial Sequence
  Description of Artificial Sequence: Synthetic peptide
DESEIRTTNPVATEQYGETSTNLQRGDE

SEQ ID NO: 9560 - protein, 29 aa, Artificial Sequence
  Description of Artificial Sequence: Synthetic peptide
DESEIRTTNPVATEQYGSVATALIRVGNR

SEQ ID NO: 9561 - protein, 29 aa, Artificial Sequence
  Description of Artificial Sequence: Synthetic peptide
DEEEIRTTNPVATEQYGSVSETNLQIILT

SEQ ID NO: 9562 - protein, 29 aa, Artificial Sequence
  Description of Artificial Sequence: Synthetic peptide
DESEIRTTNPVATEQYGSVATNLQFGNDE

SEQ ID NO: 9563 - protein, 30 aa, Artificial Sequence
  Description of Artificial Sequence: Synthetic polypeptide
DEEEICTTNPVATEQYGSVSTNLTRGDNEQ

SEQ ID NO: 9564 - protein, 29 aa, Artificial Sequence
  Description of Artificial Sequence: Synthetic peptide
DEEEICTTNPVATEQYGSVSTNLTDGNVD

SEQ ID NO: 9565 - protein, 29 aa, Artificial Sequence
  Description of Artificial Sequence: Synthetic peptide
DESEIRTTNPVATEQYGSVSNPGLQNGNR

SEQ ID NO: 9566 - protein, 30 aa, Artificial Sequence
  Description of Artificial Sequence: Synthetic polypeptide
DEEEICTTNPVATEQYGSVSTNLQVNSNRM

SEQ ID NO: 9567 - protein, 30 aa, Artificial Sequence
  Description of Artificial Sequence: Synthetic polypeptide
DEEEICTTNPVATEQYGSVSTNLQTNPNRF

SEQ ID NO: 9568 - protein, 31 aa, Artificial Sequence
  Description of Artificial Sequence: Synthetic polypeptide
DEEEICTTNPVATEQYGSVSTNLQTGPGDNR

SEQ ID NO: 9569 - protein, 30 aa, Artificial Sequence
  Description of Artificial Sequence: Synthetic polypeptide
DESEIRTTNPVATEQYGSVSDNLQLGENDR

SEQ ID NO: 9570 - protein, 29 aa, Artificial Sequence
  Description of Artificial Sequence: Synthetic peptide
DEEEICTTNPVATEQYGSVSTNLQTEANS

SEQ ID NO: 9571 - protein, 29 aa, Artificial Sequence
  Description of Artificial Sequence: Synthetic peptide
DEEEICTTNPVATEQYGSVSTNLQTDNMQ

SEQ ID NO: 9572 - protein, 31 aa, Artificial Sequence
  Description of Artificial Sequence: Synthetic polypeptide
DESEIRTTNPVATEQYGSVSCTNLQFDNGNR

SEQ ID NO: 9573 - protein, 30 aa, Artificial Sequence
  Description of Artificial Sequence: Synthetic polypeptide
DEEEICTTNPVATEQYGSVSTNLQTDGNHG

SEQ ID NO: 9574 - protein, 30 aa, Artificial Sequence
  Description of Artificial Sequence: Synthetic polypeptide
DESEIRTTNPVATEQYGSVSCNLPQREGNG

SEQ ID NO: 9575 - protein, 29 aa, Artificial Sequence
  Description of Artificial Sequence: Synthetic peptide
DEEEICTTNPVATEQYGSVSTNLQSGSVS

SEQ ID NO: 9576 - protein, 31 aa, Artificial Sequence
  Description of Artificial Sequence: Synthetic polypeptide
DEEEICTTNPVATEQYGSVSTNLQREENTRE

SEQ ID NO: 9577 - protein, 30 aa, Artificial Sequence
  Description of Artificial Sequence: Synthetic polypeptide
DEEEICTTNPVATEQYGSVSTNLQRDMNEQ

SEQ ID NO: 9578 - protein, 30 aa, Artificial Sequence
  Description of Artificial Sequence: Synthetic polypeptide
DESEIRTTNPVATEQYGSVSCANLSQRVNR

SEQ ID NO: 9579 - protein, 29 aa, Artificial Sequence
  Description of Artificial Sequence: Synthetic peptide
DEEEICTTNPVATEQYGSVSTNLQPVNSE

SEQ ID NO: 9580 - protein, 29 aa, Artificial Sequence
  Description of Artificial Sequence: Synthetic peptide
DESEIRTTNPVATEQYGSVSANLNFGNDR

SEQ ID NO: 9581 - protein, 32 aa, Artificial Sequence
  Description of Artificial Sequence: Synthetic polypeptide
DEEEIRTTNPVATEQYGSVSTPNEQSRGNERV

SEQ ID NO: 9582 - protein, 31 aa, Artificial Sequence
  Description of Artificial Sequence: Synthetic polypeptide
DESEIRTTNPVATEQYGSVQSCTNELQMGNR

SEQ ID NO: 9583 - protein, 30 aa, Artificial Sequence
  Description of Artificial Sequence: Synthetic polypeptide
DEEEICTTNPVATEQYGSVSTNLQNDGNNP

SEQ ID NO: 9584 - protein, 30 aa, Artificial Sequence
  Description of Artificial Sequence: Synthetic polypeptide
DEEEICTTNPVATEQYGSVSTNLQNDGNMF

SEQ ID NO: 9585 - protein, 30 aa, Artificial Sequence
  Description of Artificial Sequence: Synthetic polypeptide
DEEEICTTNPVATEQYGSVSTNLQNDGNEK

SEQ ID NO: 9586 - protein, 30 aa, Artificial Sequence
  Description of Artificial Sequence: Synthetic polypeptide
DEEEICTTNPVATEQYGSVSTNLQLDGNLK

SEQ ID NO: 9587 - protein, 28 aa, Artificial Sequence
  Description of Artificial Sequence: Synthetic peptide
DESEIRTTNPVATEQYGSVEVNLQFGNM

SEQ ID NO: 9588 - protein, 29 aa, Artificial Sequence
  Description of Artificial Sequence: Synthetic peptide
DEEEICTTNPVATEQYGSVSTNLQHEVNQ

SEQ ID NO: 9589 - protein, 30 aa, Artificial Sequence
  Description of Artificial Sequence: Synthetic polypeptide
DESEIRTTNPVATEQYGSVDTNDLQGGNQR

SEQ ID NO: 9590 - protein, 29 aa, Artificial Sequence
  Description of Artificial Sequence: Synthetic peptide
DEEEICTTNPVATEQYGSVSTNLQHDNPV

SEQ ID NO: 9591 - protein, 32 aa, Artificial Sequence
  Description of Artificial Sequence: Synthetic polypeptide
DEEEIRTTNPVATEQYGSVSTPNGQRGQNQRG

SEQ ID NO: 9592 - protein, 30 aa, Artificial Sequence
  Description of Artificial Sequence: Synthetic polypeptide
DEEEICTTNPVATEQYGSVSTNGEEQRGNT

SEQ ID NO: 9593 - protein, 30 aa, Artificial Sequence
  Description of Artificial Sequence: Synthetic polypeptide
DESEIRTTNPVATEQYGSVSTTLQGTGENR

SEQ ID NO: 9594 - protein, 29 aa, Artificial Sequence
  Description of Artificial Sequence: Synthetic peptide
DEEEICTTNPVATEHYGSVSTNLQMSGNT

SEQ ID NO: 9595 - protein, 28 aa, Artificial Sequence
  Description of Artificial Sequence: Synthetic peptide
DESEIATTNPVATEQYGSVATNLERGNT

SEQ ID NO: 9596 - protein, 31 aa, Artificial Sequence
  Description of Artificial Sequence: Synthetic polypeptide
DEEEIRTTNPVATEQYGSVSETALEQRGENV

SEQ ID NO: 9597 - protein, 29 aa, Artificial Sequence
  Description of Artificial Sequence: Synthetic peptide
DEQEIRTTNPVATEQYGSISTNTQRQGLR

SEQ ID NO: 9598 - protein, 30 aa, Artificial Sequence
  Description of Artificial Sequence: Synthetic polypeptide
DEEEICTTNPMATEQYGSVPTNLQTRGSNR

SEQ ID NO: 9599 - protein, 30 aa, Artificial Sequence
  Description of Artificial Sequence: Synthetic polypeptide
DEEEICTTNPMATEQYGSVPTNLQQRGNDR

SEQ ID NO: 9600 - protein, 30 aa, Artificial Sequence
  Description of Artificial Sequence: Synthetic polypeptide
DEEEICTTNPMATEQYGSVPTNLQNRGNLR

SEQ ID NO: 9601 - protein, 30 aa, Artificial Sequence
  Description of Artificial Sequence: Synthetic polypeptide
DEQEIRTTNPVATEQYGEVSTNLQIDGNQR

SEQ ID NO: 9602 - protein, 28 aa, Artificial Sequence
  Description of Artificial Sequence: Synthetic peptide
DEQEIRTTNPVATEQYGDVSEDLQRGNA

SEQ ID NO: 9603 - protein, 29 aa, Artificial Sequence
  Description of Artificial Sequence: Synthetic peptide
CEEEIATTNPVATEHYGSVSTNLQAGDNR

SEQ ID NO: 9604 - protein, 30 aa, Artificial Sequence
  Description of Artificial Sequence: Synthetic polypeptide
DEEEIRTTNPVATEQYGSVSESPNLQRVNI

SEQ ID NO: 9605 - protein, 30 aa, Artificial Sequence
  Description of Artificial Sequence: Synthetic polypeptide
DEEEICTTNPMATEQYGSVPTNLQARGNQR

SEQ ID NO: 9606 - protein, 30 aa, Artificial Sequence
  Description of Artificial Sequence: Synthetic polypeptide
DEEEIRTTNPVATEQYGSVASTSGQRGNQD

SEQ ID NO: 9607 - protein, 30 aa, Artificial Sequence
  Description of Artificial Sequence: Synthetic polypeptide
DEEEIRTTNPVATEQYGSVSESNLQRTNQN

SEQ ID NO: 9608 - protein, 30 aa, Artificial Sequence
  Description of Artificial Sequence: Synthetic polypeptide
DEEEIRTTNPVATEQYGSVASTTNLQDGED

SEQ ID NO: 9609 - protein, 30 aa, Artificial Sequence
  Description of Artificial Sequence: Synthetic polypeptide
DEQEIRTTNPVATEQYGSVCSENLQRGGDR

SEQ ID NO: 9610 - protein, 30 aa, Artificial Sequence
  Description of Artificial Sequence: Synthetic polypeptide
DEEEIRTTNPVATEQYGSVSTPNNIQRDNP

SEQ ID NO: 9611 - protein, 29 aa, Artificial Sequence
  Description of Artificial Sequence: Synthetic peptide
DEQEIRTTNPVATEQYGCVATNLQREGND

SEQ ID NO: 9612 - protein, 32 aa, Artificial Sequence
  Description of Artificial Sequence: Synthetic polypeptide
DEEEIRTTNPVATEQYGSVSTPNNLQAGNFRG

SEQ ID NO: 9613 - protein, 30 aa, Artificial Sequence
  Description of Artificial Sequence: Synthetic polypeptide
DEEEICTTNPMATEQYGSVITNLQQRGNGR

SEQ ID NO: 9614 - protein, 28 aa, Artificial Sequence
  Description of Artificial Sequence: Synthetic peptide
DEQEIRTTNPVATECYGSVSTNLEHGER

SEQ ID NO: 9615 - protein, 31 aa, Artificial Sequence
  Description of Artificial Sequence: Synthetic polypeptide
DEEEIRTTNPVATEQYGSVSTPNNQRGMVRE

SEQ ID NO: 9616 - protein, 28 aa, Artificial Sequence
  Description of Artificial Sequence: Synthetic peptide
DEQEIRTTNPVATECYGSVSTDLEQGNR

SEQ ID NO: 9617 - protein, 30 aa, Artificial Sequence
  Description of Artificial Sequence: Synthetic polypeptide
DEEEIRTTNPVATEQYGSVSTPNNQRLERE

SEQ ID NO: 9618 - protein, 30 aa, Artificial Sequence
  Description of Artificial Sequence: Synthetic polypeptide
DEEEIRTTNPVATEQYGSVSTPNNQRMERA

SEQ ID NO: 9619 - protein, 28 aa, Artificial Sequence
  Description of Artificial Sequence: Synthetic peptide
DEQEIRTTNPVATDQYGSVNTPLQRGND

SEQ ID NO: 9620 - protein, 32 aa, Artificial Sequence
  Description of Artificial Sequence: Synthetic polypeptide
DEEEIRTTNPVATEQYGSVSTPNPLQMGSNRL

SEQ ID NO: 9621 - protein, 28 aa, Artificial Sequence
  Description of Artificial Sequence: Synthetic peptide
DEQEIRTTNCVAYTQYGSVSTNLQRGDR

SEQ ID NO: 9622 - protein, 29 aa, Artificial Sequence
  Description of Artificial Sequence: Synthetic peptide
DEQEIRCTNPVATEQYGSVSTNLEDRGNL

SEQ ID NO: 9623 - protein, 31 aa, Artificial Sequence
  Description of Artificial Sequence: Synthetic polypeptide
DEEEIRTTNPVATEQYGSVSTPNPLQNQGNQ

SEQ ID NO: 9624 - protein, 29 aa, Artificial Sequence
  Description of Artificial Sequence: Synthetic peptide
DEEEIRTTNPVATEQYGSVSESNLQRIID

SEQ ID NO: 9625 - protein, 32 aa, Artificial Sequence
  Description of Artificial Sequence: Synthetic polypeptide
DEEEIRTTNPVATEQYGSVSTPNPLQRGNEMN

SEQ ID NO: 9626 - protein, 31 aa, Artificial Sequence
  Description of Artificial Sequence: Synthetic polypeptide
DEEEIRTTNPVATEQYGSVSTPNLSNSNGNR

SEQ ID NO: 9627 - protein, 30 aa, Artificial Sequence
  Description of Artificial Sequence: Synthetic polypeptide
DEEEIRTTNPVATEQYGSVASTNQQTAGNV

SEQ ID NO: 9628 - protein, 30 aa, Artificial Sequence
  Description of Artificial Sequence: Synthetic polypeptide
DEQEIRTTNPVATEQYGSVSTNLQDEGNDQ

SEQ ID NO: 9629 - protein, 30 aa, Artificial Sequence
  Description of Artificial Sequence: Synthetic polypeptide
DEEEIRTTNPVATEQYGSVASTNLNAGNIQ

SEQ ID NO: 9630 - protein, 31 aa, Artificial Sequence
  Description of Artificial Sequence: Synthetic polypeptide
DEEEIRTTNPVATEQYGSVASTNLPQEDGNF

SEQ ID NO: 9631 - protein, 30 aa, Artificial Sequence
  Description of Artificial Sequence: Synthetic polypeptide
DEQEIRTTNPVATEQYGSVSTNLEDREGNL

SEQ ID NO: 9632 - protein, 31 aa, Artificial Sequence
  Description of Artificial Sequence: Synthetic polypeptide
DEEEIRTTNPVATEQYGSVSTPNLQSGGGNI

SEQ ID NO: 9633 - protein, 30 aa, Artificial Sequence
  Description of Artificial Sequence: Synthetic polypeptide
DEQEIRTTNPVATEQYGSVSTNGQQAGNNR

SEQ ID NO: 9634 - protein, 29 aa, Artificial Sequence
  Description of Artificial Sequence: Synthetic peptide
DEQEIRTTNPVATEQYGSVSTNGQDGDND

SEQ ID NO: 9635 - protein, 32 aa, Artificial Sequence
  Description of Artificial Sequence: Synthetic polypeptide
DEEEIRTTNPVATEQYGSVASTNLQDDMGNTR

SEQ ID NO: 9636 - protein, 30 aa, Artificial Sequence
  Description of Artificial Sequence: Synthetic polypeptide
DEEEIRTTNPVATEQYGSVASTNLQDLNMD

SEQ ID NO: 9637 - protein, 31 aa, Artificial Sequence
  Description of Artificial Sequence: Synthetic polypeptide
DEEEIRTTNPVATEQYGSVASTNLQQEFGNA

SEQ ID NO: 9638 - protein, 30 aa, Artificial Sequence
  Description of Artificial Sequence: Synthetic polypeptide
DEQEIRTTNPVATEQYGSVSTGPLQAGGNR

SEQ ID NO: 9639 - protein, 29 aa, Artificial Sequence
  Description of Artificial Sequence: Synthetic peptide
DEQEIRTTNPVATEQYGSVSTGNLDRENE

SEQ ID NO: 9640 - protein, 31 aa, Artificial Sequence
  Description of Artificial Sequence: Synthetic polypeptide
DEQEIRTTNPVATEQYGSVSTGNGEQRGNNR

SEQ ID NO: 9641 - protein, 31 aa, Artificial Sequence
  Description of Artificial Sequence: Synthetic polypeptide
DEEEIRTTNPVATEQYGSVASTNWIQENGNR

SEQ ID NO: 9642 - protein, 30 aa, Artificial Sequence
  Description of Artificial Sequence: Synthetic polypeptide
DEQEIRTTNPVATEQYGSVSTENLQAGGNQ

SEQ ID NO: 9643 - protein, 28 aa, Artificial Sequence
  Description of Artificial Sequence: Synthetic peptide
DEQEIRTTNPVATEQYGSVSTDDQRGEF

SEQ ID NO: 9644 - protein, 30 aa, Artificial Sequence
  Description of Artificial Sequence: Synthetic polypeptide
DEQEIRTTNPVATEQYGSVSTALQHMGENR

SEQ ID NO: 9645 - protein, 31 aa, Artificial Sequence
  Description of Artificial Sequence: Synthetic polypeptide
DEEEIRTTNPVATEQYGSVASTNLQSEMGNA

SEQ ID NO: 9646 - protein, 30 aa, Artificial Sequence
  Description of Artificial Sequence: Synthetic polypeptide
DEQEIRTTNPVATEQYGSVSSTNLQQTGNS

SEQ ID NO: 9647 - protein, 31 aa, Artificial Sequence
  Description of Artificial Sequence: Synthetic polypeptide
DEEEIRTTNPVATEQYGSVSTPNLQTGENEE

SEQ ID NO: 9648 - protein, 29 aa, Artificial Sequence
  Description of Artificial Sequence: Synthetic peptide
DEQEIRTTNPVATEQYGSVSQNLLRNNNR

SEQ ID NO: 9649 - protein, 30 aa, Artificial Sequence
  Description of Artificial Sequence: Synthetic polypeptide
DEQEIRTTNPVATEQYGSVSNQNLFRNGNR

SEQ ID NO: 9650 - protein, 31 aa, Artificial Sequence
  Description of Artificial Sequence: Synthetic polypeptide
DEEEIRTTNPVATEQYGSVASTNLVQTGNGG

SEQ ID NO: 9651 - protein, 30 aa, Artificial Sequence
  Description of Artificial Sequence: Synthetic polypeptide
DEQEIRTTNPVATEQYGSVSETELQERGER

SEQ ID NO: 9652 - protein, 29 aa, Artificial Sequence
  Description of Artificial Sequence: Synthetic peptide
DEQEIRTTNPVATEQYGSVSENLQDVGNS

SEQ ID NO: 9653 - protein, 29 aa, Artificial Sequence
  Description of Artificial Sequence: Synthetic peptide
DEQEIRTTNPVATEQYGSVSENLFRNTNR

SEQ ID NO: 9654 - protein, 30 aa, Artificial Sequence
  Description of Artificial Sequence: Synthetic polypeptide
DEQEIRTTNPVATEQYGSVSDTNLQLGMER

SEQ ID NO: 9655 - protein, 31 aa, Artificial Sequence
  Description of Artificial Sequence: Synthetic polypeptide
DEEEIRTTNPVATEQYGSVSTPNLQVGENSN

SEQ ID NO: 9656 - protein, 28 aa, Artificial Sequence
  Description of Artificial Sequence: Synthetic peptide
DEQEIRTTNPVATEQYGSVSTDLQLGEP

SEQ ID NO: 9657 - protein, 30 aa, Artificial Sequence
  Description of Artificial Sequence: Synthetic polypeptide
DEEEICTTNPLATEQYGSVPTNLQPRGNGR

SEQ ID NO: 9658 - protein, 30 aa, Artificial Sequence
  Description of Artificial Sequence: Synthetic polypeptide
DEEEICTTNPLATEQYGSVFTNLQHRGNGR

SEQ ID NO: 9659 - protein, 29 aa, Artificial Sequence
  Description of Artificial Sequence: Synthetic peptide
DEEEIRTTNPVATEQYGSVATALQRENQM

SEQ ID NO: 9660 - protein, 31 aa, Artificial Sequence
  Description of Artificial Sequence: Synthetic polypeptide
DEEEIRTTNPVATEQYGSVSTQGLQMDGTNR

SEQ ID NO: 9661 - protein, 29 aa, Artificial Sequence
  Description of Artificial Sequence: Synthetic peptide
CEEEIATTNPVATEQYGVVSTNLQRGDNQ

SEQ ID NO: 9662 - protein, 29 aa, Artificial Sequence
  Description of Artificial Sequence: Synthetic peptide
DEEEIRTTNPVATEQYGSVSENPVMRGND

SEQ ID NO: 9663 - protein, 30 aa, Artificial Sequence
  Description of Artificial Sequence: Synthetic polypeptide
DEEEIRTTNPVATEQYGSVSENNPQRGNSV

SEQ ID NO: 9664 - protein, 29 aa, Artificial Sequence
  Description of Artificial Sequence: Synthetic peptide
DEEEIRTTNPVATEQYGSVSTQLFEMGNT

SEQ ID NO: 9665 - protein, 30 aa, Artificial Sequence
  Description of Artificial Sequence: Synthetic polypeptide
DEEEIRTTNPVATEQYGSVSENLVTRGERN

SEQ ID NO: 9666 - protein, 29 aa, Artificial Sequence
  Description of Artificial Sequence: Synthetic peptide
DEQEIATTNPVATEQYGSVSTNLQDGSNN

SEQ ID NO: 9667 - protein, 28 aa, Artificial Sequence
  Description of Artificial Sequence: Synthetic peptide
DEEEIRTTNPVATEQYGSVATNDFRENM

SEQ ID NO: 9668 - protein, 30 aa, Artificial Sequence
  Description of Artificial Sequence: Synthetic polypeptide
DEEEIRTTNPVATEQYGSVATNDFTRGNER

SEQ ID NO: 9669 - protein, 30 aa, Artificial Sequence
  Description of Artificial Sequence: Synthetic polypeptide
DEEEIRTTNPVATEQYGSVATNDGDRGNER

SEQ ID NO: 9670 - protein, 28 aa, Artificial Sequence
  Description of Artificial Sequence: Synthetic peptide
DEQEIATTNPVATEQYGSVSTNLERGEL

SEQ ID NO: 9671 - protein, 29 aa, Artificial Sequence
  Description of Artificial Sequence: Synthetic peptide
DEEEIRTTNPVATEQYGSVSTQLIDGMNE

SEQ ID NO: 9672 - protein, 28 aa, Artificial Sequence
  Description of Artificial Sequence: Synthetic peptide
DEEEIRTTNPVATEQYGSVATNDIRDNN

SEQ ID NO: 9673 - protein, 30 aa, Artificial Sequence
  Description of Artificial Sequence: Synthetic polypeptide
DEEEIRTTNPVATEQYGSVSTQDQRMNDRQ

SEQ ID NO: 9674 - protein, 30 aa, Artificial Sequence
  Description of Artificial Sequence: Synthetic polypeptide
DEEEIRTTNPVATEQYGSVATNDLERGDNQ

SEQ ID NO: 9675 - protein, 31 aa, Artificial Sequence
  Description of Artificial Sequence: Synthetic polypeptide
DEEEIRTTNPVATEQYGSVATNDLQRGENPT

SEQ ID NO: 9676 - protein, 31 aa, Artificial Sequence
  Description of Artificial Sequence: Synthetic polypeptide
DEEEIRTTNPVATEQYGSVATNDLQRGENTD

SEQ ID NO: 9677 - protein, 31 aa, Artificial Sequence
  Description of Artificial Sequence: Synthetic polypeptide
DEEEIRTTNPVATEQYGSVATNDLQRGPNEQ

SEQ ID NO: 9678 - protein, 29 aa, Artificial Sequence
  Description of Artificial Sequence: Synthetic peptide
DEEEIRTTNPVATEQYGSVATNDQAGNDD

SEQ ID NO: 9679 - protein, 30 aa, Artificial Sequence
  Description of Artificial Sequence: Synthetic polypeptide
DEEEIRTTNPVATEQYGSVATNDQEAGNRD

SEQ ID NO: 9680 - protein, 29 aa, Artificial Sequence
  Description of Artificial Sequence: Synthetic peptide
DEEEIRTTNPVATEQYGSVSTQLNFNGNG

SEQ ID NO: 9681 - protein, 30 aa, Artificial Sequence
  Description of Artificial Sequence: Synthetic polypeptide
DEEEIRTTNPVATEQYGSVATNDQNRGNVY

SEQ ID NO: 9682 - protein, 28 aa, Artificial Sequence
  Description of Artificial Sequence: Synthetic peptide
DEEEIRTTNPVATEQYGSVATNDSRSNA

SEQ ID NO: 9683 - protein, 30 aa, Artificial Sequence
  Description of Artificial Sequence: Synthetic polypeptide
DEEEIRTTNPVATEQYGSVATNDTDRGNIR

SEQ ID NO: 9684 - protein, 30 aa, Artificial Sequence
  Description of Artificial Sequence: Synthetic polypeptide
DEEEIRTTNPVATEQYGSVATNELTQGNPR

SEQ ID NO: 9685 - protein, 29 aa, Artificial Sequence
  Description of Artificial Sequence: Synthetic peptide
DEEEIRTTNPVATEQYGSVATNEQEGNDF

SEQ ID NO: 9686 - protein, 29 aa, Artificial Sequence
  Description of Artificial Sequence: Synthetic peptide
DEEEIRTTNPVATEQYGSVATNEQEGNEQ

SEQ ID NO: 9687 - protein, 30 aa, Artificial Sequence
  Description of Artificial Sequence: Synthetic polypeptide
DEEEIRTTNPVATEQYGSVATNEQRGNSFM

SEQ ID NO: 9688 - protein, 30 aa, Artificial Sequence
  Description of Artificial Sequence: Synthetic polypeptide
DEEEIRTTNPVATEQYGSVATNDLNRGNED

SEQ ID NO: 9689 - protein, 30 aa, Artificial Sequence
  Description of Artificial Sequence: Synthetic polypeptide
DEEEIRTTNPVATEQYGSVSENTLQRDQNM

SEQ ID NO: 9690 - protein, 28 aa, Artificial Sequence
  Description of Artificial Sequence: Synthetic peptide
DEEEIRTTNPVATEQYGSVATNDDRING

SEQ ID NO: 9691 - protein, 30 aa, Artificial Sequence
  Description of Artificial Sequence: Synthetic polypeptide
DEEEIRTTNPVATEQYGSVATNDDQRQNRE

SEQ ID NO: 9692 - protein, 29 aa, Artificial Sequence
  Description of Artificial Sequence: Synthetic peptide
DEEEIRTTNPVATEQYGSVATALQRQNHQ

SEQ ID NO: 9693 - protein, 30 aa, Artificial Sequence
  Description of Artificial Sequence: Synthetic polypeptide
DEQEIRCTNPVASEQYGSVSATNLQRNGNR

SEQ ID NO: 9694 - protein, 28 aa, Artificial Sequence
  Description of Artificial Sequence: Synthetic peptide
DEQEIRCTNPVASEIYGCVSTNLQRGNR

SEQ ID NO: 9695 - protein, 31 aa, Artificial Sequence
  Description of Artificial Sequence: Synthetic polypeptide
DEEEIRTTNPVATEQYGSVATANLPQRENRF

SEQ ID NO: 9696 - protein, 30 aa, Artificial Sequence
  Description of Artificial Sequence: Synthetic polypeptide
DEEEICTTNPFATEQYGSVCTNLQHRGNSR

SEQ ID NO: 9697 - protein, 31 aa, Artificial Sequence
  Description of Artificial Sequence: Synthetic polypeptide
DEEEIRTTNPVATEQYGSVSTPNPQERANER

SEQ ID NO: 9698 - protein, 28 aa, Artificial Sequence
  Description of Artificial Sequence: Synthetic peptide
DEQEIRATNPVATEQYGEVSTNLQHGGR

SEQ ID NO: 9699 - protein, 28 aa, Artificial Sequence
  Description of Artificial Sequence: Synthetic peptide
DEEEIRTTNPVATEQYGSVSEQLTRGSS

SEQ ID NO: 9700 - protein, 30 aa, Artificial Sequence
  Description of Artificial Sequence: Synthetic polypeptide
DEEEIRTTNPVATEQYGSVSTPNVQGDGNH

SEQ ID NO: 9701 - protein, 29 aa, Artificial Sequence
  Description of Artificial Sequence: Synthetic peptide
DEEEIRTTNPVATEQYGSVATDLQEGMRN

SEQ ID NO: 9702 - protein, 29 aa, Artificial Sequence
  Description of Artificial Sequence: Synthetic peptide
DEEEIRTTNPVATEQYGSVATDLQGGDRD

SEQ ID NO: 9703 - protein, 30 aa, Artificial Sequence
  Description of Artificial Sequence: Synthetic polypeptide
DEEEIRTTNPVATEQYGSVSTPNVQTGNMT

SEQ ID NO: 9704 - protein, 29 aa, Artificial Sequence
  Description of Artificial Sequence: Synthetic peptide
DEEEIRTTNPVATEQYGSVATDLQGGSRN

SEQ ID NO: 9705 - protein, 31 aa, Artificial Sequence
  Description of Artificial Sequence: Synthetic polypeptide
DEEEIRTTNPVATEQYGSVSTPPLQYFGNRS

SEQ ID NO: 9706 - protein, 29 aa, Artificial Sequence
  Description of Artificial Sequence: Synthetic peptide
DEEEIRTTNPVATEQYGSVSTPPQASVNR

SEQ ID NO: 9707 - protein, 30 aa, Artificial Sequence
  Description of Artificial Sequence: Synthetic polypeptide
DEEEICTTNPCATEQYGSVPTNLQFRGNTR

SEQ ID NO: 9708 - protein, 30 aa, Artificial Sequence
  Description of Artificial Sequence: Synthetic polypeptide
DEEEIRTTNPVATEQYGSVSTPQLGQMGNG

SEQ ID NO: 9709 - protein, 30 aa, Artificial Sequence
  Description of Artificial Sequence: Synthetic polypeptide
DEEEICTTNPCATEQYGSVCTNLQDRGNGR

SEQ ID NO: 9710 - protein, 29 aa, Artificial Sequence
  Description of Artificial Sequence: Synthetic peptide
DEEEIRTTNPVATEQYGSVSTPQQRGEEL

SEQ ID NO: 9711 - protein, 30 aa, Artificial Sequence
  Description of Artificial Sequence: Synthetic polypeptide
DEEEIRTTNPVATEQYGSVSTPTLQDGPDR

SEQ ID NO: 9712 - protein, 31 aa, Artificial Sequence
  Description of Artificial Sequence: Synthetic polypeptide
DEEEIRTTNPVATEQYGSVATDNLQPGENRM

SEQ ID NO: 9713 - protein, 30 aa, Artificial Sequence
  Description of Artificial Sequence: Synthetic polypeptide
DEEEIRTTNPVATEQYGSVATFTLQRGNLL

SEQ ID NO: 9714 - protein, 31 aa, Artificial Sequence
  Description of Artificial Sequence: Synthetic polypeptide
DEEEIRTTNPVATEQYGSVATGNLQRGNNSM

SEQ ID NO: 9715 - protein, 30 aa, Artificial Sequence
  Description of Artificial Sequence: Synthetic polypeptide
DEEEICTTNPAATEQYGSVPTNLQYRGNGR

SEQ ID NO: 9716 - protein, 29 aa, Artificial Sequence
  Description of Artificial Sequence: Synthetic peptide
DEEEIRTTNPVATEQYGSVSTPVELRGDR

SEQ ID NO: 9717 - protein, 30 aa, Artificial Sequence
  Description of Artificial Sequence: Synthetic polypeptide
DEEEICTTNPAATEQYGSVMTNLQMRGNGR

SEQ ID NO: 9718 - protein, 29 aa, Artificial Sequence
  Description of Artificial Sequence: Synthetic peptide
DEEEIRTTNPVATEQYGSVSENVQRGEET

SEQ ID NO: 9719 - protein, 28 aa, Artificial Sequence
  Description of Artificial Sequence: Synthetic peptide
DEQEIATTNPVATEYYGSVSTNGQRGNM

SEQ ID NO: 9720 - protein, 30 aa, Artificial Sequence
  Description of Artificial Sequence: Synthetic polypeptide
DEEEIRTTNPVATEQYGSVSENVLENRENR

SEQ ID NO: 9721 - protein, 29 aa, Artificial Sequence
  Description of Artificial Sequence: Synthetic peptide
DEQEIRTTNPVATEQYGSVSTNLQDNENS

SEQ ID NO: 9722 - protein, 30 aa, Artificial Sequence
  Description of Artificial Sequence: Synthetic polypeptide
DEEEIRTTNPVATEQYGSVACTNLQRENPA

SEQ ID NO: 9723 - protein, 30 aa, Artificial Sequence
  Description of Artificial Sequence: Synthetic polypeptide
DEQEIRTTNPVATEQYGSVSTNLQGVGNQS

SEQ ID NO: 9724 - protein, 31 aa, Artificial Sequence
  Description of Artificial Sequence: Synthetic polypeptide
DEQEIRTTNPVATEQYGSVSTNLQIDGENDR

SEQ ID NO: 9725 - protein, 28 aa, Artificial Sequence
  Description of Artificial Sequence: Synthetic peptide
DESAIRTTNPVATEQYGSCSTNLIIGNR

SEQ ID NO: 9726 - protein, 29 aa, Artificial Sequence
  Description of Artificial Sequence: Synthetic peptide
DEEEIRTTNPVATEQYGSVANNLQHGPNY

SEQ ID NO: 9727 - protein, 28 aa, Artificial Sequence
  Description of Artificial Sequence: Synthetic peptide
DEREIYTTNPVATEQYGSVSTNLHVGNT

SEQ ID NO: 9728 - protein, 29 aa, Artificial Sequence
  Description of Artificial Sequence: Synthetic peptide
DEEEIRTTNPVATEQYGSVANNLQRENQH

SEQ ID NO: 9729 - protein, 30 aa, Artificial Sequence
  Description of Artificial Sequence: Synthetic polypeptide
DEEEIRTTNPVATEQYGSVSTPNLQFPGDI

SEQ ID NO: 9730 - protein, 28 aa, Artificial Sequence
  Description of Artificial Sequence: Synthetic peptide
DEREIRTTNPVATWHYGSVSTNLQRTNM

SEQ ID NO: 9731 - protein, 28 aa, Artificial Sequence
  Description of Artificial Sequence: Synthetic peptide
DEREIRTTNPVATQQYGCVSTNLERGNP

SEQ ID NO: 9732 - protein, 31 aa, Artificial Sequence
  Description of Artificial Sequence: Synthetic polypeptide
DEEEIRTTNPVATEQYGSVSTPNLQGSGNQN

SEQ ID NO: 9733 - protein, 30 aa, Artificial Sequence
  Description of Artificial Sequence: Synthetic polypeptide
DEREIRTTNPVATEQYGSVSTNLQSNSNRY

SEQ ID NO: 9734 - protein, 30 aa, Artificial Sequence
  Description of Artificial Sequence: Synthetic polypeptide
DEREIRTTNPVATEQYGSVSTNLQNVENRG

SEQ ID NO: 9735 - protein, 31 aa, Artificial Sequence
  Description of Artificial Sequence: Synthetic polypeptide
DEREIRTTNPVATEQYGSVSTNLQDGGNNMR

SEQ ID NO: 9736 - protein, 31 aa, Artificial Sequence
  Description of Artificial Sequence: Synthetic polypeptide
DEEEIRTTNPVATEQYGSVSTPNLQHGGNQS

SEQ ID NO: 9737 - protein, 31 aa, Artificial Sequence
  Description of Artificial Sequence: Synthetic polypeptide
DEEEIRTTNPVATEQYGSVSTPNLQIAGNIN

SEQ ID NO: 9738 - protein, 31 aa, Artificial Sequence
  Description of Artificial Sequence: Synthetic polypeptide
DEEEIRTTNPVATEQYGSVANNLQERGNVRW

SEQ ID NO: 9739 - protein, 29 aa, Artificial Sequence
  Description of Artificial Sequence: Synthetic peptide
DEREIRTTNPVATEQYGSVSTNDQRGSQQ

SEQ ID NO: 9740 - protein, 28 aa, Artificial Sequence
  Description of Artificial Sequence: Synthetic peptide
DEREIRTTNPVATEQYGSVSTNDQMGEM

SEQ ID NO: 9741 - protein, 31 aa, Artificial Sequence
  Description of Artificial Sequence: Synthetic polypeptide
DEEEIRTTNPVATEQYGSVANTNLQERGDRQ

SEQ ID NO: 9742 - protein, 30 aa, Artificial Sequence
  Description of Artificial Sequence: Synthetic polypeptide
DEEEIRTTNPVATEQYGSVANTNLQRPNEM

SEQ ID NO: 9743 - protein, 30 aa, Artificial Sequence
  Description of Artificial Sequence: Synthetic polypeptide
DEREIRTTNPVATEQYGSVSTHDQRGNERV

SEQ ID NO: 9744 - protein, 28 aa, Artificial Sequence
  Description of Artificial Sequence: Synthetic peptide
DEREIRTTNPVATEQYGSVSTDDQRGDV

SEQ ID NO: 9745 - protein, 31 aa, Artificial Sequence
  Description of Artificial Sequence: Synthetic polypeptide
DEEEIRTTNPVATEQYGSVANTNLQTGGNDR

SEQ ID NO: 9746 - protein, 31 aa, Artificial Sequence
  Description of Artificial Sequence: Synthetic polypeptide
DEEEIRTTNPVATEQYGSVSTPNLQNFGNQN

SEQ ID NO: 9747 - protein, 28 aa, Artificial Sequence
  Description of Artificial Sequence: Synthetic peptide
DEREIRTTNPVATEQYGETSTNLQRGDA

SEQ ID NO: 9748 - protein, 29 aa, Artificial Sequence
  Description of Artificial Sequence: Synthetic peptide
DEREIRTTNPVATEQYGDVSTNNQNGSNR

SEQ ID NO: 9749 - protein, 31 aa, Artificial Sequence
  Description of Artificial Sequence: Synthetic polypeptide
DEEEIRTTNPVATEQYGSVSETGLQRMNARI

SEQ ID NO: 9750 - protein, 28 aa, Artificial Sequence
  Description of Artificial Sequence: Synthetic peptide
DEREIRTTNPVATDQYGSVLTQLQRGND

SEQ ID NO: 9751 - protein, 32 aa, Artificial Sequence
  Description of Artificial Sequence: Synthetic polypeptide
DEEEIRTTNPVATEQYGSVSETEVLQRGNDRV

SEQ ID NO: 9752 - protein, 28 aa, Artificial Sequence
  Description of Artificial Sequence: Synthetic peptide
DERAIRTTNPVATEQYGSYSTNLIIGNR

SEQ ID NO: 9753 - protein, 29 aa, Artificial Sequence
  Description of Artificial Sequence: Synthetic peptide
DEREIRTTNPVATEQYGSVSTNDQRGEDH

SEQ ID NO: 9754 - protein, 28 aa, Artificial Sequence
  Description of Artificial Sequence: Synthetic peptide
DEQVIRTTNPVATEQYGCVETNEQRGNR

SEQ ID NO: 9755 - protein, 30 aa, Artificial Sequence
  Description of Artificial Sequence: Synthetic polypeptide
DEEEIRTTNPVATEQYGSVANNLQEMGNDR

SEQ ID NO: 9756 - protein, 28 aa, Artificial Sequence
  Description of Artificial Sequence: Synthetic peptide
DEEEIRTTNPVATEQYGSVANNLEDGNE

SEQ ID NO: 9757 - protein, 31 aa, Artificial Sequence
  Description of Artificial Sequence: Synthetic polypeptide
DEEEIRTTNPVATEQYGSVSTPNLQARAGDD

SEQ ID NO: 9758 - protein, 31 aa, Artificial Sequence
  Description of Artificial Sequence: Synthetic polypeptide
DEEEIRTTNPVATEQYGSVSTPNLQARIGDI

SEQ ID NO: 9759 - protein, 29 aa, Artificial Sequence
  Description of Artificial Sequence: Synthetic peptide
DEEEIRTTNPVATEQYGSVSTPNLQDAPM

SEQ ID NO: 9760 - protein, 30 aa, Artificial Sequence
  Description of Artificial Sequence: Synthetic polypeptide
DEEEIRTTNPVATEQYGSVADTNGLQRGLT

SEQ ID NO: 9761 - protein, 29 aa, Artificial Sequence
  Description of Artificial Sequence: Synthetic peptide
DEEEIRTTNPVATEQYGSVAEGLQRGNID

SEQ ID NO: 9762 - protein, 29 aa, Artificial Sequence
  Description of Artificial Sequence: Synthetic peptide
DEEEIRTTNPVATEQYGSVAEGLQRGNST

SEQ ID NO: 9763 - protein, 28 aa, Artificial Sequence
  Description of Artificial Sequence: Synthetic peptide
DEEEIRTTNPVATEQYGSVAENLDQGNL

SEQ ID NO: 9764 - protein, 30 aa, Artificial Sequence
  Description of Artificial Sequence: Synthetic polypeptide
DEEEIRTTNPVATEQYGSVAENLQNPGNSR

SEQ ID NO: 9765 - protein, 28 aa, Artificial Sequence
  Description of Artificial Sequence: Synthetic peptide
DEEEIRTTNPVATEQYGSVAENLQQHDR

SEQ ID NO: 9766 - protein, 29 aa, Artificial Sequence
  Description of Artificial Sequence: Synthetic peptide
DESEIATTNPVATEHYGSVSTNLQRDGNP

SEQ ID NO: 9767 - protein, 31 aa, Artificial Sequence
  Description of Artificial Sequence: Synthetic polypeptide
DEEEIRTTNPVATEQYGSVAENLQRGVNPRE

SEQ ID NO: 9768 - protein, 30 aa, Artificial Sequence
  Description of Artificial Sequence: Synthetic polypeptide
DEEEIRTTNPVATEQYGSVAETGNLQAGNN

SEQ ID NO: 9769 - protein, 29 aa, Artificial Sequence
  Description of Artificial Sequence: Synthetic peptide
DEEEICTTNPVATECYGSVSTNLQMDGND

SEQ ID NO: 9770 - protein, 30 aa, Artificial Sequence
  Description of Artificial Sequence: Synthetic polypeptide
DEEEIRTTNPVATEQYGSVANNLERGDNRL

SEQ ID NO: 9771 - protein, 28 aa, Artificial Sequence
  Description of Artificial Sequence: Synthetic peptide
DEEEIRTTNPVATEQYGSVSETLDRGLV

SEQ ID NO: 9772 - protein, 30 aa, Artificial Sequence
  Description of Artificial Sequence: Synthetic polypeptide
DEEEIRTTNPVATEQYGSVAGNLQNRDGNN

SEQ ID NO: 9773 - protein, 31 aa, Artificial Sequence
  Description of Artificial Sequence: Synthetic polypeptide
DEEEIRTTNPVATEQYGSVSTPNLQESGQNN

SEQ ID NO: 9774 - protein, 30 aa, Artificial Sequence
  Description of Artificial Sequence: Synthetic polypeptide
DEEEIRTTNPVATEQYGSVSTPNLQETGDE

SEQ ID NO: 9775 - protein, 30 aa, Artificial Sequence
  Description of Artificial Sequence: Synthetic polypeptide
DEEEIRTTNPVATEQYGSVAGTNLQRAPPR

SEQ ID NO: 9776 - protein, 31 aa, Artificial Sequence
  Description of Artificial Sequence: Synthetic polypeptide
DEEEIRTTNPVATEQYGSVSTPNLQETGNIE

SEQ ID NO: 9777 - protein, 32 aa, Artificial Sequence
  Description of Artificial Sequence: Synthetic polypeptide
DEEEIRTTNPVATEQYGSVAITNLQNRGDNRA

SEQ ID NO: 9778 - protein, 31 aa, Artificial Sequence
  Description of Artificial Sequence: Synthetic polypeptide
DEEEIRTTNPVATEQYGSVAITNLQNRGNED

SEQ ID NO: 9779 - protein, 31 aa, Artificial Sequence
  Description of Artificial Sequence: Synthetic polypeptide
DEEEIRTTNPVATEQYGSVSTPNLQFGGNTS

SEQ ID NO: 9780 - protein, 30 aa, Artificial Sequence
  Description of Artificial Sequence: Synthetic polypeptide
DEEEIRTTNPVATEQYGSVAMNGLQRGNNS

SEQ ID NO: 9781 - protein, 32 aa, Artificial Sequence
  Description of Artificial Sequence: Synthetic polypeptide
DEEEIRTTNPVATEQYGSVSETGNLQRVGNIN

SEQ ID NO: 9782 - protein, 31 aa, Artificial Sequence
  Description of Artificial Sequence: Synthetic polypeptide
DEEEIRTTNPVATEQYGSVAMNLQERGNPRH

SEQ ID NO: 9783 - protein, 29 aa, Artificial Sequence
  Description of Artificial Sequence: Synthetic peptide
DEEEIRTTNPVATEQYGSVAMNLQLGNAD

SEQ ID NO: 9784 - protein, 29 aa, Artificial Sequence
  Description of Artificial Sequence: Synthetic peptide
DEEEIRTTNPVATEQYGSVANMNLQDGND

SEQ ID NO: 9785 - protein, 31 aa, Artificial Sequence
  Description of Artificial Sequence: Synthetic polypeptide
DEEEIRTTNPVATEQYGSVAETNLQRGNQGN

SEQ ID NO: 9786 - protein, 29 aa, Artificial Sequence
  Description of Artificial Sequence: Synthetic peptide
DEEEIRTTNPVATEQYGSVAPNNLQDGNM

SEQ ID NO: 9787 - protein, 31 aa, Artificial Sequence
  Description of Artificial Sequence: Synthetic polypeptide
DEEEIRTTNPVATEQYGSVSTPNLQNLGNAN

SEQ ID NO: 9788 - protein, 29 aa, Artificial Sequence
  Description of Artificial Sequence: Synthetic peptide
DEEEIRTTNPVATEQYGSVAPTNLQDGLD

SEQ ID NO: 9789 - protein, 31 aa, Artificial Sequence
  Description of Artificial Sequence: Synthetic polypeptide
DEEEIRTTNPVATEQYGSVSTPNLQQMGLRE

SEQ ID NO: 9790 - protein, 30 aa, Artificial Sequence
  Description of Artificial Sequence: Synthetic polypeptide
DEEEICTTNPTATEQYGSVTTNLQQRGNGR

SEQ ID NO: 9791 - protein, 30 aa, Artificial Sequence
  Description of Artificial Sequence: Synthetic polypeptide
DEEEICTTNPTATEQYGSVPTNLQGRGNGR

SEQ ID NO: 9792 - protein, 30 aa, Artificial Sequence
  Description of Artificial Sequence: Synthetic polypeptide
DEEEICTTNPTATEQYGSVATNLQHRGNPR

SEQ ID NO: 9793 - protein, 31 aa, Artificial Sequence
  Description of Artificial Sequence: Synthetic polypeptide
DEEEIRTTNPVATEQYGSVSTPNLQRANNIV

SEQ ID NO: 9794 - protein, 31 aa, Artificial Sequence
  Description of Artificial Sequence: Synthetic polypeptide
DEEEIRTTNPVATEQYGSVSTPNLQRANNLG

SEQ ID NO: 9795 - protein, 32 aa, Artificial Sequence
  Description of Artificial Sequence: Synthetic polypeptide
DEEEIRTTNPVATEQYGSVSTPNLQREGVNTE

SEQ ID NO: 9796 - protein, 31 aa, Artificial Sequence
  Description of Artificial Sequence: Synthetic polypeptide
DEEEIRTTNPVATEQYGSVSTPNLQRFENVT

SEQ ID NO: 9797 - protein, 31 aa, Artificial Sequence
  Description of Artificial Sequence: Synthetic polypeptide
DEEEIRTTNPVATEQYGSVSTPNLQRGEVLE

SEQ ID NO: 9798 - protein, 31 aa, Artificial Sequence
  Description of Artificial Sequence: Synthetic polypeptide
DEEEIRTTNPVATEQYGSVSTPNLQRGIGIG

SEQ ID NO: 9799 - protein, 33 aa, Artificial Sequence
  Description of Artificial Sequence: Synthetic polypeptide
DEEEIRTTNPVATEQYGSVASTNALSQRTGNNR

SEQ ID NO: 9800 - protein, 31 aa, Artificial Sequence
  Description of Artificial Sequence: Synthetic polypeptide
DEEEIRTTNPVATEQYGSVASTNDIQKQGNR

SEQ ID NO: 9801 - protein, 31 aa, Artificial Sequence
  Description of Artificial Sequence: Synthetic polypeptide
DEEEIRTTNPVATEQYGSVASTNDLQRENDS

SEQ ID NO: 9802 - protein, 30 aa, Artificial Sequence
  Description of Artificial Sequence: Synthetic polypeptide
DEEEIRTTNPVATEQYGSVASTGLERGNEH

SEQ ID NO: 9803 - protein, 30 aa, Artificial Sequence
  Description of Artificial Sequence: Synthetic polypeptide
DEQEIRTTNPVATEQYGSVSTNPQDDGMNR

SEQ ID NO: 9804 - protein, 29 aa, Artificial Sequence
  Description of Artificial Sequence: Synthetic peptide
DEQEIRTTNPVATEQYGSVSTNNQAEGDR

SEQ ID NO: 9805 - protein, 29 aa, Artificial Sequence
  Description of Artificial Sequence: Synthetic peptide
DEQEIRTTNPVATEQYGSVSTNNDEGNRQ

SEQ ID NO: 9806 - protein, 31 aa, Artificial Sequence
  Description of Artificial Sequence: Synthetic polypeptide
DEEEIRTTNPVATEQYGSVSTPNLQRGVMVE

SEQ ID NO: 9807 - protein, 31 aa, Artificial Sequence
  Description of Artificial Sequence: Synthetic polypeptide
DEEEIRTTNPVATEQYGSVSTPNLQRNVFNF

SEQ ID NO: 9808 - protein, 31 aa, Artificial Sequence
  Description of Artificial Sequence: Synthetic polypeptide
DEEEIRTTNPVATEQYGSVSTPNLQRQENAT

SEQ ID NO: 9809 - protein, 30 aa, Artificial Sequence
  Description of Artificial Sequence: Synthetic polypeptide
DEQEIRTTNPVATEQYGSVSTNLQVRMNEF

SEQ ID NO: 9810 - protein, 30 aa, Artificial Sequence
  Description of Artificial Sequence: Synthetic polypeptide
DEQEIRTTNPVATEQYGSVSTNLQVGVDRM

SEQ ID NO: 9811 - protein, 29 aa, Artificial Sequence
  Description of Artificial Sequence: Synthetic peptide
DEQEIRTTNPVATEQYGSVSTNLQTNNQG

SEQ ID NO: 9812 - protein, 31 aa, Artificial Sequence
  Description of Artificial Sequence: Synthetic polypeptide
DEQEIRTTNPVATEQYGSVSTNLQRPGDVRP

SEQ ID NO: 9813 - protein, 31 aa, Artificial Sequence
  Description of Artificial Sequence: Synthetic polypeptide
DEQEIRTTNPVATEQYGSVSTNLQRGGDGRV

SEQ ID NO: 9814 - protein, 30 aa, Artificial Sequence
  Description of Artificial Sequence: Synthetic polypeptide
DEQEIRTTNPVATEQYGSVSTNLQQRMNPV

SEQ ID NO: 9815 - protein, 29 aa, Artificial Sequence
  Description of Artificial Sequence: Synthetic peptide
DEQEIRTTNPVATEQYGSVSTNLQQGQSG

SEQ ID NO: 9816 - protein, 30 aa, Artificial Sequence
  Description of Artificial Sequence: Synthetic polypeptide
DEQEIRTTNPVATEQYGSVSTNLQMGNPNN

SEQ ID NO: 9817 - protein, 30 aa, Artificial Sequence
  Description of Artificial Sequence: Synthetic polypeptide
DEQEIRTTNPVATEQYGSVSTNNQDGGTNR

SEQ ID NO: 9818 - protein, 30 aa, Artificial Sequence
  Description of Artificial Sequence: Synthetic polypeptide
DEEEIRTTNPVATEQYGSVASTELERGNDD

SEQ ID NO: 9819 - protein, 31 aa, Artificial Sequence
  Description of Artificial Sequence: Synthetic polypeptide
DEEEIRTTNPVATEQYGSVSTPNLQQMGENS

SEQ ID NO: 9820 - protein, 31 aa, Artificial Sequence
  Description of Artificial Sequence: Synthetic polypeptide
DEEEIRTTNPVATEQYGSVASTCPLQRKGNL

SEQ ID NO: 9821 - protein, 29 aa, Artificial Sequence
  Description of Artificial Sequence: Synthetic peptide
DEEEIRTTNPVATEQYGSVAQNGQPGNER

SEQ ID NO: 9822 - protein, 30 aa, Artificial Sequence
  Description of Artificial Sequence: Synthetic polypeptide
DEEEIRTTNPVATEQYGSVSTPNLQNMGQP

SEQ ID NO: 9823 - protein, 28 aa, Artificial Sequence
  Description of Artificial Sequence: Synthetic peptide
DEQEIYTTNPVATEQYGSVSTNLNPGNT

SEQ ID NO: 9824 - protein, 28 aa, Artificial Sequence
  Description of Artificial Sequence: Synthetic peptide
DEQEIVATNPVATEQYGVVSTNLQRGNQ

SEQ ID NO: 9825 - protein, 29 aa, Artificial Sequence
  Description of Artificial Sequence: Synthetic peptide
DEQEISTTNPVATEQYGSVATNLQVGNRQ

SEQ ID NO: 9826 - protein, 31 aa, Artificial Sequence
  Description of Artificial Sequence: Synthetic polypeptide
DEEEIRTTNPVATEQYGSVSTPNLQNQGNNM

SEQ ID NO: 9827 - protein, 28 aa, Artificial Sequence
  Description of Artificial Sequence: Synthetic peptide
DEQEIRTTNPVCTEQYGSVSENLCHGNR

SEQ ID NO: 9828 - protein, 29 aa, Artificial Sequence
  Description of Artificial Sequence: Synthetic peptide
DEQEIRTTNPVCTEHYGSVSMTNLQRGNL

SEQ ID NO: 9829 - protein, 30 aa, Artificial Sequence
  Description of Artificial Sequence: Synthetic polypeptide
DEEEIRTTNPVATEQYGSVAQTNLQRAMND

SEQ ID NO: 9830 - protein, 31 aa, Artificial Sequence
  Description of Artificial Sequence: Synthetic polypeptide
DEEEIRTTNPVATEQYGSVASANLQRGNEIG

SEQ ID NO: 9831 - protein, 31 aa, Artificial Sequence
  Description of Artificial Sequence: Synthetic polypeptide
DEEEIRTTNPVATEQYGSVASCTNLSVQGNR

SEQ ID NO: 9832 - protein, 29 aa, Artificial Sequence
  Description of Artificial Sequence: Synthetic peptide
DEQEIRTTNPVATESYGSVSTNNGQEGNR

SEQ ID NO: 9833 - protein, 29 aa, Artificial Sequence
  Description of Artificial Sequence: Synthetic peptide
DEQEIRTTNPVATESYGSVSTELQMGDNR

SEQ ID NO: 9834 - protein, 28 aa, Artificial Sequence
  Description of Artificial Sequence: Synthetic peptide
DEEEIRTTNPVATEQYGSVASNLERGLI

SEQ ID NO: 9835 - protein, 30 aa, Artificial Sequence
  Description of Artificial Sequence: Synthetic polypeptide
DEEEIRTTNPVATEQYGSVASNLQRGEEGR

SEQ ID NO: 9836 - protein, 28 aa, Artificial Sequence
  Description of Artificial Sequence: Synthetic peptide
DEQEIRTTNPVATEQYGVVSTNLQHGQQ

SEQ ID NO: 9837 - protein, 30 aa, Artificial Sequence
  Description of Artificial Sequence: Synthetic polypeptide
DEEEICTTNPVATEAYGSVSTNHSQRPGNR

SEQ ID NO: 9838 - protein, 28 aa, Artificial Sequence
  Description of Artificial Sequence: Synthetic peptide
DEQEIRTTNPVATEQYGVVSTLLQRPNE

SEQ ID NO: 9839 - protein, 29 aa, Artificial Sequence
  Description of Artificial Sequence: Synthetic peptide
DEQEIRTTNPVATEQYGVVSTLLQRGMND

SEQ ID NO: 9840 - protein, 30 aa, Artificial Sequence
  Description of Artificial Sequence: Synthetic polypeptide
DEEEIRTTNPVATEQYGSVSTPNLQNVGMD

SEQ ID NO: 9841 - protein, 30 aa, Artificial Sequence
  Description of Artificial Sequence: Synthetic polypeptide
DEEEIRTTNPVATEQYGSVSTPNLQNVNGI

SEQ ID NO: 9842 - protein, 31 aa, Artificial Sequence
  Description of Artificial Sequence: Synthetic polypeptide
DEEEIRTTNPVATEQYGSVSTPNLQPGNQGN

SEQ ID NO: 9843 - protein, 28 aa, Artificial Sequence
  Description of Artificial Sequence: Synthetic peptide
DEQEIRTTNPVATEQYGVVSTFLQRPND

SEQ ID NO: 9844 - protein, 28 aa, Artificial Sequence
  Description of Artificial Sequence: Synthetic peptide
DEQEIRTTNPVATEQYGVVSTALQRFND

SEQ ID NO: 9845 - protein, 30 aa, Artificial Sequence
  Description of Artificial Sequence: Synthetic polypeptide
DEEEIRTTNPVATEQYGSVSTPNLQPGPSP

SEQ ID NO: 9846 - protein, 30 aa, Artificial Sequence
  Description of Artificial Sequence: Synthetic polypeptide
DEQEIRTTNPVATEQYGTVSTNLQRNGNGA

SEQ ID NO: 9847 - protein, 29 aa, Artificial Sequence
  Description of Artificial Sequence: Synthetic peptide
DEQEIRTTNPVATEQYGTVSTNLQHDGNQ

SEQ ID NO: 9848 - protein, 31 aa, Artificial Sequence
  Description of Artificial Sequence: Synthetic polypeptide
DEEEIRTTNPVATEQYGSVSTPNLQQGENNA

SEQ ID NO: 9849 - protein, 29 aa, Artificial Sequence
  Description of Artificial Sequence: Synthetic peptide
DEQEIRTTNPVATEQYGSVYTTLQERGDR

SEQ ID NO: 9850 - protein, 30 aa, Artificial Sequence
  Description of Artificial Sequence: Synthetic polypeptide
DEQEIRTTNPVATEQYGSVSTNLQHQEGER

SEQ ID NO: 9851 - protein, 30 aa, Artificial Sequence
  Description of Artificial Sequence: Synthetic polypeptide
DESEIRTTNPVATEQYGSVSTTNLQAGNDS

SEQ ID NO: 9852 - protein, 30 aa, Artificial Sequence
  Description of Artificial Sequence: Synthetic polypeptide
DESEIRTTNPVATEQYGSVSTTNLQEGNEN

SEQ ID NO: 9853 - protein, 31 aa, Artificial Sequence
  Description of Artificial Sequence: Synthetic polypeptide
DESEIRTTNPVATEQYGSVSTTNLQSGDNDR

SEQ ID NO: 9854 - protein, 30 aa, Artificial Sequence
  Description of Artificial Sequence: Synthetic polypeptide
DEEEIRTTNPVATEQYGSVSTNNNGQNGNI

SEQ ID NO: 9855 - protein, 29 aa, Artificial Sequence
  Description of Artificial Sequence: Synthetic peptide
DEEEIRTTNPVATEQYGSVSFENDQRPER

SEQ ID NO: 9856 - protein, 31 aa, Artificial Sequence
  Description of Artificial Sequence: Synthetic polypeptide
DEEEIRTTNPVATEQYGSQVDSTYHQRGSNR

SEQ ID NO: 9857 - protein, 28 aa, Artificial Sequence
  Description of Artificial Sequence: Synthetic peptide
DEEEIRTTNPVATEQYGSVSTNNNSGDQ

SEQ ID NO: 9858 - protein, 30 aa, Artificial Sequence
  Description of Artificial Sequence: Synthetic polypeptide
DEEEIRTTNPVATEQYGSVSTNNPQFLGER

SEQ ID NO: 9859 - protein, 32 aa, Artificial Sequence
  Description of Artificial Sequence: Synthetic polypeptide
DEEEIGTTNPVATEQYGSVVSTNLSQRGGNPR

SEQ ID NO: 9860 - protein, 29 aa, Artificial Sequence
  Description of Artificial Sequence: Synthetic peptide
DEEEIRTTNPVATEQYGSQVSTALDNGER

SEQ ID NO: 9861 - protein, 29 aa, Artificial Sequence
  Description of Artificial Sequence: Synthetic peptide
DEEEIRTTNPVATEQYGSVSTNNQGFNQG

SEQ ID NO: 9862 - protein, 30 aa, Artificial Sequence
  Description of Artificial Sequence: Synthetic polypeptide
DEEEIRTTNPVATEQYGSVSTNNQHGDQRN

SEQ ID NO: 9863 - protein, 30 aa, Artificial Sequence
  Description of Artificial Sequence: Synthetic polypeptide
DEEEIRTTNPVATEQYGSVSTNNQIEGNTV

SEQ ID NO: 9864 - protein, 31 aa, Artificial Sequence
  Description of Artificial Sequence: Synthetic polypeptide
DEEEIGTTNPVATEQYGSVSTNSLQERIGNL

SEQ ID NO: 9865 - protein, 30 aa, Artificial Sequence
  Description of Artificial Sequence: Synthetic polypeptide
DEEEIRTTNPVATEQYGSVSTNNQMFGGNQ

SEQ ID NO: 9866 - protein, 31 aa, Artificial Sequence
  Description of Artificial Sequence: Synthetic polypeptide
DEEEIGTTNPVATEQYGSVSTNQLQQRAGNL

SEQ ID NO: 9867 - protein, 28 aa, Artificial Sequence
  Description of Artificial Sequence: Synthetic peptide
DEVEIATTNPVATCQYGEVSTQLQRGNR

SEQ ID NO: 9868 - protein, 31 aa, Artificial Sequence
  Description of Artificial Sequence: Synthetic polypeptide
DEEEIGTTNPVATEQYGSVSTNQLQERTGNE

SEQ ID NO: 9869 - protein, 31 aa, Artificial Sequence
  Description of Artificial Sequence: Synthetic polypeptide
DEEEIGTTNPVATEQYGSVSTNNLQERMGNQ

SEQ ID NO: 9870 - protein, 31 aa, Artificial Sequence
  Description of Artificial Sequence: Synthetic polypeptide
DEEEIGTTNPVATEQYGSVSTNLQRSGSERQ

SEQ ID NO: 9871 - protein, 31 aa, Artificial Sequence
  Description of Artificial Sequence: Synthetic polypeptide
DEEEIRTTNPVATEQYGSVSTNNQRGQNFDN

SEQ ID NO: 9872 - protein, 29 aa, Artificial Sequence
  Description of Artificial Sequence: Synthetic peptide
DEEEIGTTNPVATEQYGSVSTNLQGNNIG

SEQ ID NO: 9873 - protein, 30 aa, Artificial Sequence
  Description of Artificial Sequence: Synthetic polypeptide
DEEEIRTTNPVATEQYGSVSTNNQVFGFNA

SEQ ID NO: 9874 - protein, 30 aa, Artificial Sequence
  Description of Artificial Sequence: Synthetic polypeptide
DEEEIGTTNPVATEQYGSVSTNLNMFGNNR

SEQ ID NO: 9875 - protein, 30 aa, Artificial Sequence
  Description of Artificial Sequence: Synthetic polypeptide
DEEEIRTTNPVATEQYGSVSTNNQVMGMNA

SEQ ID NO: 9876 - protein, 30 aa, Artificial Sequence
  Description of Artificial Sequence: Synthetic polypeptide
DEEEIRTTNPVATEQYGSVSTNNQVNGFNG

SEQ ID NO: 9877 - protein, 30 aa, Artificial Sequence
  Description of Artificial Sequence: Synthetic polypeptide
DEEEIGTTNPVATEQYGSVSTNLNANGSNR

SEQ ID NO: 9878 - protein, 31 aa, Artificial Sequence
  Description of Artificial Sequence: Synthetic polypeptide
DEEEIGTTNPVATEQYGSVSTNLLQERLGNL

SEQ ID NO: 9879 - protein, 28 aa, Artificial Sequence
  Description of Artificial Sequence: Synthetic peptide
DEEEIRTTNPVATEQYGSVSTNNSEINQ

SEQ ID NO: 9880 - protein, 30 aa, Artificial Sequence
  Description of Artificial Sequence: Synthetic polypeptide
DEEEIGTTNPVATEQYGSVSTNLARGSNLV

SEQ ID NO: 9881 - protein, 31 aa, Artificial Sequence
  Description of Artificial Sequence: Synthetic polypeptide
DEEEIGTTNPVATEQYGSVSTNGLQERMGNQ

SEQ ID NO: 9882 - protein, 31 aa, Artificial Sequence
  Description of Artificial Sequence: Synthetic polypeptide
DEEEIGTTNPVATEQYGSVSTNNLQNGSNRQ

SEQ ID NO: 9883 - protein, 29 aa, Artificial Sequence
  Description of Artificial Sequence: Synthetic peptide
DEEEIRTTNPVATEQYGSVSEYLQFENRQ

SEQ ID NO: 9884 - protein, 31 aa, Artificial Sequence
  Description of Artificial Sequence: Synthetic polypeptide
DEEEIRTTNPVATEQYGSVSTNNLTGAFGNR

SEQ ID NO: 9885 - protein, 30 aa, Artificial Sequence
  Description of Artificial Sequence: Synthetic polypeptide
DEEEIRTTNPVATEQYGSQSTGLQRGNNAD

SEQ ID NO: 9886 - protein, 30 aa, Artificial Sequence
  Description of Artificial Sequence: Synthetic polypeptide
DEEEIRTTNPVATEQYGSVSTNNLGFGNEN

SEQ ID NO: 9887 - protein, 29 aa, Artificial Sequence
  Description of Artificial Sequence: Synthetic peptide
DEVEIATTNPVATEQYGSVSTNLQRENHV

SEQ ID NO: 9888 - protein, 30 aa, Artificial Sequence
  Description of Artificial Sequence: Synthetic polypeptide
DEVEIATTNPVATEQYGSVSTNLQRDGNMA

SEQ ID NO: 9889 - protein, 28 aa, Artificial Sequence
  Description of Artificial Sequence: Synthetic peptide
DEEEIRTTNPVATEQYGSVSFNDQRSEG

SEQ ID NO: 9890 - protein, 29 aa, Artificial Sequence
  Description of Artificial Sequence: Synthetic peptide
DEEEIKTTNPVATEQYGCVSTNLQNTGNA

SEQ ID NO: 9891 - protein, 30 aa, Artificial Sequence
  Description of Artificial Sequence: Synthetic polypeptide
DEEEIRTTNPVATEQYGSVSTNNLNNFGND

SEQ ID NO: 9892 - protein, 29 aa, Artificial Sequence
  Description of Artificial Sequence: Synthetic peptide
DEVEIATTNPVATEQYGSVSTNLQHDNRN

SEQ ID NO: 9893 - protein, 32 aa, Artificial Sequence
  Description of Artificial Sequence: Synthetic polypeptide
DEEEIRTTNPVATEQYGSVSTNNLNQRGSERA

SEQ ID NO: 9894 - protein, 31 aa, Artificial Sequence
  Description of Artificial Sequence: Synthetic polypeptide
DEEEIRTTNPVATEQYGSVSTNNLPQQSGER

SEQ ID NO: 9895 - protein, 30 aa, Artificial Sequence
  Description of Artificial Sequence: Synthetic polypeptide
DEEEIRTTNPVATEQYGSMVVTGPLQRGER

SEQ ID NO: 9896 - protein, 31 aa, Artificial Sequence
  Description of Artificial Sequence: Synthetic polypeptide
DEEEIRTTNPVATEQYGSVSTNNLQAVEGNN

SEQ ID NO: 9897 - protein, 30 aa, Artificial Sequence
  Description of Artificial Sequence: Synthetic polypeptide
DEEEIRTTNPVATEQYGSNSLYNMLQRDNR

SEQ ID NO: 9898 - protein, 30 aa, Artificial Sequence
  Description of Artificial Sequence: Synthetic polypeptide
DEEEIRTTNPVATEQYGSNSQPNMLQRENR

SEQ ID NO: 9899 - protein, 31 aa, Artificial Sequence
  Description of Artificial Sequence: Synthetic polypeptide
DEEEIRTTNPVATEQYGSVSTNNLQVNLNRG

SEQ ID NO: 9900 - protein, 30 aa, Artificial Sequence
  Description of Artificial Sequence: Synthetic polypeptide
DEEEIRTTNPVATEQYGSVSTNNLQEHGEE

SEQ ID NO: 9901 - protein, 31 aa, Artificial Sequence
  Description of Artificial Sequence: Synthetic polypeptide
DEEEIRTTNPVATEQYGSVSTNNLQHRFIDR

SEQ ID NO: 9902 - protein, 30 aa, Artificial Sequence
  Description of Artificial Sequence: Synthetic polypeptide
DEEEIKTTNPVATEAYGSTVSTNLSQRGNV

SEQ ID NO: 9903 - protein, 30 aa, Artificial Sequence
  Description of Artificial Sequence: Synthetic polypeptide
DEEEIRTTNPVATEQYGSVSTNNLQPSGDD

SEQ ID NO: 9904 - protein, 30 aa, Artificial Sequence
  Description of Artificial Sequence: Synthetic polypeptide
DEEEIRTTNPVATEQYGSVSTNNLQPVGDE

SEQ ID NO: 9905 - protein, 31 aa, Artificial Sequence
  Description of Artificial Sequence: Synthetic polypeptide
DEEEIRTTNPVATEQYGSVSTNNLQRFENVT

SEQ ID NO: 9906 - protein, 29 aa, Artificial Sequence
  Description of Artificial Sequence: Synthetic peptide
DEEEIRTTNPVATEQYGSNVSTPLDDGER

SEQ ID NO: 9907 - protein, 30 aa, Artificial Sequence
  Description of Artificial Sequence: Synthetic polypeptide
DEAEISTTNPVATEQYGSVSTNLNGQDGNR

SEQ ID NO: 9908 - protein, 29 aa, Artificial Sequence
  Description of Artificial Sequence: Synthetic peptide
DEAEISTTNPVATEQYGSVSTNLGEDGNR

SEQ ID NO: 9909 - protein, 31 aa, Artificial Sequence
  Description of Artificial Sequence: Synthetic polypeptide
DEEEIHTTNPVATEQYGSVSTNQLQERGGNL

SEQ ID NO: 9910 - protein, 30 aa, Artificial Sequence
  Description of Artificial Sequence: Synthetic polypeptide
DEEEIHTTNPVATEQYGSVSTNLQANSNRS

SEQ ID NO: 9911 - protein, 29 aa, Artificial Sequence
  Description of Artificial Sequence: Synthetic peptide
DEEEIRTTNPVATEQYGSVSFINLQPLNV

SEQ ID NO: 9912 - protein, 32 aa, Artificial Sequence
  Description of Artificial Sequence: Synthetic polypeptide
DEEEIRTTNPVATEQYGSVSTNNLQRTGNNGQ

SEQ ID NO: 9913 - protein, 30 aa, Artificial Sequence
  Description of Artificial Sequence: Synthetic polypeptide
DEEEIGTTNPVAYEQYGSVSMTNLQRGSQR

SEQ ID NO: 9914 - protein, 31 aa, Artificial Sequence
  Description of Artificial Sequence: Synthetic polypeptide
DEEEIRTTNPVATEQYGSVSTNNLQGSGNEG

SEQ ID NO: 9915 - protein, 29 aa, Artificial Sequence
  Description of Artificial Sequence: Synthetic peptide
DEEEIRTTNPVATEQYGSVSTNNTQIDFR

SEQ ID NO: 9916 - protein, 31 aa, Artificial Sequence
  Description of Artificial Sequence: Synthetic polypeptide
DEEEIGTTNPVATEQYGSVSTNELQNRQGNL

SEQ ID NO: 9917 - protein, 29 aa, Artificial Sequence
  Description of Artificial Sequence: Synthetic peptide
DETEISTTNPVATEQYGSVSTNLQGDGNA

SEQ ID NO: 9918 - protein, 28 aa, Artificial Sequence
  Description of Artificial Sequence: Synthetic peptide
DETEIRTTNPVAWEQYGSISTNLERPNR

SEQ ID NO: 9919 - protein, 30 aa, Artificial Sequence
  Description of Artificial Sequence: Synthetic polypeptide
DEEEIRTTNPVATEQYGSSSEPNMLQRDNR

SEQ ID NO: 9920 - protein, 30 aa, Artificial Sequence
  Description of Artificial Sequence: Synthetic polypeptide
DEEEIRTTNPVATEQYGSSSLPNALQRDNR

SEQ ID NO: 9921 - protein, 28 aa, Artificial Sequence
  Description of Artificial Sequence: Synthetic peptide
DEEEIRTTNPVATEQYGSSSTDIQRTND

SEQ ID NO: 9922 - protein, 28 aa, Artificial Sequence
  Description of Artificial Sequence: Synthetic peptide
DETEIRTTNPVAVEQYGSCSTNLERENR

SEQ ID NO: 9923 - protein, 28 aa, Artificial Sequence
  Description of Artificial Sequence: Synthetic peptide
DETEIRTTNPVATTVYGSVSTNLQRTNN

SEQ ID NO: 9924 - protein, 30 aa, Artificial Sequence
  Description of Artificial Sequence: Synthetic polypeptide
DEEEIRTTNPVATEQYGSVSTNQNQGDGNG

SEQ ID NO: 9925 - protein, 31 aa, Artificial Sequence
  Description of Artificial Sequence: Synthetic polypeptide
DEEEIRTTNPVATEQYGSSSTNLQRFGNTQP

SEQ ID NO: 9926 - protein, 28 aa, Artificial Sequence
  Description of Artificial Sequence: Synthetic peptide
DETEIRTTNPVATQQYGCVSTNLDRGNP

SEQ ID NO: 9927 - protein, 28 aa, Artificial Sequence
  Description of Artificial Sequence: Synthetic peptide
DETEIRTTNPVATGQYGCVSTNLERGNP

SEQ ID NO: 9928 - protein, 29 aa, Artificial Sequence
  Description of Artificial Sequence: Synthetic peptide
DETEIRTTNPVATEWYGSVSTNLQQIGND

SEQ ID NO: 9929 - protein, 30 aa, Artificial Sequence
  Description of Artificial Sequence: Synthetic polypeptide
DETEIRTTNPVATEVYGSVSTNLQSPGDNR

SEQ ID NO: 9930 - protein, 30 aa, Artificial Sequence
  Description of Artificial Sequence: Synthetic polypeptide
DETEIRTTNPVATEVYGSVSTNLQRGENNH

SEQ ID NO: 9931 - protein, 29 aa, Artificial Sequence
  Description of Artificial Sequence: Synthetic peptide
DEEEIRTTNPVATEQYGSSCSTDLQRNNM

SEQ ID NO: 9932 - protein, 29 aa, Artificial Sequence
  Description of Artificial Sequence: Synthetic peptide
DETEIRTTNPVATEVYGSVSTNLQQNGNE

SEQ ID NO: 9933 - protein, 29 aa, Artificial Sequence
  Description of Artificial Sequence: Synthetic peptide
DETEIRTTNPVATETYGSVSTNLQKDGNA

SEQ ID NO: 9934 - protein, 29 aa, Artificial Sequence
  Description of Artificial Sequence: Synthetic peptide
DETEIRTTNPVATETYGSVSTNLQHQGNG

SEQ ID NO: 9935 - protein, 30 aa, Artificial Sequence
  Description of Artificial Sequence: Synthetic polypeptide
DETEIRTTNPVATESYGAVSTNLQRGENDR

SEQ ID NO: 9936 - protein, 28 aa, Artificial Sequence
  Description of Artificial Sequence: Synthetic peptide
DETEIRTTNPVATEQYGVVSTLLQRPNQ

SEQ ID NO: 9937 - protein, 28 aa, Artificial Sequence
  Description of Artificial Sequence: Synthetic peptide
DEEEIGTTNPVATEQYGEVSTNLIHGNQ

SEQ ID NO: 9938 - protein, 30 aa, Artificial Sequence
  Description of Artificial Sequence: Synthetic polypeptide
DEEEIRTTNPVATEQYGSVSTNQQHGNDVY

SEQ ID NO: 9939 - protein, 30 aa, Artificial Sequence
  Description of Artificial Sequence: Synthetic polypeptide
DEEEIRTTNPVATEQYGSVSTNQQNNGNIQ

SEQ ID NO: 9940 - protein, 29 aa, Artificial Sequence
  Description of Artificial Sequence: Synthetic peptide
DETEIRTTNPVATEQYGTVSTNLQPDGNQ

SEQ ID NO: 9941 - protein, 30 aa, Artificial Sequence
  Description of Artificial Sequence: Synthetic polypeptide
DEEEIRTTNPVATEQYGSVSTNQSHHVGNR

SEQ ID NO: 9942 - protein, 29 aa, Artificial Sequence
  Description of Artificial Sequence: Synthetic peptide
DETEIRTTNPVATEQYGTVSTNLQFGGDR

SEQ ID NO: 9943 - protein, 29 aa, Artificial Sequence
  Description of Artificial Sequence: Synthetic peptide
DETEIRTTNPVATEQYGTVSTNLQEGDQR

SEQ ID NO: 9944 - protein, 29 aa, Artificial Sequence
  Description of Artificial Sequence: Synthetic peptide
DETEIRTTNPVATEQYGTVSTNLQDDGNT

SEQ ID NO: 9945 - protein, 28 aa, Artificial Sequence
  Description of Artificial Sequence: Synthetic peptide
DEEEIRTTNPVATEQYGSVSTNQSVING

SEQ ID NO: 9946 - protein, 30 aa, Artificial Sequence
  Description of Artificial Sequence: Synthetic polypeptide
DETEIRTTNPVATEVYGEVSTNLQRGENPR

SEQ ID NO: 9947 - protein, 31 aa, Artificial Sequence
  Description of Artificial Sequence: Synthetic polypeptide
DEEEIGTTNPVATEQYGSVCSNTELQRGNNR

SEQ ID NO: 9948 - protein, 30 aa, Artificial Sequence
  Description of Artificial Sequence: Synthetic polypeptide
DEEEIRTTNPVATEQYGSVSTNQIEVGNER

SEQ ID NO: 9949 - protein, 30 aa, Artificial Sequence
  Description of Artificial Sequence: Synthetic polypeptide
DEEEIRTTNPVATEQYGSVSTNQDTGENRS

SEQ ID NO: 9950 - protein, 28 aa, Artificial Sequence
  Description of Artificial Sequence: Synthetic peptide
DETEISTTNPVATEQYGSVSTNLAYGNT

SEQ ID NO: 9951 - protein, 30 aa, Artificial Sequence
  Description of Artificial Sequence: Synthetic polypeptide
DEEEIRTTNPVATEQYGSVSTNNVQEVGND

SEQ ID NO: 9952 - protein, 31 aa, Artificial Sequence
  Description of Artificial Sequence: Synthetic polypeptide
DEEEIRTTNPVATEQYGSVSTNNWLANGNRG

SEQ ID NO: 9953 - protein, 29 aa, Artificial Sequence
  Description of Artificial Sequence: Synthetic peptide
DEEEIRTTNPVATEQYGSVSTNPDDQGNA

SEQ ID NO: 9954 - protein, 31 aa, Artificial Sequence
  Description of Artificial Sequence: Synthetic polypeptide
DEEEIRTTNPVATEQYGSVSTNPDQLGSNQR

SEQ ID NO: 9955 - protein, 28 aa, Artificial Sequence
  Description of Artificial Sequence: Synthetic peptide
DETEISTTNPVATEQYGSVSENLQQGNL

SEQ ID NO: 9956 - protein, 30 aa, Artificial Sequence
  Description of Artificial Sequence: Synthetic polypeptide
DETEIRTTNPVSTEQYGSVSTNLQRGNEQA

SEQ ID NO: 9957 - protein, 30 aa, Artificial Sequence
  Description of Artificial Sequence: Synthetic polypeptide
DEEEIRTTNPVATEQYGSVSEVQLQRLNRQ

SEQ ID NO: 9958 - protein, 30 aa, Artificial Sequence
  Description of Artificial Sequence: Synthetic polypeptide
DEEEIRTTNPVATEQYGSVSTNPIQGNGNL

SEQ ID NO: 9959 - protein, 30 aa, Artificial Sequence
  Description of Artificial Sequence: Synthetic polypeptide
DEEEIRTTNPVATEQYGSVSTNPLDIIGND

SEQ ID NO: 9960 - protein, 31 aa, Artificial Sequence
  Description of Artificial Sequence: Synthetic polypeptide
DEEEIRTTNPVATEQYGSQVSTNLQRFNSND

SEQ ID NO: 9961 - protein, 31 aa, Artificial Sequence
  Description of Artificial Sequence: Synthetic polypeptide
DEEEIRTTNPVATEQYGSQVSTNLQRLANEE

SEQ ID NO: 9962 - protein, 30 aa, Artificial Sequence
  Description of Artificial Sequence: Synthetic polypeptide
DEEEIRTTNPVATEQYGSVSTNPMQGMGNP

SEQ ID NO: 9963 - protein, 32 aa, Artificial Sequence
  Description of Artificial Sequence: Synthetic polypeptide
DEEEIRTTNPVATEQYGSQVSTNLQRLGNEDT

SEQ ID NO: 9964 - protein, 30 aa, Artificial Sequence
  Description of Artificial Sequence: Synthetic polypeptide
DEEEIRTTNPVATEQYGSVSTNPMQQGGNA

SEQ ID NO: 9965 - protein, 28 aa, Artificial Sequence
  Description of Artificial Sequence: Synthetic peptide
DEEEIRTTNPVATEQYGSVSTNPNDGPS

SEQ ID NO: 9966 - protein, 31 aa, Artificial Sequence
  Description of Artificial Sequence: Synthetic polypeptide
DEEEIRTTNPVATEQYGSVSTNPQLRGENQE

SEQ ID NO: 9967 - protein, 28 aa, Artificial Sequence
  Description of Artificial Sequence: Synthetic peptide
AENEIRTTNPVATEQYGEVSENLQRGGR

SEQ ID NO: 9968 - protein, 29 aa, Artificial Sequence
  Description of Artificial Sequence: Synthetic peptide
DETEIRTTNPVAYEQYGSVSTNLQPGNTD

SEQ ID NO: 9969 - protein, 30 aa, Artificial Sequence
  Description of Artificial Sequence: Synthetic polypeptide
DETEIRTTNPVAYEQYGSVSTNLEQDRGNS

SEQ ID NO: 9970 - protein, 28 aa, Artificial Sequence
  Description of Artificial Sequence: Synthetic peptide
DETEIRTTNPVAYEQYGSVSSNLQHGNL

SEQ ID NO: 9971 - protein, 30 aa, Artificial Sequence
  Description of Artificial Sequence: Synthetic polypeptide
DEEEIRTTNPVATEQYGSVSEVNLQRGVTI

SEQ ID NO: 9972 - protein, 30 aa, Artificial Sequence
  Description of Artificial Sequence: Synthetic polypeptide
AENEIRTTNPVATEQYGSVVSTNLQRGGND

SEQ ID NO: 9973 - protein, 30 aa, Artificial Sequence
  Description of Artificial Sequence: Synthetic polypeptide
DEEEIRTTNPVATEQYGSQVSTNNQRNNQF

SEQ ID NO: 9974 - protein, 28 aa, Artificial Sequence
  Description of Artificial Sequence: Synthetic peptide
DEEEIGTTNPVATEQYGSVPEVLQRGER

SEQ ID NO: 9975 - protein, 30 aa, Artificial Sequence
  Description of Artificial Sequence: Synthetic polypeptide
DEEEIRTTNPVATEQYGSQVSYTNLDRGEN

SEQ ID NO: 9976 - protein, 29 aa, Artificial Sequence
  Description of Artificial Sequence: Synthetic peptide
DEEEIRTTNPVATEQYGSVSEVLQGENRY

SEQ ID NO: 9977 - protein, 31 aa, Artificial Sequence
  Description of Artificial Sequence: Synthetic polypeptide
DEEEIRTTNPVATEQYGSVSTNPQVRSNQRV

SEQ ID NO: 9978 - protein, 32 aa, Artificial Sequence
  Description of Artificial Sequence: Synthetic polypeptide
DEEEIRTTNPVATEQYGSQVTSTENLQRGNPQ

SEQ ID NO: 9979 - protein, 31 aa, Artificial Sequence
  Description of Artificial Sequence: Synthetic polypeptide
DEEEIKTTNPVATEQYGESVSCTNLSQRGNG

SEQ ID NO: 9980 - protein, 29 aa, Artificial Sequence
  Description of Artificial Sequence: Synthetic peptide
DETEIRTTNPVATEQYGSVSYTNLDSGNL

SEQ ID NO: 9981 - protein, 30 aa, Artificial Sequence
  Description of Artificial Sequence: Synthetic polypeptide
DEEEIRTTNPVATEQYGSVSFNLQHFGNEG

SEQ ID NO: 9982 - protein, 28 aa, Artificial Sequence
  Description of Artificial Sequence: Synthetic peptide
DEEEIRTTNPVATEQYGSMSTDIQRENQ

SEQ ID NO: 9983 - protein, 28 aa, Artificial Sequence
  Description of Artificial Sequence: Synthetic peptide
DEEEIRATNPVATAQYGSVETGPQRGNR

SEQ ID NO: 9984 - protein, 30 aa, Artificial Sequence
  Description of Artificial Sequence: Synthetic polypeptide
DEVEIRTTNPVATEQYGSVSTNDQHDEGNR

SEQ ID NO: 9985 - protein, 29 aa, Artificial Sequence
  Description of Artificial Sequence: Synthetic peptide
DEVEIRTTNPVATEQYGSVSTNDHQNGNY

SEQ ID NO: 9986 - protein, 29 aa, Artificial Sequence
  Description of Artificial Sequence: Synthetic peptide
DEVEIRTTNPVATEQYGSVSTNDDQRGEP

SEQ ID NO: 9987 - protein, 29 aa, Artificial Sequence
  Description of Artificial Sequence: Synthetic peptide
DEEEIRATNPTATEVYGSVSTNLQRGNWE

SEQ ID NO: 9988 - protein, 31 aa, Artificial Sequence
  Description of Artificial Sequence: Synthetic polypeptide
DEVEIRTTNPVATEQYGSVSTLNDHNQRGNR

SEQ ID NO: 9989 - protein, 31 aa, Artificial Sequence
  Description of Artificial Sequence: Synthetic polypeptide
DEEEIRTTNPVATEQYGSVSTNLVQIGENSQ

SEQ ID NO: 9990 - protein, 30 aa, Artificial Sequence
  Description of Artificial Sequence: Synthetic polypeptide
DEEEIRTTNPVATEQYGSISQTNLQRVQRT

SEQ ID NO: 9991 - protein, 32 aa, Artificial Sequence
  Description of Artificial Sequence: Synthetic polypeptide
DEVEIRTTNPVATEQYGSVSTGNELQRGSNRT

SEQ ID NO: 9992 - protein, 29 aa, Artificial Sequence
  Description of Artificial Sequence: Synthetic peptide
DEVEIRTTNPVATEQYGSVSTGLQQDGNA

SEQ ID NO: 9993 - protein, 29 aa, Artificial Sequence
  Description of Artificial Sequence: Synthetic peptide
DEVEIRTTNPVATEQYGSVSTGLQMEGNQ

SEQ ID NO: 9994 - protein, 30 aa, Artificial Sequence
  Description of Artificial Sequence: Synthetic polypeptide
DEVEIRTTNPVATEQYGSVSTGLQEGHGNR

SEQ ID NO: 9995 - protein, 29 aa, Artificial Sequence
  Description of Artificial Sequence: Synthetic peptide
DEVEIRTTNPVATEQYGSVSTGLQEGGNG

SEQ ID NO: 9996 - protein, 31 aa, Artificial Sequence
  Description of Artificial Sequence: Synthetic polypeptide
DEVEIRTTNPVATEQYGSVSTNGDQERGGNR

SEQ ID NO: 9997 - protein, 31 aa, Artificial Sequence
  Description of Artificial Sequence: Synthetic polypeptide
DEEEIRTTNPVATEQYGSVSTNLVQSGTNDV

SEQ ID NO: 9998 - protein, 30 aa, Artificial Sequence
  Description of Artificial Sequence: Synthetic polypeptide
DEEEIRTTNPVATEQYGSISTNAQRGEENQ

SEQ ID NO: 9999 - protein, 29 aa, Artificial Sequence
  Description of Artificial Sequence: Synthetic peptide
DEVEIRTTNPVATEQYGSVSTELQHGGNE

SEQ ID NO: 10000 - protein, 30 aa, Artificial Sequence
  Description of Artificial Sequence: Synthetic polypeptide
DEEEIRTTNPVATEQYGSVSTNLVVGINGN

SEQ ID NO: 10001 - protein, 31 aa, Artificial Sequence
  Description of Artificial Sequence: Synthetic polypeptide
DEVEIRTTNPVATEQYGSVSTDNDNNQRGNR

SEQ ID NO: 10002 - protein, 30 aa, Artificial Sequence
  Description of Artificial Sequence: Synthetic polypeptide
DEVEIRTTNPVATEQYGSVSSTNLQQIGNS

SEQ ID NO: 10003 - protein, 30 aa, Artificial Sequence
  Description of Artificial Sequence: Synthetic polypeptide
DEVEIRTTNPVATEQYGSVSPTNLERGSNQ

SEQ ID NO: 10004 - protein, 31 aa, Artificial Sequence
  Description of Artificial Sequence: Synthetic polypeptide
DEEEIRTTNPVATEQYGSVSTNLYDRNGVRE

SEQ ID NO: 10005 - protein, 30 aa, Artificial Sequence
  Description of Artificial Sequence: Synthetic polypeptide
DEEEIRTTNPVATEQYGSVSTNMAEGENRS

SEQ ID NO: 10006 - protein, 29 aa, Artificial Sequence
  Description of Artificial Sequence: Synthetic peptide
DEEEIRTTNPVATEQYGSISTNLQRLVTD

SEQ ID NO: 10007 - protein, 31 aa, Artificial Sequence
  Description of Artificial Sequence: Synthetic polypeptide
DEEEIRTTNPVATEQYGSVSFTMLQRGIPRD

SEQ ID NO: 10008 - protein, 31 aa, Artificial Sequence
  Description of Artificial Sequence: Synthetic polypeptide
DEEEIRTTNPVATEQYGSVSTNMDSQSGDNR

SEQ ID NO: 10009 - protein, 31 aa, Artificial Sequence
  Description of Artificial Sequence: Synthetic polypeptide
DEEEIRTTNPVATEQYGSVSTNMESQTGGNR

SEQ ID NO: 10010 - protein, 30 aa, Artificial Sequence
  Description of Artificial Sequence: Synthetic polypeptide
DEEEIRTTNPVATEQYGSVSTNMGGQNGAR

SEQ ID NO: 10011 - protein, 31 aa, Artificial Sequence
  Description of Artificial Sequence: Synthetic polypeptide
DEEEIRTTNPVATEQYGSVSTNLVQVGNMEM

SEQ ID NO: 10012 - protein, 29 aa, Artificial Sequence
  Description of Artificial Sequence: Synthetic peptide
DEVEIRTTNPVATEQYGSVCSTYLQAGER

SEQ ID NO: 10013 - protein, 29 aa, Artificial Sequence
  Description of Artificial Sequence: Synthetic peptide
DEEEIRTTNPVATEQYGSVSTNLVIDMNV

SEQ ID NO: 10014 - protein, 29 aa, Artificial Sequence
  Description of Artificial Sequence: Synthetic peptide
DEVEIRTTNPVATEQYGSVSTNGGQNGNY

SEQ ID NO: 10015 - protein, 30 aa, Artificial Sequence
  Description of Artificial Sequence: Synthetic polypeptide
DEVEIRTTNPVATEQYGSVSTNLQHQNGER

SEQ ID NO: 10016 - protein, 30 aa, Artificial Sequence
  Description of Artificial Sequence: Synthetic polypeptide
DEVEIRTTNPVATEQYGSVSTNLQHEQNPR

SEQ ID NO: 10017 - protein, 30 aa, Artificial Sequence
  Description of Artificial Sequence: Synthetic polypeptide
DEVEIRTTNPVATEQYGSVSTNLQGQMGER

SEQ ID NO: 10018 - protein, 30 aa, Artificial Sequence
  Description of Artificial Sequence: Synthetic polypeptide
DEVEIRTTNPVATEQYGSVSTNLQGNGGNV

SEQ ID NO: 10019 - protein, 30 aa, Artificial Sequence
  Description of Artificial Sequence: Synthetic polypeptide
DEEEIRTTNPVATEQYGSVSFTNEDQFGER

SEQ ID NO: 10020 - protein, 30 aa, Artificial Sequence
  Description of Artificial Sequence: Synthetic polypeptide
DEVEIRTTNPVATEQYGSVSTNLQGDGNET

SEQ ID NO: 10021 - protein, 30 aa, Artificial Sequence
  Description of Artificial Sequence: Synthetic polypeptide
DEVEIRTTNPVATEQYGSVSTNLQGDGNDV

SEQ ID NO: 10022 - protein, 30 aa, Artificial Sequence
  Description of Artificial Sequence: Synthetic polypeptide
DEVEIRTTNPVATEQYGSVSTNLQFGGNAD

SEQ ID NO: 10023 - protein, 31 aa, Artificial Sequence
  Description of Artificial Sequence: Synthetic polypeptide
DEVEIRTTNPVATEQYGSVSTNLQDNGNNMR

SEQ ID NO: 10024 - protein, 31 aa, Artificial Sequence
  Description of Artificial Sequence: Synthetic polypeptide
DEVEIRTTNPVATEQYGSVSTNLQDNGDNER

SEQ ID NO: 10025 - protein, 29 aa, Artificial Sequence
  Description of Artificial Sequence: Synthetic peptide
DEEEIRATNPVATEHYGSVSTNLQNDGNE

SEQ ID NO: 10026 - protein, 29 aa, Artificial Sequence
  Description of Artificial Sequence: Synthetic peptide
DEEEIRATNPVATEGYGSVSTNLQVDGNH

SEQ ID NO: 10027 - protein, 32 aa, Artificial Sequence
  Description of Artificial Sequence: Synthetic polypeptide
DEEEIRTTNPVATEQYGSVSFTNDLQRGGNQG

SEQ ID NO: 10028 - protein, 31 aa, Artificial Sequence
  Description of Artificial Sequence: Synthetic polypeptide
DEEEIRTTNPVATEQYGSVSTNLVHGDNERE

SEQ ID NO: 10029 - protein, 29 aa, Artificial Sequence
  Description of Artificial Sequence: Synthetic peptide
DEEEIRATNPVATEGYGSVSTGLQRDGND

SEQ ID NO: 10030 - protein, 30 aa, Artificial Sequence
  Description of Artificial Sequence: Synthetic polypeptide
DEEEIRATNPVATECYGSVSTNLEERGENR

SEQ ID NO: 10031 - protein, 30 aa, Artificial Sequence
  Description of Artificial Sequence: Synthetic polypeptide
DEVEIRTTNPVATEQYGSVSTNLNQNGNLT

SEQ ID NO: 10032 - protein, 29 aa, Artificial Sequence
  Description of Artificial Sequence: Synthetic peptide
DEEEIRTTNPVATEQYGSVSTNLVANENM

SEQ ID NO: 10033 - protein, 30 aa, Artificial Sequence
  Description of Artificial Sequence: Synthetic polypeptide
DEEEIRTTNPVATEQYGSVSTNLVAVGGNQ

SEQ ID NO: 10034 - protein, 28 aa, Artificial Sequence
  Description of Artificial Sequence: Synthetic peptide
DEEEIRATNPVATECYGSVSTDLQRGEC

SEQ ID NO: 10035 - protein, 30 aa, Artificial Sequence
  Description of Artificial Sequence: Synthetic polypeptide
DEVEIRTTNPVATEQYGSVSTNLERGSNFY

SEQ ID NO: 10036 - protein, 31 aa, Artificial Sequence
  Description of Artificial Sequence: Synthetic polypeptide
DEVEIRTTNPVATEQYGSVSTNLEQNGNNDR

SEQ ID NO: 10037 - protein, 31 aa, Artificial Sequence
  Description of Artificial Sequence: Synthetic polypeptide
DEEEIRTTNPVATEQYGSVSTNLVEGMNGRI

SEQ ID NO: 10038 - protein, 31 aa, Artificial Sequence
  Description of Artificial Sequence: Synthetic polypeptide
DEVEIRTTNPVATEQYGSVSTNLEQDGDGNR

SEQ ID NO: 10039 - protein, 30 aa, Artificial Sequence
  Description of Artificial Sequence: Synthetic polypeptide
DEVEIRTTNPVATEQYGSVSTNLDHQNGDR

SEQ ID NO: 10040 - protein, 32 aa, Artificial Sequence
  Description of Artificial Sequence: Synthetic polypeptide
DEEEIRTTNPVATEQYGSISMTENLQQRIGNR

SEQ ID NO: 10041 - protein, 30 aa, Artificial Sequence
  Description of Artificial Sequence: Synthetic polypeptide
DEVEIRTTNPVATEQYGSVSTNLARGSNQS

SEQ ID NO: 10042 - protein, 29 aa, Artificial Sequence
  Description of Artificial Sequence: Synthetic peptide
DEVEIRTTNPVATEQYGSVSTNGMQNGNS

SEQ ID NO: 10043 - protein, 30 aa, Artificial Sequence
  Description of Artificial Sequence: Synthetic polypeptide
DEVEIRTTNPVATEQYGSVSTNLQAGGNEY

SEQ ID NO: 10044 - protein, 31 aa, Artificial Sequence
  Description of Artificial Sequence: Synthetic polypeptide
DEEEIRTTNPVATEQYGSVSTNMISQHGMNR

SEQ ID NO: 10045 - protein, 32 aa, Artificial Sequence
  Description of Artificial Sequence: Synthetic polypeptide
DEEEIRTTNPVATEQYGSVSTNMLQHGGNNRM

SEQ ID NO: 10046 - protein, 29 aa, Artificial Sequence
  Description of Artificial Sequence: Synthetic peptide
DEVEIRTTNPVATEQYGSVATNLQTGNDA

SEQ ID NO: 10047 - protein, 30 aa, Artificial Sequence
  Description of Artificial Sequence: Synthetic polypeptide
DEEEIRTTNPVATEQYGSIVSTNHQRGEDT

SEQ ID NO: 10048 - protein, 32 aa, Artificial Sequence
  Description of Artificial Sequence: Synthetic polypeptide
DEEEIRTTNPVATEQYGSIVSTNLQRFGSNHY

SEQ ID NO: 10049 - protein, 30 aa, Artificial Sequence
  Description of Artificial Sequence: Synthetic polypeptide
DEEEIRTTNPVATEQYGSVSFTDEQRGEDR

SEQ ID NO: 10050 - protein, 31 aa, Artificial Sequence
  Description of Artificial Sequence: Synthetic polypeptide
DEEEIRTTNPVATEQYGSVSTNNALGRGGNY

SEQ ID NO: 10051 - protein, 31 aa, Artificial Sequence
  Description of Artificial Sequence: Synthetic polypeptide
DEEEIRTTNPVATEQYGSIVSYTELQRGSNQ

SEQ ID NO: 10052 - protein, 31 aa, Artificial Sequence
  Description of Artificial Sequence: Synthetic polypeptide
DEEEIRTTNPVATEQYGSVSTNNDGQDGNQR

SEQ ID NO: 10053 - protein, 30 aa, Artificial Sequence
  Description of Artificial Sequence: Synthetic polypeptide
DEEEIRTTNPVATEQYGSVSTNNDGQEGNM

SEQ ID NO: 10054 - protein, 30 aa, Artificial Sequence
  Description of Artificial Sequence: Synthetic polypeptide
DEEEIRTTNPVATEQYGSVSTNNDGQNGNS

SEQ ID NO: 10055 - protein, 29 aa, Artificial Sequence
  Description of Artificial Sequence: Synthetic peptide
DEEEIRTTNPVATEQYGSVSFNNLQAGDN

SEQ ID NO: 10056 - protein, 29 aa, Artificial Sequence
  Description of Artificial Sequence: Synthetic peptide
DEEEIKTTNPVATESYGSVSTNLQGGNDL

SEQ ID NO: 10057 - protein, 29 aa, Artificial Sequence
  Description of Artificial Sequence: Synthetic peptide
DEEEIKTTNPVATEQYGVVSTALQFGGNR

SEQ ID NO: 10058 - protein, 29 aa, Artificial Sequence
  Description of Artificial Sequence: Synthetic peptide
DEEEIRTTNPVATEQYGSVSTNNDNRGDQ

SEQ ID NO: 10059 - protein, 28 aa, Artificial Sequence
  Description of Artificial Sequence: Synthetic peptide
DEVEIATTNPVATTQYGEVSTALQRGNR

SEQ ID NO: 10060 - protein, 30 aa, Artificial Sequence
  Description of Artificial Sequence: Synthetic polypeptide
DEEEIRTTNPVATEQYGSVSFTDWLQREND

SEQ ID NO: 10061 - protein, 31 aa, Artificial Sequence
  Description of Artificial Sequence: Synthetic polypeptide
DEEEIRTTNPVATEQYGSVSTNNDQLGMNIR

SEQ ID NO: 10062 - protein, 31 aa, Artificial Sequence
  Description of Artificial Sequence: Synthetic polypeptide
DEEEIKTTNPVATEQYGSVSTNLQERGGNVL

SEQ ID NO: 10063 - protein, 29 aa, Artificial Sequence
  Description of Artificial Sequence: Synthetic peptide
DEEEIKTTNPVATEQYGSVSTNLQAGGDN

SEQ ID NO: 10064 - protein, 30 aa, Artificial Sequence
  Description of Artificial Sequence: Synthetic polypeptide
DEEEIKTTNPVATEQYGSVSTMALQSGNRF

SEQ ID NO: 10065 - protein, 30 aa, Artificial Sequence
  Description of Artificial Sequence: Synthetic polypeptide
DEEEIRTTNPVATEQYGSVSTNNDRGTPRE

SEQ ID NO: 10066 - protein, 28 aa, Artificial Sequence
  Description of Artificial Sequence: Synthetic peptide
DEVEIATTNPVATIQYGAVSTDLQRGNR

SEQ ID NO: 10067 - protein, 28 aa, Artificial Sequence
  Description of Artificial Sequence: Synthetic peptide
DEVEIATTNPVATHQYGMVSTTLQRGNR

SEQ ID NO: 10068 - protein, 28 aa, Artificial Sequence
  Description of Artificial Sequence: Synthetic peptide
DEVEIATTNPVATGQYGDVSTALQRGNR

SEQ ID NO: 10069 - protein, 30 aa, Artificial Sequence
  Description of Artificial Sequence: Synthetic polypeptide
DEEEIRTTNPVATEQYGSVSTNNGQNDENR

SEQ ID NO: 10070 - protein, 30 aa, Artificial Sequence
  Description of Artificial Sequence: Synthetic polypeptide
DEEEIRTTNPVATEQYGSVSTNNGQTPENR

SEQ ID NO: 10071 - protein, 29 aa, Artificial Sequence
  Description of Artificial Sequence: Synthetic peptide
DEEEIRTTNPVATEQYGSVSFNLQRNEGE

SEQ ID NO: 10072 - protein, 30 aa, Artificial Sequence
  Description of Artificial Sequence: Synthetic polypeptide
DEEEIRTTNPVATEQYGSVSTNNHGQNGNS

SEQ ID NO: 10073 - protein, 31 aa, Artificial Sequence
  Description of Artificial Sequence: Synthetic polypeptide
DEEEIRTTNPVATEQYGSVSTNNIQRGNNFD

SEQ ID NO: 10074 - protein, 31 aa, Artificial Sequence
  Description of Artificial Sequence: Synthetic polypeptide
DEEEIRTTNPVATEQYGSVSTNNLDRGIDIR

SEQ ID NO: 10075 - protein, 31 aa, Artificial Sequence
  Description of Artificial Sequence: Synthetic polypeptide
DEEEIKTTNPVATEQYGSVSTNLQERGSNQG

SEQ ID NO: 10076 - protein, 28 aa, Artificial Sequence
  Description of Artificial Sequence: Synthetic peptide
DEVEICTTNPVATCQYGMVSTELQRGNR

SEQ ID NO: 10077 - protein, 30 aa, Artificial Sequence
  Description of Artificial Sequence: Synthetic polypeptide
DEEEINTTNPVATEQWGSVSTNELSQRDNR

SEQ ID NO: 10078 - protein, 28 aa, Artificial Sequence
  Description of Artificial Sequence: Synthetic peptide
DEVEICTTNPVATDQYGVVSTDLQRGNR

SEQ ID NO: 10079 - protein, 31 aa, Artificial Sequence
  Description of Artificial Sequence: Synthetic polypeptide
DEEEIRTTNPVATEQYGSVSFTENLQRNNEE

SEQ ID NO: 10080 - protein, 29 aa, Artificial Sequence
  Description of Artificial Sequence: Synthetic peptide
DEVEIRTTNPVATEQYGSISTNGQREGDR

SEQ ID NO: 10081 - protein, 30 aa, Artificial Sequence
  Description of Artificial Sequence: Synthetic polypeptide
DEVEIRTTNPVATEQYGEVSTNLQGDGNRG

SEQ ID NO: 10082 - protein, 29 aa, Artificial Sequence
  Description of Artificial Sequence: Synthetic peptide
DEVEIRTTNPVATEQYGDVSTNLQGGGND

SEQ ID NO: 10083 - protein, 30 aa, Artificial Sequence
  Description of Artificial Sequence: Synthetic polypeptide
DEEEINTTNPVATEQYGSVSTNLSQESGER

SEQ ID NO: 10084 - protein, 29 aa, Artificial Sequence
  Description of Artificial Sequence: Synthetic peptide
DEVEIRTTNPVATEQYGCVSTNLLQRVDR

SEQ ID NO: 10085 - protein, 31 aa, Artificial Sequence
  Description of Artificial Sequence: Synthetic polypeptide
DEEEIRTTNPVATEQYGSVSTNMLSQRFTNE

SEQ ID NO: 10086 - protein, 29 aa, Artificial Sequence
  Description of Artificial Sequence: Synthetic peptide
DEVEIRTTNPVATEQYGCVSTNLGDGNER

SEQ ID NO: 10087 - protein, 29 aa, Artificial Sequence
  Description of Artificial Sequence: Synthetic peptide
DEVEIRTTNPVATEQYGCVSTNALQRLDR

SEQ ID NO: 10088 - protein, 29 aa, Artificial Sequence
  Description of Artificial Sequence: Synthetic peptide
DEEEIRTTNPVATEQYGSVSTNMNDGNGE

SEQ ID NO: 10089 - protein, 31 aa, Artificial Sequence
  Description of Artificial Sequence: Synthetic polypeptide
DEEEIRTTNPVATEQYGSVSTNMNNQDHGNR

SEQ ID NO: 10090 - protein, 28 aa, Artificial Sequence
  Description of Artificial Sequence: Synthetic peptide
DEVEIRTTNPVATEQFGSVSTNEQRGDF

SEQ ID NO: 10091 - protein, 29 aa, Artificial Sequence
  Description of Artificial Sequence: Synthetic peptide
DEVEIRTTNPVATEPYGSVSTNLQYGGNE

SEQ ID NO: 10092 - protein, 29 aa, Artificial Sequence
  Description of Artificial Sequence: Synthetic peptide
DEVEIRTTNPVATEPYGSVSTNLQMGGNG

SEQ ID NO: 10093 - protein, 30 aa, Artificial Sequence
  Description of Artificial Sequence: Synthetic polypeptide
DEVEIRTTNPVATEIYGSVSTNLQRGNGNM

SEQ ID NO: 10094 - protein, 29 aa, Artificial Sequence
  Description of Artificial Sequence: Synthetic peptide
DEVEIRTTNPVATEIYGSVSTNLQGQGNA

SEQ ID NO: 10095 - protein, 29 aa, Artificial Sequence
  Description of Artificial Sequence: Synthetic peptide
DEVEIRTTNPVATEGYGSVSTNLQEGGNA

SEQ ID NO: 10096 - protein, 28 aa, Artificial Sequence
  Description of Artificial Sequence: Synthetic peptide
DEVEIRTTNPVATEGYGEVSTNLQGGNA

SEQ ID NO: 10097 - protein, 31 aa, Artificial Sequence
  Description of Artificial Sequence: Synthetic polypeptide
DEEEIRTTNPVATEQYGSVSTNMQGNEGNER

SEQ ID NO: 10098 - protein, 30 aa, Artificial Sequence
  Description of Artificial Sequence: Synthetic polypeptide
DEEEIRTTNPVATEQYGSVSTNMQGVGNGF

SEQ ID NO: 10099 - protein, 29 aa, Artificial Sequence
  Description of Artificial Sequence: Synthetic peptide
DEEEIRTTNPVATEQYGSISTSLQREGED

SEQ ID NO: 10100 - protein, 30 aa, Artificial Sequence
  Description of Artificial Sequence: Synthetic polypeptide
DEEEIRTTNPVATEQYGSVSTNMQNGNGEN

SEQ ID NO: 10101 - protein, 30 aa, Artificial Sequence
  Description of Artificial Sequence: Synthetic polypeptide
DEEEIRTTNPVATEQYGSVSTNMQNGNGGN

SEQ ID NO: 10102 - protein, 30 aa, Artificial Sequence
  Description of Artificial Sequence: Synthetic polypeptide
DEEEINTTNPVATEQYGSVATNLQGGNSRD

SEQ ID NO: 10103 - protein, 30 aa, Artificial Sequence
  Description of Artificial Sequence: Synthetic polypeptide
DEVEIRTTNPTATEQYGSVSENLPQDRGNR

SEQ ID NO: 10104 - protein, 30 aa, Artificial Sequence
  Description of Artificial Sequence: Synthetic polypeptide
DEEEIRTTNPVATEQYGSISTTGLQRGNQD

SEQ ID NO: 10105 - protein, 28 aa, Artificial Sequence
  Description of Artificial Sequence: Synthetic peptide
DEVEIHTTNPVATDQYGCVSTALQRGNR

SEQ ID NO: 10106 - protein, 30 aa, Artificial Sequence
  Description of Artificial Sequence: Synthetic polypeptide
DEVEICTTNPVATEQYGSVSTNNQRGDNDR

SEQ ID NO: 10107 - protein, 30 aa, Artificial Sequence
  Description of Artificial Sequence: Synthetic polypeptide
DEEEIRTTNPVATEQYGSVSTNMQRSEGRI

SEQ ID NO: 10108 - protein, 31 aa, Artificial Sequence
  Description of Artificial Sequence: Synthetic polypeptide
DEEEIRTTNPVATEQYGSVSTNNLEQDTGNG

SEQ ID NO: 10109 - protein, 29 aa, Artificial Sequence
  Description of Artificial Sequence: Synthetic peptide
DETEIRTTNPVATEQYGSVSTYLQGDHNR

SEQ ID NO: 10110 - protein, 31 aa, Artificial Sequence
  Description of Artificial Sequence: Synthetic polypeptide
DETEIRTTNPVATEQYGSVSTPNLSQGDGNR

SEQ ID NO: 10111 - protein, 29 aa, Artificial Sequence
  Description of Artificial Sequence: Synthetic peptide
DETEIRTTNPVATEQYGSVSTNQNSSGNR

SEQ ID NO: 10112 - protein, 29 aa, Artificial Sequence
  Description of Artificial Sequence: Synthetic peptide
DESEIRTTNPVAYEQYGSVSTNLQPGDAR

SEQ ID NO: 10113 - protein, 29 aa, Artificial Sequence
  Description of Artificial Sequence: Synthetic peptide
DESEIRTTNPVAYEQYGSVSTNLQPDGNT

SEQ ID NO: 10114 - protein, 32 aa, Artificial Sequence
  Description of Artificial Sequence: Synthetic polypeptide
DEEEIRTTNPVATEQYGSTVSCTGNHQRPGNR

SEQ ID NO: 10115 - protein, 30 aa, Artificial Sequence
  Description of Artificial Sequence: Synthetic polypeptide
DEEEIRTTNPVATEQYGSVSTPLMQRGEDN

SEQ ID NO: 10116 - protein, 31 aa, Artificial Sequence
  Description of Artificial Sequence: Synthetic polypeptide
AETEIRTTNPVATEQYGYSVSTSNLQREGNR

SEQ ID NO: 10117 - protein, 32 aa, Artificial Sequence
  Description of Artificial Sequence: Synthetic polypeptide
DEEEIRTTNPVATEQYGSTVSCTHLSQRSGNR

SEQ ID NO: 10118 - protein, 31 aa, Artificial Sequence
  Description of Artificial Sequence: Synthetic polypeptide
DEEEIRTTNPVATEQYGSVSTPLPQRENERE

SEQ ID NO: 10119 - protein, 31 aa, Artificial Sequence
  Description of Artificial Sequence: Synthetic polypeptide
DEEEIRTTNPVATEQYGSVSETNLQQIGNIS

SEQ ID NO: 10120 - protein, 31 aa, Artificial Sequence
  Description of Artificial Sequence: Synthetic polypeptide
DEEEIRTTNPVATEQYGSVSTPLQAIGSNRG

SEQ ID NO: 10121 - protein, 30 aa, Artificial Sequence
  Description of Artificial Sequence: Synthetic polypeptide
DEEEIRTTNPVATEQYGSVSTPLQANGNNN

SEQ ID NO: 10122 - protein, 30 aa, Artificial Sequence
  Description of Artificial Sequence: Synthetic polypeptide
DEEEIRTTNPVATEQYGSVSTPLQARDNDQ

SEQ ID NO: 10123 - protein, 31 aa, Artificial Sequence
  Description of Artificial Sequence: Synthetic polypeptide
DEEEIRTTNPVATEQYGSVSETNLQQGNEFW

SEQ ID NO: 10124 - protein, 30 aa, Artificial Sequence
  Description of Artificial Sequence: Synthetic polypeptide
DEEEIRTTNPVATEQYGSVSTPLQELEGNN

SEQ ID NO: 10125 - protein, 30 aa, Artificial Sequence
  Description of Artificial Sequence: Synthetic polypeptide
DESEIRTTNPVAYEQYGSVSTNLQRGPNDT

SEQ ID NO: 10126 - protein, 30 aa, Artificial Sequence
  Description of Artificial Sequence: Synthetic polypeptide
DEEEIRTTNPVATEQYGSVSTPLQEMGGNE

SEQ ID NO: 10127 - protein, 30 aa, Artificial Sequence
  Description of Artificial Sequence: Synthetic polypeptide
DEEEIRTTNPVATEQYGSVSTPLQFGENEA

SEQ ID NO: 10128 - protein, 30 aa, Artificial Sequence
  Description of Artificial Sequence: Synthetic polypeptide
DEEEIRTTNPVATEQYGSVSTPLQFGQNNP

SEQ ID NO: 10129 - protein, 32 aa, Artificial Sequence
  Description of Artificial Sequence: Synthetic polypeptide
DEEEIRTTNPVATEQYGSTVSCTNLSQTGGNR

SEQ ID NO: 10130 - protein, 29 aa, Artificial Sequence
  Description of Artificial Sequence: Synthetic peptide
AMEEIRTTNPVATEQYGVVSTNLQDGENR

SEQ ID NO: 10131 - protein, 30 aa, Artificial Sequence
  Description of Artificial Sequence: Synthetic polypeptide
DEEEIRTTNPVATEQYGSVSTPLQIAGNNQ

SEQ ID NO: 10132 - protein, 30 aa, Artificial Sequence
  Description of Artificial Sequence: Synthetic polypeptide
DEEEIRTTNPVATEQYGSVSTPLQIGENDI

SEQ ID NO: 10133 - protein, 29 aa, Artificial Sequence
  Description of Artificial Sequence: Synthetic peptide
ANEEIRTTNPVATEQYGVVSTNLQQGPNR

SEQ ID NO: 10134 - protein, 30 aa, Artificial Sequence
  Description of Artificial Sequence: Synthetic polypeptide
DEEEIRTTNPVATEQYGSVSTPLQLEGNNQ

SEQ ID NO: 10135 - protein, 30 aa, Artificial Sequence
  Description of Artificial Sequence: Synthetic polypeptide
DEEEIRTTNPVATEQYGSVSTPLQMGENLN

SEQ ID NO: 10136 - protein, 30 aa, Artificial Sequence
  Description of Artificial Sequence: Synthetic polypeptide
DEEEIRTTNPVATEQYGSVSTPLQMQGGNQ

SEQ ID NO: 10137 - protein, 31 aa, Artificial Sequence
  Description of Artificial Sequence: Synthetic polypeptide
DEEEIRTTNPVATEQYGSTVSCTTLQSPGNR

SEQ ID NO: 10138 - protein, 30 aa, Artificial Sequence
  Description of Artificial Sequence: Synthetic polypeptide
DEEEIRTTNPVATEQYGSVSTPLQNGNFFQ

SEQ ID NO: 10139 - protein, 30 aa, Artificial Sequence
  Description of Artificial Sequence: Synthetic polypeptide
DEEEIRTTNPVATEQYGSTVSLNHSQRGNQ

SEQ ID NO: 10140 - protein, 30 aa, Artificial Sequence
  Description of Artificial Sequence: Synthetic polypeptide
DEEEIRTTNPVATEQYGSVSTPLQEVGMNI

SEQ ID NO: 10141 - protein, 31 aa, Artificial Sequence
  Description of Artificial Sequence: Synthetic polypeptide
DEEEIRTTNPVATEQYGSTVSTDLSGRGNPR

SEQ ID NO: 10142 - protein, 29 aa, Artificial Sequence
  Description of Artificial Sequence: Synthetic peptide
DESEIRTTNPVAYEQYGSVSTNLQVGGNT

SEQ ID NO: 10143 - protein, 30 aa, Artificial Sequence
  Description of Artificial Sequence: Synthetic polypeptide
DESEIRTTNPVAYEQYGSVWTNLSQDRGNR

SEQ ID NO: 10144 - protein, 30 aa, Artificial Sequence
  Description of Artificial Sequence: Synthetic polypeptide
DEEEIRTTNPVATEQYGSVSTPDQRENYRF

SEQ ID NO: 10145 - protein, 30 aa, Artificial Sequence
  Description of Artificial Sequence: Synthetic polypeptide
DEEEIRTTNPVATEQYGSVSTPDQRMNNRS

SEQ ID NO: 10146 - protein, 31 aa, Artificial Sequence
  Description of Artificial Sequence: Synthetic polypeptide
DEEEIRTTNPVATEQYGSTVASTNGSQRGNT

SEQ ID NO: 10147 - protein, 30 aa, Artificial Sequence
  Description of Artificial Sequence: Synthetic polypeptide
DEEEIRTTNPVATEQYGSVSETNLQVGILQ

SEQ ID NO: 10148 - protein, 29 aa, Artificial Sequence
  Description of Artificial Sequence: Synthetic peptide
DEEEIRTTNPVATEQYGSVSTPEQEFGNG

SEQ ID NO: 10149 - protein, 28 aa, Artificial Sequence
  Description of Artificial Sequence: Synthetic peptide
DESTIRTTNPVATEQYGSYSTNLIGGNR

SEQ ID NO: 10150 - protein, 30 aa, Artificial Sequence
  Description of Artificial Sequence: Synthetic polypeptide
DEEEICTTNPVAYEQYGSVATNLQRGGNYR

SEQ ID NO: 10151 - protein, 30 aa, Artificial Sequence
  Description of Artificial Sequence: Synthetic polypeptide
DEEEIRTTNPVATEQYGSVSETNLQSSGIV

SEQ ID NO: 10152 - protein, 32 aa, Artificial Sequence
  Description of Artificial Sequence: Synthetic polypeptide
DEEEIRTTNPVATEQYGSVSETNLQRIGLQNI

SEQ ID NO: 10153 - protein, 30 aa, Artificial Sequence
  Description of Artificial Sequence: Synthetic polypeptide
DEEEICTTNPVAYEQYGSTVSTNLAGRGNR

SEQ ID NO: 10154 - protein, 31 aa, Artificial Sequence
  Description of Artificial Sequence: Synthetic polypeptide
DEEEIRTTNPVATEQYGSVSTPGLTPRGNFR

SEQ ID NO: 10155 - protein, 29 aa, Artificial Sequence
  Description of Artificial Sequence: Synthetic peptide
DEEEICTTNPVAYEQYGNVSCTNLQIGNR

SEQ ID NO: 10156 - protein, 29 aa, Artificial Sequence
  Description of Artificial Sequence: Synthetic peptide
DEEEIRTTNPVATEQYGSVSTPGQEGGNF

SEQ ID NO: 10157 - protein, 30 aa, Artificial Sequence
  Description of Artificial Sequence: Synthetic polypeptide
DEEEIRTTNPVATEQYGSVSTPLIQTGNLE

SEQ ID NO: 10158 - protein, 31 aa, Artificial Sequence
  Description of Artificial Sequence: Synthetic polypeptide
DEEEIRTTNPVATEQYGSTVPSTNASQRGNQ

SEQ ID NO: 10159 - protein, 28 aa, Artificial Sequence
  Description of Artificial Sequence: Synthetic peptide
DESEIYTTNPVATEQYGSVSTNLDYGNT

SEQ ID NO: 10160 - protein, 31 aa, Artificial Sequence
  Description of Artificial Sequence: Synthetic polypeptide
DEEEIRTTNPVATEQYGSTVPSTNLSQAGNE

SEQ ID NO: 10161 - protein, 31 aa, Artificial Sequence
  Description of Artificial Sequence: Synthetic polypeptide
DEEEIRTTNPVATEQYGSTVPSTNLSQAGNQ

SEQ ID NO: 10162 - protein, 28 aa, Artificial Sequence
  Description of Artificial Sequence: Synthetic peptide
DESEISTTNPVATEQYGSVSGNLQHGNA

SEQ ID NO: 10163 - protein, 32 aa, Artificial Sequence
  Description of Artificial Sequence: Synthetic polypeptide
DEEEIRTTNPVATEQYGSVSETNLQREINVRT

SEQ ID NO: 10164 - protein, 28 aa, Artificial Sequence
  Description of Artificial Sequence: Synthetic peptide
DESEIRTTNPVSTEQYGNVATNLQRGQR

SEQ ID NO: 10165 - protein, 29 aa, Artificial Sequence
  Description of Artificial Sequence: Synthetic peptide
DESEIRTTNPVSTEMYGSVSTNLQRNGNG

SEQ ID NO: 10166 - protein, 33 aa, Artificial Sequence
  Description of Artificial Sequence: Synthetic polypeptide
DEEEIRTTNPVATEQYGSTVPSYTGNLQRVGNR

SEQ ID NO: 10167 - protein, 31 aa, Artificial Sequence
  Description of Artificial Sequence: Synthetic polypeptide
DEEEIRTTNPVATEQYGSVSETNLQRAGAFD

SEQ ID NO: 10168 - protein, 31 aa, Artificial Sequence
  Description of Artificial Sequence: Synthetic polypeptide
DEEEIRTTNPVATEQYGSVSTPLDQGFGNRD

SEQ ID NO: 10169 - protein, 33 aa, Artificial Sequence
  Description of Artificial Sequence: Synthetic polypeptide
DEEEIRTTNPVATEQYGSTVQSTGNLSQRGTNR

SEQ ID NO: 10170 - protein, 31 aa, Artificial Sequence
  Description of Artificial Sequence: Synthetic polypeptide
DEEEIRTTNPVATEQYGSTVSATELQRGDRL

SEQ ID NO: 10171 - protein, 29 aa, Artificial Sequence
  Description of Artificial Sequence: Synthetic peptide
DEEEIRTTNPVATEQYGSVSTPLENIGIR

SEQ ID NO: 10172 - protein, 28 aa, Artificial Sequence
  Description of Artificial Sequence: Synthetic peptide
DESEIYTTNPVATEQYGSVSTNLGYGNT

SEQ ID NO: 10173 - protein, 29 aa, Artificial Sequence
  Description of Artificial Sequence: Synthetic peptide
DESEIRTTNPVAVEQYGSVISTNLDRNNR

SEQ ID NO: 10174 - protein, 30 aa, Artificial Sequence
  Description of Artificial Sequence: Synthetic polypeptide
DEEEIRTTNPVATEQYGSVSTPLQPEGENQ

SEQ ID NO: 10175 - protein, 30 aa, Artificial Sequence
  Description of Artificial Sequence: Synthetic polypeptide
DEEEIRTTNPVATEQYGSVSTPLQQEGTNI

SEQ ID NO: 10176 - protein, 29 aa, Artificial Sequence
  Description of Artificial Sequence: Synthetic peptide
DESEIRTTNPVATERYGSVSTNLQAEGNT

SEQ ID NO: 10177 - protein, 29 aa, Artificial Sequence
  Description of Artificial Sequence: Synthetic peptide
DESEIRTTNPVATEQYGWVSTNDQRGERN

SEQ ID NO: 10178 - protein, 30 aa, Artificial Sequence
  Description of Artificial Sequence: Synthetic polypeptide
DEEEICTTNPVATEQYGTVSTNLSQSPGNR

SEQ ID NO: 10179 - protein, 28 aa, Artificial Sequence
  Description of Artificial Sequence: Synthetic peptide
DEAEIRTTNSVAYTQYGSVSTNLQRGDR

SEQ ID NO: 10180 - protein, 28 aa, Artificial Sequence
  Description of Artificial Sequence: Synthetic peptide
DESEIRTTNPVATEQYGVVSTQLQRPND

SEQ ID NO: 10181 - protein, 29 aa, Artificial Sequence
  Description of Artificial Sequence: Synthetic peptide
DEAEIRTTNSVAYTQYGSVSTNLQRGDNR

SEQ ID NO: 10182 - protein, 29 aa, Artificial Sequence
  Description of Artificial Sequence: Synthetic peptide
DESEIRTTNPVATEQYGVVSTELQRGNLG

SEQ ID NO: 10183 - protein, 32 aa, Artificial Sequence
  Description of Artificial Sequence: Synthetic polypeptide
DEEEIRTTNPVATEQYGSVSTPLSQRPGGNRS

SEQ ID NO: 10184 - protein, 31 aa, Artificial Sequence
  Description of Artificial Sequence: Synthetic polypeptide
DEEEIRTTNPVATEQYGSVSETNLQMTGNGD

SEQ ID NO: 10185 - protein, 30 aa, Artificial Sequence
  Description of Artificial Sequence: Synthetic polypeptide
DEEEIRTTNPVATEQYGSVSTPLTRGNDNE

SEQ ID NO: 10186 - protein, 29 aa, Artificial Sequence
  Description of Artificial Sequence: Synthetic peptide
DESEIRTTNPVATEQYGTVSTELQRGNVM

SEQ ID NO: 10187 - protein, 31 aa, Artificial Sequence
  Description of Artificial Sequence: Synthetic polypeptide
DEEEICTTNPVATEQYGSVSTVNDQRGDANR

SEQ ID NO: 10188 - protein, 29 aa, Artificial Sequence
  Description of Artificial Sequence: Synthetic peptide
DEEEICTTNPVATEQYGSVSTVDQRGNDH

SEQ ID NO: 10189 - protein, 29 aa, Artificial Sequence
  Description of Artificial Sequence: Synthetic peptide
DESEIRTTNPVATESWGSVSTNLQVGDNR

SEQ ID NO: 10190 - protein, 30 aa, Artificial Sequence
  Description of Artificial Sequence: Synthetic polypeptide
DESEIRTTNPVATEQYGSVVSTNQQPTGNR

SEQ ID NO: 10191 - protein, 30 aa, Artificial Sequence
  Description of Artificial Sequence: Synthetic polypeptide
DESEIRTTNPVATEQYGSVVSTNLQTLGNQ

SEQ ID NO: 10192 - protein, 30 aa, Artificial Sequence
  Description of Artificial Sequence: Synthetic polypeptide
DESEIRTTNPVATEQYGSVVSTNDTQGGNR

SEQ ID NO: 10193 - protein, 29 aa, Artificial Sequence
  Description of Artificial Sequence: Synthetic peptide
DEEEICTTNPVATEQYGSVSTNSQHQGNT

SEQ ID NO: 10194 - protein, 30 aa, Artificial Sequence
  Description of Artificial Sequence: Synthetic polypeptide
DESEIRTTNPVATEQYGSVTTNLQRGENPS

SEQ ID NO: 10195 - protein, 29 aa, Artificial Sequence
  Description of Artificial Sequence: Synthetic peptide
DESEIRTTNPVATEQYGSVTTNLQRGEET

SEQ ID NO: 10196 - protein, 29 aa, Artificial Sequence
  Description of Artificial Sequence: Synthetic peptide
DESEIRTTNPVATEQYGSVTTNLDRGNDP

SEQ ID NO: 10197 - protein, 31 aa, Artificial Sequence
  Description of Artificial Sequence: Synthetic polypeptide
DESEIRTTNPVATEQYGSVSWTNLQEDSGNR

SEQ ID NO: 10198 - protein, 30 aa, Artificial Sequence
  Description of Artificial Sequence: Synthetic polypeptide
DESEIRTTNPVATEQYGSVSVTNLQTGGNN

SEQ ID NO: 10199 - protein, 29 aa, Artificial Sequence
  Description of Artificial Sequence: Synthetic peptide
DESEIRTTNPVATEQYGSVSVNLQGIGNP

SEQ ID NO: 10200 - protein, 30 aa, Artificial Sequence
  Description of Artificial Sequence: Synthetic polypeptide
DEEEIRTTNPVATEQYGSVSTPNDLQPQNL

SEQ ID NO: 10201 - protein, 30 aa, Artificial Sequence
  Description of Artificial Sequence: Synthetic polypeptide
DEEEIRTTNPVATEQYGSVSTPNDLQTINT

SEQ ID NO: 10202 - protein, 30 aa, Artificial Sequence
  Description of Artificial Sequence: Synthetic polypeptide
DESEIRTTNPVATEQYGSVSTVNLLQAGNL

SEQ ID NO: 10203 - protein, 29 aa, Artificial Sequence
  Description of Artificial Sequence: Synthetic peptide
DESEIRTTNPVATEQYGSVSTVLQGDGNT

SEQ ID NO: 10204 - protein, 30 aa, Artificial Sequence
  Description of Artificial Sequence: Synthetic polypeptide
DESEIRTTNPVATEQYGSVVSTNLQVNGNI

SEQ ID NO: 10205 - protein, 29 aa, Artificial Sequence
  Description of Artificial Sequence: Synthetic peptide
DESEIRTTNPVATETYGSVSTNLQQLGNV

SEQ ID NO: 10206 - protein, 29 aa, Artificial Sequence
  Description of Artificial Sequence: Synthetic peptide
DESEIRTTNPVATETYGSVSTNLQRGESD

SEQ ID NO: 10207 - protein, 30 aa, Artificial Sequence
  Description of Artificial Sequence: Synthetic polypeptide
DESEIRTTNPVATEVYGSVSTNLQFGGDNR

SEQ ID NO: 10208 - protein, 28 aa, Artificial Sequence
  Description of Artificial Sequence: Synthetic peptide
DESEIRTTNPVATYHYGSVSTNLQRDNM

SEQ ID NO: 10209 - protein, 33 aa, Artificial Sequence
  Description of Artificial Sequence: Synthetic polypeptide
DEEEIRTTNPVATEQYGSTVSTGNLSQRVGNVR

SEQ ID NO: 10210 - protein, 30 aa, Artificial Sequence
  Description of Artificial Sequence: Synthetic polypeptide
DEEEIRTTNPVATEQYGSVSTPLQQGENSA

SEQ ID NO: 10211 - protein, 28 aa, Artificial Sequence
  Description of Artificial Sequence: Synthetic peptide
DESEIRTTNPVATTQYGSVNTTLQRGND

SEQ ID NO: 10212 - protein, 28 aa, Artificial Sequence
  Description of Artificial Sequence: Synthetic peptide
DESEIRTTNPVATTIYGSVSTNLQRNNP

SEQ ID NO: 10213 - protein, 31 aa, Artificial Sequence
  Description of Artificial Sequence: Synthetic polypeptide
DEEEIRTTNPVATEQYGSVSTPLQQSGNERT

SEQ ID NO: 10214 - protein, 32 aa, Artificial Sequence
  Description of Artificial Sequence: Synthetic polypeptide
DEEEIRTTNPVATEQYGSTVSTLNLSGRGGNR

SEQ ID NO: 10215 - protein, 29 aa, Artificial Sequence
  Description of Artificial Sequence: Synthetic peptide
DEEEIRTTNPVATEQYGSVSTPLQREVDL

SEQ ID NO: 10216 - protein, 31 aa, Artificial Sequence
  Description of Artificial Sequence: Synthetic polypeptide
DEEEIRTTNPVATEQYGSTVSTNAQQRGGNI

SEQ ID NO: 10217 - protein, 30 aa, Artificial Sequence
  Description of Artificial Sequence: Synthetic polypeptide
DEEEIRTTNPVATEQYGSVSTPLQRFSETR

SEQ ID NO: 10218 - protein, 28 aa, Artificial Sequence
  Description of Artificial Sequence: Synthetic peptide
DESEIRTTNPVATQQYGCVSTNLERGNQ

SEQ ID NO: 10219 - protein, 28 aa, Artificial Sequence
  Description of Artificial Sequence: Synthetic peptide
DESEIRTTNPVATQQYGAVSTNLERGNG

SEQ ID NO: 10220 - protein, 31 aa, Artificial Sequence
  Description of Artificial Sequence: Synthetic polypeptide
DEEEIRTTNPVATEQYGSTVSTNASQRGGNV

SEQ ID NO: 10221 - protein, 30 aa, Artificial Sequence
  Description of Artificial Sequence: Synthetic polypeptide
DEEEIRTTNPVATEQYGSVSTPLQRGEDSM

SEQ ID NO: 10222 - protein, 28 aa, Artificial Sequence
  Description of Artificial Sequence: Synthetic peptide
DESEIRTTNPVATQHYGSVSTNLQRTNI

SEQ ID NO: 10223 - protein, 28 aa, Artificial Sequence
  Description of Artificial Sequence: Synthetic peptide
DESEIRTTNPVATNLYGSVSTNLQRTNM

SEQ ID NO: 10224 - protein, 28 aa, Artificial Sequence
  Description of Artificial Sequence: Synthetic peptide
DESEIRTTNPVATNHYGSVSTNLQRTNN

SEQ ID NO: 10225 - protein, 28 aa, Artificial Sequence
  Description of Artificial Sequence: Synthetic peptide
DESEIRTTNPVATLHYGSVSTNLQRTNL

SEQ ID NO: 10226 - protein, 28 aa, Artificial Sequence
  Description of Artificial Sequence: Synthetic peptide
DESEIRTTNPVATKYYGSVSTNLQRENM

SEQ ID NO: 10227 - protein, 28 aa, Artificial Sequence
  Description of Artificial Sequence: Synthetic peptide
DESEIRTTNPVATKWYGSVSTNLQRNNG

SEQ ID NO: 10228 - protein, 28 aa, Artificial Sequence
  Description of Artificial Sequence: Synthetic peptide
DESEIRTTNPVATKTYGSVSTNLQRTNA

SEQ ID NO: 10229 - protein, 28 aa, Artificial Sequence
  Description of Artificial Sequence: Synthetic peptide
DESEIRTTNPVATKCYGSVSTNLQRENM

SEQ ID NO: 10230 - protein, 28 aa, Artificial Sequence
  Description of Artificial Sequence: Synthetic peptide
DESEIRTTNPVATKAYGSVSTNLQRINM

SEQ ID NO: 10231 - protein, 30 aa, Artificial Sequence
  Description of Artificial Sequence: Synthetic polypeptide
DEEEIRTTNPVATEQYGSVSTPLQRGSQQP

SEQ ID NO: 10232 - protein, 28 aa, Artificial Sequence
  Description of Artificial Sequence: Synthetic peptide
DESEIRTTNPVATHFYGSVSTNLQRTNM

SEQ ID NO: 10233 - protein, 28 aa, Artificial Sequence
  Description of Artificial Sequence: Synthetic peptide
DESEIRTTNPVATGHYGSVSTNLQRMNM

SEQ ID NO: 10234 - protein, 28 aa, Artificial Sequence
  Description of Artificial Sequence: Synthetic peptide
DESEIRTTNPVATFHYGSVSTNLQRNNM

SEQ ID NO: 10235 - protein, 29 aa, Artificial Sequence
  Description of Artificial Sequence: Synthetic peptide
DESEIRTTNPVATEWYGSVSTNRQEGNER

SEQ ID NO: 10236 - protein, 29 aa, Artificial Sequence
  Description of Artificial Sequence: Synthetic peptide
DESEIRTTNPVATEWYGSVSTNLQLTGNA

SEQ ID NO: 10237 - protein, 29 aa, Artificial Sequence
  Description of Artificial Sequence: Synthetic peptide
DEEEIRTTNPVATEQYGSVSTPDQQRGDD

SEQ ID NO: 10238 - protein, 31 aa, Artificial Sequence
  Description of Artificial Sequence: Synthetic polypeptide
DEEEIRTTNPVATEQYGSVSTPDLQRGDNDM

SEQ ID NO: 10239 - protein, 30 aa, Artificial Sequence
  Description of Artificial Sequence: Synthetic polypeptide
DEEEIRTTNPVATEQYGSTSWNDQRGNSRS

SEQ ID NO: 10240 - protein, 30 aa, Artificial Sequence
  Description of Artificial Sequence: Synthetic polypeptide
DEEEIRTTNPVATEQYGSVSETNLWEGGER

SEQ ID NO: 10241 - protein, 29 aa, Artificial Sequence
  Description of Artificial Sequence: Synthetic peptide
DEEEIRTTNPVATEQYGSVSTNSNNGNAE

SEQ ID NO: 10242 - protein, 30 aa, Artificial Sequence
  Description of Artificial Sequence: Synthetic polypeptide
DEEEIRTTNPVATEQYGSVSTNSQGDNGNQ

SEQ ID NO: 10243 - protein, 30 aa, Artificial Sequence
  Description of Artificial Sequence: Synthetic polypeptide
DEEEIRTTNPVATEQYGSVSTNSQGGGERA

SEQ ID NO: 10244 - protein, 29 aa, Artificial Sequence
  Description of Artificial Sequence: Synthetic peptide
DETEIRTTNPVATEQYGSVATNIQRGNES

SEQ ID NO: 10245 - protein, 31 aa, Artificial Sequence
  Description of Artificial Sequence: Synthetic polypeptide
DEEEIRTTNPVATEQYGSVSTNSQRVGVNEE

SEQ ID NO: 10246 - protein, 29 aa, Artificial Sequence
  Description of Artificial Sequence: Synthetic peptide
DETEIRTTNPVATEQYGSISTNTQREGTR

SEQ ID NO: 10247 - protein, 30 aa, Artificial Sequence
  Description of Artificial Sequence: Synthetic polypeptide
DETEIRTTNPVATEQYGSISTNLTQREGER

SEQ ID NO: 10248 - protein, 29 aa, Artificial Sequence
  Description of Artificial Sequence: Synthetic peptide
DETEIRTTNPVATEQYGSISTNAQREGER

SEQ ID NO: 10249 - protein, 31 aa, Artificial Sequence
  Description of Artificial Sequence: Synthetic polypeptide
DEEEIRTTNPVATEQYGSTASCTNLSQRGSR

SEQ ID NO: 10250 - protein, 29 aa, Artificial Sequence
  Description of Artificial Sequence: Synthetic peptide
DETEIRTTNPVATEQYGQVSTNLQMAGND

SEQ ID NO: 10251 - protein, 29 aa, Artificial Sequence
  Description of Artificial Sequence: Synthetic peptide
DETEIRTTNPVATEQYGQVSTNLQGDGNA

SEQ ID NO: 10252 - protein, 29 aa, Artificial Sequence
  Description of Artificial Sequence: Synthetic peptide
DETEIRTTNPVATEQYGQVSTNLERDGNK

SEQ ID NO: 10253 - protein, 30 aa, Artificial Sequence
  Description of Artificial Sequence: Synthetic polypeptide
DETEIRTTNPVATEQYGNVSTNLQGPGNER

SEQ ID NO: 10254 - protein, 29 aa, Artificial Sequence
  Description of Artificial Sequence: Synthetic peptide
DETEIRTTNPVATEQYGSVSADLQRGNQF

SEQ ID NO: 10255 - protein, 30 aa, Artificial Sequence
  Description of Artificial Sequence: Synthetic polypeptide
DETEIRTTNPVATEQYGNVSTNLQGMGNAR

SEQ ID NO: 10256 - protein, 32 aa, Artificial Sequence
  Description of Artificial Sequence: Synthetic polypeptide
DEEEIRTTNPVATEQYGSVSETTNLQRGNNEF

SEQ ID NO: 10257 - protein, 30 aa, Artificial Sequence
  Description of Artificial Sequence: Synthetic polypeptide
DETEIRTTNPVATEQYGEVSTNLGREGNPR

SEQ ID NO: 10258 - protein, 30 aa, Artificial Sequence
  Description of Artificial Sequence: Synthetic polypeptide
DETEIRTTNPVATEQYGEVSTNLDRGGNDR

SEQ ID NO: 10259 - protein, 29 aa, Artificial Sequence
  Description of Artificial Sequence: Synthetic peptide
DETEIRTTNPVATEQYGDVSTNLQGGDDR

SEQ ID NO: 10260 - protein, 28 aa, Artificial Sequence
  Description of Artificial Sequence: Synthetic peptide
DEEEIRTTNPVATEQYGSVSTNTEQGLT

SEQ ID NO: 10261 - protein, 30 aa, Artificial Sequence
  Description of Artificial Sequence: Synthetic polypeptide
DETEIRTTNPVATEQYGDVSTNLQGDGDNR

SEQ ID NO: 10262 - protein, 29 aa, Artificial Sequence
  Description of Artificial Sequence: Synthetic peptide
DETEIRTTNPVATEQYGCVSTNLERGGNS

SEQ ID NO: 10263 - protein, 30 aa, Artificial Sequence
  Description of Artificial Sequence: Synthetic polypeptide
DETEIRTTNPVATEPYGSVSTNNQRGENER

SEQ ID NO: 10264 - protein, 29 aa, Artificial Sequence
  Description of Artificial Sequence: Synthetic peptide
DETEIRTTNPVATEPYGSVSTELQRGSER

SEQ ID NO: 10265 - protein, 30 aa, Artificial Sequence
  Description of Artificial Sequence: Synthetic polypeptide
DETEIRTTNPVATENYGSVSTNLQEMGMNR

SEQ ID NO: 10266 - protein, 29 aa, Artificial Sequence
  Description of Artificial Sequence: Synthetic peptide
DETEIRTTNPVATEMYGSVSTNLQMNGNS

SEQ ID NO: 10267 - protein, 30 aa, Artificial Sequence
  Description of Artificial Sequence: Synthetic polypeptide
DETEIRTTNPVATELYGSVSTNLQEPGNNR

SEQ ID NO: 10268 - protein, 28 aa, Artificial Sequence
  Description of Artificial Sequence: Synthetic peptide
DETEIRTTNPVATELYGCVSDNVQRGNR

SEQ ID NO: 10269 - protein, 30 aa, Artificial Sequence
  Description of Artificial Sequence: Synthetic polypeptide
DETEIRTTNPVATEQYGNVSTNLQFNGDNR

SEQ ID NO: 10270 - protein, 31 aa, Artificial Sequence
  Description of Artificial Sequence: Synthetic polypeptide
DETEIRTTNPVATEQYGSVSCTNLQIGGNRM

SEQ ID NO: 10271 - protein, 29 aa, Artificial Sequence
  Description of Artificial Sequence: Synthetic peptide
DETEIRTTNPVATEQYGSVSENEQRGNEL

SEQ ID NO: 10272 - protein, 30 aa, Artificial Sequence
  Description of Artificial Sequence: Synthetic polypeptide
DETEIRTTNPVATEQYGSVSENLQPAGNER

SEQ ID NO: 10273 - protein, 30 aa, Artificial Sequence
  Description of Artificial Sequence: Synthetic polypeptide
DETEIRTTNPVATEQYGSVSTNPQRGNDEN

SEQ ID NO: 10274 - protein, 29 aa, Artificial Sequence
  Description of Artificial Sequence: Synthetic peptide
DETEIRTTNPVATEQYGSVSTNPQDGDHR

SEQ ID NO: 10275 - protein, 30 aa, Artificial Sequence
  Description of Artificial Sequence: Synthetic polypeptide
DETEIRTTNPVATEQYGSVSTNLQSNGNMQ

SEQ ID NO: 10276 - protein, 30 aa, Artificial Sequence
  Description of Artificial Sequence: Synthetic polypeptide
DETEIRTTNPVATEQYGSVSTNLQSGSEGR

SEQ ID NO: 10277 - protein, 30 aa, Artificial Sequence
  Description of Artificial Sequence: Synthetic polypeptide
DETEIRTTNPVATEQYGSVSTNLQRGGDGT

SEQ ID NO: 10278 - protein, 30 aa, Artificial Sequence
  Description of Artificial Sequence: Synthetic polypeptide
DETEIRTTNPVATEQYGSVSTNLQRGEDSG

SEQ ID NO: 10279 - protein, 31 aa, Artificial Sequence
  Description of Artificial Sequence: Synthetic polypeptide
DETEIRTTNPVATEQYGSVSTNLQREGNGQP

SEQ ID NO: 10280 - protein, 30 aa, Artificial Sequence
  Description of Artificial Sequence: Synthetic polypeptide
DETEIRTTNPVATEQYGSVSTNLQREGDMS

SEQ ID NO: 10281 - protein, 30 aa, Artificial Sequence
  Description of Artificial Sequence: Synthetic polypeptide
DETEIRTTNPVATEQYGSVSTNLQQGGQND

SEQ ID NO: 10282 - protein, 30 aa, Artificial Sequence
  Description of Artificial Sequence: Synthetic polypeptide
DETEIRTTNPVATEQYGSVSTNLQPQGQNA

SEQ ID NO: 10283 - protein, 30 aa, Artificial Sequence
  Description of Artificial Sequence: Synthetic polypeptide
DETEIRTTNPVATEQYGSVSTNLQPNGNHQ

SEQ ID NO: 10284 - protein, 30 aa, Artificial Sequence
  Description of Artificial Sequence: Synthetic polypeptide
DETEIRTTNPVATEQYGSVSTNLQNGDHRG

SEQ ID NO: 10285 - protein, 30 aa, Artificial Sequence
  Description of Artificial Sequence: Synthetic polypeptide
DETEIRTTNPVATEQYGSVSTNLQHQGGNL

SEQ ID NO: 10286 - protein, 31 aa, Artificial Sequence
  Description of Artificial Sequence: Synthetic polypeptide
DETEIRTTNPVATEQYGSVSTNLQHQGGNDR

SEQ ID NO: 10287 - protein, 30 aa, Artificial Sequence
  Description of Artificial Sequence: Synthetic polypeptide
DETEIRTTNPVATEQYGSVSTNLQHNGNDH

SEQ ID NO: 10288 - protein, 30 aa, Artificial Sequence
  Description of Artificial Sequence: Synthetic polypeptide
DETEIRTTNPVATEQYGSVSTNLQHGGNDL

SEQ ID NO: 10289 - protein, 31 aa, Artificial Sequence
  Description of Artificial Sequence: Synthetic polypeptide
DETEIRTTNPVATEQYGSVSTNLQHEGNGDR

SEQ ID NO: 10290 - protein, 30 aa, Artificial Sequence
  Description of Artificial Sequence: Synthetic polypeptide
DETEIRTTNPVATEQYGSVSTNLQHDNGMR

SEQ ID NO: 10291 - protein, 31 aa, Artificial Sequence
  Description of Artificial Sequence: Synthetic polypeptide
DETEIRTTNPVATEQYGSVSTNLQGEGGMNR

SEQ ID NO: 10292 - protein, 30 aa, Artificial Sequence
  Description of Artificial Sequence: Synthetic polypeptide
DETEIRTTNPVATEQYGSVSTNLQDSGQNL

SEQ ID NO: 10293 - protein, 31 aa, Artificial Sequence
  Description of Artificial Sequence: Synthetic polypeptide
DETEIRTTNPVATEQYGSVSTNLQDGGNNRE

SEQ ID NO: 10294 - protein, 31 aa, Artificial Sequence
  Description of Artificial Sequence: Synthetic polypeptide
DETEIRTTNPVATEQYGSVSTNLPQDGAGNR

SEQ ID NO: 10295 - protein, 29 aa, Artificial Sequence
  Description of Artificial Sequence: Synthetic peptide
DETEIRTTNPVATEQYGSVSTNLERGDDL

SEQ ID NO: 10296 - protein, 29 aa, Artificial Sequence
  Description of Artificial Sequence: Synthetic peptide
DETEIRTTNPVATEQYGSVSTNLDQGNVG

SEQ ID NO: 10297 - protein, 31 aa, Artificial Sequence
  Description of Artificial Sequence: Synthetic polypeptide
DETEIRTTNPVATEQYGSVSTNILQEGGNER

SEQ ID NO: 10298 - protein, 29 aa, Artificial Sequence
  Description of Artificial Sequence: Synthetic peptide
DETEIRTTNPVATEQYGSVSTNDNRDGNP

SEQ ID NO: 10299 - protein, 29 aa, Artificial Sequence
  Description of Artificial Sequence: Synthetic peptide
DETEIRTTNPVATEQYGSVSTGLQDHGNQ

SEQ ID NO: 10300 - protein, 29 aa, Artificial Sequence
  Description of Artificial Sequence: Synthetic peptide
DETEIRTTNPVATEQYGSVSQNLTRNMNR

SEQ ID NO: 10301 - protein, 31 aa, Artificial Sequence
  Description of Artificial Sequence: Synthetic polypeptide
DETEIRTTNPVATEQYGSVSNTNLQREGNAN

SEQ ID NO: 10302 - protein, 30 aa, Artificial Sequence
  Description of Artificial Sequence: Synthetic polypeptide
DEEEIRTTNPVATEQYGSVSTNTGQNGTNN

SEQ ID NO: 10303 - protein, 29 aa, Artificial Sequence
  Description of Artificial Sequence: Synthetic peptide
DEEEIRTTNPVATEQYGSVATNEQTGNDL

SEQ ID NO: 10304 - protein, 32 aa, Artificial Sequence
  Description of Artificial Sequence: Synthetic polypeptide
DEEEIRTTNPVATEQYGSTISCTNNLQRGGNR

SEQ ID NO: 10305 - protein, 28 aa, Artificial Sequence
  Description of Artificial Sequence: Synthetic peptide
DETEIRTTNPVATECYGSVSTNIQRGDT

SEQ ID NO: 10306 - protein, 32 aa, Artificial Sequence
  Description of Artificial Sequence: Synthetic polypeptide
DEEEIRTTNPVATEQYGSTSPTDNLGQRIGNR

SEQ ID NO: 10307 - protein, 28 aa, Artificial Sequence
  Description of Artificial Sequence: Synthetic peptide
DETEIATTNPVATEVYGSVSTNNQRGNE

SEQ ID NO: 10308 - protein, 30 aa, Artificial Sequence
  Description of Artificial Sequence: Synthetic polypeptide
DEEEIRTTNPVATEQYGSVSTNVQTGMGNP

SEQ ID NO: 10309 - protein, 30 aa, Artificial Sequence
  Description of Artificial Sequence: Synthetic polypeptide
DEEEIRTTNPVATEQYGSTSTNDLQRMNDQ

SEQ ID NO: 10310 - protein, 31 aa, Artificial Sequence
  Description of Artificial Sequence: Synthetic polypeptide
DEEEIRTTNPVATEQYGSVSTNVQVPGNERQ

SEQ ID NO: 10311 - protein, 29 aa, Artificial Sequence
  Description of Artificial Sequence: Synthetic peptide
DETEIATTNPVATEQYGVVSTNLQASGNR

SEQ ID NO: 10312 - protein, 29 aa, Artificial Sequence
  Description of Artificial Sequence: Synthetic peptide
DETEIATTNPVATEQYGSVSTNPQDEGNR

SEQ ID NO: 10313 - protein, 30 aa, Artificial Sequence
  Description of Artificial Sequence: Synthetic polypeptide
DEEEIRTTNPVATEQYGSVSTNVSQTGGNS

SEQ ID NO: 10314 - protein, 31 aa, Artificial Sequence
  Description of Artificial Sequence: Synthetic polypeptide
DEEEIGCTNPVATEQYGSVCSTNLQRGNSNR

SEQ ID NO: 10315 - protein, 29 aa, Artificial Sequence
  Description of Artificial Sequence: Synthetic peptide
DEAEISTTNPVATEHYGSVSTNLQRDGNI

SEQ ID NO: 10316 - protein, 32 aa, Artificial Sequence
  Description of Artificial Sequence: Synthetic polypeptide
DEEEIRTTNPVATEQYGSVSTNWLQMSGTENR

SEQ ID NO: 10317 - protein, 30 aa, Artificial Sequence
  Description of Artificial Sequence: Synthetic polypeptide
DETEIATTNPVATEQYGSVATNLQRDGNRF

SEQ ID NO: 10318 - protein, 32 aa, Artificial Sequence
  Description of Artificial Sequence: Synthetic polypeptide
DEEEIRTTNPVATEQYGSVSTNWLQRGVNPEE

SEQ ID NO: 10319 - protein, 32 aa, Artificial Sequence
  Description of Artificial Sequence: Synthetic polypeptide
DEEEIRTTNPVATEQYGSTSNTTNLSQRTGNR

SEQ ID NO: 10320 - protein, 31 aa, Artificial Sequence
  Description of Artificial Sequence: Synthetic polypeptide
DEEEIRTTNPVATEQYGSVSETNNQRQGERQ

SEQ ID NO: 10321 - protein, 28 aa, Artificial Sequence
  Description of Artificial Sequence: Synthetic peptide
DETEIATTNPVATEGYGSVSTGLQNGNR

SEQ ID NO: 10322 - protein, 28 aa, Artificial Sequence
  Description of Artificial Sequence: Synthetic peptide
DETEIATTNPVATECYGSVSTNEQRGNA

SEQ ID NO: 10323 - protein, 31 aa, Artificial Sequence
  Description of Artificial Sequence: Synthetic polypeptide
DEEEIRTTNPVATEQYGSVSTNYQRDGNEEG

SEQ ID NO: 10324 - protein, 30 aa, Artificial Sequence
  Description of Artificial Sequence: Synthetic polypeptide
DEEEIRTTNPVATEQYGSVSTNYQVSGMNG

SEQ ID NO: 10325 - protein, 30 aa, Artificial Sequence
  Description of Artificial Sequence: Synthetic polypeptide
DEEEIRTTNPVATEQYGSTSVNNMLQRDNR

SEQ ID NO: 10326 - protein, 32 aa, Artificial Sequence
  Description of Artificial Sequence: Synthetic polypeptide
DEEEIRTTNPVATEQYGSTSVTENLSQRFGNR

SEQ ID NO: 10327 - protein, 29 aa, Artificial Sequence
  Description of Artificial Sequence: Synthetic peptide
DEEEICTTNPVAYEQYGTVSTNLQGGNDR

SEQ ID NO: 10328 - protein, 32 aa, Artificial Sequence
  Description of Artificial Sequence: Synthetic polypeptide
DEEEIRTTNPVATEQYGSTSVTENLTQRMGNR

SEQ ID NO: 10329 - protein, 29 aa, Artificial Sequence
  Description of Artificial Sequence: Synthetic peptide
DEEEICTTNPVAYEQYGSVSTNQQMEGNR

SEQ ID NO: 10330 - protein, 29 aa, Artificial Sequence
  Description of Artificial Sequence: Synthetic peptide
DEEEICTTNPVAYEQYGSVSTNPQSGGNR

SEQ ID NO: 10331 - protein, 28 aa, Artificial Sequence
  Description of Artificial Sequence: Synthetic peptide
DESVIRTTNPVATEQYGSFSTNLDIGNR

SEQ ID NO: 10332 - protein, 31 aa, Artificial Sequence
  Description of Artificial Sequence: Synthetic polypeptide
DEEEIRTTNPVATEQYGSVSETNMLQRQMDR

SEQ ID NO: 10333 - protein, 28 aa, Artificial Sequence
  Description of Artificial Sequence: Synthetic peptide
DESVIRTTNPVATEQYGCVHTNDQRGNR

SEQ ID NO: 10334 - protein, 29 aa, Artificial Sequence
  Description of Artificial Sequence: Synthetic peptide
DETEIATTNPVATEQYGIVSTNLQHEGNR

SEQ ID NO: 10335 - protein, 30 aa, Artificial Sequence
  Description of Artificial Sequence: Synthetic polypeptide
DEEEIGTTNPVATEHYGSVSTNLQQGNERM

SEQ ID NO: 10336 - protein, 31 aa, Artificial Sequence
  Description of Artificial Sequence: Synthetic polypeptide
DEEEIRTTNPVATEQYGSVSTNVQPGGNERQ

SEQ ID NO: 10337 - protein, 32 aa, Artificial Sequence
  Description of Artificial Sequence: Synthetic polypeptide
DEEEIRTTNPVATEQYGSTSMTNGLEQRDGNR

SEQ ID NO: 10338 - protein, 30 aa, Artificial Sequence
  Description of Artificial Sequence: Synthetic polypeptide
DEEEIRTTNPVATEQYGSTSCPNMLQRDNR

SEQ ID NO: 10339 - protein, 30 aa, Artificial Sequence
  Description of Artificial Sequence: Synthetic polypeptide
DETEIRTTNPVATEAYGSVSTNLQRGGDNG

SEQ ID NO: 10340 - protein, 28 aa, Artificial Sequence
  Description of Artificial Sequence: Synthetic peptide
DETEIRTTNPVATDTYGSVSTNLQRTNA

SEQ ID NO: 10341 - protein, 32 aa, Artificial Sequence
  Description of Artificial Sequence: Synthetic polypeptide
DEEEIRTTNPVATEQYGSTSCTGNLSQRFGNR

SEQ ID NO: 10342 - protein, 31 aa, Artificial Sequence
  Description of Artificial Sequence: Synthetic polypeptide
DEEEIRTTNPVATEQYGSVSTNTLQNDGNEG

SEQ ID NO: 10343 - protein, 32 aa, Artificial Sequence
  Description of Artificial Sequence: Synthetic polypeptide
DEEEIRTTNPVATEQYGSTSETENLLQRIGNR

SEQ ID NO: 10344 - protein, 28 aa, Artificial Sequence
  Description of Artificial Sequence: Synthetic peptide
DETEIRTTNPVATDQYGSVNTQLQRGNN

SEQ ID NO: 10345 - protein, 29 aa, Artificial Sequence
  Description of Artificial Sequence: Synthetic peptide
DETEIRTTNPVATDQYGSVNTNELQRGNG

SEQ ID NO: 10346 - protein, 32 aa, Artificial Sequence
  Description of Artificial Sequence: Synthetic polypeptide
DEEEIRTTNPVATEQYGSTSGTENLNQRIGNR

SEQ ID NO: 10347 - protein, 32 aa, Artificial Sequence
  Description of Artificial Sequence: Synthetic polypeptide
DEEEIRTTNPVATEQYGSTSGTENLSQRNGNR

SEQ ID NO: 10348 - protein, 28 aa, Artificial Sequence
  Description of Artificial Sequence: Synthetic peptide
DETEIRTTNPVATDQYGSVNTGLQRGND

SEQ ID NO: 10349 - protein, 32 aa, Artificial Sequence
  Description of Artificial Sequence: Synthetic polypeptide
DEEEIRTTNPVATEQYGSTSLTENLSQRDGNR

SEQ ID NO: 10350 - protein, 28 aa, Artificial Sequence
  Description of Artificial Sequence: Synthetic peptide
DETEIRTTNPVATAQYGCVSTNLERGNP

SEQ ID NO: 10351 - protein, 28 aa, Artificial Sequence
  Description of Artificial Sequence: Synthetic peptide
DETEIRTTNPVASEQYGSVPTNIQRQNR

SEQ ID NO: 10352 - protein, 28 aa, Artificial Sequence
  Description of Artificial Sequence: Synthetic peptide
DETEIRTTNPCATECYGSVSTNLQFGER

SEQ ID NO: 10353 - protein, 32 aa, Artificial Sequence
  Description of Artificial Sequence: Synthetic polypeptide
DEEEIRTTNPVATEQYGSTSLTENLVQRIGNR

SEQ ID NO: 10354 - protein, 31 aa, Artificial Sequence
  Description of Artificial Sequence: Synthetic polypeptide
DEEEIRTTNPVATEQYGSVSETPNMNQRLNR

SEQ ID NO: 10355 - protein, 30 aa, Artificial Sequence
  Description of Artificial Sequence: Synthetic polypeptide
DEEEIRTTNPVATEQYGSVSTNTQRGGGIG

SEQ ID NO: 10356 - protein, 28 aa, Artificial Sequence
  Description of Artificial Sequence: Synthetic peptide
DETEICTTNPVATEVYGSVSTNEQRGNV

SEQ ID NO: 10357 - protein, 32 aa, Artificial Sequence
  Description of Artificial Sequence: Synthetic polypeptide
DEEEIRTTNPVATEQYGSTSMTENLQQREGNR

SEQ ID NO: 10358 - protein, 30 aa, Artificial Sequence
  Description of Artificial Sequence: Synthetic polypeptide
DEEEIRTTNPVATEQYGSVSTNTQRILNAP

SEQ ID NO: 10359 - protein, 31 aa, Artificial Sequence
  Description of Artificial Sequence: Synthetic polypeptide
DEEEIRTTNPVATEQYGSVSTNTQWRGNNDS

SEQ ID NO: 10360 - protein, 29 aa, Artificial Sequence
  Description of Artificial Sequence: Synthetic peptide
DETEICTTNPVATEQYGSVSTNLQGMGND

SEQ ID NO: 10361 - protein, 30 aa, Artificial Sequence
  Description of Artificial Sequence: Synthetic polypeptide
DEEEIRTTNPVATEQYGSVSTNTVQEGNVA

SEQ ID NO: 10362 - protein, 32 aa, Artificial Sequence
  Description of Artificial Sequence: Synthetic polypeptide
DEEEIRTTNPVATEQYGSTSMTENLVQRTGNR

SEQ ID NO: 10363 - protein, 31 aa, Artificial Sequence
  Description of Artificial Sequence: Synthetic polypeptide
DEEEIRTTNPVATEQYGSVSTNVLQNFGNGN

SEQ ID NO: 10364 - protein, 28 aa, Artificial Sequence
  Description of Artificial Sequence: Synthetic peptide
DETEICTTNPVATEQYGSVSTNLDNGNH

SEQ ID NO: 10365 - protein, 32 aa, Artificial Sequence
  Description of Artificial Sequence: Synthetic polypeptide
DEEEIRTTNPVATEQYGSTSMTLNLSQRSGNR

SEQ ID NO: 10366 - protein, 30 aa, Artificial Sequence
  Description of Artificial Sequence: Synthetic polypeptide
DEEEIRTTNPVATEQYGSVSETNQQRGAEH

SEQ ID NO: 10367 - protein, 28 aa, Artificial Sequence
  Description of Artificial Sequence: Synthetic peptide
AEREIRTTNPVATEQYGSVCTNLQDGSR

SEQ ID NO: 10368 - protein, 30 aa, Artificial Sequence
  Description of Artificial Sequence: Synthetic polypeptide
DEEEIATTNPVATEQYGSVSTGNLQDGNNS

SEQ ID NO: 10369 - protein, 29 aa, Artificial Sequence
  Description of Artificial Sequence: Synthetic peptide
DEEEIRTTNPVATEQYGSVATNGQMGNHV

SEQ ID NO: 10370 - protein, 30 aa, Artificial Sequence
  Description of Artificial Sequence: Synthetic polypeptide
DEEEIRTTNPVATEQYGSVATNIQNQGNRF

SEQ ID NO: 10371 - protein, 32 aa, Artificial Sequence
  Description of Artificial Sequence: Synthetic polypeptide
DEEEIRTTNPVATEQYGSVSCTNMFQRTEGNR

SEQ ID NO: 10372 - protein, 31 aa, Artificial Sequence
  Description of Artificial Sequence: Synthetic polypeptide
DEEEIRTTNPVATEQYGSVSCTNLVRDNDRD

SEQ ID NO: 10373 - protein, 32 aa, Artificial Sequence
  Description of Artificial Sequence: Synthetic polypeptide
DEEEIATTNPVATEQYGSVVSTPNLQREGNDR

SEQ ID NO: 10374 - protein, 30 aa, Artificial Sequence
  Description of Artificial Sequence: Synthetic polypeptide
DEEEIRTTNPVATEQYGSVSTTVLQYGTND

SEQ ID NO: 10375 - protein, 31 aa, Artificial Sequence
  Description of Artificial Sequence: Synthetic polypeptide
DEEEIRTTNPVATEQYGSVSCTNLSVRGNNE

SEQ ID NO: 10376 - protein, 32 aa, Artificial Sequence
  Description of Artificial Sequence: Synthetic polypeptide
DEEEIRTTNPVATEQYGSVSCTNLSSQGGNNR

SEQ ID NO: 10377 - protein, 31 aa, Artificial Sequence
  Description of Artificial Sequence: Synthetic polypeptide
DEEEIRTTNPVATEQYGSVSTTVNLEMRGDR

SEQ ID NO: 10378 - protein, 31 aa, Artificial Sequence
  Description of Artificial Sequence: Synthetic polypeptide
DEEEIRTTNPVATEQYGSVSTTVNLQFGENI

SEQ ID NO: 10379 - protein, 31 aa, Artificial Sequence
  Description of Artificial Sequence: Synthetic polypeptide
DEEEIRTTNPVATEQYGSVSTTWLNQRSQNR

SEQ ID NO: 10380 - protein, 28 aa, Artificial Sequence
  Description of Artificial Sequence: Synthetic peptide
DELVIRTTNPVATEQYGCVETNHQRGNR

SEQ ID NO: 10381 - protein, 28 aa, Artificial Sequence
  Description of Artificial Sequence: Synthetic peptide
DELEIYTTNPVATEQYGSVSTNLFEGNT

SEQ ID NO: 10382 - protein, 30 aa, Artificial Sequence
  Description of Artificial Sequence: Synthetic polypeptide
DELEIRTTNPVATEQYGSVYTNLQRGSNAI

SEQ ID NO: 10383 - protein, 30 aa, Artificial Sequence
  Description of Artificial Sequence: Synthetic polypeptide
DEEEIRTTNPVATEQYGSVSTTWLQPRGEN

SEQ ID NO: 10384 - protein, 30 aa, Artificial Sequence
  Description of Artificial Sequence: Synthetic polypeptide
DEEEIRTTNPVATEQYGSVSTTVLQQGINN

SEQ ID NO: 10385 - protein, 28 aa, Artificial Sequence
  Description of Artificial Sequence: Synthetic peptide
DELEIRTTNPVATEQYGETSTNLQRGMS

SEQ ID NO: 10386 - protein, 31 aa, Artificial Sequence
  Description of Artificial Sequence: Synthetic polypeptide
DEEEIATTNPVATEQYGSVVSTANLQAGNTR

SEQ ID NO: 10387 - protein, 31 aa, Artificial Sequence
  Description of Artificial Sequence: Synthetic polypeptide
DEEEIATTNPVATEQYGSVVSNTNLQHSGNR

SEQ ID NO: 10388 - protein, 30 aa, Artificial Sequence
  Description of Artificial Sequence: Synthetic polypeptide
DEEEIRTTNPVATEQYGSVCSTNHQANNDR

SEQ ID NO: 10389 - protein, 28 aa, Artificial Sequence
  Description of Artificial Sequence: Synthetic peptide
DEIEIRTTNPVATEQYGVVSTKLQRPNM

SEQ ID NO: 10390 - protein, 28 aa, Artificial Sequence
  Description of Artificial Sequence: Synthetic peptide
DEIEIRTTNPVATEQYGENSTNLQRGVS

SEQ ID NO: 10391 - protein, 28 aa, Artificial Sequence
  Description of Artificial Sequence: Synthetic peptide
DEIEIRTTNPVATDQYGSVNTTLQRGND

SEQ ID NO: 10392 - protein, 30 aa, Artificial Sequence
  Description of Artificial Sequence: Synthetic polypeptide
DEEEIRTTNPVATEQYGSVCSTNHQDGNAG

SEQ ID NO: 10393 - protein, 30 aa, Artificial Sequence
  Description of Artificial Sequence: Synthetic polypeptide
DEEEIATTNPVATEQYGSVVATNLQRGGNM

SEQ ID NO: 10394 - protein, 29 aa, Artificial Sequence
  Description of Artificial Sequence: Synthetic peptide
DEEEIATTNPVATEQYGSVTSTNIEQGNR

SEQ ID NO: 10395 - protein, 29 aa, Artificial Sequence
  Description of Artificial Sequence: Synthetic peptide
DEIAIRTTNPVATEQYGSVCSTNLIIGNR

SEQ ID NO: 10396 - protein, 28 aa, Artificial Sequence
  Description of Artificial Sequence: Synthetic peptide
DEHEIYTTNPVATEQYGSVSTNLMEGNT

SEQ ID NO: 10397 - protein, 31 aa, Artificial Sequence
  Description of Artificial Sequence: Synthetic polypeptide
DEEEIATTNPVATEQYGSVSVTNLQSDGSNR

SEQ ID NO: 10398 - protein, 31 aa, Artificial Sequence
  Description of Artificial Sequence: Synthetic polypeptide
DEEEIATTNPVATEQYGSVSVTNLQDGFNVR

SEQ ID NO: 10399 - protein, 28 aa, Artificial Sequence
  Description of Artificial Sequence: Synthetic peptide
DELEIRTTNPVATDQYGSVYTQLQRGND

SEQ ID NO: 10400 - protein, 28 aa, Artificial Sequence
  Description of Artificial Sequence: Synthetic peptide
DEHEISTTNPVATEQYGSVSTNLMSGNT

SEQ ID NO: 10401 - protein, 30 aa, Artificial Sequence
  Description of Artificial Sequence: Synthetic polypeptide
DEEEIRTTNPVATEQYGSVCSTNGQRFNDM

SEQ ID NO: 10402 - protein, 29 aa, Artificial Sequence
  Description of Artificial Sequence: Synthetic peptide
DEMEIRCTNPVATEQYGSVSENLVERGNR

SEQ ID NO: 10403 - protein, 31 aa, Artificial Sequence
  Description of Artificial Sequence: Synthetic polypeptide
DEEEIRTTNPVATEQYGSVSCTTNLQRGVLE

SEQ ID NO: 10404 - protein, 31 aa, Artificial Sequence
  Description of Artificial Sequence: Synthetic polypeptide
DEEEIRTTNPVATEQYGSVCSTNDLQRFNDA

SEQ ID NO: 10405 - protein, 31 aa, Artificial Sequence
  Description of Artificial Sequence: Synthetic polypeptide
DEEEIRTTNPVATEQYGSVCSTNDLQRMNDQ

SEQ ID NO: 10406 - protein, 31 aa, Artificial Sequence
  Description of Artificial Sequence: Synthetic polypeptide
DEEEIRTTNPVATEQYGSVCSTNDLQRSNDP

SEQ ID NO: 10407 - protein, 32 aa, Artificial Sequence
  Description of Artificial Sequence: Synthetic polypeptide
DEEEIRTTNPVATEQYGSVCSTNDQERDGNIR

SEQ ID NO: 10408 - protein, 33 aa, Artificial Sequence
  Description of Artificial Sequence: Synthetic polypeptide
DEEEIRTTNPVATEQYGSVSCTPNLFQRGTNNR

SEQ ID NO: 10409 - protein, 28 aa, Artificial Sequence
  Description of Artificial Sequence: Synthetic peptide
DEMEIRTTNPVATEIYGSVSNNLQRGTP

SEQ ID NO: 10410 - protein, 28 aa, Artificial Sequence
  Description of Artificial Sequence: Synthetic peptide
DEMEIRTTNPVATEIYGSVSNNLQRGTE

SEQ ID NO: 10411 - protein, 29 aa, Artificial Sequence
  Description of Artificial Sequence: Synthetic peptide
DEMEIRTTNPVATEHYGSVSTNLQGQGNS

SEQ ID NO: 10412 - protein, 30 aa, Artificial Sequence
  Description of Artificial Sequence: Synthetic polypeptide
DEEEIRTTNPVATEQYGSVSTTTLQNMNER

SEQ ID NO: 10413 - protein, 28 aa, Artificial Sequence
  Description of Artificial Sequence: Synthetic peptide
DEMEIRTTNPVATDQYGSVNTQLQRGNP

SEQ ID NO: 10414 - protein, 28 aa, Artificial Sequence
  Description of Artificial Sequence: Synthetic peptide
DEMEIRTTNPVATDQYGSVGTYLQRGND

SEQ ID NO: 10415 - protein, 28 aa, Artificial Sequence
  Description of Artificial Sequence: Synthetic peptide
DEMEIRTTNPVATDQYGMVSTNLERGNG

SEQ ID NO: 10416 - protein, 28 aa, Artificial Sequence
  Description of Artificial Sequence: Synthetic peptide
DEMEIRCTNPVATEQYGSVSEGLMRGNR

SEQ ID NO: 10417 - protein, 31 aa, Artificial Sequence
  Description of Artificial Sequence: Synthetic polypeptide
DEEEIRTTNPVATEQYGSVSTTTLQRFGTRV

SEQ ID NO: 10418 - protein, 30 aa, Artificial Sequence
  Description of Artificial Sequence: Synthetic polypeptide
DEEEIRTTNPVATEQYGSVSCTNTGQRGKI

SEQ ID NO: 10419 - protein, 30 aa, Artificial Sequence
  Description of Artificial Sequence: Synthetic polypeptide
DEEEIRTTNPVATEQYGSVSCTNQSQQGNQ

SEQ ID NO: 10420 - protein, 30 aa, Artificial Sequence
  Description of Artificial Sequence: Synthetic polypeptide
DEEEIRTTNPVATEQYGSVSCTNPQRGDVF

SEQ ID NO: 10421 - protein, 30 aa, Artificial Sequence
  Description of Artificial Sequence: Synthetic polypeptide
DEEEIRTTNPVATEQYGSVSCTNNTQRGEF

SEQ ID NO: 10422 - protein, 30 aa, Artificial Sequence
  Description of Artificial Sequence: Synthetic polypeptide
DEEEIRTTNPVATEQYGSVSCTNNQRGEEN

SEQ ID NO: 10423 - protein, 28 aa, Artificial Sequence
  Description of Artificial Sequence: Synthetic peptide
DEMEIRTTNPVATCQYGCVSTNLERGNT

SEQ ID NO: 10424 - protein, 30 aa, Artificial Sequence
  Description of Artificial Sequence: Synthetic polypeptide
DEEEIRTTNPVATEQYGSVCSTNDQSGEPR

SEQ ID NO: 10425 - protein, 29 aa, Artificial Sequence
  Description of Artificial Sequence: Synthetic peptide
DEEEIRTTNPVATEQYGSVSTTVLDRIER

SEQ ID NO: 10426 - protein, 32 aa, Artificial Sequence
  Description of Artificial Sequence: Synthetic polypeptide
DEEEIRTTNPVATEQYGSVCSTNELQRHDNRV

SEQ ID NO: 10427 - protein, 31 aa, Artificial Sequence
  Description of Artificial Sequence: Synthetic polypeptide
DEEEIRTTNPVATEQYGSVCSTNGIQESGNR

SEQ ID NO: 10428 - protein, 31 aa, Artificial Sequence
  Description of Artificial Sequence: Synthetic polypeptide
DEEEIRTTNPVATEQYGSVCSTNGQADGNRE

SEQ ID NO: 10429 - protein, 29 aa, Artificial Sequence
  Description of Artificial Sequence: Synthetic peptide
DEEEIRTTNPVATEQYGSVCSTNGQRDIQ

SEQ ID NO: 10430 - protein, 29 aa, Artificial Sequence
  Description of Artificial Sequence: Synthetic peptide
DEMEIRCTNPVATEQYGSVSTNPVERGNR

SEQ ID NO: 10431 - protein, 30 aa, Artificial Sequence
  Description of Artificial Sequence: Synthetic polypeptide
DEEEIRTTNPVATEQYGSVSCTPLQRQERF

SEQ ID NO: 10432 - protein, 31 aa, Artificial Sequence
  Description of Artificial Sequence: Synthetic polypeptide
DEEEIRTTNPVATEQYGSVSCTNLSGRGSNG

SEQ ID NO: 10433 - protein, 30 aa, Artificial Sequence
  Description of Artificial Sequence: Synthetic polypeptide
DEEEIRTTNPVATEQYGSVSTVDLQMGDER

SEQ ID NO: 10434 - protein, 31 aa, Artificial Sequence
  Description of Artificial Sequence: Synthetic polypeptide
DEAEIRTTNPVATEQYGSVVSTNNQREGNVR

SEQ ID NO: 10435 - protein, 30 aa, Artificial Sequence
  Description of Artificial Sequence: Synthetic polypeptide
DAEEIRSTNPVATEQYGSVSTNLQNRNGGR

SEQ ID NO: 10436 - protein, 30 aa, Artificial Sequence
  Description of Artificial Sequence: Synthetic polypeptide
DAEEIRSTNPVATEQYGSVSTNLQQRNGDR

SEQ ID NO: 10437 - protein, 30 aa, Artificial Sequence
  Description of Artificial Sequence: Synthetic polypeptide
DEEEIRTTNPVATEQYGSVSTVLPQRGEQN

SEQ ID NO: 10438 - protein, 29 aa, Artificial Sequence
  Description of Artificial Sequence: Synthetic peptide
DAEEIRTTNPCATEQYGSVSTNLQHGNDH

SEQ ID NO: 10439 - protein, 31 aa, Artificial Sequence
  Description of Artificial Sequence: Synthetic polypeptide
DEEEIRTTNPVATEQYGSVSTVLQARGEQRD

SEQ ID NO: 10440 - protein, 29 aa, Artificial Sequence
  Description of Artificial Sequence: Synthetic peptide
DAEEIRTTNPVATEQWGSVQSTLLQRGTR

SEQ ID NO: 10441 - protein, 29 aa, Artificial Sequence
  Description of Artificial Sequence: Synthetic peptide
DAEEIRTTNPVATEQWGSVTSTQLQRGTR

SEQ ID NO: 10442 - protein, 28 aa, Artificial Sequence
  Description of Artificial Sequence: Synthetic peptide
DEEEIATTNPVATEQYGSVSTNSQGADR

SEQ ID NO: 10443 - protein, 29 aa, Artificial Sequence
  Description of Artificial Sequence: Synthetic peptide
DEEEIATTNPVATEQYGSVSTNQQDGERM

SEQ ID NO: 10444 - protein, 31 aa, Artificial Sequence
  Description of Artificial Sequence: Synthetic polypeptide
DEEEIATTNPVATEQYGSVSTNQLQQREGNL

SEQ ID NO: 10445 - protein, 31 aa, Artificial Sequence
  Description of Artificial Sequence: Synthetic polypeptide
DEEEIATTNPVATEQYGSVSTNQLQERMGNT

SEQ ID NO: 10446 - protein, 30 aa, Artificial Sequence
  Description of Artificial Sequence: Synthetic polypeptide
DEEEIATTNPVATEQYGSVSTNPQQPGDNR

SEQ ID NO: 10447 - protein, 30 aa, Artificial Sequence
  Description of Artificial Sequence: Synthetic polypeptide
DEEEIATTNPVATEQYGSVSTNPQPEGDNR

SEQ ID NO: 10448 - protein, 30 aa, Artificial Sequence
  Description of Artificial Sequence: Synthetic polypeptide
DAEEIRSTNPVATEQYGSVSTNLQFREGQR

SEQ ID NO: 10449 - protein, 30 aa, Artificial Sequence
  Description of Artificial Sequence: Synthetic polypeptide
DEEEIRTTNPVATEQYGSVSTVLQGGGNES

SEQ ID NO: 10450 - protein, 31 aa, Artificial Sequence
  Description of Artificial Sequence: Synthetic polypeptide
DEEEIATTNPVATEQYGSVSTNNLQERPGNL

SEQ ID NO: 10451 - protein, 30 aa, Artificial Sequence
  Description of Artificial Sequence: Synthetic polypeptide
DEEEIATTNPVATEQYGSVSTNMLQPGGNS

SEQ ID NO: 10452 - protein, 30 aa, Artificial Sequence
  Description of Artificial Sequence: Synthetic polypeptide
DEEEIRTTNPVATEQYGSVSTVLQIVGNPP

SEQ ID NO: 10453 - protein, 30 aa, Artificial Sequence
  Description of Artificial Sequence: Synthetic polypeptide
DEEEIATTNPVATEQYGSVSTNMDQHGNVR

SEQ ID NO: 10454 - protein, 29 aa, Artificial Sequence
  Description of Artificial Sequence: Synthetic peptide
DEEEIATTNPVATEQYGSVSTNLTAGERN

SEQ ID NO: 10455 - protein, 30 aa, Artificial Sequence
  Description of Artificial Sequence: Synthetic polypeptide
DEEEIRTTNPVATEQYGSVSTVLQLLGINT

SEQ ID NO: 10456 - protein, 30 aa, Artificial Sequence
  Description of Artificial Sequence: Synthetic polypeptide
DEEEIRTTNPVATEQYGSVSTVLQMANGNG

SEQ ID NO: 10457 - protein, 29 aa, Artificial Sequence
  Description of Artificial Sequence: Synthetic peptide
DAGEIRTTNPVATEQYGSVSTNALQDGMR

SEQ ID NO: 10458 - protein, 29 aa, Artificial Sequence
  Description of Artificial Sequence: Synthetic peptide
DEEEIRTTNPVATEQYGSVSTVLQMEMQR

SEQ ID NO: 10459 - protein, 29 aa, Artificial Sequence
  Description of Artificial Sequence: Synthetic peptide
DAGEIRTTNPVATEQYGSVSTNDLQHGGR

SEQ ID NO: 10460 - protein, 29 aa, Artificial Sequence
  Description of Artificial Sequence: Synthetic peptide
DAGEIRTTNPVATEQYGSVSTNGLQMGMR

SEQ ID NO: 10461 - protein, 29 aa, Artificial Sequence
  Description of Artificial Sequence: Synthetic peptide
DAGEIRTTNPVATEQYGSVSTNKLQGGAR

SEQ ID NO: 10462 - protein, 29 aa, Artificial Sequence
  Description of Artificial Sequence: Synthetic peptide
DAGEIRTTNPVATEQYGSVSTNKLQSGPR

SEQ ID NO: 10463 - protein, 30 aa, Artificial Sequence
  Description of Artificial Sequence: Synthetic polypeptide
DEEEIATTNPVATEQYGSVSTNNQRNGNDG

SEQ ID NO: 10464 - protein, 30 aa, Artificial Sequence
  Description of Artificial Sequence: Synthetic polypeptide
DAEEIRSTNPVATEQYGSVSTNLQDRGGQR

SEQ ID NO: 10465 - protein, 30 aa, Artificial Sequence
  Description of Artificial Sequence: Synthetic polypeptide
DEEEIATTNPVATEQYGSVSTPLQRFGGNF

SEQ ID NO: 10466 - protein, 30 aa, Artificial Sequence
  Description of Artificial Sequence: Synthetic polypeptide
DEEEIRTTNPVATEQYGSVCSTNIQRPNQT

SEQ ID NO: 10467 - protein, 31 aa, Artificial Sequence
  Description of Artificial Sequence: Synthetic polypeptide
DEEEIRTTNPVATEQYGSVSCTNLQSGGNLY

SEQ ID NO: 10468 - protein, 32 aa, Artificial Sequence
  Description of Artificial Sequence: Synthetic polypeptide
DEEEIRTTNPVATEQYGSVSCTNLQRQGVNDE

SEQ ID NO: 10469 - protein, 30 aa, Artificial Sequence
  Description of Artificial Sequence: Synthetic polypeptide
DEAEIRTTNPVATEQYGSVVSTNLQVGNSE

SEQ ID NO: 10470 - protein, 30 aa, Artificial Sequence
  Description of Artificial Sequence: Synthetic polypeptide
DEAEIRTTNPVATEQYGSVVSTNLQGGNNA

SEQ ID NO: 10471 - protein, 30 aa, Artificial Sequence
  Description of Artificial Sequence: Synthetic polypeptide
DEAEIRTTNPVATEQYGSVVSTNLQGGNHP

SEQ ID NO: 10472 - protein, 30 aa, Artificial Sequence
  Description of Artificial Sequence: Synthetic polypeptide
DEEEIATTNPVATEQYGSVSTYNLQSQGNS

SEQ ID NO: 10473 - protein, 30 aa, Artificial Sequence
  Description of Artificial Sequence: Synthetic polypeptide
DEEEIATTNPVATEQYGSVSTVNGQNGNSR

SEQ ID NO: 10474 - protein, 29 aa, Artificial Sequence
  Description of Artificial Sequence: Synthetic peptide
DEEEIATTNPVATEQYGSVSTVLEHGNDR

SEQ ID NO: 10475 - protein, 29 aa, Artificial Sequence
  Description of Artificial Sequence: Synthetic peptide
DEEEIRTTNPVATEQYGSVSTVDPDQGNR

SEQ ID NO: 10476 - protein, 30 aa, Artificial Sequence
  Description of Artificial Sequence: Synthetic polypeptide
DEEEIRTTNPVATEQYGSVSTVEDQRGGND

SEQ ID NO: 10477 - protein, 30 aa, Artificial Sequence
  Description of Artificial Sequence: Synthetic polypeptide
DEEEIRTTNPVATEQYGSVCSTNHQNNNDR

SEQ ID NO: 10478 - protein, 30 aa, Artificial Sequence
  Description of Artificial Sequence: Synthetic polypeptide
DEEEIATTNPVATEQYGSVSTTNSNQDGNR

SEQ ID NO: 10479 - protein, 30 aa, Artificial Sequence
  Description of Artificial Sequence: Synthetic polypeptide
DEEEIATTNPVATEQYGSVSTTLQDRGNQM

SEQ ID NO: 10480 - protein, 31 aa, Artificial Sequence
  Description of Artificial Sequence: Synthetic polypeptide
DEEEIATTNPVATEQYGSVSTTGNLQVGNRQ

SEQ ID NO: 10481 - protein, 30 aa, Artificial Sequence
  Description of Artificial Sequence: Synthetic polypeptide
DEEEIRTTNPVATEQYGSVSTVLEGNGNSR

SEQ ID NO: 10482 - protein, 30 aa, Artificial Sequence
  Description of Artificial Sequence: Synthetic polypeptide
DEEEIRTTNPVATEQYGSVSCTNLQDNENE

SEQ ID NO: 10483 - protein, 31 aa, Artificial Sequence
  Description of Artificial Sequence: Synthetic polypeptide
DEEEIRTTNPVATEQYGSVSCTNLFNGSNRF

SEQ ID NO: 10484 - protein, 30 aa, Artificial Sequence
  Description of Artificial Sequence: Synthetic polypeptide
DEEEIRTTNPVATEQYGSVCSTNIQRANDG

SEQ ID NO: 10485 - protein, 28 aa, Artificial Sequence
  Description of Artificial Sequence: Synthetic peptide
DAEEIRATNPVATEQYGSTSTNMQRGNN

SEQ ID NO: 10486 - protein, 31 aa, Artificial Sequence
  Description of Artificial Sequence: Synthetic polypeptide
DEEEIRTTNPVATEQYGSVSTVLHQNGQNRN

SEQ ID NO: 10487 - protein, 30 aa, Artificial Sequence
  Description of Artificial Sequence: Synthetic polypeptide
DAEEIRATNPVATEQYGSVSTNLQIGDNDR

SEQ ID NO: 10488 - protein, 29 aa, Artificial Sequence
  Description of Artificial Sequence: Synthetic peptide
DAEEIRATNPVATEQYGSVSTNLQNGNSD

SEQ ID NO: 10489 - protein, 30 aa, Artificial Sequence
  Description of Artificial Sequence: Synthetic polypeptide
DEEEIATTNPVATEQYGSVSTQNLQQHGER

SEQ ID NO: 10490 - protein, 29 aa, Artificial Sequence
  Description of Artificial Sequence: Synthetic peptide
DAEEIRCTNPVATEQYGSTVSTNLQAGTR

SEQ ID NO: 10491 - protein, 30 aa, Artificial Sequence
  Description of Artificial Sequence: Synthetic polypeptide
DAEEIRCTNPVATEQYGSVSTNLQARDGQR

SEQ ID NO: 10492 - protein, 30 aa, Artificial Sequence
  Description of Artificial Sequence: Synthetic polypeptide
DAEEIRGTNPVATEQYGSVSTNLQARNGLR

SEQ ID NO: 10493 - protein, 29 aa, Artificial Sequence
  Description of Artificial Sequence: Synthetic peptide
DAEEIRPTNPVATEQYGSCVSTNLQNGTR

SEQ ID NO: 10494 - protein, 30 aa, Artificial Sequence
  Description of Artificial Sequence: Synthetic polypeptide
DEEEIATTNPVATEQYGSVSTPNLQNEGDR

SEQ ID NO: 10495 - protein, 30 aa, Artificial Sequence
  Description of Artificial Sequence: Synthetic polypeptide
DEEEIATTNPVATEQYGSVSTPNLQEGNQH

SEQ ID NO: 10496 - protein, 32 aa, Artificial Sequence
  Description of Artificial Sequence: Synthetic polypeptide
DEEEIRTTNPVATEQYGSVSCTTNLSDRGNNR

SEQ ID NO: 10497 - protein, 29 aa, Artificial Sequence
  Description of Artificial Sequence: Synthetic peptide
DAGEIRTTNPVATEQYGSVSTPNLQHGMR

SEQ ID NO: 10498 - protein, 29 aa, Artificial Sequence
  Description of Artificial Sequence: Synthetic peptide
DEEEIRTTNPVATEQYGSVSTTQQIGVNA

SEQ ID NO: 10499 - protein, 31 aa, Artificial Sequence
  Description of Artificial Sequence: Synthetic polypeptide
DEEEIRTTNPVATEQYGSVSCTWLYQREQNR

SEQ ID NO: 10500 - protein, 31 aa, Artificial Sequence
  Description of Artificial Sequence: Synthetic polypeptide
DEEEIRTTNPVATEQYGSVSTTNLQQGLMIR

SEQ ID NO: 10501 - protein, 28 aa, Artificial Sequence
  Description of Artificial Sequence: Synthetic peptide
DEMEIRTTNPVATMQYGCVSTNLERGNL

SEQ ID NO: 10502 - protein, 31 aa, Artificial Sequence
  Description of Artificial Sequence: Synthetic polypeptide
DEEEIRTTNPVATEQYGSVSTTNLQQGQNGF

SEQ ID NO: 10503 - protein, 31 aa, Artificial Sequence
  Description of Artificial Sequence: Synthetic polypeptide
DEEEIRTTNPVATEQYGSVSTTNLQQGQNGG

SEQ ID NO: 10504 - protein, 30 aa, Artificial Sequence
  Description of Artificial Sequence: Synthetic polypeptide
DEAEIRTTNPVATESYGSVSTNLNQREGNS

SEQ ID NO: 10505 - protein, 31 aa, Artificial Sequence
  Description of Artificial Sequence: Synthetic polypeptide
DEEEIRTTNPVATEQYGSVSTTNLQQVFGGR

SEQ ID NO: 10506 - protein, 30 aa, Artificial Sequence
  Description of Artificial Sequence: Synthetic polypeptide
DEEEIRTTNPVATEQYGSVSDSNLQEPGNL

SEQ ID NO: 10507 - protein, 32 aa, Artificial Sequence
  Description of Artificial Sequence: Synthetic polypeptide
DEEEIRTTNPVATEQYGSVSTTNLQREGPNVS

SEQ ID NO: 10508 - protein, 31 aa, Artificial Sequence
  Description of Artificial Sequence: Synthetic polypeptide
DEEEIRTTNPVATEQYGSVCSTGNLQNGENQ

SEQ ID NO: 10509 - protein, 30 aa, Artificial Sequence
  Description of Artificial Sequence: Synthetic polypeptide
DEEEIRTTNPVATEQYGSVCSTGNLQYGEL

SEQ ID NO: 10510 - protein, 31 aa, Artificial Sequence
  Description of Artificial Sequence: Synthetic polypeptide
DEEEIRTTNPVATEQYGSVCSTGNLQYGSND

SEQ ID NO: 10511 - protein, 31 aa, Artificial Sequence
  Description of Artificial Sequence: Synthetic polypeptide
DEEEIRTTNPVATEQYGSVSTTNLQSDGMNG

SEQ ID NO: 10512 - protein, 30 aa, Artificial Sequence
  Description of Artificial Sequence: Synthetic polypeptide
DEAEIRTTNPVATEQYGVVVSTNLQHGNER

SEQ ID NO: 10513 - protein, 30 aa, Artificial Sequence
  Description of Artificial Sequence: Synthetic polypeptide
DEEEIRTTNPVATEQYGSVSTTNLQQGELV

SEQ ID NO: 10514 - protein, 31 aa, Artificial Sequence
  Description of Artificial Sequence: Synthetic polypeptide
DEEEIRTTNPVATEQYGSVCSTILQRSGEER

SEQ ID NO: 10515 - protein, 28 aa, Artificial Sequence
  Description of Artificial Sequence: Synthetic peptide
DEMEIRTTNPVATEQYGSVSTVLNREMR

SEQ ID NO: 10516 - protein, 28 aa, Artificial Sequence
  Description of Artificial Sequence: Synthetic peptide
DEAEIRTTNPVATEQYGVVSTWLQRDND

SEQ ID NO: 10517 - protein, 30 aa, Artificial Sequence
  Description of Artificial Sequence: Synthetic polypeptide
DEEEIRTTNPVATEQYGSVSDSNDLQRVNY

SEQ ID NO: 10518 - protein, 31 aa, Artificial Sequence
  Description of Artificial Sequence: Synthetic polypeptide
DEEEIRTTNPVATEQYGSVCSTINLQNGSNQ

SEQ ID NO: 10519 - protein, 29 aa, Artificial Sequence
  Description of Artificial Sequence: Synthetic peptide
DEAEIRTTNPVATEQYGVVSTNNQNGSNR

SEQ ID NO: 10520 - protein, 29 aa, Artificial Sequence
  Description of Artificial Sequence: Synthetic peptide
DEAEIRTTNPVATEQYGVVSTNLQHDGNS

SEQ ID NO: 10521 - protein, 28 aa, Artificial Sequence
  Description of Artificial Sequence: Synthetic peptide
DEMEIRTTNPVATEQYGSVSTPLNRDDR

SEQ ID NO: 10522 - protein, 28 aa, Artificial Sequence
  Description of Artificial Sequence: Synthetic peptide
DEAEIRTTNPVATEQYGVVSTNLQGGMQ

SEQ ID NO: 10523 - protein, 28 aa, Artificial Sequence
  Description of Artificial Sequence: Synthetic peptide
DEMEIRTTNPVATEQYGSVSTPLFRDIR

SEQ ID NO: 10524 - protein, 29 aa, Artificial Sequence
  Description of Artificial Sequence: Synthetic peptide
DEMEIRTTNPVATEQYGSVSTNQQRTENN

SEQ ID NO: 10525 - protein, 29 aa, Artificial Sequence
  Description of Artificial Sequence: Synthetic peptide
DEMEIRTTNPVATEQYGSVSTNPVMRGND

SEQ ID NO: 10526 - protein, 29 aa, Artificial Sequence
  Description of Artificial Sequence: Synthetic peptide
DEMEIRTTNPVATEQYGSVSTNPVERGND

SEQ ID NO: 10527 - protein, 31 aa, Artificial Sequence
  Description of Artificial Sequence: Synthetic polypeptide
DEMEIRTTNPVATEQYGSVSTNPLQHDGDNR

SEQ ID NO: 10528 - protein, 30 aa, Artificial Sequence
  Description of Artificial Sequence: Synthetic polypeptide
DEEEIRTTNPVATEQYGSVSTTNLQTGETE

SEQ ID NO: 10529 - protein, 29 aa, Artificial Sequence
  Description of Artificial Sequence: Synthetic peptide
DEMEIRTTNPVATEQYGSVSTNNQRTERD

SEQ ID NO: 10530 - protein, 29 aa, Artificial Sequence
  Description of Artificial Sequence: Synthetic peptide
DEEEIRTTNPVATEQYGSVSDTADQRGQG

SEQ ID NO: 10531 - protein, 29 aa, Artificial Sequence
  Description of Artificial Sequence: Synthetic peptide
CNEEIRTTNPVATEQYGQVSTNLQDGPNR

SEQ ID NO: 10532 - protein, 28 aa, Artificial Sequence
  Description of Artificial Sequence: Synthetic peptide
DEAEIRTTNPVATHQYGSVNTQLQRGND

SEQ ID NO: 10533 - protein, 28 aa, Artificial Sequence
  Description of Artificial Sequence: Synthetic peptide
DENAIRTTNPVATEQYGSFSTNLIQGNR

SEQ ID NO: 10534 - protein, 31 aa, Artificial Sequence
  Description of Artificial Sequence: Synthetic polypeptide
DEEEIRTTNPVATEQYGSVSTTNLQLDGNQQ

SEQ ID NO: 10535 - protein, 31 aa, Artificial Sequence
  Description of Artificial Sequence: Synthetic polypeptide
DEEEIRTTNPVATEQYGSVSTTNLQLGMNGS

SEQ ID NO: 10536 - protein, 29 aa, Artificial Sequence
  Description of Artificial Sequence: Synthetic peptide
DEAEIRTTNPVATEYYGSVSTPNLQDGNW

SEQ ID NO: 10537 - protein, 28 aa, Artificial Sequence
  Description of Artificial Sequence: Synthetic peptide
DEMEIYTTNPVATEQYGSVSTNLMNGNT

SEQ ID NO: 10538 - protein, 29 aa, Artificial Sequence
  Description of Artificial Sequence: Synthetic peptide
CESEIRTTNPVATEQYGSVMTNLYVRGNR

SEQ ID NO: 10539 - protein, 30 aa, Artificial Sequence
  Description of Artificial Sequence: Synthetic polypeptide
DEAEIRTTNPVATEYYGSVFTNLSQRGGNR

SEQ ID NO: 10540 - protein, 32 aa, Artificial Sequence
  Description of Artificial Sequence: Synthetic polypeptide
DEEEIRTTNPVATEQYGSVCSTENQSQRGNNR

SEQ ID NO: 10541 - protein, 31 aa, Artificial Sequence
  Description of Artificial Sequence: Synthetic polypeptide
DEEEIRTTNPVATEQYGSVSTTNLQLGNEEN

SEQ ID NO: 10542 - protein, 32 aa, Artificial Sequence
  Description of Artificial Sequence: Synthetic polypeptide
DEEEIRTTNPVATEQYGSVCSTEPLQRLGNRS

SEQ ID NO: 10543 - protein, 29 aa, Artificial Sequence
  Description of Artificial Sequence: Synthetic peptide
DEAEIRTTNPVATEWYGSVSTNLQNSGNA

SEQ ID NO: 10544 - protein, 30 aa, Artificial Sequence
  Description of Artificial Sequence: Synthetic polypeptide
DEAEIRTTNPVATEWYGSVSTNLQADGNRD

SEQ ID NO: 10545 - protein, 32 aa, Artificial Sequence
  Description of Artificial Sequence: Synthetic polypeptide
DEEEIRTTNPVATEQYGSVSTTNLQQETVGNR

SEQ ID NO: 10546 - protein, 31 aa, Artificial Sequence
  Description of Artificial Sequence: Synthetic polypeptide
DEEEIRTTNPVATEQYGSVSTTNLQMGNVGG

SEQ ID NO: 10547 - protein, 31 aa, Artificial Sequence
  Description of Artificial Sequence: Synthetic polypeptide
DEEEIRTTNPVATEQYGSVSTTNLQNIGINQ

SEQ ID NO: 10548 - protein, 29 aa, Artificial Sequence
  Description of Artificial Sequence: Synthetic peptide
DEMEISTTNPVATEQYGSVATNLQDGNRN

SEQ ID NO: 10549 - protein, 30 aa, Artificial Sequence
  Description of Artificial Sequence: Synthetic polypeptide
DEAEIRTTNPVATEVYGSVSTNLQRGDTRQ

SEQ ID NO: 10550 - protein, 28 aa, Artificial Sequence
  Description of Artificial Sequence: Synthetic peptide
DEAEIRTTNPVATEVYGSVSTNDLRGNE

SEQ ID NO: 10551 - protein, 28 aa, Artificial Sequence
  Description of Artificial Sequence: Synthetic peptide
DEMEIRTTNPVATYQYGCVSTNLERGNA

SEQ ID NO: 10552 - protein, 29 aa, Artificial Sequence
  Description of Artificial Sequence: Synthetic peptide
DEEEIRTTNPVATEQYGSVCSTGLQDLDR

SEQ ID NO: 10553 - protein, 32 aa, Artificial Sequence
  Description of Artificial Sequence: Synthetic polypeptide
DEEEIRTTNPVATEQYGSVCSTGLQRGLNSRV

SEQ ID NO: 10554 - protein, 29 aa, Artificial Sequence
  Description of Artificial Sequence: Synthetic peptide
DEMEIRTTNPVATQQYGEVSTNLQERGNP

SEQ ID NO: 10555 - protein, 29 aa, Artificial Sequence
  Description of Artificial Sequence: Synthetic peptide
DEAEIRTTNPVATETYGSVSTNMQRGDRS

SEQ ID NO: 10556 - protein, 29 aa, Artificial Sequence
  Description of Artificial Sequence: Synthetic peptide
CETEIRTTNPVATEQYGSVSWNWLQRGER

SEQ ID NO: 10557 - protein, 29 aa, Artificial Sequence
  Description of Artificial Sequence: Synthetic peptide
DEAEIRTTNPVATETYGSVSTNLQMDGNG

SEQ ID NO: 10558 - protein, 28 aa, Artificial Sequence
  Description of Artificial Sequence: Synthetic peptide
DEMEIRTTNPVATQQYGCVSTNLARGND

SEQ ID NO: 10559 - protein, 29 aa, Artificial Sequence
  Description of Artificial Sequence: Synthetic peptide
CNEEIRTTNPVATEQYGDVSTNLQDGPNR

SEQ ID NO: 10560 - protein, 31 aa, Artificial Sequence
  Description of Artificial Sequence: Synthetic polypeptide
DEEEIRTTNPVATEQYGSVSTTNLQNIGFNG

SEQ ID NO: 10561 - protein, 28 aa, Artificial Sequence
  Description of Artificial Sequence: Synthetic peptide
DEMEIRTTNPVATEQYGSVSTNNQGGEA

SEQ ID NO: 10562 - protein, 30 aa, Artificial Sequence
  Description of Artificial Sequence: Synthetic polypeptide
DEMEIRTTNPVATEQYGSVSTNLQNLDNRG

SEQ ID NO: 10563 - protein, 31 aa, Artificial Sequence
  Description of Artificial Sequence: Synthetic polypeptide
DEMEIRTTNPVATEQYGSVSTNLLQRIGGNQ

SEQ ID NO: 10564 - protein, 30 aa, Artificial Sequence
  Description of Artificial Sequence: Synthetic polypeptide
DEEEIRTTNPVATEQYGSVSTTNMLQRELD

SEQ ID NO: 10565 - protein, 29 aa, Artificial Sequence
  Description of Artificial Sequence: Synthetic peptide
DEEEIATTNPVATESYGSVSTNLQVTGNM

SEQ ID NO: 10566 - protein, 30 aa, Artificial Sequence
  Description of Artificial Sequence: Synthetic polypeptide
DEMEIRTTNPVATEQYGSVGTNLQRGSNAN

SEQ ID NO: 10567 - protein, 30 aa, Artificial Sequence
  Description of Artificial Sequence: Synthetic polypeptide
DEMEIRTTNPVATEQYGSVCSTPLQRGNQM

SEQ ID NO: 10568 - protein, 29 aa, Artificial Sequence
  Description of Artificial Sequence: Synthetic peptide
DEEEIATTNPVATESYGSVSTNLQHNGNA

SEQ ID NO: 10569 - protein, 29 aa, Artificial Sequence
  Description of Artificial Sequence: Synthetic peptide
DEMEIRTTNPVATEQYGSVCSENLQRGGE

SEQ ID NO: 10570 - protein, 29 aa, Artificial Sequence
  Description of Artificial Sequence: Synthetic peptide
DEEEIATTNPVATESYGSVSTNLQFPGNS

SEQ ID NO: 10571 - protein, 29 aa, Artificial Sequence
  Description of Artificial Sequence: Synthetic peptide
DAAEIRTTNPVATEQYGSVSTNILQLGMR

SEQ ID NO: 10572 - protein, 30 aa, Artificial Sequence
  Description of Artificial Sequence: Synthetic polypeptide
DEEEIATTNPVATESYGSVSTNLQEGNERM

SEQ ID NO: 10573 - protein, 30 aa, Artificial Sequence
  Description of Artificial Sequence: Synthetic polypeptide
DEEEIRTTNPVATEQYGSVSDNLHRGDEDR

SEQ ID NO: 10574 - protein, 30 aa, Artificial Sequence
  Description of Artificial Sequence: Synthetic polypeptide
DEEEIRTTNPVATEQYGSVSTTNSGQQGNQ

SEQ ID NO: 10575 - protein, 30 aa, Artificial Sequence
  Description of Artificial Sequence: Synthetic polypeptide
DEEEIRTTNPVATEQYGSVSTTNSGQRGVF

SEQ ID NO: 10576 - protein, 29 aa, Artificial Sequence
  Description of Artificial Sequence: Synthetic peptide
DEEEIRTTNPVATEQYGSVSDGTLQRTNQ

SEQ ID NO: 10577 - protein, 31 aa, Artificial Sequence
  Description of Artificial Sequence: Synthetic polypeptide
DEEEIRTTNPVATEQYGSVCSTNDEQADGNR

SEQ ID NO: 10578 - protein, 29 aa, Artificial Sequence
  Description of Artificial Sequence: Synthetic peptide
DEAEIRTTNPVATEQYGSWSTNTQREGLR

SEQ ID NO: 10579 - protein, 30 aa, Artificial Sequence
  Description of Artificial Sequence: Synthetic polypeptide
DEEEIRTTNPVATEQYGSVSTTNVQAGNLA

SEQ ID NO: 10580 - protein, 31 aa, Artificial Sequence
  Description of Artificial Sequence: Synthetic polypeptide
DEEEIRTTNPVATEQYGSVSTTNWLERGNIP

SEQ ID NO: 10581 - protein, 29 aa, Artificial Sequence
  Description of Artificial Sequence: Synthetic peptide
DEAEIRTTNPVATEQYGSVYTNHQRDGDR

SEQ ID NO: 10582 - protein, 30 aa, Artificial Sequence
  Description of Artificial Sequence: Synthetic polypeptide
DEMEIRTTNPVATEQYGNVSTNLQSDGNSR

SEQ ID NO: 10583 - protein, 28 aa, Artificial Sequence
  Description of Artificial Sequence: Synthetic peptide
DEMEIRTTNPVATEQYGDTSTNLQRGDS

SEQ ID NO: 10584 - protein, 31 aa, Artificial Sequence
  Description of Artificial Sequence: Synthetic polypeptide
DEEEIRTTNPVATEQYGSVCSTNDIQHGGNR

SEQ ID NO: 10585 - protein, 28 aa, Artificial Sequence
  Description of Artificial Sequence: Synthetic peptide
DEEEIRTTNPVATEQYGSVSDCGQPGNW

SEQ ID NO: 10586 - protein, 31 aa, Artificial Sequence
  Description of Artificial Sequence: Synthetic polypeptide
DEEEIRTTNPVATEQYGSVSTTPNDQDGDNR

SEQ ID NO: 10587 - protein, 31 aa, Artificial Sequence
  Description of Artificial Sequence: Synthetic polypeptide
DEEEIRTTNPVATEQYGSVCSTNDLNRNGNV

SEQ ID NO: 10588 - protein, 31 aa, Artificial Sequence
  Description of Artificial Sequence: Synthetic polypeptide
DEEEIRTTNPVATEQYGSVSDANLQERGSIR

SEQ ID NO: 10589 - protein, 29 aa, Artificial Sequence
  Description of Artificial Sequence: Synthetic peptide
DEEEIATTNPVATEQYGVVSTNLQGGMNS

SEQ ID NO: 10590 - protein, 29 aa, Artificial Sequence
  Description of Artificial Sequence: Synthetic peptide
DEEEIATTNPVATEQYGVVSTNLQDGNAT

SEQ ID NO: 10591 - protein, 29 aa, Artificial Sequence
  Description of Artificial Sequence: Synthetic peptide
DEEEIATTNPVATEQYGVVSTNGQHGNER

SEQ ID NO: 10592 - protein, 29 aa, Artificial Sequence
  Description of Artificial Sequence: Synthetic peptide
DEEEIRTTNPVATEQYGSVSDENDQRNER

SEQ ID NO: 10593 - protein, 31 aa, Artificial Sequence
  Description of Artificial Sequence: Synthetic polypeptide
DEMEIRTTNPVATEQYGSVSDTNLEQRFGNQ

SEQ ID NO: 10594 - protein, 32 aa, Artificial Sequence
  Description of Artificial Sequence: Synthetic polypeptide
DEEEIRTTNPVATEQYGSVCSTNALQRIDNRP

SEQ ID NO: 10595 - protein, 31 aa, Artificial Sequence
  Description of Artificial Sequence: Synthetic polypeptide
DEEEIRTTNPVATEQYGSVCSTNAIQTTGNR

SEQ ID NO: 10596 - protein, 31 aa, Artificial Sequence
  Description of Artificial Sequence: Synthetic polypeptide
DEMEIRTTNPVATEQYGSVSTNLLQRFGSNA

SEQ ID NO: 10597 - protein, 30 aa, Artificial Sequence
  Description of Artificial Sequence: Synthetic polypeptide
DEMEIRTTNPVATEQYGSVSTNLERGSNVS

SEQ ID NO: 10598 - protein, 28 aa, Artificial Sequence
  Description of Artificial Sequence: Synthetic peptide
DEMEIRTTNPVATEQYGSVSTNLEQGEQ

SEQ ID NO: 10599 - protein, 31 aa, Artificial Sequence
  Description of Artificial Sequence: Synthetic polypeptide
DEEEIRTTNPVATEQYGSVSTTNLQTGNEMI

SEQ ID NO: 10600 - protein, 31 aa, Artificial Sequence
  Description of Artificial Sequence: Synthetic polypeptide
DEMEIRTTNPVATEQYGSVSTNEQRDGNNRG

SEQ ID NO: 10601 - protein, 29 aa, Artificial Sequence
  Description of Artificial Sequence: Synthetic peptide
DEMEIRTTNPVATEQYGSVSTNEQEGNDF

SEQ ID NO: 10602 - protein, 30 aa, Artificial Sequence
  Description of Artificial Sequence: Synthetic polypeptide
DEMEIRTTNPVATEQYGSVSTNDQFGSNRV

SEQ ID NO: 10603 - protein, 28 aa, Artificial Sequence
  Description of Artificial Sequence: Synthetic peptide
DEMEIRTTNPVATEQYGSVSTNDQEGEQ

SEQ ID NO: 10604 - protein, 30 aa, Artificial Sequence
  Description of Artificial Sequence: Synthetic polypeptide
DEMEIRTTNPVATEQYGSVSTNDEQGGNRN

SEQ ID NO: 10605 - protein, 30 aa, Artificial Sequence
  Description of Artificial Sequence: Synthetic polypeptide
DEEEIATTNPVATEWYGSVSTNLQQGNMRM

SEQ ID NO: 10606 - protein, 29 aa, Artificial Sequence
  Description of Artificial Sequence: Synthetic peptide
DEEEIATTNPVATEWYGSVSTNLQHDGGR

SEQ ID NO: 10607 - protein, 28 aa, Artificial Sequence
  Description of Artificial Sequence: Synthetic peptide
DEMEIRTTNPVATEQYGSVSTMLERMDR

SEQ ID NO: 10608 - protein, 30 aa, Artificial Sequence
  Description of Artificial Sequence: Synthetic polypeptide
DEEEIATTNPVATEVYGSVSTNLQVGDNNR

SEQ ID NO: 10609 - protein, 31 aa, Artificial Sequence
  Description of Artificial Sequence: Synthetic polypeptide
DEEEIRTTNPVATEQYGSVSTTNLQTPGENV

SEQ ID NO: 10610 - protein, 31 aa, Artificial Sequence
  Description of Artificial Sequence: Synthetic polypeptide
DEEEIRTTNPVATEQYGSVSTTNLQTRGEFD

SEQ ID NO: 10611 - protein, 32 aa, Artificial Sequence
  Description of Artificial Sequence: Synthetic polypeptide
DEMEIRTTNPVATEQYGSVSTGNDLQRGSNRE

SEQ ID NO: 10612 - protein, 29 aa, Artificial Sequence
  Description of Artificial Sequence: Synthetic peptide
DEMEIRTTNPVATEQYGSVSTELTREGDR

SEQ ID NO: 10613 - protein, 29 aa, Artificial Sequence
  Description of Artificial Sequence: Synthetic peptide
DEEEIATTNPVATEVYGSVSTNLQNPGNQ

SEQ ID NO: 10614 - protein, 30 aa, Artificial Sequence
  Description of Artificial Sequence: Synthetic polypeptide
DEEEIRTTNPVATEQYGSVSTTNLQVGFIG

SEQ ID NO: 10615 - protein, 29 aa, Artificial Sequence
  Description of Artificial Sequence: Synthetic peptide
DEEEIRTTNPVATEQYGSVSDNNLQNFND

SEQ ID NO: 10616 - protein, 31 aa, Artificial Sequence
  Description of Artificial Sequence: Synthetic polypeptide
DEEEIRTTNPVATEQYGSVSTTNLSQGEGNT

SEQ ID NO: 10617 - protein, 31 aa, Artificial Sequence
  Description of Artificial Sequence: Synthetic polypeptide
DEEEIRTTNPVATEQYGSVSTTNLSQGGGNT

SEQ ID NO: 10618 - protein, 32 aa, Artificial Sequence
  Description of Artificial Sequence: Synthetic polypeptide
DEEEIRTTNPVATEQYGSVSTTNLSQHTGNRG

SEQ ID NO: 10619 - protein, 29 aa, Artificial Sequence
  Description of Artificial Sequence: Synthetic peptide
DEEEIATTNPVATETYGSVSTNLQSGGNH

SEQ ID NO: 10620 - protein, 30 aa, Artificial Sequence
  Description of Artificial Sequence: Synthetic polypeptide
DEMEIRTTNPVATEQYGSVSNTNLQGGSDR

SEQ ID NO: 10621 - protein, 30 aa, Artificial Sequence
  Description of Artificial Sequence: Synthetic polypeptide
DEAEIRTTNPVATEQYGTVSTNLQPDGNQR

SEQ ID NO: 10622 - protein, 32 aa, Artificial Sequence
  Description of Artificial Sequence: Synthetic polypeptide
DEEEIRTTNPVATEQYGSVCSTMPLQRFGNRS

SEQ ID NO: 10623 - protein, 30 aa, Artificial Sequence
  Description of Artificial Sequence: Synthetic polypeptide
DEAEIRTTNPVATEQYGTVSTNLQKDGNMR

SEQ ID NO: 10624 - protein, 31 aa, Artificial Sequence
  Description of Artificial Sequence: Synthetic polypeptide
DEEEIRTTNPVATEQYGSVCSTNADQKCGNR

SEQ ID NO: 10625 - protein, 30 aa, Artificial Sequence
  Description of Artificial Sequence: Synthetic polypeptide
DEEEIRTTNPVATEQYGSVSCTWLQRIGDD

SEQ ID NO: 10626 - protein, 31 aa, Artificial Sequence
  Description of Artificial Sequence: Synthetic polypeptide
DEEEIRTTNPVATEQYGSVSTTNLQGVNNRQ

SEQ ID NO: 10627 - protein, 30 aa, Artificial Sequence
  Description of Artificial Sequence: Synthetic polypeptide
DEEEIATTNPVATEQYGSVSTNLQYGSNAL

SEQ ID NO: 10628 - protein, 30 aa, Artificial Sequence
  Description of Artificial Sequence: Synthetic polypeptide
DEEEIATTNPVATEQYGSVSTNLQYGGNAA

SEQ ID NO: 10629 - protein, 29 aa, Artificial Sequence
  Description of Artificial Sequence: Synthetic peptide
DEHEIRTTNPVATEQYGSVSQNLLRPMNR

SEQ ID NO: 10630 - protein, 29 aa, Artificial Sequence
  Description of Artificial Sequence: Synthetic peptide
DEHEIRTTNPVATEQYGSVSQNLGREMNR

SEQ ID NO: 10631 - protein, 30 aa, Artificial Sequence
  Description of Artificial Sequence: Synthetic polypeptide
DEHEIRTTNPVATEQYGSVSQNLFRVGNRP

SEQ ID NO: 10632 - protein, 30 aa, Artificial Sequence
  Description of Artificial Sequence: Synthetic polypeptide
DEEEIRTTNPVATEQYGSVSCTNGEQRGIG

SEQ ID NO: 10633 - protein, 30 aa, Artificial Sequence
  Description of Artificial Sequence: Synthetic polypeptide
DEAEIRTTNPVATEQYGSVSTSNTQQGENR

SEQ ID NO: 10634 - protein, 30 aa, Artificial Sequence
  Description of Artificial Sequence: Synthetic polypeptide
DEAEIRTTNPVATEQYGSVSTSLQHQGENR

SEQ ID NO: 10635 - protein, 29 aa, Artificial Sequence
  Description of Artificial Sequence: Synthetic peptide
DEAEIRTTNPVATEQYGSVSTSLNSGENR

SEQ ID NO: 10636 - protein, 29 aa, Artificial Sequence
  Description of Artificial Sequence: Synthetic peptide
DEHEIRTTNPVATEQYGSVSQNLARNNNR

SEQ ID NO: 10637 - protein, 30 aa, Artificial Sequence
  Description of Artificial Sequence: Synthetic polypeptide
DEAEIRTTNPVATEQYGSVSTQNDQGGDNR

SEQ ID NO: 10638 - protein, 30 aa, Artificial Sequence
  Description of Artificial Sequence: Synthetic polypeptide
DEEEIATTNPVATEQYGSVSTNLNGAMGNR

SEQ ID NO: 10639 - protein, 31 aa, Artificial Sequence
  Description of Artificial Sequence: Synthetic polypeptide
DEHEIRTTNPVATEQYGSVSMTGLQRGENER

SEQ ID NO: 10640 - protein, 28 aa, Artificial Sequence
  Description of Artificial Sequence: Synthetic peptide
DEHEIRTTNPVATEQYGSVSKDDQHGNR

SEQ ID NO: 10641 - protein, 29 aa, Artificial Sequence
  Description of Artificial Sequence: Synthetic peptide
DEHEIRTTNPVATEQYGSVSINLERNMNR

SEQ ID NO: 10642 - protein, 29 aa, Artificial Sequence
  Description of Artificial Sequence: Synthetic peptide
DEHEIRTTNPVATEQYGSVSQNLYRNDNR

SEQ ID NO: 10643 - protein, 29 aa, Artificial Sequence
  Description of Artificial Sequence: Synthetic peptide
DEHEIRTTNPVATEQYGSVSINDQRGSNP

SEQ ID NO: 10644 - protein, 29 aa, Artificial Sequence
  Description of Artificial Sequence: Synthetic peptide
DEHEIRTTNPVATEQYGSVSGNIGQDGNR

SEQ ID NO: 10645 - protein, 30 aa, Artificial Sequence
  Description of Artificial Sequence: Synthetic polypeptide
DEHEIRTTNPVATEQYGSVSFTNLQEGNFS

SEQ ID NO: 10646 - protein, 31 aa, Artificial Sequence
  Description of Artificial Sequence: Synthetic polypeptide
DEHEIRTTNPVATEQYGSVSDTNLQDGDNRA

SEQ ID NO: 10647 - protein, 29 aa, Artificial Sequence
  Description of Artificial Sequence: Synthetic peptide
DEHEIRTTNPVATEQYGSVSDNEQRGSND

SEQ ID NO: 10648 - protein, 31 aa, Artificial Sequence
  Description of Artificial Sequence: Synthetic polypeptide
DEAEIRTTNPVATEQYGSVSTPNQLQDGGNR

SEQ ID NO: 10649 - protein, 32 aa, Artificial Sequence
  Description of Artificial Sequence: Synthetic polypeptide
DEEEIRTTNPVATEQYGSVSCTNELANRGNNR

SEQ ID NO: 10650 - protein, 30 aa, Artificial Sequence
  Description of Artificial Sequence: Synthetic polypeptide
DEEEIATTNPVATEQYGSVSTNLGMGDENR

SEQ ID NO: 10651 - protein, 29 aa, Artificial Sequence
  Description of Artificial Sequence: Synthetic peptide
DEHEIRTTNPVATEQYGSVSCNDQRGMND

SEQ ID NO: 10652 - protein, 30 aa, Artificial Sequence
  Description of Artificial Sequence: Synthetic polypeptide
DEHEIRTTNPVATEQYGSVSANLQPGGNER

SEQ ID NO: 10653 - protein, 30 aa, Artificial Sequence
  Description of Artificial Sequence: Synthetic polypeptide
DEEEIATTNPVATEQYGSVSTNLGGLMGNR

SEQ ID NO: 10654 - protein, 29 aa, Artificial Sequence
  Description of Artificial Sequence: Synthetic peptide
DEHEIRTTNPVATEQYGSVGTNDQRQGNS

SEQ ID NO: 10655 - protein, 29 aa, Artificial Sequence
  Description of Artificial Sequence: Synthetic peptide
DEEEIATTNPVATEQYGSVSTNLESGMDR

SEQ ID NO: 10656 - protein, 31 aa, Artificial Sequence
  Description of Artificial Sequence: Synthetic polypeptide
DEEEIATTNPVATEQYGSVSTNLEQEQGNDR

SEQ ID NO: 10657 - protein, 31 aa, Artificial Sequence
  Description of Artificial Sequence: Synthetic polypeptide
DEHEIRTTNPVATEQYGSVSHTWNDLQDGNR

SEQ ID NO: 10658 - protein, 31 aa, Artificial Sequence
  Description of Artificial Sequence: Synthetic polypeptide
DEEEIATTNPVATEQYGSVSTNLEQEMGHNR

SEQ ID NO: 10659 - protein, 30 aa, Artificial Sequence
  Description of Artificial Sequence: Synthetic polypeptide
DEAEIRTTNPVATEQYGSVSTTNEQKEGNR

SEQ ID NO: 10660 - protein, 31 aa, Artificial Sequence
  Description of Artificial Sequence: Synthetic polypeptide
DEHEIRTTNPVATEQYGSVSSTNLQDAGNAR

SEQ ID NO: 10661 - protein, 30 aa, Artificial Sequence
  Description of Artificial Sequence: Synthetic polypeptide
DEAEIRTTNPVATEQYGSVSTVNLQAGNIA

SEQ ID NO: 10662 - protein, 29 aa, Artificial Sequence
  Description of Artificial Sequence: Synthetic peptide
DEHEIRTTNPVATEQYGSVSTNLNGGNAQ

SEQ ID NO: 10663 - protein, 30 aa, Artificial Sequence
  Description of Artificial Sequence: Synthetic polypeptide
DEEEIATTNPVATEQYGSVSTNLQAAGDMR

SEQ ID NO: 10664 - protein, 31 aa, Artificial Sequence
  Description of Artificial Sequence: Synthetic polypeptide
DEEEIRTTNPVATEQYGSVSTVNLQTEGENL

SEQ ID NO: 10665 - protein, 29 aa, Artificial Sequence
  Description of Artificial Sequence: Synthetic peptide
DEHEIRTTNPVATEQYGSVSTNLMGGNNM

SEQ ID NO: 10666 - protein, 31 aa, Artificial Sequence
  Description of Artificial Sequence: Synthetic polypeptide
DEHEIRTTNPVATEQYGSVSTNLGQEGDNNR

SEQ ID NO: 10667 - protein, 30 aa, Artificial Sequence
  Description of Artificial Sequence: Synthetic polypeptide
DEHEIRTTNPVATEQYGSVSTNLGHQDENR

SEQ ID NO: 10668 - protein, 30 aa, Artificial Sequence
  Description of Artificial Sequence: Synthetic polypeptide
DEHEIRTTNPVATEQYGSVSTNLEQNGNSD

SEQ ID NO: 10669 - protein, 30 aa, Artificial Sequence
  Description of Artificial Sequence: Synthetic polypeptide
DEHEIRTTNPVATEQYGSVSTNIQQGGNNR

SEQ ID NO: 10670 - protein, 29 aa, Artificial Sequence
  Description of Artificial Sequence: Synthetic peptide
DEHEIRTTNPVATEQYGSVSTNHQAGNLN

SEQ ID NO: 10671 - protein, 30 aa, Artificial Sequence
  Description of Artificial Sequence: Synthetic polypeptide
DEHEIRTTNPVATEQYGSVSTNGQRPGDHR

SEQ ID NO: 10672 - protein, 30 aa, Artificial Sequence
  Description of Artificial Sequence: Synthetic polypeptide
DEHEIRTTNPVATEQYGSVSTNGQRMGDAR

SEQ ID NO: 10673 - protein, 30 aa, Artificial Sequence
  Description of Artificial Sequence: Synthetic polypeptide
DEHEIRTTNPVATEQYGSVSTNGQRGGDVR

SEQ ID NO: 10674 - protein, 29 aa, Artificial Sequence
  Description of Artificial Sequence: Synthetic peptide
DEHEIRTTNPVATEQYGSVSSNLGRNMNR

SEQ ID NO: 10675 - protein, 30 aa, Artificial Sequence
  Description of Artificial Sequence: Synthetic polypeptide
DEHEIRTTNPVATEQYGSVSTNGQMNGNNR

SEQ ID NO: 10676 - protein, 30 aa, Artificial Sequence
  Description of Artificial Sequence: Synthetic polypeptide
DEEEIATTNPVATEQYGSVSTNLNGQMGND

SEQ ID NO: 10677 - protein, 31 aa, Artificial Sequence
  Description of Artificial Sequence: Synthetic polypeptide
DEEEIRTTNPVATEQYGSVSTVNLQVGENAG

SEQ ID NO: 10678 - protein, 30 aa, Artificial Sequence
  Description of Artificial Sequence: Synthetic polypeptide
DEHEIRTTNPVATEQYGSVSTNAQRDGDNE

SEQ ID NO: 10679 - protein, 29 aa, Artificial Sequence
  Description of Artificial Sequence: Synthetic peptide
DEHEIRTTNPVATEQYGSVSTNAQQGNEP

SEQ ID NO: 10680 - protein, 29 aa, Artificial Sequence
  Description of Artificial Sequence: Synthetic peptide
DEHEIRTTNPVATEQYGSVSTNAQGGNFN

SEQ ID NO: 10681 - protein, 29 aa, Artificial Sequence
  Description of Artificial Sequence: Synthetic peptide
DEHEIRTTNPVATEQYGSVSTNAQAGNEH

SEQ ID NO: 10682 - protein, 30 aa, Artificial Sequence
  Description of Artificial Sequence: Synthetic polypeptide
DEHEIRTTNPVATEQYGSVSTMNTQQGGNR

SEQ ID NO: 10683 - protein, 30 aa, Artificial Sequence
  Description of Artificial Sequence: Synthetic polypeptide
DEHEIRTTNPVATEQYGSVSTHNMQDMGNR

SEQ ID NO: 10684 - protein, 30 aa, Artificial Sequence
  Description of Artificial Sequence: Synthetic polypeptide
DEHEIRTTNPVATEQYGSVSTGLQRGGNNA

SEQ ID NO: 10685 - protein, 30 aa, Artificial Sequence
  Description of Artificial Sequence: Synthetic polypeptide
DEHEIRTTNPVATEQYGSVSTDNAQDGNSR

SEQ ID NO: 10686 - protein, 30 aa, Artificial Sequence
  Description of Artificial Sequence: Synthetic polypeptide
DEAEIRTTNPVATEQYGSVSTTNLQGGNMK

SEQ ID NO: 10687 - protein, 29 aa, Artificial Sequence
  Description of Artificial Sequence: Synthetic peptide
DEEEIATTNPVATEQYGSVSTNLNGNGNT

SEQ ID NO: 10688 - protein, 29 aa, Artificial Sequence
  Description of Artificial Sequence: Synthetic peptide
DEHEIRTTNPVATEQYGSVSSTNLQHGAM

SEQ ID NO: 10689 - protein, 30 aa, Artificial Sequence
  Description of Artificial Sequence: Synthetic polypeptide
DEHEIRTTNPVATEQYGSVSTNEDQNSGNR

SEQ ID NO: 10690 - protein, 31 aa, Artificial Sequence
  Description of Artificial Sequence: Synthetic polypeptide
DEHEIRTTNPVATEQYGSVCSTNLQRDGNGM

SEQ ID NO: 10691 - protein, 31 aa, Artificial Sequence
  Description of Artificial Sequence: Synthetic polypeptide
DEHEIRTTNPVATEQYGSVCSTNELQDGNFR

SEQ ID NO: 10692 - protein, 30 aa, Artificial Sequence
  Description of Artificial Sequence: Synthetic polypeptide
DEHEIRTTNPVATEQYGSVCSTNEGQRGNM

SEQ ID NO: 10693 - protein, 29 aa, Artificial Sequence
  Description of Artificial Sequence: Synthetic peptide
DEAEIRTTNPVATEQYGSVSTNMNQDGNF

SEQ ID NO: 10694 - protein, 30 aa, Artificial Sequence
  Description of Artificial Sequence: Synthetic polypeptide
DEHEIRTTNPVATEQYGMVSTNLQFDGNNR

SEQ ID NO: 10695 - protein, 30 aa, Artificial Sequence
  Description of Artificial Sequence: Synthetic polypeptide
DEHEIRTTNPVATEQYGIVSTNLQRGENGP

SEQ ID NO: 10696 - protein, 29 aa, Artificial Sequence
  Description of Artificial Sequence: Synthetic peptide
DEHEIRTTNPVATEQYGHVSTNLQDGNDS

SEQ ID NO: 10697 - protein, 31 aa, Artificial Sequence
  Description of Artificial Sequence: Synthetic polypeptide
DEHEIRTTNPVATEQYGEVSTNLQRDGNGSR

SEQ ID NO: 10698 - protein, 29 aa, Artificial Sequence
  Description of Artificial Sequence: Synthetic peptide
DEAEIRTTNPVATEQYGSVSTNMDQHGNN

SEQ ID NO: 10699 - protein, 30 aa, Artificial Sequence
  Description of Artificial Sequence: Synthetic polypeptide
DEAEIRTTNPVATEQYGSVSTNLTQDGMNQ

SEQ ID NO: 10700 - protein, 30 aa, Artificial Sequence
  Description of Artificial Sequence: Synthetic polypeptide
DEEEIATTNPVATEQYGSVSTNEQEHEGNR

SEQ ID NO: 10701 - protein, 30 aa, Artificial Sequence
  Description of Artificial Sequence: Synthetic polypeptide
DEHEIRTTNPVATEQYGEVSTNLDREGNAR

SEQ ID NO: 10702 - protein, 30 aa, Artificial Sequence
  Description of Artificial Sequence: Synthetic polypeptide
DEAEIRTTNPVATEQYGSVSTNLSTSAGNR

SEQ ID NO: 10703 - protein, 28 aa, Artificial Sequence
  Description of Artificial Sequence: Synthetic peptide
DEHEIRTTNPVATEQYGETSTNLQRGDI

SEQ ID NO: 10704 - protein, 29 aa, Artificial Sequence
  Description of Artificial Sequence: Synthetic peptide
DEHEIRTTNPVATEQYGDVSTNLQIGNDI

SEQ ID NO: 10705 - protein, 30 aa, Artificial Sequence
  Description of Artificial Sequence: Synthetic polypeptide
DEAEIRTTNPVATEQYGSVSTNLQVGDGNA

SEQ ID NO: 10706 - protein, 29 aa, Artificial Sequence
  Description of Artificial Sequence: Synthetic peptide
DEHEIRTTNPVATEQYGNVATNLQRGGND

SEQ ID NO: 10707 - protein, 29 aa, Artificial Sequence
  Description of Artificial Sequence: Synthetic peptide
DEHEIRTTNPVATEQYGCVSTNLQMGENK

SEQ ID NO: 10708 - protein, 31 aa, Artificial Sequence
  Description of Artificial Sequence: Synthetic polypeptide
DEAEIRTTNPVATEQYGSVSTNLQRGPNLEV

SEQ ID NO: 10709 - protein, 29 aa, Artificial Sequence
  Description of Artificial Sequence: Synthetic peptide
DEHEIRTTNPVATEQYGCVSTNLLQRFDR

SEQ ID NO: 10710 - protein, 31 aa, Artificial Sequence
  Description of Artificial Sequence: Synthetic polypeptide
DEEEIATTNPVATEQYGSVSTNELQERTGND

SEQ ID NO: 10711 - protein, 29 aa, Artificial Sequence
  Description of Artificial Sequence: Synthetic peptide
DEHEIRTTNPVATEQYGAVSTNLQHGNDM

SEQ ID NO: 10712 - protein, 29 aa, Artificial Sequence
  Description of Artificial Sequence: Synthetic peptide
DEHEIRTTNPVATEQYGAVSTNLQHANDR

SEQ ID NO: 10713 - protein, 31 aa, Artificial Sequence
  Description of Artificial Sequence: Synthetic polypeptide
DEAEIRTTNPVATEQYGSVSTNLQRGGSTRL

SEQ ID NO: 10714 - protein, 28 aa, Artificial Sequence
  Description of Artificial Sequence: Synthetic peptide
DEEEIATTNPVATEQYGSVSTMLPDGNT

SEQ ID NO: 10715 - protein, 31 aa, Artificial Sequence
  Description of Artificial Sequence: Synthetic polypeptide
DEAEIRTTNPVATEQYGSVSTNLQRGGDNEK

SEQ ID NO: 10716 - protein, 31 aa, Artificial Sequence
  Description of Artificial Sequence: Synthetic polypeptide
DEAEIRTTNPVATEQYGSVSTNLQRGENAEV

SEQ ID NO: 10717 - protein, 31 aa, Artificial Sequence
  Description of Artificial Sequence: Synthetic polypeptide
DEEEIATTNPVATEQYGSVSTGNPQRDGNRD

SEQ ID NO: 10718 - protein, 31 aa, Artificial Sequence
  Description of Artificial Sequence: Synthetic polypeptide
DEAEIRTTNPVATEQYGSVSTNLQRDGDNNM

SEQ ID NO: 10719 - protein, 30 aa, Artificial Sequence
  Description of Artificial Sequence: Synthetic polypeptide
DEEEIATTNPVATEQYGSVSTGNLQSGDNV

SEQ ID NO: 10720 - protein, 30 aa, Artificial Sequence
  Description of Artificial Sequence: Synthetic polypeptide
DEEEIATTNPVATEQYGSVSTGNLQDGTNV

SEQ ID NO: 10721 - protein, 30 aa, Artificial Sequence
  Description of Artificial Sequence: Synthetic polypeptide
DEHEIRTTNPVATEQYGCVSTNLQGMGNER

SEQ ID NO: 10722 - protein, 30 aa, Artificial Sequence
  Description of Artificial Sequence: Synthetic polypeptide
DEHEIRTTNPVATEQYGNVSTNLQGGGDNR

SEQ ID NO: 10723 - protein, 29 aa, Artificial Sequence
  Description of Artificial Sequence: Synthetic peptide
DEHEIRTTNPVATEQYGQVSTNTQDMGNR

SEQ ID NO: 10724 - protein, 28 aa, Artificial Sequence
  Description of Artificial Sequence: Synthetic peptide
DEEEIATTNPVATEQYGSVSTNGQAGEA

SEQ ID NO: 10725 - protein, 29 aa, Artificial Sequence
  Description of Artificial Sequence: Synthetic peptide
DEEEIRTTNPVATEQYGSVSTVNPQEGFQ

SEQ ID NO: 10726 - protein, 29 aa, Artificial Sequence
  Description of Artificial Sequence: Synthetic peptide
DEEEIATTNPVATEQYGSVSTNLEHGEER

SEQ ID NO: 10727 - protein, 28 aa, Artificial Sequence
  Description of Artificial Sequence: Synthetic peptide
DEHEIRTTNPVATEQYGSVATNWGRGNV

SEQ ID NO: 10728 - protein, 29 aa, Artificial Sequence
  Description of Artificial Sequence: Synthetic peptide
DEAEIRTTNPVATEQYGSVSTPLQRPNMD

SEQ ID NO: 10729 - protein, 30 aa, Artificial Sequence
  Description of Artificial Sequence: Synthetic polypeptide
DEHEIRTTNPVATEQYGSVATNLQREGNSD

SEQ ID NO: 10730 - protein, 29 aa, Artificial Sequence
  Description of Artificial Sequence: Synthetic peptide
DEHEIRTTNPVATEQYGSVATNLQGDGNK

SEQ ID NO: 10731 - protein, 28 aa, Artificial Sequence
  Description of Artificial Sequence: Synthetic peptide
DEHEIRTTNPVATEQYGSVATNHQGNNR

SEQ ID NO: 10732 - protein, 28 aa, Artificial Sequence
  Description of Artificial Sequence: Synthetic peptide
DEHEIRTTNPVATEQYGSTSTNLQHGDM

SEQ ID NO: 10733 - protein, 30 aa, Artificial Sequence
  Description of Artificial Sequence: Synthetic polypeptide
DEEEIATTNPVATEQYGSVSTNLDHEGNHR

SEQ ID NO: 10734 - protein, 29 aa, Artificial Sequence
  Description of Artificial Sequence: Synthetic peptide
DEEEIATTNPVATEQYGSVSTNLDGGNMN

SEQ ID NO: 10735 - protein, 30 aa, Artificial Sequence
  Description of Artificial Sequence: Synthetic polypeptide
DEEEIRTTNPVATEQYGSVSTVNQDRIGSR

SEQ ID NO: 10736 - protein, 30 aa, Artificial Sequence
  Description of Artificial Sequence: Synthetic polypeptide
DEEEIATTNPVATEQYGSVSTNIQHEGDNR

SEQ ID NO: 10737 - protein, 30 aa, Artificial Sequence
  Description of Artificial Sequence: Synthetic polypeptide
DEEEIATTNPVATEQYGSVSTNINQDGDNR

SEQ ID NO: 10738 - protein, 30 aa, Artificial Sequence
  Description of Artificial Sequence: Synthetic polypeptide
DEAEIRTTNPVATEQYGSVSTNSQSGNNDR

SEQ ID NO: 10739 - protein, 30 aa, Artificial Sequence
  Description of Artificial Sequence: Synthetic polypeptide
DEAEIRTTNPVATEQYGSVSTNQQRGNGET

SEQ ID NO: 10740 - protein, 31 aa, Artificial Sequence
  Description of Artificial Sequence: Synthetic polypeptide
DEAEIRTTNPVATEQYGSVSTNQLEQRDGNH

SEQ ID NO: 10741 - protein, 29 aa, Artificial Sequence
  Description of Artificial Sequence: Synthetic peptide
DEEEIRTTNPVATEQYGSVSTVNQMGERD

SEQ ID NO: 10742 - protein, 29 aa, Artificial Sequence
  Description of Artificial Sequence: Synthetic peptide
DEAEIRTTNPVATEQYGSVSTNNQAGNDN

SEQ ID NO: 10743 - protein, 29 aa, Artificial Sequence
  Description of Artificial Sequence: Synthetic peptide
DEHEIRTTNPVATEQYGSISTNPQREGKR

SEQ ID NO: 10744 - protein, 29 aa, Artificial Sequence
  Description of Artificial Sequence: Synthetic peptide
DEHEIRTTNPVATEQYGSISTNNQRTGLR

SEQ ID NO: 10745 - protein, 29 aa, Artificial Sequence
  Description of Artificial Sequence: Synthetic peptide
DEHEIRTTNPVATEQYGSISTNIQRSGLR

SEQ ID NO: 10746 - protein, 29 aa, Artificial Sequence
  Description of Artificial Sequence: Synthetic peptide
DEAEIRTTNPVATEQYGSVSTNNNQSGNH

SEQ ID NO: 10747 - protein, 29 aa, Artificial Sequence
  Description of Artificial Sequence: Synthetic peptide
DEHEIRTTNPVATEQYGSISTNHQRTGDR

SEQ ID NO: 10748 - protein, 29 aa, Artificial Sequence
  Description of Artificial Sequence: Synthetic peptide
DEHEIRTTNPVATEQYGSISTNGQREGDR

SEQ ID NO: 10749 - protein, 30 aa, Artificial Sequence
  Description of Artificial Sequence: Synthetic polypeptide
DEEEIATTNPVATEQYGSVSTNHDQSGNER

SEQ ID NO: 10750 - protein, 28 aa, Artificial Sequence
  Description of Artificial Sequence: Synthetic peptide
DEEEIATTNPVATEQYGSVSTNGQHGAK

SEQ ID NO: 10751 - protein, 29 aa, Artificial Sequence
  Description of Artificial Sequence: Synthetic peptide
DEHEIRTTNPVATEQYGSCSTNTQREGHR

SEQ ID NO: 10752 - protein, 29 aa, Artificial Sequence
  Description of Artificial Sequence: Synthetic peptide
DEHEIRTTNPVATEQYGSCSTNNQREGQR

SEQ ID NO: 10753 - protein, 29 aa, Artificial Sequence
  Description of Artificial Sequence: Synthetic peptide
DEHEIRTTNPVATEQYGSASTNEQREGLR

SEQ ID NO: 10754 - protein, 30 aa, Artificial Sequence
  Description of Artificial Sequence: Synthetic polypeptide
DEHEIRTTNPVATEQYGSVSTNLNQNGNEN

SEQ ID NO: 10755 - protein, 30 aa, Artificial Sequence
  Description of Artificial Sequence: Synthetic polypeptide
DEEEIRTTNPVATEQYGSVSTVLQNEDGNQ

SEQ ID NO: 10756 - protein, 30 aa, Artificial Sequence
  Description of Artificial Sequence: Synthetic polypeptide
DEEEIATTNPVATEQYGSVSTNLQAGGENQ

SEQ ID NO: 10757 - protein, 30 aa, Artificial Sequence
  Description of Artificial Sequence: Synthetic polypeptide
DEHEIRTTNPVATEQYGSVSTNLQANMGDR

SEQ ID NO: 10758 - protein, 32 aa, Artificial Sequence
  Description of Artificial Sequence: Synthetic polypeptide
DEEEIRTTNPVATEQYGSVSCTNGQRGGNLRP

SEQ ID NO: 10759 - protein, 30 aa, Artificial Sequence
  Description of Artificial Sequence: Synthetic polypeptide
DEEEIATTNPVATEQYGSVSTNLQHNGGNV

SEQ ID NO: 10760 - protein, 29 aa, Artificial Sequence
  Description of Artificial Sequence: Synthetic peptide
DEHEIRTTNPVATEQYGSVVSTNTQWGDR

SEQ ID NO: 10761 - protein, 30 aa, Artificial Sequence
  Description of Artificial Sequence: Synthetic polypeptide
DEAEIRTTNPVATEQYGSVSVTNLQMGNDA

SEQ ID NO: 10762 - protein, 29 aa, Artificial Sequence
  Description of Artificial Sequence: Synthetic peptide
DEHEIRTTNPVATEQYGSVVSTMLQDGNT

SEQ ID NO: 10763 - protein, 29 aa, Artificial Sequence
  Description of Artificial Sequence: Synthetic peptide
DEHEIRTTNPVATEQYGSVVSTGLQQGSR

SEQ ID NO: 10764 - protein, 30 aa, Artificial Sequence
  Description of Artificial Sequence: Synthetic polypeptide
DEAEIRTTNPVATEQYGSVSVTNLQLGNMN

SEQ ID NO: 10765 - protein, 31 aa, Artificial Sequence
  Description of Artificial Sequence: Synthetic polypeptide
DEHEIRTTNPVATEQYGSVTSTNLQHGGDNR

SEQ ID NO: 10766 - protein, 29 aa, Artificial Sequence
  Description of Artificial Sequence: Synthetic peptide
DEEEIATTNPVATEQYGSVSTNLQHDNDP

SEQ ID NO: 10767 - protein, 32 aa, Artificial Sequence
  Description of Artificial Sequence: Synthetic polypeptide
DEEEIRTTNPVATEQYGSVSTVNDLQHPGGNR

SEQ ID NO: 10768 - protein, 30 aa, Artificial Sequence
  Description of Artificial Sequence: Synthetic polypeptide
DEEEIATTNPVATEQYGSVSTNLQHDGDER

SEQ ID NO: 10769 - protein, 29 aa, Artificial Sequence
  Description of Artificial Sequence: Synthetic peptide
DEHEIRTTNPVATEQYGSVSWNDQGRGNA

SEQ ID NO: 10770 - protein, 30 aa, Artificial Sequence
  Description of Artificial Sequence: Synthetic polypeptide
DEEEIRTTNPVATEQYGSVSTVNEQDGNGN

SEQ ID NO: 10771 - protein, 30 aa, Artificial Sequence
  Description of Artificial Sequence: Synthetic polypeptide
DEHEIRTTNPVATEQYGSVYSTNTQREGLR

SEQ ID NO: 10772 - protein, 30 aa, Artificial Sequence
  Description of Artificial Sequence: Synthetic polypeptide
DEEEIATTNPVATEQYGSVSTNLQHAGGNH

SEQ ID NO: 10773 - protein, 29 aa, Artificial Sequence
  Description of Artificial Sequence: Synthetic peptide
DEHEIRTTNPVATEQYGSVSTTTQRMGNS

SEQ ID NO: 10774 - protein, 29 aa, Artificial Sequence
  Description of Artificial Sequence: Synthetic peptide
DEHEIRTTNPVATEQYGSVSTTSQRGGNE

SEQ ID NO: 10775 - protein, 30 aa, Artificial Sequence
  Description of Artificial Sequence: Synthetic polypeptide
DEHEIRTTNPVATEQYGSVSTTQQRGNNDR

SEQ ID NO: 10776 - protein, 30 aa, Artificial Sequence
  Description of Artificial Sequence: Synthetic polypeptide
DEEEIRTTNPVATEQYGSVSCTNGMQRGKQ

SEQ ID NO: 10777 - protein, 28 aa, Artificial Sequence
  Description of Artificial Sequence: Synthetic peptide
DCEEIRSTNPVATEQYGSSSTNNQRGNM

SEQ ID NO: 10778 - protein, 31 aa, Artificial Sequence
  Description of Artificial Sequence: Synthetic polypeptide
DEEEIRTTNPVATEQYGSVSTVNLDQLGNTQ

SEQ ID NO: 10779 - protein, 29 aa, Artificial Sequence
  Description of Artificial Sequence: Synthetic peptide
DEEEIATTNPVATEQYGSVSTNLQGQGGI

SEQ ID NO: 10780 - protein, 30 aa, Artificial Sequence
  Description of Artificial Sequence: Synthetic polypeptide
DCEEIRSTNPVATEQYGSVSTNLQARNGDR

SEQ ID NO: 10781 - protein, 30 aa, Artificial Sequence
  Description of Artificial Sequence: Synthetic polypeptide
DCEEIRSTNPVATEQYGSVSTNLQYRNGQR

SEQ ID NO: 10782 - protein, 30 aa, Artificial Sequence
  Description of Artificial Sequence: Synthetic polypeptide
DEHEIRTTNPVATEQYGSVSTTNVQHGNER

SEQ ID NO: 10783 - protein, 31 aa, Artificial Sequence
  Description of Artificial Sequence: Synthetic polypeptide
DEEEIRTTNPVATEQYGSVSTVNLIQGGNTT

SEQ ID NO: 10784 - protein, 30 aa, Artificial Sequence
  Description of Artificial Sequence: Synthetic polypeptide
DEHEIRTTNPVATEQYGSVSTTNLQENGNM

SEQ ID NO: 10785 - protein, 30 aa, Artificial Sequence
  Description of Artificial Sequence: Synthetic polypeptide
DEEEIRTTNPVATEQYGSVSCTNGGQRGTV

SEQ ID NO: 10786 - protein, 30 aa, Artificial Sequence
  Description of Artificial Sequence: Synthetic polypeptide
DEEEIRTTNPVATEQYGSVSCTNGNQRGEN

SEQ ID NO: 10787 - protein, 30 aa, Artificial Sequence
  Description of Artificial Sequence: Synthetic polypeptide
DEEEIRTTNPVATEQYGSVSTVNLNIFGNV

SEQ ID NO: 10788 - protein, 29 aa, Artificial Sequence
  Description of Artificial Sequence: Synthetic peptide
DEHEIRTTNPVATEQYGSYSTNGQREGLR

SEQ ID NO: 10789 - protein, 29 aa, Artificial Sequence
  Description of Artificial Sequence: Synthetic peptide
DEHEIRTTNPVATEQYGTVSTNLQPQGNQ

SEQ ID NO: 10790 - protein, 30 aa, Artificial Sequence
  Description of Artificial Sequence: Synthetic polypeptide
DEEEIATTNPVATEQYGSVSTNLQVDGNDG

SEQ ID NO: 10791 - protein, 30 aa, Artificial Sequence
  Description of Artificial Sequence: Synthetic polypeptide
DEEEIATTNPVATEQYGSVSTNLQSMGDTR

SEQ ID NO: 10792 - protein, 29 aa, Artificial Sequence
  Description of Artificial Sequence: Synthetic peptide
DEEEIATTNPVATEQYGSVSTNLQSGEFD

SEQ ID NO: 10793 - protein, 29 aa, Artificial Sequence
  Description of Artificial Sequence: Synthetic peptide
DEEEIRTTNPVATEQYGSVSTVLQNGEIA

SEQ ID NO: 10794 - protein, 30 aa, Artificial Sequence
  Description of Artificial Sequence: Synthetic polypeptide
DEEEIATTNPVATEQYGSVSTNLQRGGDQS

SEQ ID NO: 10795 - protein, 30 aa, Artificial Sequence
  Description of Artificial Sequence: Synthetic polypeptide
DEEEIATTNPVATEQYGSVSTNLQRGEDKD

SEQ ID NO: 10796 - protein, 30 aa, Artificial Sequence
  Description of Artificial Sequence: Synthetic polypeptide
DEEEIATTNPVATEQYGSVSTNLQREGQVV

SEQ ID NO: 10797 - protein, 28 aa, Artificial Sequence
  Description of Artificial Sequence: Synthetic peptide
DEHEIRTTNPVATTQYGCVSTNLERGNQ

SEQ ID NO: 10798 - protein, 28 aa, Artificial Sequence
  Description of Artificial Sequence: Synthetic peptide
DEHEIRTTNPVATQQYGSVNTPLQRGND

SEQ ID NO: 10799 - protein, 30 aa, Artificial Sequence
  Description of Artificial Sequence: Synthetic polypeptide
DEEEIATTNPVATEQYGSVSTNLQREGGMQ

SEQ ID NO: 10800 - protein, 28 aa, Artificial Sequence
  Description of Artificial Sequence: Synthetic peptide
DEHEIRTTNPVATEWYGSVSTNSQGGNA

SEQ ID NO: 10801 - protein, 29 aa, Artificial Sequence
  Description of Artificial Sequence: Synthetic peptide
DEHEIRTTNPVATEWYGSVSTNHQRGDRE

SEQ ID NO: 10802 - protein, 28 aa, Artificial Sequence
  Description of Artificial Sequence: Synthetic peptide
DEHEIRTTNPVATEWYGSVSTNDQNGNA

SEQ ID NO: 10803 - protein, 30 aa, Artificial Sequence
  Description of Artificial Sequence: Synthetic polypeptide
DEEEIRTTNPVATEQYGSVSTVLSQRGELD

SEQ ID NO: 10804 - protein, 29 aa, Artificial Sequence
  Description of Artificial Sequence: Synthetic peptide
DEHEIRTTNPVATEWYGSVSTNAQEGNSR

SEQ ID NO: 10805 - protein, 30 aa, Artificial Sequence
  Description of Artificial Sequence: Synthetic polypeptide
DEHEIRTTNPVATETYGSVSTNLQRGGERG

SEQ ID NO: 10806 - protein, 30 aa, Artificial Sequence
  Description of Artificial Sequence: Synthetic polypeptide
DEEEIRTTNPVATEQYGSVSCTNHGQRGHF

SEQ ID NO: 10807 - protein, 31 aa, Artificial Sequence
  Description of Artificial Sequence: Synthetic polypeptide
DEEEIATTNPVATEQYGSVSTNLQRDGNDNE

SEQ ID NO: 10808 - protein, 29 aa, Artificial Sequence
  Description of Artificial Sequence: Synthetic peptide
DEHEIRTTNPVATETYGSVSTNGQGGANR

SEQ ID NO: 10809 - protein, 30 aa, Artificial Sequence
  Description of Artificial Sequence: Synthetic polypeptide
DEEEIRTTNPVATEQYGSVSCTNHFQRGKF

SEQ ID NO: 10810 - protein, 30 aa, Artificial Sequence
  Description of Artificial Sequence: Synthetic polypeptide
DEEEIRTTNPVATEQYGSVSTVLQRGTQEI

SEQ ID NO: 10811 - protein, 30 aa, Artificial Sequence
  Description of Artificial Sequence: Synthetic polypeptide
DEHEIRTTNPVATEQYGVVSTPNLQDGGNR

SEQ ID NO: 10812 - protein, 31 aa, Artificial Sequence
  Description of Artificial Sequence: Synthetic polypeptide
DEEEIRTTNPVATEQYGSVSTVLQRVGVAIR

SEQ ID NO: 10813 - protein, 30 aa, Artificial Sequence
  Description of Artificial Sequence: Synthetic polypeptide
DEHEIRTTNPVATEQYGVVSTNLQMDGNQR

SEQ ID NO: 10814 - protein, 31 aa, Artificial Sequence
  Description of Artificial Sequence: Synthetic polypeptide
DEEEIATTNPVATEQYGSVSTNLQPDGNERE

SEQ ID NO: 10815 - protein, 30 aa, Artificial Sequence
  Description of Artificial Sequence: Synthetic polypeptide
DEEEIRTTNPVATEQYGSVSTVLQSSNGNL

SEQ ID NO: 10816 - protein, 29 aa, Artificial Sequence
  Description of Artificial Sequence: Synthetic peptide
DEEEIRTTNPVATEQYGSVSTVLQTGDVA

SEQ ID NO: 10817 - protein, 30 aa, Artificial Sequence
  Description of Artificial Sequence: Synthetic polypeptide
DEEEIRTTNPVATEQYGSVSTVLQYNSGNM

SEQ ID NO: 10818 - protein, 30 aa, Artificial Sequence
  Description of Artificial Sequence: Synthetic polypeptide
DEHEIRTTNPVATEVYGSVSTNLQREGNHE

SEQ ID NO: 10819 - protein, 31 aa, Artificial Sequence
  Description of Artificial Sequence: Synthetic polypeptide
DEEEIATTNPVATEQYGSVSTNLQGMGDNNR

SEQ ID NO: 10820 - protein, 31 aa, Artificial Sequence
  Description of Artificial Sequence: Synthetic polypeptide
DEEEIRTTNPVATEQYGSVSTVNLQDDPGNQ

SEQ ID NO: 10821 - protein, 30 aa, Artificial Sequence
  Description of Artificial Sequence: Synthetic polypeptide
DEEEIATTNPVATEQYGSVSTNLQGESGER

SEQ ID NO: 10822 - protein, 31 aa, Artificial Sequence
  Description of Artificial Sequence: Synthetic polypeptide
DEEEIRTTNPVATEQYGSVSTVNLQPVGNVM

SEQ ID NO: 10823 - protein, 29 aa, Artificial Sequence
  Description of Artificial Sequence: Synthetic peptide
DEEEIATTNPVATEQYGSVSTNLQAGGVN

SEQ ID NO: 10824 - protein, 30 aa, Artificial Sequence
  Description of Artificial Sequence: Synthetic polypeptide
DEHEIRTTNPVATEQYGSVSTNLQNGDVRK

SEQ ID NO: 10825 - protein, 30 aa, Artificial Sequence
  Description of Artificial Sequence: Synthetic polypeptide
DEHEIRTTNPVATEQYGSVSTNLQNGDVRG

SEQ ID NO: 10826 - protein, 31 aa, Artificial Sequence
  Description of Artificial Sequence: Synthetic polypeptide
DEEEIRTTNPVATEQYGSVSTVNLQRFTNLN

SEQ ID NO: 10827 - protein, 30 aa, Artificial Sequence
  Description of Artificial Sequence: Synthetic polypeptide
DEHEIRTTNPVATEQYGSVSTNLQMGDNKD

SEQ ID NO: 10828 - protein, 30 aa, Artificial Sequence
  Description of Artificial Sequence: Synthetic polypeptide
DEHEIRTTNPVATEQYGSVSTNLQLGNNNQ

SEQ ID NO: 10829 - protein, 30 aa, Artificial Sequence
  Description of Artificial Sequence: Synthetic polypeptide
DEHEIRTTNPVATEQYGSVSTNLQKGMGDR

SEQ ID NO: 10830 - protein, 31 aa, Artificial Sequence
  Description of Artificial Sequence: Synthetic polypeptide
DEHEIRTTNPVATEQYGSVSTNLQIMGPNDR

SEQ ID NO: 10831 - protein, 30 aa, Artificial Sequence
  Description of Artificial Sequence: Synthetic polypeptide
DEHEIRTTNPVATEQYGSVSTNLQHNGGDR

SEQ ID NO: 10832 - protein, 29 aa, Artificial Sequence
  Description of Artificial Sequence: Synthetic peptide
DEHEIRTTNPVATEQYGSVSTNLQHGQQN

SEQ ID NO: 10833 - protein, 30 aa, Artificial Sequence
  Description of Artificial Sequence: Synthetic polypeptide
DEHEIRTTNPVATEQYGSVSTNLQHANGER

SEQ ID NO: 10834 - protein, 29 aa, Artificial Sequence
  Description of Artificial Sequence: Synthetic peptide
DEEEIATTNPVATEQYGSVSTNLQAGGTK

SEQ ID NO: 10835 - protein, 30 aa, Artificial Sequence
  Description of Artificial Sequence: Synthetic polypeptide
DEHEIRTTNPVATEQYGSVSTNLQPGGNDG

SEQ ID NO: 10836 - protein, 30 aa, Artificial Sequence
  Description of Artificial Sequence: Synthetic polypeptide
DEEEIRTTNPVATEQYGSVSCTNGGQRGAM

SEQ ID NO: 10837 - protein, 29 aa, Artificial Sequence
  Description of Artificial Sequence: Synthetic peptide
DEHEIRTTNPVATEQYGSVSTNLQGGQME

SEQ ID NO: 10838 - protein, 30 aa, Artificial Sequence
  Description of Artificial Sequence: Synthetic polypeptide
DEHEIRTTNPVATEQYGSVSTNLQGGNNAT

SEQ ID NO: 10839 - protein, 30 aa, Artificial Sequence
  Description of Artificial Sequence: Synthetic polypeptide
DEHEIRTTNPVATEQYGSVSTNLQGEGNSD

SEQ ID NO: 10840 - protein, 31 aa, Artificial Sequence
  Description of Artificial Sequence: Synthetic polypeptide
DEHEIRTTNPVATEQYGSVSTNLQGEGDMNR

SEQ ID NO: 10841 - protein, 31 aa, Artificial Sequence
  Description of Artificial Sequence: Synthetic polypeptide
DEHEIRTTNPVATEQYGSVSTNLQGDGNNSR

SEQ ID NO: 10842 - protein, 31 aa, Artificial Sequence
  Description of Artificial Sequence: Synthetic polypeptide
DEEEIRTTNPVATEQYGSVSTVNLQRGVFVV

SEQ ID NO: 10843 - protein, 30 aa, Artificial Sequence
  Description of Artificial Sequence: Synthetic polypeptide
DEHEIRTTNPVATEQYGSVSTNLQFPGNEK

SEQ ID NO: 10844 - protein, 30 aa, Artificial Sequence
  Description of Artificial Sequence: Synthetic polypeptide
DEHEIRTTNPVATEQYGSVSTNLQESNDRI

SEQ ID NO: 10845 - protein, 30 aa, Artificial Sequence
  Description of Artificial Sequence: Synthetic polypeptide
DEHEIRTTNPVATEQYGSVSTNLQENNMRH

SEQ ID NO: 10846 - protein, 29 aa, Artificial Sequence
  Description of Artificial Sequence: Synthetic peptide
DEHEIRTTNPVATEQYGSVSTNLQEGQMN

SEQ ID NO: 10847 - protein, 30 aa, Artificial Sequence
  Description of Artificial Sequence: Synthetic polypeptide
DEHEIRTTNPVATEQYGSVSTNLQEGNQAQ

SEQ ID NO: 10848 - protein, 31 aa, Artificial Sequence
  Description of Artificial Sequence: Synthetic polypeptide
DEEEIRTTNPVATEQYGSVSTVNLQRMNNQF

SEQ ID NO: 10849 - protein, 30 aa, Artificial Sequence
  Description of Artificial Sequence: Synthetic polypeptide
DEHEIRTTNPVATEQYGSVSTNLQDGDGNV

SEQ ID NO: 10850 - protein, 29 aa, Artificial Sequence
  Description of Artificial Sequence: Synthetic peptide
DEAEIRTTNPVATEQYGSVSTYLQDGNMI

SEQ ID NO: 10851 - protein, 30 aa, Artificial Sequence
  Description of Artificial Sequence: Synthetic polypeptide
DEHEIRTTNPVATEQYGSVSTNLQPGNNAQ

SEQ ID NO: 10852 - protein, 30 aa, Artificial Sequence
  Description of Artificial Sequence: Synthetic polypeptide
DEHEIRTTNPVATEQYGSVSTNLQPGQNEQ

SEQ ID NO: 10853 - protein, 30 aa, Artificial Sequence
  Description of Artificial Sequence: Synthetic polypeptide
DEHEIRTTNPVATEQYGSVSTNLQQGNNMK

SEQ ID NO: 10854 - protein, 31 aa, Artificial Sequence
  Description of Artificial Sequence: Synthetic polypeptide
DEEEIRTTNPVATEQYGSVSTVNLQDEGNEA

SEQ ID NO: 10855 - protein, 30 aa, Artificial Sequence
  Description of Artificial Sequence: Synthetic polypeptide
DEHEIRTTNPVATEQYGSVSTTLQRGGNDP

SEQ ID NO: 10856 - protein, 30 aa, Artificial Sequence
  Description of Artificial Sequence: Synthetic polypeptide
DEEEIRTTNPVATEQYGSVSCTNGGQRGLA

SEQ ID NO: 10857 - protein, 30 aa, Artificial Sequence
  Description of Artificial Sequence: Synthetic polypeptide
DEEEIRTTNPVATEQYGSVSCTNGGQRGID

SEQ ID NO: 10858 - protein, 29 aa, Artificial Sequence
  Description of Artificial Sequence: Synthetic peptide
DCEEIRTTNPVATEQYGSVSTNVDRIGER

SEQ ID NO: 10859 - protein, 31 aa, Artificial Sequence
  Description of Artificial Sequence: Synthetic polypeptide
DEEEIATTNPVATEQYGSVSTNLQERKGENI

SEQ ID NO: 10860 - protein, 30 aa, Artificial Sequence
  Description of Artificial Sequence: Synthetic polypeptide
DEHEIRTTNPVATEQYGSVSTTDQRGMNDR

SEQ ID NO: 10861 - protein, 31 aa, Artificial Sequence
  Description of Artificial Sequence: Synthetic polypeptide
DEEEIRTTNPVATEQYGSVSTVNLQGIGFNQ

SEQ ID NO: 10862 - protein, 31 aa, Artificial Sequence
  Description of Artificial Sequence: Synthetic polypeptide
DEEEIRTTNPVATEQYGSVSTVNLQIGGNGQ

SEQ ID NO: 10863 - protein, 31 aa, Artificial Sequence
  Description of Artificial Sequence: Synthetic polypeptide
DEEEIRTTNPVATEQYGSVSTVNLQIVGNGN

SEQ ID NO: 10864 - protein, 30 aa, Artificial Sequence
  Description of Artificial Sequence: Synthetic polypeptide
DEHEIRTTNPVATEQYGSVSTPNLDGRGNA

SEQ ID NO: 10865 - protein, 29 aa, Artificial Sequence
  Description of Artificial Sequence: Synthetic peptide
DEEEIATTNPVATEQYGSVSTNLQEGGMK

SEQ ID NO: 10866 - protein, 31 aa, Artificial Sequence
  Description of Artificial Sequence: Synthetic polypeptide
DEEEIRTTNPVATEQYGSVSTVNLQLDEGNE

SEQ ID NO: 10867 - protein, 30 aa, Artificial Sequence
  Description of Artificial Sequence: Synthetic polypeptide
DEHEIRTTNPVATEQYGSVSTPLLQRGERD

SEQ ID NO: 10868 - protein, 30 aa, Artificial Sequence
  Description of Artificial Sequence: Synthetic polypeptide
DEHEIRTTNPVATEQYGSVSTNQDQGNGNR

SEQ ID NO: 10869 - protein, 29 aa, Artificial Sequence
  Description of Artificial Sequence: Synthetic peptide
DEAEIRTTNPVATEQYGSVSVNVGQDGNR

SEQ ID NO: 10870 - protein, 31 aa, Artificial Sequence
  Description of Artificial Sequence: Synthetic polypeptide
DEHEIRTTNPVATEQYGSVSTNNNLQRGNEE

SEQ ID NO: 10871 - protein, 29 aa, Artificial Sequence
  Description of Artificial Sequence: Synthetic peptide
DEEEIATTNPVATEQYGSVSTNLQDGGPT

SEQ ID NO: 10872 - protein, 32 aa, Artificial Sequence
  Description of Artificial Sequence: Synthetic polypeptide
DEEEIRTTNPVATEQYGSVSTVNLQNRFGNTT

SEQ ID NO: 10873 - protein, 31 aa, Artificial Sequence
  Description of Artificial Sequence: Synthetic polypeptide
DEEEIATTNPVATEQYGSVSTNLQDGGMNQR

SEQ ID NO: 10874 - protein, 30 aa, Artificial Sequence
  Description of Artificial Sequence: Synthetic polypeptide
DEEEIATTNPVATEQYGSVSTNLQDDGNPE

SEQ ID NO: 10875 - protein, 30 aa, Artificial Sequence
  Description of Artificial Sequence: Synthetic polypeptide
DEHEIRTTNPVATEQYGSVSTNMQNRGDRL

SEQ ID NO: 10876 - protein, 32 aa, Artificial Sequence
  Description of Artificial Sequence: Synthetic polypeptide
DEHEIRTTNPVATEQYGSVSTNLSQTRGGNRM

SEQ ID NO: 10877 - protein, 31 aa, Artificial Sequence
  Description of Artificial Sequence: Synthetic polypeptide
DEEEIRTTNPVATEQYGSVSTVNLQNSGNQQ

SEQ ID NO: 10878 - protein, 30 aa, Artificial Sequence
  Description of Artificial Sequence: Synthetic polypeptide
DEHEIRTTNPVATEQYGSVSTNLQVGSNME

SEQ ID NO: 10879 - protein, 30 aa, Artificial Sequence
  Description of Artificial Sequence: Synthetic polypeptide
DEHEIRTTNPVATEQYGSVSTNLQVGNNEP

SEQ ID NO: 10880 - protein, 30 aa, Artificial Sequence
  Description of Artificial Sequence: Synthetic polypeptide
DEHEIRTTNPVATEQYGSVSTNLQSGGENS

SEQ ID NO: 10881 - protein, 31 aa, Artificial Sequence
  Description of Artificial Sequence: Synthetic polypeptide
DEHEIRTTNPVATEQYGSVSTNLQRGDDNQE

SEQ ID NO: 10882 - protein, 31 aa, Artificial Sequence
  Description of Artificial Sequence: Synthetic polypeptide
DEEEIRTTNPVATEQYGSVSTVNLQNVGNMF

SEQ ID NO: 10883 - protein, 30 aa, Artificial Sequence
  Description of Artificial Sequence: Synthetic polypeptide
DEHEIRTTNPVATEQYGSVSTNLQAGGDNH

SEQ ID NO: 10884 - protein, 31 aa, Artificial Sequence
  Description of Artificial Sequence: Synthetic polypeptide
DEEEIRTTNPVATEQYGSVSTTNLQGSGNTQ

SEQ ID NO: 10885 - protein, 31 aa, Artificial Sequence
  Description of Artificial Sequence: Synthetic polypeptide
DEEEIRTTNPVATEQYGSVCSTENLHHDGNR

SEQ ID NO: 10886 - protein, 31 aa, Artificial Sequence
  Description of Artificial Sequence: Synthetic polypeptide
DEEEIRTTNPVATEQYGSVSTTNLQGGMNQA

SEQ ID NO: 10887 - protein, 31 aa, Artificial Sequence
  Description of Artificial Sequence: Synthetic polypeptide
DEEEIRTTNPVATEQYGSVSTQNLQEMGNQI

SEQ ID NO: 10888 - protein, 30 aa, Artificial Sequence
  Description of Artificial Sequence: Synthetic polypeptide
DEEEIRTTNPVATEQYGSVATNLVQVGNDP

SEQ ID NO: 10889 - protein, 30 aa, Artificial Sequence
  Description of Artificial Sequence: Synthetic polypeptide
DEEEIATTNPVAYEQYGSVSTNLQSTGTNR

SEQ ID NO: 10890 - protein, 30 aa, Artificial Sequence
  Description of Artificial Sequence: Synthetic polypeptide
CEEEIRTTNPVATEQYGKVSTNLQRVGNNY

SEQ ID NO: 10891 - protein, 30 aa, Artificial Sequence
  Description of Artificial Sequence: Synthetic polypeptide
CEEEIRTTNPVATEQYGLVSTNLQRGGNAN

SEQ ID NO: 10892 - protein, 31 aa, Artificial Sequence
  Description of Artificial Sequence: Synthetic polypeptide
DEEEIRTTNPVATEQYGSVSTQNLQFTGNNP

SEQ ID NO: 10893 - protein, 30 aa, Artificial Sequence
  Description of Artificial Sequence: Synthetic polypeptide
DEEEIRTTNPVATEQYGSVSTQNLQFTQNQ

SEQ ID NO: 10894 - protein, 29 aa, Artificial Sequence
  Description of Artificial Sequence: Synthetic peptide
DENEIRTTNPVAVEQYGSVTSTNLERENR

SEQ ID NO: 10895 - protein, 30 aa, Artificial Sequence
  Description of Artificial Sequence: Synthetic polypeptide
DEEEIRTTNPVATEQYGSVSENLNGRGDRN

SEQ ID NO: 10896 - protein, 31 aa, Artificial Sequence
  Description of Artificial Sequence: Synthetic polypeptide
DEEEIRTTNPVATEQYGSVSTQNLQMEGNNS

SEQ ID NO: 10897 - protein, 30 aa, Artificial Sequence
  Description of Artificial Sequence: Synthetic polypeptide
DEEEIRTTNPVATEQYGSVSTQNLQMGGEM

SEQ ID NO: 10898 - protein, 31 aa, Artificial Sequence
  Description of Artificial Sequence: Synthetic polypeptide
DEEEIRTTNPVATEQYGSVSTQNLQNIGNQN

SEQ ID NO: 10899 - protein, 30 aa, Artificial Sequence
  Description of Artificial Sequence: Synthetic polypeptide
DEEEIRTTNPVATEQYGSVSTQNLQQGGGD

SEQ ID NO: 10900 - protein, 31 aa, Artificial Sequence
  Description of Artificial Sequence: Synthetic polypeptide
DEEEIRTTNPVATEQYGSVSTQNLQDGNFNA

SEQ ID NO: 10901 - protein, 31 aa, Artificial Sequence
  Description of Artificial Sequence: Synthetic polypeptide
DEEEIRTTNPVATEQYGSVSTQNLQRTMNSA

SEQ ID NO: 10902 - protein, 31 aa, Artificial Sequence
  Description of Artificial Sequence: Synthetic polypeptide
DEEEIRTTNPVATEQYGSVSTQNLQTGNEGI

SEQ ID NO: 10903 - protein, 31 aa, Artificial Sequence
  Description of Artificial Sequence: Synthetic polypeptide
DEEEIRTTNPVATEQYGSVSTQNLQTIGNAP

SEQ ID NO: 10904 - protein, 29 aa, Artificial Sequence
  Description of Artificial Sequence: Synthetic peptide
DEEEIRTTNPVATEQYGSVSENLEQRVDL

SEQ ID NO: 10905 - protein, 28 aa, Artificial Sequence
  Description of Artificial Sequence: Synthetic peptide
DENEIRTTNPVATTSYGSVSTNLQRTNN

SEQ ID NO: 10906 - protein, 28 aa, Artificial Sequence
  Description of Artificial Sequence: Synthetic peptide
DENEIRTTNPVATKHYGSVSTNLQRQNM

SEQ ID NO: 10907 - protein, 28 aa, Artificial Sequence
  Description of Artificial Sequence: Synthetic peptide
DENEIRTTNPVATKHYGSVSTNLQRPNM

SEQ ID NO: 10908 - protein, 28 aa, Artificial Sequence
  Description of Artificial Sequence: Synthetic peptide
DENEIRTTNPVATEWYGSVSNNLQRGTD

SEQ ID NO: 10909 - protein, 30 aa, Artificial Sequence
  Description of Artificial Sequence: Synthetic polypeptide
DEEEIRTTNPVATEQYGSVSENLDRINERY

SEQ ID NO: 10910 - protein, 29 aa, Artificial Sequence
  Description of Artificial Sequence: Synthetic peptide
DENEIRTTNPVATETYGSVSTNLQEGGNG

SEQ ID NO: 10911 - protein, 28 aa, Artificial Sequence
  Description of Artificial Sequence: Synthetic peptide
DENEIRTTNPVATETYGSVSNNLQRGTT

SEQ ID NO: 10912 - protein, 30 aa, Artificial Sequence
  Description of Artificial Sequence: Synthetic polypeptide
DEEEIRTTNPVATEQYGSVATNMLTRGNNS

SEQ ID NO: 10913 - protein, 30 aa, Artificial Sequence
  Description of Artificial Sequence: Synthetic polypeptide
DEEEIRTTNPVATEQYGSVSTQNNQTGNTQ

SEQ ID NO: 10914 - protein, 28 aa, Artificial Sequence
  Description of Artificial Sequence: Synthetic peptide
DENEIRTTNPVATERYGSVSNNLQRGTH

SEQ ID NO: 10915 - protein, 30 aa, Artificial Sequence
  Description of Artificial Sequence: Synthetic polypeptide
DEEEIRTTNPVATEQYGSVATNMLTHGNER

SEQ ID NO: 10916 - protein, 32 aa, Artificial Sequence
  Description of Artificial Sequence: Synthetic polypeptide
DEEEIRTTNPVATEQYGSVSTQNPLQEWGNPR

SEQ ID NO: 10917 - protein, 29 aa, Artificial Sequence
  Description of Artificial Sequence: Synthetic peptide
DEEEIRTTNPVATEQYGSVSENLNQAGVE

SEQ ID NO: 10918 - protein, 29 aa, Artificial Sequence
  Description of Artificial Sequence: Synthetic peptide
DEEEIRTTNPVATEQYGSVATNLTRGDEW

SEQ ID NO: 10919 - protein, 31 aa, Artificial Sequence
  Description of Artificial Sequence: Synthetic polypeptide
DEEEIRTTNPVATEQYGSVSTQNLEQNMGNV

SEQ ID NO: 10920 - protein, 30 aa, Artificial Sequence
  Description of Artificial Sequence: Synthetic polypeptide
DEEEIRTTNPVATEQYGSVATNLQRNGEDH

SEQ ID NO: 10921 - protein, 31 aa, Artificial Sequence
  Description of Artificial Sequence: Synthetic polypeptide
DEEEIRTTNPVATEQYGSVSTQNLEYNGNIR

SEQ ID NO: 10922 - protein, 30 aa, Artificial Sequence
  Description of Artificial Sequence: Synthetic polypeptide
DEEEIRTTNPVATEQYGSVATNLQRNPENI

SEQ ID NO: 10923 - protein, 30 aa, Artificial Sequence
  Description of Artificial Sequence: Synthetic polypeptide
DEEEIRTTNPVATEQYGSVATNLQRNPENP

SEQ ID NO: 10924 - protein, 29 aa, Artificial Sequence
  Description of Artificial Sequence: Synthetic peptide
DEEEIRTTNPVATEQYGSVSENLNQQGTE

SEQ ID NO: 10925 - protein, 30 aa, Artificial Sequence
  Description of Artificial Sequence: Synthetic polypeptide
DEEEIRTTNPVATEQYGSVATNLQRNPPNQ

SEQ ID NO: 10926 - protein, 28 aa, Artificial Sequence
  Description of Artificial Sequence: Synthetic peptide
DENSIRTTNPVATEQYGCVETNFQRGNR

SEQ ID NO: 10927 - protein, 30 aa, Artificial Sequence
  Description of Artificial Sequence: Synthetic polypeptide
DEEEIRTTNPVATEQYGSVATNLQRNSENM

SEQ ID NO: 10928 - protein, 29 aa, Artificial Sequence
  Description of Artificial Sequence: Synthetic peptide
DENEIVTTNPVATEQYGSVATNLQHGNRP

SEQ ID NO: 10929 - protein, 30 aa, Artificial Sequence
  Description of Artificial Sequence: Synthetic polypeptide
DEEEIRTTNPVATEQYGSVATNLQRPGEPN

SEQ ID NO: 10930 - protein, 29 aa, Artificial Sequence
  Description of Artificial Sequence: Synthetic peptide
DEEEIRTTNPVATEQYGSVATNLQRQTGE

SEQ ID NO: 10931 - protein, 28 aa, Artificial Sequence
  Description of Artificial Sequence: Synthetic peptide
DENEIVTTNPVATDQYGMVSTELQRGNR

SEQ ID NO: 10932 - protein, 29 aa, Artificial Sequence
  Description of Artificial Sequence: Synthetic peptide
DENEIRTTNPVAYEQYGSVSTNLQANGNG

SEQ ID NO: 10933 - protein, 30 aa, Artificial Sequence
  Description of Artificial Sequence: Synthetic polypeptide
DEEEIRTTNPVATEQYGSVATNLQRSNPEG

SEQ ID NO: 10934 - protein, 28 aa, Artificial Sequence
  Description of Artificial Sequence: Synthetic peptide
DENEISTTNPVATEQYGSVSTNLDYGNG

SEQ ID NO: 10935 - protein, 29 aa, Artificial Sequence
  Description of Artificial Sequence: Synthetic peptide
DEEEIRTTNPVATEQYGSVATNLQRVVEM

SEQ ID NO: 10936 - protein, 30 aa, Artificial Sequence
  Description of Artificial Sequence: Synthetic polypeptide
DEEEIRTTNPVATEQYGSVATNLQSEGNMV

SEQ ID NO: 10937 - protein, 30 aa, Artificial Sequence
  Description of Artificial Sequence: Synthetic polypeptide
DEEEIRTTNPVATEQYGSVATNLQSEGNPD

SEQ ID NO: 10938 - protein, 30 aa, Artificial Sequence
  Description of Artificial Sequence: Synthetic polypeptide
DEEEIRTTNPVATEQYGSVATNLQTIGTND

SEQ ID NO: 10939 - protein, 31 aa, Artificial Sequence
  Description of Artificial Sequence: Synthetic polypeptide
DEEEIRTTNPVATEQYGSVATNLQTRGNNGV

SEQ ID NO: 10940 - protein, 31 aa, Artificial Sequence
  Description of Artificial Sequence: Synthetic polypeptide
DEEEIRTTNPVATEQYGSVATNLQVGDNPRD

SEQ ID NO: 10941 - protein, 31 aa, Artificial Sequence
  Description of Artificial Sequence: Synthetic polypeptide
DEEEIRTTNPVATEQYGSVATNLQVRDGDNM

SEQ ID NO: 10942 - protein, 31 aa, Artificial Sequence
  Description of Artificial Sequence: Synthetic polypeptide
DEEEIRTTNPVATEQYGSVATNLQVREGDRY

SEQ ID NO: 10943 - protein, 32 aa, Artificial Sequence
  Description of Artificial Sequence: Synthetic polypeptide
DEEEIRTTNPVATEQYGSVATNLSQERTGNRN

SEQ ID NO: 10944 - protein, 31 aa, Artificial Sequence
  Description of Artificial Sequence: Synthetic polypeptide
DEEEIRTTNPVATEQYGSVATNLSQGNGTNR

SEQ ID NO: 10945 - protein, 30 aa, Artificial Sequence
  Description of Artificial Sequence: Synthetic polypeptide
DEEEIRTTNPVATEQYGSVSTQNLPPGGNI

SEQ ID NO: 10946 - protein, 30 aa, Artificial Sequence
  Description of Artificial Sequence: Synthetic polypeptide
CEEEIRTTNPVATEQYGCVSTNLQRNSNRD

SEQ ID NO: 10947 - protein, 29 aa, Artificial Sequence
  Description of Artificial Sequence: Synthetic peptide
DENEISTTNPVATEQYGSVSTNLQTMNRT

SEQ ID NO: 10948 - protein, 28 aa, Artificial Sequence
  Description of Artificial Sequence: Synthetic peptide
DENEIRTTNPVATEQYGVVSTELQREND

SEQ ID NO: 10949 - protein, 29 aa, Artificial Sequence
  Description of Artificial Sequence: Synthetic peptide
DEEEIRTTNPVATEQYGSVATNPQHGNMQ

SEQ ID NO: 10950 - protein, 30 aa, Artificial Sequence
  Description of Artificial Sequence: Synthetic polypeptide
DEEEIRTTNPVATEQYGSVATNPQNMGNRA

SEQ ID NO: 10951 - protein, 30 aa, Artificial Sequence
  Description of Artificial Sequence: Synthetic polypeptide
DEEEIRTTNPVATEQYGSVSTSEDLQMGDR

SEQ ID NO: 10952 - protein, 30 aa, Artificial Sequence
  Description of Artificial Sequence: Synthetic polypeptide
CEEEIRTTNPVATEQYGSVPTELQRGSNRE

SEQ ID NO: 10953 - protein, 30 aa, Artificial Sequence
  Description of Artificial Sequence: Synthetic polypeptide
DEEEIRTTNPVATEQYGSVSTSGNLQEVNI

SEQ ID NO: 10954 - protein, 30 aa, Artificial Sequence
  Description of Artificial Sequence: Synthetic polypeptide
DEEEIRTTNPVATEQYGSVSTSLEQRDDDR

SEQ ID NO: 10955 - protein, 31 aa, Artificial Sequence
  Description of Artificial Sequence: Synthetic polypeptide
CEEEIRTTNPVATEQYGSVSATNLQQGDNNR

SEQ ID NO: 10956 - protein, 31 aa, Artificial Sequence
  Description of Artificial Sequence: Synthetic polypeptide
CEEEIRTTNPVATEQYGSVSCTNLQIGGNRP

SEQ ID NO: 10957 - protein, 30 aa, Artificial Sequence
  Description of Artificial Sequence: Synthetic polypeptide
DEEEIRTTNPVATEQYGSVSTSLQAEGNIP

SEQ ID NO: 10958 - protein, 30 aa, Artificial Sequence
  Description of Artificial Sequence: Synthetic polypeptide
DEEEIRTTNPVATEQYGSVSTSLQDNGNPN

SEQ ID NO: 10959 - protein, 30 aa, Artificial Sequence
  Description of Artificial Sequence: Synthetic polypeptide
DEEEIRTTNPVATEQYGSVSTSLQDPGNPP

SEQ ID NO: 10960 - protein, 30 aa, Artificial Sequence
  Description of Artificial Sequence: Synthetic polypeptide
DEEEIRTTNPVATEQYGSVSTSLQEIGNVT

SEQ ID NO: 10961 - protein, 29 aa, Artificial Sequence
  Description of Artificial Sequence: Synthetic peptide
DEEEIRTTNPVATEQYGSVSTSLQFDNVV

SEQ ID NO: 10962 - protein, 30 aa, Artificial Sequence
  Description of Artificial Sequence: Synthetic polypeptide
CEEEIRTTNPVATEQYGSVSNTNLQGAGNQ

SEQ ID NO: 10963 - protein, 29 aa, Artificial Sequence
  Description of Artificial Sequence: Synthetic peptide
DENEIRTTNPVATEQYGSVSTNSPERGNE

SEQ ID NO: 10964 - protein, 31 aa, Artificial Sequence
  Description of Artificial Sequence: Synthetic polypeptide
CEEEIRTTNPVATEQYGSVPSCTNLQRGNTF

SEQ ID NO: 10965 - protein, 28 aa, Artificial Sequence
  Description of Artificial Sequence: Synthetic peptide
DENEIRTTNPVATEQYGSVSTNPQFGQD

SEQ ID NO: 10966 - protein, 29 aa, Artificial Sequence
  Description of Artificial Sequence: Synthetic peptide
CEEEIRTTNPVATEQYGSVSSELQSGNRI

SEQ ID NO: 10967 - protein, 30 aa, Artificial Sequence
  Description of Artificial Sequence: Synthetic polypeptide
DEEEIRTTNPVATEQYGSVSTSLQGDGNMA

SEQ ID NO: 10968 - protein, 30 aa, Artificial Sequence
  Description of Artificial Sequence: Synthetic polypeptide
CEEEIRTTNPVATEQYGSVSSTENQQVGNR

SEQ ID NO: 10969 - protein, 31 aa, Artificial Sequence
  Description of Artificial Sequence: Synthetic polypeptide
DEEEIRTTNPVATEQYGSVCATNEQRGSNRS

SEQ ID NO: 10970 - protein, 29 aa, Artificial Sequence
  Description of Artificial Sequence: Synthetic peptide
CEEEIRTTNPVATEQYGSVSSTNFQTGNN

SEQ ID NO: 10971 - protein, 30 aa, Artificial Sequence
  Description of Artificial Sequence: Synthetic polypeptide
CEEEIRTTNPVATEQYGSVSSTNNLQFGNG

SEQ ID NO: 10972 - protein, 30 aa, Artificial Sequence
  Description of Artificial Sequence: Synthetic polypeptide
DENEIRTTNPVATEQYGSVSTNLQTGNNVP

SEQ ID NO: 10973 - protein, 31 aa, Artificial Sequence
  Description of Artificial Sequence: Synthetic polypeptide
DENEIRTTNPVATEQYGSVSTNLQSFGSENR

SEQ ID NO: 10974 - protein, 32 aa, Artificial Sequence
  Description of Artificial Sequence: Synthetic polypeptide
CEEEIRTTNPVATEQYGSVSTANLPQRGGNYR

SEQ ID NO: 10975 - protein, 30 aa, Artificial Sequence
  Description of Artificial Sequence: Synthetic polypeptide
DEEEIRTTNPVATEQYGSVSTSLQIEGNED

SEQ ID NO: 10976 - protein, 30 aa, Artificial Sequence
  Description of Artificial Sequence: Synthetic polypeptide
DEEEIRTTNPVATEQYGSVSTSLQLMGINN

SEQ ID NO: 10977 - protein, 30 aa, Artificial Sequence
  Description of Artificial Sequence: Synthetic polypeptide
CEEEIRTTNPVATEQYGSVSTNDHQYGSNR

SEQ ID NO: 10978 - protein, 30 aa, Artificial Sequence
  Description of Artificial Sequence: Synthetic polypeptide
CEEEIRTTNPVATEQYGSVSTNGDQFGNRG

SEQ ID NO: 10979 - protein, 29 aa, Artificial Sequence
  Description of Artificial Sequence: Synthetic peptide
DENEIRTTNPVATEQYGSVSTNNQEGNDM

SEQ ID NO: 10980 - protein, 30 aa, Artificial Sequence
  Description of Artificial Sequence: Synthetic polypeptide
DEEEIRTTNPVATEQYGSVAVDNLQNGNER

SEQ ID NO: 10981 - protein, 30 aa, Artificial Sequence
  Description of Artificial Sequence: Synthetic polypeptide
DEEEIRTTNPVATEQYGSVATVNNDQRDNR

SEQ ID NO: 10982 - protein, 28 aa, Artificial Sequence
  Description of Artificial Sequence: Synthetic peptide
DENEIRTTNPVATEQYGSVSVNLQNGPQ

SEQ ID NO: 10983 - protein, 29 aa, Artificial Sequence
  Description of Artificial Sequence: Synthetic peptide
DENEIRTTNPVATEQYGTVSTNLERSGNA

SEQ ID NO: 10984 - protein, 29 aa, Artificial Sequence
  Description of Artificial Sequence: Synthetic peptide
DENEIRTTNPVATEQYGSVYSTYHQRGDR

SEQ ID NO: 10985 - protein, 31 aa, Artificial Sequence
  Description of Artificial Sequence: Synthetic polypeptide
CEEEIRTTNPVATEQYGQSVSTNLDQRGSNF

SEQ ID NO: 10986 - protein, 30 aa, Artificial Sequence
  Description of Artificial Sequence: Synthetic polypeptide
DEEEIRTTNPVATEQYGSVSTQNVQDGNMQ

SEQ ID NO: 10987 - protein, 30 aa, Artificial Sequence
  Description of Artificial Sequence: Synthetic polypeptide
DEEEIRTTNPVATEQYGSVATNQSPRGNNR

SEQ ID NO: 10988 - protein, 31 aa, Artificial Sequence
  Description of Artificial Sequence: Synthetic polypeptide
CEEEIRTTNPVATEQYGSIVSTNLQRSGNDN

SEQ ID NO: 10989 - protein, 28 aa, Artificial Sequence
  Description of Artificial Sequence: Synthetic peptide
CEEEIRTTNPVATEQYGSLSTDLQRQGR

SEQ ID NO: 10990 - protein, 28 aa, Artificial Sequence
  Description of Artificial Sequence: Synthetic peptide
CEEEIRTTNPVATEQYGSLSTHLQRQER

SEQ ID NO: 10991 - protein, 30 aa, Artificial Sequence
  Description of Artificial Sequence: Synthetic polypeptide
CEEEIRTTNPVATEQYGSTVSTNLSHRGNA

SEQ ID NO: 10992 - protein, 28 aa, Artificial Sequence
  Description of Artificial Sequence: Synthetic peptide
CEEEIRTTNPVATEQYGSVAMNLQDGPR

SEQ ID NO: 10993 - protein, 30 aa, Artificial Sequence
  Description of Artificial Sequence: Synthetic polypeptide
DEEEIRTTNPVATEQYGSVSTQQLGQIGNF

SEQ ID NO: 10994 - protein, 28 aa, Artificial Sequence
  Description of Artificial Sequence: Synthetic peptide
CEEEIRTTNPVATEQYGSVATALQNGTR

SEQ ID NO: 10995 - protein, 28 aa, Artificial Sequence
  Description of Artificial Sequence: Synthetic peptide
CEEEIRTTNPVATEQYGSVATSLQNGFR

SEQ ID NO: 10996 - protein, 30 aa, Artificial Sequence
  Description of Artificial Sequence: Synthetic polypeptide
DEEEIRTTNPVATEQYGSVSENEQDGNDRP

SEQ ID NO: 10997 - protein, 30 aa, Artificial Sequence
  Description of Artificial Sequence: Synthetic polypeptide
DEEEIRTTNPVATEQYGSVATPNFVQRGNI

SEQ ID NO: 10998 - protein, 30 aa, Artificial Sequence
  Description of Artificial Sequence: Synthetic polypeptide
DEEEIRTTNPVATEQYGSVSENEPQRGNNS

SEQ ID NO: 10999 - protein, 30 aa, Artificial Sequence
  Description of Artificial Sequence: Synthetic polypeptide
DEEEIRTTNPVATEQYGSVSTQTQEHGNNR

SEQ ID NO: 11000 - protein, 28 aa, Artificial Sequence
  Description of Artificial Sequence: Synthetic peptide
DEEEIRTTNPVATEQYGSVSENDQRNVD

SEQ ID NO: 11001 - protein, 30 aa, Artificial Sequence
  Description of Artificial Sequence: Synthetic polypeptide
DEEEIRTTNPVATEQYGSVATPNLQHGNST

SEQ ID NO: 11002 - protein, 31 aa, Artificial Sequence
  Description of Artificial Sequence: Synthetic polypeptide
CEEEIRTTNPVATEQYGSVDSTNLQRMSNRP

SEQ ID NO: 11003 - protein, 31 aa, Artificial Sequence
  Description of Artificial Sequence: Synthetic polypeptide
DEEEIRTTNPVATEQYGSVATPNLQPREGVR

SEQ ID NO: 11004 - protein, 30 aa, Artificial Sequence
  Description of Artificial Sequence: Synthetic polypeptide
DEEEIRTTNPVATEQYGSVSTRNLNRSNNV

SEQ ID NO: 11005 - protein, 31 aa, Artificial Sequence
  Description of Artificial Sequence: Synthetic polypeptide
DEEEIATTNPVAYEQYGSVPSTNLQRGGNRI

SEQ ID NO: 11006 - protein, 29 aa, Artificial Sequence
  Description of Artificial Sequence: Synthetic peptide
DENEIRTTNPVATEQYGSVSWNLFRNNNR

SEQ ID NO: 11007 - protein, 30 aa, Artificial Sequence
  Description of Artificial Sequence: Synthetic polypeptide
DEEEIATTNPVAYEQYGSVCTNLQDRGNAR

SEQ ID NO: 11008 - protein, 31 aa, Artificial Sequence
  Description of Artificial Sequence: Synthetic polypeptide
DEEEIRTTNPVATEQYGSVATTNLQESGDNR

SEQ ID NO: 11009 - protein, 30 aa, Artificial Sequence
  Description of Artificial Sequence: Synthetic polypeptide
DEEEIRTTNPVATEQYGSVSTSDLQIGNDD

SEQ ID NO: 11010 - protein, 30 aa, Artificial Sequence
  Description of Artificial Sequence: Synthetic polypeptide
DEEEIRTTNPVATEQYGSVATVNLDRGTNS

SEQ ID NO: 11011 - protein, 31 aa, Artificial Sequence
  Description of Artificial Sequence: Synthetic polypeptide
DEEEIRTTNPVATEQYGSVATVNLPQRSNRD

SEQ ID NO: 11012 - protein, 30 aa, Artificial Sequence
  Description of Artificial Sequence: Synthetic polypeptide
DEEEIRTTNPVATEQYGSVATNLQRGMLTA

SEQ ID NO: 11013 - protein, 30 aa, Artificial Sequence
  Description of Artificial Sequence: Synthetic polypeptide
CEEEIRTTNPVATEQYGSVSTNHQRGNNDP

SEQ ID NO: 11014 - protein, 30 aa, Artificial Sequence
  Description of Artificial Sequence: Synthetic polypeptide
DEEEIRTTNPVATEQYGSVATNLQRGDLES

SEQ ID NO: 11015 - protein, 30 aa, Artificial Sequence
  Description of Artificial Sequence: Synthetic polypeptide
DEEEIRTTNPVATEQYGSVATNLQRGDEGI

SEQ ID NO: 11016 - protein, 29 aa, Artificial Sequence
  Description of Artificial Sequence: Synthetic peptide
DEQEIATTNPVATEHYGSVSTNLQRDGNL

SEQ ID NO: 11017 - protein, 30 aa, Artificial Sequence
  Description of Artificial Sequence: Synthetic polypeptide
DEEEIRTTNPVATEQYGSVSTQLVQDGGNN

SEQ ID NO: 11018 - protein, 28 aa, Artificial Sequence
  Description of Artificial Sequence: Synthetic peptide
DEEEIRTTNPVATEQYGSVATNLERHTL

SEQ ID NO: 11019 - protein, 31 aa, Artificial Sequence
  Description of Artificial Sequence: Synthetic polypeptide
DEEEIRTTNPVATEQYGSVATNLERNGPNRV

SEQ ID NO: 11020 - protein, 32 aa, Artificial Sequence
  Description of Artificial Sequence: Synthetic polypeptide
DEEEIRTTNPVATEQYGSVSTQNALSQRGGNG

SEQ ID NO: 11021 - protein, 30 aa, Artificial Sequence
  Description of Artificial Sequence: Synthetic polypeptide
DEEEIRTTNPVATEQYGSVATNLERPGGNM

SEQ ID NO: 11022 - protein, 31 aa, Artificial Sequence
  Description of Artificial Sequence: Synthetic polypeptide
DEEEIRTTNPVATEQYGSVATNLERPGPNRT

SEQ ID NO: 11023 - protein, 28 aa, Artificial Sequence
  Description of Artificial Sequence: Synthetic peptide
DEEEIRTTNPVATEQYGSVATNLERTIK

SEQ ID NO: 11024 - protein, 29 aa, Artificial Sequence
  Description of Artificial Sequence: Synthetic peptide
CEEEIRTTNPCATEQYGSVSTNPQRGDND

SEQ ID NO: 11025 - protein, 30 aa, Artificial Sequence
  Description of Artificial Sequence: Synthetic polypeptide
DEEEIRTTNPVATEQYGSVATNLETEGENR

SEQ ID NO: 11026 - protein, 29 aa, Artificial Sequence
  Description of Artificial Sequence: Synthetic peptide
DEEEIRTTNPVATEQYGSVATNLGRNLNH

SEQ ID NO: 11027 - protein, 29 aa, Artificial Sequence
  Description of Artificial Sequence: Synthetic peptide
DEEEIRTTNPVATEQYGSVATNLNDGNSD

SEQ ID NO: 11028 - protein, 31 aa, Artificial Sequence
  Description of Artificial Sequence: Synthetic polypeptide
DEEEIRTTNPVATEQYGSVATNLNEREGNRN

SEQ ID NO: 11029 - protein, 28 aa, Artificial Sequence
  Description of Artificial Sequence: Synthetic peptide
CEEEIRCTNPTATEQYGSVSENLMRGNR

SEQ ID NO: 11030 - protein, 29 aa, Artificial Sequence
  Description of Artificial Sequence: Synthetic peptide
DEEEIRTTNPVATEQYGSVATNLNHGNDI

SEQ ID NO: 11031 - protein, 28 aa, Artificial Sequence
  Description of Artificial Sequence: Synthetic peptide
DEQEIACTNPVATEMYGWVSTNLQRGNR

SEQ ID NO: 11032 - protein, 31 aa, Artificial Sequence
  Description of Artificial Sequence: Synthetic polypeptide
DEEEIRTTNPVATEQYGSVSENLQRIGPNDT

SEQ ID NO: 11033 - protein, 29 aa, Artificial Sequence
  Description of Artificial Sequence: Synthetic peptide
DEEEIRTTNPVATEQYGSVSENLQRIEME

SEQ ID NO: 11034 - protein, 28 aa, Artificial Sequence
  Description of Artificial Sequence: Synthetic peptide
DEQEIAATNPVATEIYGVVSTNLQRGNR

SEQ ID NO: 11035 - protein, 28 aa, Artificial Sequence
  Description of Artificial Sequence: Synthetic peptide
DEQAIRTTNPVATEQYGSTSTNLIAGNR

SEQ ID NO: 11036 - protein, 30 aa, Artificial Sequence
  Description of Artificial Sequence: Synthetic polypeptide
DEEEIRTTNPVATEQYGSVATNLQAGGNAI

SEQ ID NO: 11037 - protein, 30 aa, Artificial Sequence
  Description of Artificial Sequence: Synthetic polypeptide
DEEEIRTTNPVATEQYGSVATNLQAGNDNT

SEQ ID NO: 11038 - protein, 28 aa, Artificial Sequence
  Description of Artificial Sequence: Synthetic peptide
CEEEIRTTNPVATEEYGIISINLQRGNR

SEQ ID NO: 11039 - protein, 28 aa, Artificial Sequence
  Description of Artificial Sequence: Synthetic peptide
DEPEIRTTNPVATTHYGSVSTNLQRINQ

SEQ ID NO: 11040 - protein, 28 aa, Artificial Sequence
  Description of Artificial Sequence: Synthetic peptide
DEPEIRTTNPVATEQYGVVSTPLQRAND

SEQ ID NO: 11041 - protein, 29 aa, Artificial Sequence
  Description of Artificial Sequence: Synthetic peptide
DEEEIRTTNPVATEQYGSVATNLQAGPTD

SEQ ID NO: 11042 - protein, 29 aa, Artificial Sequence
  Description of Artificial Sequence: Synthetic peptide
DEPEIRTTNPVATEQYGSVSTTDQRGNQN

SEQ ID NO: 11043 - protein, 31 aa, Artificial Sequence
  Description of Artificial Sequence: Synthetic polypeptide
DEEEIRTTNPVATEQYGSVSENLQPRIGLER

SEQ ID NO: 11044 - protein, 28 aa, Artificial Sequence
  Description of Artificial Sequence: Synthetic peptide
DEEEIRTTNPVATEQYGSVATNLNRVTS

SEQ ID NO: 11045 - protein, 32 aa, Artificial Sequence
  Description of Artificial Sequence: Synthetic polypeptide
DEPEIRTTNPVATEQYGSVSTPNLQQRMGNER

SEQ ID NO: 11046 - protein, 28 aa, Artificial Sequence
  Description of Artificial Sequence: Synthetic peptide
CEEEIRCTNPIATEQYGSVSENLMRGNR

SEQ ID NO: 11047 - protein, 30 aa, Artificial Sequence
  Description of Artificial Sequence: Synthetic polypeptide
DEEEIRTTNPVATEQYGSVSTQLQTNGINE

SEQ ID NO: 11048 - protein, 28 aa, Artificial Sequence
  Description of Artificial Sequence: Synthetic peptide
DEEEIRTTNPVATEQYGSVATNLARMEE

SEQ ID NO: 11049 - protein, 31 aa, Artificial Sequence
  Description of Artificial Sequence: Synthetic polypeptide
DEEEIRTTNPVATEQYGSVATNLDNREGNRN

SEQ ID NO: 11050 - protein, 30 aa, Artificial Sequence
  Description of Artificial Sequence: Synthetic polypeptide
DEEEIRTTNPVATEQYGSVATNLDQGGNQF

SEQ ID NO: 11051 - protein, 31 aa, Artificial Sequence
  Description of Artificial Sequence: Synthetic polypeptide
DEEEIRTTNPVATEQYGSVATNLDQNRGEND

SEQ ID NO: 11052 - protein, 31 aa, Artificial Sequence
  Description of Artificial Sequence: Synthetic polypeptide
DEEEIRTTNPVATEQYGSVATNLDQRPGNDM

SEQ ID NO: 11053 - protein, 30 aa, Artificial Sequence
  Description of Artificial Sequence: Synthetic polypeptide
DEEEIRTTNPVATEQYGSVATNLDRGDNNL

SEQ ID NO: 11054 - protein, 29 aa, Artificial Sequence
  Description of Artificial Sequence: Synthetic peptide
DEEEIRTTNPVATEQYGSVATNLDRPDND

SEQ ID NO: 11055 - protein, 28 aa, Artificial Sequence
  Description of Artificial Sequence: Synthetic peptide
DEEEIATVNPVATEQYGEVSENLQRGNL

SEQ ID NO: 11056 - protein, 30 aa, Artificial Sequence
  Description of Artificial Sequence: Synthetic polypeptide
DEEEIRTTNPVATEQYGSVATNLEDGMNRM

SEQ ID NO: 11057 - protein, 30 aa, Artificial Sequence
  Description of Artificial Sequence: Synthetic polypeptide
DEEEIRTTNPVATEQYGSVSTQLQNIGNLF

SEQ ID NO: 11058 - protein, 30 aa, Artificial Sequence
  Description of Artificial Sequence: Synthetic polypeptide
DEEEIRTTNPVATEQYGSVATNLEEAGMNR

SEQ ID NO: 11059 - protein, 30 aa, Artificial Sequence
  Description of Artificial Sequence: Synthetic polypeptide
DEEEIRTTNPVATEQYGSVATNLEGGPNRI

SEQ ID NO: 11060 - protein, 31 aa, Artificial Sequence
  Description of Artificial Sequence: Synthetic polypeptide
DEEEIRTTNPVATEQYGSVATNLEQRGDNNN

SEQ ID NO: 11061 - protein, 31 aa, Artificial Sequence
  Description of Artificial Sequence: Synthetic polypeptide
DEEEIRTTNPVATEQYGSVSTQLTQQGGDNR

SEQ ID NO: 11062 - protein, 31 aa, Artificial Sequence
  Description of Artificial Sequence: Synthetic polypeptide
DEEEIRTTNPVATEQYGSVSTQLQNQGENQR

SEQ ID NO: 11063 - protein, 30 aa, Artificial Sequence
  Description of Artificial Sequence: Synthetic polypeptide
DEEEIRTTNPVATEQYGSVATNLERAENPR

SEQ ID NO: 11064 - protein, 30 aa, Artificial Sequence
  Description of Artificial Sequence: Synthetic polypeptide
DEEEIRTTNPVATEQYGSVSTQLQPEGMNE

SEQ ID NO: 11065 - protein, 29 aa, Artificial Sequence
  Description of Artificial Sequence: Synthetic peptide
CEEEICTTNPVATEQYGSVSTNLQGGDRD

SEQ ID NO: 11066 - protein, 29 aa, Artificial Sequence
  Description of Artificial Sequence: Synthetic peptide
DEEEIRTTNPVATEQYGSVATNLERAGTP

SEQ ID NO: 11067 - protein, 30 aa, Artificial Sequence
  Description of Artificial Sequence: Synthetic polypeptide
DEEEIRTTNPVATEQYGSVATNLERANGRL

SEQ ID NO: 11068 - protein, 30 aa, Artificial Sequence
  Description of Artificial Sequence: Synthetic polypeptide
DEEEIRTTNPVATEQYGSVATNLERANMRM

SEQ ID NO: 11069 - protein, 28 aa, Artificial Sequence
  Description of Artificial Sequence: Synthetic peptide
DEEEIRTTNPVATEQYGSVATNLERDTE

SEQ ID NO: 11070 - protein, 29 aa, Artificial Sequence
  Description of Artificial Sequence: Synthetic peptide
DEEEIRTTNPVATEQYGSVATNLERGDGG

SEQ ID NO: 11071 - protein, 29 aa, Artificial Sequence
  Description of Artificial Sequence: Synthetic peptide
DEEEIRTTNPVATEQYGSVATNLERGDPQ

SEQ ID NO: 11072 - protein, 30 aa, Artificial Sequence
  Description of Artificial Sequence: Synthetic polypeptide
DEEEIRTTNPVATEQYGSVSTQLQRGIQES

SEQ ID NO: 11073 - protein, 30 aa, Artificial Sequence
  Description of Artificial Sequence: Synthetic polypeptide
DEEEIRTTNPVATEQYGSVATNLERGLGRF

SEQ ID NO: 11074 - protein, 30 aa, Artificial Sequence
  Description of Artificial Sequence: Synthetic polypeptide
DEEEIRTTNPVATEQYGSVSTQLQRTNEQA

SEQ ID NO: 11075 - protein, 30 aa, Artificial Sequence
  Description of Artificial Sequence: Synthetic polypeptide
DEEEIRTTNPVATEQYGSVATNLERGMNSL

SEQ ID NO: 11076 - protein, 30 aa, Artificial Sequence
  Description of Artificial Sequence: Synthetic polypeptide
DEEEIRTTNPVATEQYGSVATNLEQRINDE

SEQ ID NO: 11077 - protein, 29 aa, Artificial Sequence
  Description of Artificial Sequence: Synthetic peptide
DEPEIRTTNPVATEQYGSVSTPLQRGFVV

SEQ ID NO: 11078 - protein, 31 aa, Artificial Sequence
  Description of Artificial Sequence: Synthetic polypeptide
DEEEIRTTNPVATEQYGSVSENLQPIGNERD

SEQ ID NO: 11079 - protein, 30 aa, Artificial Sequence
  Description of Artificial Sequence: Synthetic polypeptide
DEEEIRTTNPVATEQYGSVATNLQARVNVD

SEQ ID NO: 11080 - protein, 30 aa, Artificial Sequence
  Description of Artificial Sequence: Synthetic polypeptide
DEEEIRTTNPVATEQYGSVSTQNGQSGNSQ

SEQ ID NO: 11081 - protein, 29 aa, Artificial Sequence
  Description of Artificial Sequence: Synthetic peptide
DEEEIRTTNPVATEQYGSVATNLQFGTAG

SEQ ID NO: 11082 - protein, 30 aa, Artificial Sequence
  Description of Artificial Sequence: Synthetic polypeptide
DEEEIRTTNPVATEQYGSVATNLQGGEQRN

SEQ ID NO: 11083 - protein, 28 aa, Artificial Sequence
  Description of Artificial Sequence: Synthetic peptide
DEPEIRTTNPVATDQYGSVVTQLQRGND

SEQ ID NO: 11084 - protein, 29 aa, Artificial Sequence
  Description of Artificial Sequence: Synthetic peptide
DEPEIRTTNPVATDQYGSVNTQNLQRGND

SEQ ID NO: 11085 - protein, 30 aa, Artificial Sequence
  Description of Artificial Sequence: Synthetic polypeptide
DEEEIRTTNPVATEQYGSVATNLQGGNLNL

SEQ ID NO: 11086 - protein, 30 aa, Artificial Sequence
  Description of Artificial Sequence: Synthetic polypeptide
DEEEIRTTNPVATEQYGSVSENLQDGNNEM

SEQ ID NO: 11087 - protein, 28 aa, Artificial Sequence
  Description of Artificial Sequence: Synthetic peptide
DEPEIRTTNPVATDQYGEVSTNLERGNL

SEQ ID NO: 11088 - protein, 29 aa, Artificial Sequence
  Description of Artificial Sequence: Synthetic peptide
DEEEIRTTNPVATEQYGSVATNLQHGEIM

SEQ ID NO: 11089 - protein, 28 aa, Artificial Sequence
  Description of Artificial Sequence: Synthetic peptide
DEPEIRTTNPVATDQYGCVSTNLNRGND

SEQ ID NO: 11090 - protein, 29 aa, Artificial Sequence
  Description of Artificial Sequence: Synthetic peptide
DEEEIRTTNPVATEQYGSVSENLQDFQNS

SEQ ID NO: 11091 - protein, 31 aa, Artificial Sequence
  Description of Artificial Sequence: Synthetic polypeptide
DEEEIRTTNPVATEQYGSVATNLQNDGNIRD

SEQ ID NO: 11092 - protein, 29 aa, Artificial Sequence
  Description of Artificial Sequence: Synthetic peptide
DEEEIRTTNPVATEQYGSVATNLQNPQDR

SEQ ID NO: 11093 - protein, 30 aa, Artificial Sequence
  Description of Artificial Sequence: Synthetic polypeptide
DEEEIRTTNPVATEQYGSVSTQNGQDGNEE

SEQ ID NO: 11094 - protein, 29 aa, Artificial Sequence
  Description of Artificial Sequence: Synthetic peptide
DEEEIRTTNPVATEQYGSVATNLQPAPRQ

SEQ ID NO: 11095 - protein, 29 aa, Artificial Sequence
  Description of Artificial Sequence: Synthetic peptide
DEEEIRTTNPVATEQYGSVATNLQPDHRV

SEQ ID NO: 11096 - protein, 30 aa, Artificial Sequence
  Description of Artificial Sequence: Synthetic polypeptide
DEEEIRTTNPVATEQYGSVATNLQPDNNRN

SEQ ID NO: 11097 - protein, 32 aa, Artificial Sequence
  Description of Artificial Sequence: Synthetic polypeptide
DEEEIRTTNPVATEQYGSVATNLQPRDGTNER

SEQ ID NO: 11098 - protein, 30 aa, Artificial Sequence
  Description of Artificial Sequence: Synthetic polypeptide
DEEEIRTTNPVATEQYGSVATNLQQAEGNN

SEQ ID NO: 11099 - protein, 30 aa, Artificial Sequence
  Description of Artificial Sequence: Synthetic polypeptide
DEEEIRTTNPVATEQYGSVATNLQQAGGPR

SEQ ID NO: 11100 - protein, 31 aa, Artificial Sequence
  Description of Artificial Sequence: Synthetic polypeptide
DEEEIRTTNPVATEQYGSVATNLQQGPNPRM

SEQ ID NO: 11101 - protein, 32 aa, Artificial Sequence
  Description of Artificial Sequence: Synthetic polypeptide
DEEEIRTTNPVATEQYGSVATNLQQREGPNDR

SEQ ID NO: 11102 - protein, 30 aa, Artificial Sequence
  Description of Artificial Sequence: Synthetic polypeptide
DEEEIRTTNPVATEQYGSVSENLQAGGNES

SEQ ID NO: 11103 - protein, 30 aa, Artificial Sequence
  Description of Artificial Sequence: Synthetic polypeptide
DEEEIRTTNPVATEQYGSVSENLQAGENES

SEQ ID NO: 11104 - protein, 31 aa, Artificial Sequence
  Description of Artificial Sequence: Synthetic polypeptide
DEEEIRTTNPVATEQYGSVATNLQRDGDNQG

SEQ ID NO: 11105 - protein, 30 aa, Artificial Sequence
  Description of Artificial Sequence: Synthetic polypeptide
DEEEIRTTNPVATEQYGSVATNLQRDNPGE

SEQ ID NO: 11106 - protein, 31 aa, Artificial Sequence
  Description of Artificial Sequence: Synthetic polypeptide
DEEEIRTTNPVATEQYGSVSTQNLEQDIGNV

SEQ ID NO: 11107 - protein, 30 aa, Artificial Sequence
  Description of Artificial Sequence: Synthetic polypeptide
DEEEIRTTNPVATEQYGSVATNLQREVNQE

SEQ ID NO: 11108 - protein, 28 aa, Artificial Sequence
  Description of Artificial Sequence: Synthetic peptide
DEPEIRTTNPVATDHYGSVSTNLQRTNL

SEQ ID NO: 11109 - protein, 31 aa, Artificial Sequence
  Description of Artificial Sequence: Synthetic polypeptide
DEEEIRTTNPVATEQYGSVATNLQERGNTPQ

SEQ ID NO: 11110 - protein, 30 aa, Artificial Sequence
  Description of Artificial Sequence: Synthetic polypeptide
DEEEIRTTNPVATEQYGSVSENLQDGNNES

SEQ ID NO: 11111 - protein, 31 aa, Artificial Sequence
  Description of Artificial Sequence: Synthetic polypeptide
DEEEIRTTNPVATEQYGSVATNLQERGNLGN

SEQ ID NO: 11112 - protein, 30 aa, Artificial Sequence
  Description of Artificial Sequence: Synthetic polypeptide
DEPEIRTTNPVATEQYGSVSTNNHQRGNDG

SEQ ID NO: 11113 - protein, 30 aa, Artificial Sequence
  Description of Artificial Sequence: Synthetic polypeptide
DEPEIRTTNPVATEQYGSVSTNLQRGPEQD

SEQ ID NO: 11114 - protein, 30 aa, Artificial Sequence
  Description of Artificial Sequence: Synthetic polypeptide
DEPEIRTTNPVATEQYGSVSTNLQRGDIQD

SEQ ID NO: 11115 - protein, 29 aa, Artificial Sequence
  Description of Artificial Sequence: Synthetic peptide
DEPEIRTTNPVATEQYGSVSTNLQNYGGQ

SEQ ID NO: 11116 - protein, 30 aa, Artificial Sequence
  Description of Artificial Sequence: Synthetic polypeptide
DEEEIRTTNPVATEQYGSVATNLQDDNNRS

SEQ ID NO: 11117 - protein, 29 aa, Artificial Sequence
  Description of Artificial Sequence: Synthetic peptide
DEEEIRTTNPVATEQYGSVATNLQDGEKD

SEQ ID NO: 11118 - protein, 30 aa, Artificial Sequence
  Description of Artificial Sequence: Synthetic polypeptide
DEPEIRTTNPVATEQYGSVSTELQRQGDER

SEQ ID NO: 11119 - protein, 29 aa, Artificial Sequence
  Description of Artificial Sequence: Synthetic peptide
DEEEIRTTNPVATEQYGSVATNLQDGHMM

SEQ ID NO: 11120 - protein, 30 aa, Artificial Sequence
  Description of Artificial Sequence: Synthetic polypeptide
DEEEIRTTNPVATEQYGSVATNLQDGNGDP

SEQ ID NO: 11121 - protein, 30 aa, Artificial Sequence
  Description of Artificial Sequence: Synthetic polypeptide
DEEEIRTTNPVATEQYGSVSENLQMGNNEQ

SEQ ID NO: 11122 - protein, 30 aa, Artificial Sequence
  Description of Artificial Sequence: Synthetic polypeptide
DEEEIRTTNPVATEQYGSVATNLQDGNNQL

SEQ ID NO: 11123 - protein, 30 aa, Artificial Sequence
  Description of Artificial Sequence: Synthetic polypeptide
DEEEIRTTNPVATEQYGSVSENLQMGENEF

SEQ ID NO: 11124 - protein, 30 aa, Artificial Sequence
  Description of Artificial Sequence: Synthetic polypeptide
DEEEIRTTNPVATEQYGSVATNLQDGNTNH

SEQ ID NO: 11125 - protein, 30 aa, Artificial Sequence
  Description of Artificial Sequence: Synthetic polypeptide
DEEEIRTTNPVATEQYGSVATNLQDGNVIG

SEQ ID NO: 11126 - protein, 30 aa, Artificial Sequence
  Description of Artificial Sequence: Synthetic polypeptide
DEEEIRTTNPVATEQYGSVATNLQDGNVNL

SEQ ID NO: 11127 - protein, 29 aa, Artificial Sequence
  Description of Artificial Sequence: Synthetic peptide
DEEEIRTTNPVATEQYGSVATNLQDGQGM

SEQ ID NO: 11128 - protein, 29 aa, Artificial Sequence
  Description of Artificial Sequence: Synthetic peptide
DEEEIRTTNPVATEQYGSVSENLQLFEVR

SEQ ID NO: 11129 - protein, 30 aa, Artificial Sequence
  Description of Artificial Sequence: Synthetic polypeptide
DEEEIRTTNPVATEQYGSVSENLQHTENQR

SEQ ID NO: 11130 - protein, 30 aa, Artificial Sequence
  Description of Artificial Sequence: Synthetic polypeptide
DEEEIRTTNPVATEQYGSVSENLQHADNTR

SEQ ID NO: 11131 - protein, 31 aa, Artificial Sequence
  Description of Artificial Sequence: Synthetic polypeptide
DEEEIRTTNPVATEQYGSVATNLQDRGNMDI

SEQ ID NO: 11132 - protein, 31 aa, Artificial Sequence
  Description of Artificial Sequence: Synthetic polypeptide
DEEEIRTTNPVATEQYGSVATNLQDRGNNQN

SEQ ID NO: 11133 - protein, 30 aa, Artificial Sequence
  Description of Artificial Sequence: Synthetic polypeptide
DEEEIRTTNPVATEQYGSVSENLQFFGSND

SEQ ID NO: 11134 - protein, 30 aa, Artificial Sequence
  Description of Artificial Sequence: Synthetic polypeptide
DEPEIRTTNPVATEQYGSVETNLQRGDGRE

SEQ ID NO: 11135 - protein, 30 aa, Artificial Sequence
  Description of Artificial Sequence: Synthetic polypeptide
DEPEIRTTNPVATEQYGSVCSTPLQRGNAP

SEQ ID NO: 11136 - protein, 29 aa, Artificial Sequence
  Description of Artificial Sequence: Synthetic peptide
DEPEIRTTNPVATEQYGSVAATDLQRGER

SEQ ID NO: 11137 - protein, 29 aa, Artificial Sequence
  Description of Artificial Sequence: Synthetic peptide
DEPEIRTTNPVATEQYGSISTNDQREGLR

SEQ ID NO: 11138 - protein, 30 aa, Artificial Sequence
  Description of Artificial Sequence: Synthetic polypeptide
DEEEIRTTNPVATEQYGSVATNLQEGEDRM

SEQ ID NO: 11139 - protein, 30 aa, Artificial Sequence
  Description of Artificial Sequence: Synthetic polypeptide
DEEEIRTTNPVATEQYGSVATNLQENGNMV

SEQ ID NO: 11140 - protein, 31 aa, Artificial Sequence
  Description of Artificial Sequence: Synthetic polypeptide
DEEEIRTTNPVATEQYGSVATNLQERGNAEM

SEQ ID NO: 11141 - protein, 31 aa, Artificial Sequence
  Description of Artificial Sequence: Synthetic polypeptide
DEEEIRTTNPVATEQYGSVSENLPMMRNGNR

SEQ ID NO: 11142 - protein, 30 aa, Artificial Sequence
  Description of Artificial Sequence: Synthetic polypeptide
CEEEIRTTNPVATEQYGSVSTNHQRGNTFE

SEQ ID NO: 11143 - protein, 31 aa, Artificial Sequence
  Description of Artificial Sequence: Synthetic polypeptide
DEEEIRTTNPVATEQYGSVSTSLQRFGESRI

SEQ ID NO: 11144 - protein, 30 aa, Artificial Sequence
  Description of Artificial Sequence: Synthetic polypeptide
CEEEIRTTNPVATEQYGSVSTNLDQYGNFA

SEQ ID NO: 11145 - protein, 31 aa, Artificial Sequence
  Description of Artificial Sequence: Synthetic polypeptide
DENEIRTTNPVATECYGSVDSTNLQLRGNCR

SEQ ID NO: 11146 - protein, 30 aa, Artificial Sequence
  Description of Artificial Sequence: Synthetic polypeptide
DEEEIRTTNPVATEQYGSVCSGNLQNGTDR

SEQ ID NO: 11147 - protein, 31 aa, Artificial Sequence
  Description of Artificial Sequence: Synthetic polypeptide
DEEEIRTTNPVATEQYGSVCSGTNLARGNSQ

SEQ ID NO: 11148 - protein, 30 aa, Artificial Sequence
  Description of Artificial Sequence: Synthetic polypeptide
DEEEIRTTNPVATEQYGSVSTTLQRLVPIR

SEQ ID NO: 11149 - protein, 31 aa, Artificial Sequence
  Description of Artificial Sequence: Synthetic polypeptide
DEEEIRTTNPVATEQYGSVCSLNLEQRGDNQ

SEQ ID NO: 11150 - protein, 31 aa, Artificial Sequence
  Description of Artificial Sequence: Synthetic polypeptide
DEEEIRTTNPVATEQYGSVCSLNLQRGEDND

SEQ ID NO: 11151 - protein, 30 aa, Artificial Sequence
  Description of Artificial Sequence: Synthetic polypeptide
DEEEIRTTNPVATEQYGSVSDTNNLERGED

SEQ ID NO: 11152 - protein, 31 aa, Artificial Sequence
  Description of Artificial Sequence: Synthetic polypeptide
DEEEIRTTNPVATEQYGSVSTTLSQFSGNRQ

SEQ ID NO: 11153 - protein, 31 aa, Artificial Sequence
  Description of Artificial Sequence: Synthetic polypeptide
DEEEIRTTNPVATEQYGSVSTTLSQNRGNNM

SEQ ID NO: 11154 - protein, 28 aa, Artificial Sequence
  Description of Artificial Sequence: Synthetic peptide
DENEIRTTNPVATEAYGSVSSNLQRGTP

SEQ ID NO: 11155 - protein, 30 aa, Artificial Sequence
  Description of Artificial Sequence: Synthetic polypeptide
DEEEIRTTNPVATEQYGSVCSNLNLQRGPF

SEQ ID NO: 11156 - protein, 28 aa, Artificial Sequence
  Description of Artificial Sequence: Synthetic peptide
DENEIRTTNPVATEAYGSVSNNLQRGDP

SEQ ID NO: 11157 - protein, 31 aa, Artificial Sequence
  Description of Artificial Sequence: Synthetic polypeptide
DEEEIRTTNPVATEQYGSVCSNNLQEGAGNR

SEQ ID NO: 11158 - protein, 28 aa, Artificial Sequence
  Description of Artificial Sequence: Synthetic peptide
DENEIRTTNPVATECYGSVSDNLERGMR

SEQ ID NO: 11159 - protein, 30 aa, Artificial Sequence
  Description of Artificial Sequence: Synthetic polypeptide
DEEEIRTTNPVATEQYGSVSTTLVQRSTNV

SEQ ID NO: 11160 - protein, 28 aa, Artificial Sequence
  Description of Artificial Sequence: Synthetic peptide
DENEIRTTNPVATDQYGSVNTDLQRGND

SEQ ID NO: 11161 - protein, 28 aa, Artificial Sequence
  Description of Artificial Sequence: Synthetic peptide
DENEIRTTNPVATDHYGSVSTNLQRTNM

SEQ ID NO: 11162 - protein, 28 aa, Artificial Sequence
  Description of Artificial Sequence: Synthetic peptide
DENEIRTTNPVATAHYGSVSTNLQRTND

SEQ ID NO: 11163 - protein, 30 aa, Artificial Sequence
  Description of Artificial Sequence: Synthetic polypeptide
DEEEIRTTNPVATEQYGSVSDTNLVGVGNP

SEQ ID NO: 11164 - protein, 33 aa, Artificial Sequence
  Description of Artificial Sequence: Synthetic polypeptide
DEEEIRTTNPVATEQYGSVCSNTGNLEQRGGNR

SEQ ID NO: 11165 - protein, 28 aa, Artificial Sequence
  Description of Artificial Sequence: Synthetic peptide
DENEIRTTNGVAYCQYGSVSTNLQRGDR

SEQ ID NO: 11166 - protein, 32 aa, Artificial Sequence
  Description of Artificial Sequence: Synthetic polypeptide
DEEEIRTTNPVATEQYGSVSDTNLQRGSNYQP

SEQ ID NO: 11167 - protein, 32 aa, Artificial Sequence
  Description of Artificial Sequence: Synthetic polypeptide
DEEEIRTTNPVATEQYGSVSDTNLQRGSNHQS

SEQ ID NO: 11168 - protein, 31 aa, Artificial Sequence
  Description of Artificial Sequence: Synthetic polypeptide
DEEEIRTTNPVATEQYGSVCSNTNLNQSGND

SEQ ID NO: 11169 - protein, 31 aa, Artificial Sequence
  Description of Artificial Sequence: Synthetic polypeptide
DEEEIRTTNPVATEQYGSVSDTNLQREENEN

SEQ ID NO: 11170 - protein, 31 aa, Artificial Sequence
  Description of Artificial Sequence: Synthetic polypeptide
DEEEIRTTNPVATEQYGSVSDTNLQQNAGNM

SEQ ID NO: 11171 - protein, 31 aa, Artificial Sequence
  Description of Artificial Sequence: Synthetic polypeptide
DEEEIRTTNPVATEQYGSVSDTNLQQGVGNF

SEQ ID NO: 11172 - protein, 31 aa, Artificial Sequence
  Description of Artificial Sequence: Synthetic polypeptide
DEEEIRTTNPVATEQYGSVSTTMNLQPGDNN

SEQ ID NO: 11173 - protein, 31 aa, Artificial Sequence
  Description of Artificial Sequence: Synthetic polypeptide
DEEEIRTTNPVATEQYGSVSDTNLVRNGDRE

SEQ ID NO: 11174 - protein, 31 aa, Artificial Sequence
  Description of Artificial Sequence: Synthetic polypeptide
DEEEIRTTNPVATEQYGSVCSNTNLQRENDD

SEQ ID NO: 11175 - protein, 30 aa, Artificial Sequence
  Description of Artificial Sequence: Synthetic polypeptide
DEEEIRTTNPVATEQYGSVSTTLQRGTQGL

SEQ ID NO: 11176 - protein, 28 aa, Artificial Sequence
  Description of Artificial Sequence: Synthetic peptide
DENEIRTTNPVATECYGSVSNNLQRGTD

SEQ ID NO: 11177 - protein, 30 aa, Artificial Sequence
  Description of Artificial Sequence: Synthetic polypeptide
DEEEIRTTNPVATEQYGSVSTTLEQRVGEQ

SEQ ID NO: 11178 - protein, 31 aa, Artificial Sequence
  Description of Artificial Sequence: Synthetic polypeptide
DEEEIRTTNPVATEQYGSVSTTLERQGDNAR

SEQ ID NO: 11179 - protein, 31 aa, Artificial Sequence
  Description of Artificial Sequence: Synthetic polypeptide
DEEEIRTTNPVATEQYGSVSDTQLQQRSTNR

SEQ ID NO: 11180 - protein, 31 aa, Artificial Sequence
  Description of Artificial Sequence: Synthetic polypeptide
DEEEIRTTNPVATEQYGSVSDTPNNQRSQNR

SEQ ID NO: 11181 - protein, 32 aa, Artificial Sequence
  Description of Artificial Sequence: Synthetic polypeptide
DEEEIRTTNPVATEQYGSVSDTPNGLQRGEND

SEQ ID NO: 11182 - protein, 30 aa, Artificial Sequence
  Description of Artificial Sequence: Synthetic polypeptide
DEEEIRTTNPVATEQYGSVSDTPNDQLGNE

SEQ ID NO: 11183 - protein, 31 aa, Artificial Sequence
  Description of Artificial Sequence: Synthetic polypeptide
DEEEIRTTNPVATEQYGSVCSAMNLQPGDNR

SEQ ID NO: 11184 - protein, 30 aa, Artificial Sequence
  Description of Artificial Sequence: Synthetic polypeptide
DEEEIRTTNPVATEQYGSVSTTLLQSGLNN

SEQ ID NO: 11185 - protein, 31 aa, Artificial Sequence
  Description of Artificial Sequence: Synthetic polypeptide
DEEEIRTTNPVATEQYGSVSDTPLAQREQNR

SEQ ID NO: 11186 - protein, 31 aa, Artificial Sequence
  Description of Artificial Sequence: Synthetic polypeptide
DEEEIRTTNPVATEQYGSVSDTNTQGIGSNR

SEQ ID NO: 11187 - protein, 28 aa, Artificial Sequence
  Description of Artificial Sequence: Synthetic peptide
DENEIRTTNPVATEIYGSVSMNLQRGTL

SEQ ID NO: 11188 - protein, 28 aa, Artificial Sequence
  Description of Artificial Sequence: Synthetic peptide
DENEIRTTNPVATEIYGSVSINLQRGTN

SEQ ID NO: 11189 - protein, 31 aa, Artificial Sequence
  Description of Artificial Sequence: Synthetic polypeptide
DEEEIRTTNPVATEQYGSVSDTNPQRINERM

SEQ ID NO: 11190 - protein, 30 aa, Artificial Sequence
  Description of Artificial Sequence: Synthetic polypeptide
DEEEIRTTNPVATEQYGSVSTTLQRGTFEF

SEQ ID NO: 11191 - protein, 28 aa, Artificial Sequence
  Description of Artificial Sequence: Synthetic peptide
DENEIRTTNPVATEIYGSVSFNLQRGTQ

SEQ ID NO: 11192 - protein, 28 aa, Artificial Sequence
  Description of Artificial Sequence: Synthetic peptide
DENEIRTTNPVATEIYGSVSENLQRGIQ

SEQ ID NO: 11193 - protein, 30 aa, Artificial Sequence
  Description of Artificial Sequence: Synthetic polypeptide
DEEEIRTTNPVATEQYGSVSTTLPQSGGNA

SEQ ID NO: 11194 - protein, 33 aa, Artificial Sequence
  Description of Artificial Sequence: Synthetic polypeptide
DEEEIRTTNPVATEQYGSVCSCTNLSQRGTNRI

SEQ ID NO: 11195 - protein, 30 aa, Artificial Sequence
  Description of Artificial Sequence: Synthetic polypeptide
DEEEIRTTNPVATEQYGSVSTTLQIGGNPN

SEQ ID NO: 11196 - protein, 30 aa, Artificial Sequence
  Description of Artificial Sequence: Synthetic polypeptide
DEEEIRTTNPVATEQYGSVSDTNPEQRGEQ

SEQ ID NO: 11197 - protein, 30 aa, Artificial Sequence
  Description of Artificial Sequence: Synthetic polypeptide
DEEEIRTTNPVATEQYGSVCSDNLQTGVRM

SEQ ID NO: 11198 - protein, 32 aa, Artificial Sequence
  Description of Artificial Sequence: Synthetic polypeptide
DEEEIRTTNPVATEQYGSVCSDTNLQRGQNDQ

SEQ ID NO: 11199 - protein, 28 aa, Artificial Sequence
  Description of Artificial Sequence: Synthetic peptide
DENEIRTTNPVATEHYGSVSNNLQRGTF

SEQ ID NO: 11200 - protein, 30 aa, Artificial Sequence
  Description of Artificial Sequence: Synthetic polypeptide
DEEEIRTTNPVATEQYGSVSTTLQRAVSVR

SEQ ID NO: 11201 - protein, 31 aa, Artificial Sequence
  Description of Artificial Sequence: Synthetic polypeptide
DEEEIRTTNPVATEQYGSVCSDTTNHQRGNA

SEQ ID NO: 11202 - protein, 30 aa, Artificial Sequence
  Description of Artificial Sequence: Synthetic polypeptide
DEEEIRTTNPVATEQYGSVSTTLQRGFEEQ

SEQ ID NO: 11203 - protein, 31 aa, Artificial Sequence
  Description of Artificial Sequence: Synthetic polypeptide
DEEEIRTTNPVATEQYGSVSTTLQRGGNNEQ

SEQ ID NO: 11204 - protein, 29 aa, Artificial Sequence
  Description of Artificial Sequence: Synthetic peptide
CEEEISTTNPVATEQYGSVSTNLERGERA

SEQ ID NO: 11205 - protein, 30 aa, Artificial Sequence
  Description of Artificial Sequence: Synthetic polypeptide
DEEEIRTTNPVATEQYGSVSDTNPQNGSDR

SEQ ID NO: 11206 - protein, 32 aa, Artificial Sequence
  Description of Artificial Sequence: Synthetic polypeptide
DEEEIRTTNPVATEQYGSVCSNTNLQRGNIQD

SEQ ID NO: 11207 - protein, 28 aa, Artificial Sequence
  Description of Artificial Sequence: Synthetic peptide
DENEICTTNPVATEQYGSVSTNLMYGNT

SEQ ID NO: 11208 - protein, 31 aa, Artificial Sequence
  Description of Artificial Sequence: Synthetic polypeptide
DEEEIRTTNPVATEQYGSVSDTNLIQGIGNP

SEQ ID NO: 11209 - protein, 32 aa, Artificial Sequence
  Description of Artificial Sequence: Synthetic polypeptide
DEEEIRTTNPVATEQYGSVCSTDNDLQRGNGQ

SEQ ID NO: 11210 - protein, 31 aa, Artificial Sequence
  Description of Artificial Sequence: Synthetic polypeptide
DEEEIRTTNPVATEQYGSVSDTELQRIVNER

SEQ ID NO: 11211 - protein, 32 aa, Artificial Sequence
  Description of Artificial Sequence: Synthetic polypeptide
DEEEIRTTNPVATEQYGSVSTTNLGQRGFERE

SEQ ID NO: 11212 - protein, 32 aa, Artificial Sequence
  Description of Artificial Sequence: Synthetic polypeptide
DEEEIRTTNPVATEQYGSVSTTNLINRVGNRP

SEQ ID NO: 11213 - protein, 30 aa, Artificial Sequence
  Description of Artificial Sequence: Synthetic polypeptide
DEEEIRTTNPVATEQYGSVSTTNLLTGENV

SEQ ID NO: 11214 - protein, 31 aa, Artificial Sequence
  Description of Artificial Sequence: Synthetic polypeptide
DEEEIRTTNPVATEQYGSVSTTNLNNRNNVR

SEQ ID NO: 11215 - protein, 31 aa, Artificial Sequence
  Description of Artificial Sequence: Synthetic polypeptide
DEEEIRTTNPVATEQYGSVSTTNLNRGENVE

SEQ ID NO: 11216 - protein, 32 aa, Artificial Sequence
  Description of Artificial Sequence: Synthetic polypeptide
DEEEIRTTNPVATEQYGSVSTTNLNRTGNIRD

SEQ ID NO: 11217 - protein, 30 aa, Artificial Sequence
  Description of Artificial Sequence: Synthetic polypeptide
DEEEIRTTNPVATEQYGSVSTTNLNSREER

SEQ ID NO: 11218 - protein, 30 aa, Artificial Sequence
  Description of Artificial Sequence: Synthetic polypeptide
DEEEIRTTNPVATEQYGSVSTTNLQAGTDQ

SEQ ID NO: 11219 - protein, 30 aa, Artificial Sequence
  Description of Artificial Sequence: Synthetic polypeptide
DEEEIRTTNPVATEQYGSVSTTNLQASNTP

SEQ ID NO: 11220 - protein, 30 aa, Artificial Sequence
  Description of Artificial Sequence: Synthetic polypeptide
DEEEIRTTNPVATEQYGSVSTTNLQEGPEM

SEQ ID NO: 11221 - protein, 28 aa, Artificial Sequence
  Description of Artificial Sequence: Synthetic peptide
DEAEIRTTNPVAVEQYGSISTNLSRINR

SEQ ID NO: 11222 - protein, 30 aa, Artificial Sequence
  Description of Artificial Sequence: Synthetic polypeptide
DEEEIRTTNPVATEQYGSVCSTDLPQRGEF

SEQ ID NO: 11223 - protein, 28 aa, Artificial Sequence
  Description of Artificial Sequence: Synthetic peptide
DEAEIRTTNPVAVEQYGSISTNLDRTNR

SEQ ID NO: 11224 - protein, 28 aa, Artificial Sequence
  Description of Artificial Sequence: Synthetic peptide
DENEIACTNPVATEQYGSVSTNGQRGGR

SEQ ID NO: 11225 - protein, 31 aa, Artificial Sequence
  Description of Artificial Sequence: Synthetic polypeptide
DEEEIRTTNPVATEQYGSVSDTDLYQRSQNR

SEQ ID NO: 11226 - protein, 30 aa, Artificial Sequence
  Description of Artificial Sequence: Synthetic polypeptide
DEEEIRTTNPVATEQYGSVSDTDLQRVSRM

SEQ ID NO: 11227 - protein, 32 aa, Artificial Sequence
  Description of Artificial Sequence: Synthetic polypeptide
DEEEIRTTNPVATEQYGSVCSTELQRGLNNRP

SEQ ID NO: 11228 - protein, 32 aa, Artificial Sequence
  Description of Artificial Sequence: Synthetic polypeptide
DEEEIRTTNPVATEQYGSVCSTELQRGVNPRV

SEQ ID NO: 11229 - protein, 31 aa, Artificial Sequence
  Description of Artificial Sequence: Synthetic polypeptide
DEEEIRTTNPVATEQYGSVSTTNLQFGQNDA

SEQ ID NO: 11230 - protein, 31 aa, Artificial Sequence
  Description of Artificial Sequence: Synthetic polypeptide
DEEEIRTTNPVATEQYGSVSTTNLQFGQNGE

SEQ ID NO: 11231 - protein, 31 aa, Artificial Sequence
  Description of Artificial Sequence: Synthetic polypeptide
DEEEIRTTNPVATEQYGSVSTTNLQGDGNLG

SEQ ID NO: 11232 - protein, 30 aa, Artificial Sequence
  Description of Artificial Sequence: Synthetic polypeptide
DEEEIRTTNPVATEQYGSVSDTDLQRSNVF

SEQ ID NO: 11233 - protein, 31 aa, Artificial Sequence
  Description of Artificial Sequence: Synthetic polypeptide
DEEEIRTTNPVATEQYGSVSTTNLQGFGNTG

SEQ ID NO: 11234 - protein, 28 aa, Artificial Sequence
  Description of Artificial Sequence: Synthetic peptide
CEREIRTTNPVATEQYGSVSTYLQRGEF

SEQ ID NO: 11235 - protein, 28 aa, Artificial Sequence
  Description of Artificial Sequence: Synthetic peptide
DEAEIRTTNPVATQQYGCVSTNLERGNF

SEQ ID NO: 11236 - protein, 31 aa, Artificial Sequence
  Description of Artificial Sequence: Synthetic polypeptide
DEEEIRTTNPVATEQYGSVCSTENEQRGNNL

SEQ ID NO: 11237 - protein, 28 aa, Artificial Sequence
  Description of Artificial Sequence: Synthetic peptide
DEAEIRTTNPVAVEQYGSISTNLDRINR

SEQ ID NO: 11238 - protein, 31 aa, Artificial Sequence
  Description of Artificial Sequence: Synthetic polypeptide
DEEEIRTTNPVATEQYGSVCSTDDLQRGDRV

SEQ ID NO: 11239 - protein, 31 aa, Artificial Sequence
  Description of Artificial Sequence: Synthetic polypeptide
DEEEIRTTNPVATEQYGSVSDTELTQRSQNR

SEQ ID NO: 11240 - protein, 28 aa, Artificial Sequence
  Description of Artificial Sequence: Synthetic peptide
DENEIATTNPVATEQYGAVSTNLQNGER

SEQ ID NO: 11241 - protein, 30 aa, Artificial Sequence
  Description of Artificial Sequence: Synthetic polypeptide
DEEEIRTTNPVATEQYGSVSTTNALQREDG

SEQ ID NO: 11242 - protein, 30 aa, Artificial Sequence
  Description of Artificial Sequence: Synthetic polypeptide
DEEEIRTTNPVATEQYGSVSTTNAQDGNTQ

SEQ ID NO: 11243 - protein, 30 aa, Artificial Sequence
  Description of Artificial Sequence: Synthetic polypeptide
DEEEIRTTNPVATEQYGSVSDTNHQRGVFG

SEQ ID NO: 11244 - protein, 30 aa, Artificial Sequence
  Description of Artificial Sequence: Synthetic polypeptide
DEEEIRTTNPVATEQYGSVSTTNDLERGID

SEQ ID NO: 11245 - protein, 32 aa, Artificial Sequence
  Description of Artificial Sequence: Synthetic polypeptide
DEEEIRTTNPVATEQYGSVSTTNDLQRGNEIT

SEQ ID NO: 11246 - protein, 31 aa, Artificial Sequence
  Description of Artificial Sequence: Synthetic polypeptide
DEEEIRTTNPVATEQYGSVSTTNDLQRNENT

SEQ ID NO: 11247 - protein, 31 aa, Artificial Sequence
  Description of Artificial Sequence: Synthetic polypeptide
DEEEIRTTNPVATEQYGSVCSPNPLQTRGND

SEQ ID NO: 11248 - protein, 30 aa, Artificial Sequence
  Description of Artificial Sequence: Synthetic polypeptide
DEEEIRTTNPVATEQYGSVSDTNGQGIGNE

SEQ ID NO: 11249 - protein, 31 aa, Artificial Sequence
  Description of Artificial Sequence: Synthetic polypeptide
DEEEIRTTNPVATEQYGSVCSPTILQRGELR

SEQ ID NO: 11250 - protein, 28 aa, Artificial Sequence
  Description of Artificial Sequence: Synthetic peptide
DENEIATTNPVATEQYGSVSTNLQNDNN

SEQ ID NO: 11251 - protein, 30 aa, Artificial Sequence
  Description of Artificial Sequence: Synthetic polypeptide
DEEEIRTTNPVATEQYGSVSTTNDPRGENN

SEQ ID NO: 11252 - protein, 31 aa, Artificial Sequence
  Description of Artificial Sequence: Synthetic polypeptide
DEEEIRTTNPVATEQYGSVSTTNDQRGQFRS

SEQ ID NO: 11253 - protein, 30 aa, Artificial Sequence
  Description of Artificial Sequence: Synthetic polypeptide
DENEIATTNPVATEQYGSVSPTNLQRGEDR

SEQ ID NO: 11254 - protein, 30 aa, Artificial Sequence
  Description of Artificial Sequence: Synthetic polypeptide
DEEEIRTTNPVATEQYGSVSDTNDQRGPVD

SEQ ID NO: 11255 - protein, 31 aa, Artificial Sequence
  Description of Artificial Sequence: Synthetic polypeptide
DEEEIRTTNPVATEQYGSVSTTNELQFGNAG

SEQ ID NO: 11256 - protein, 31 aa, Artificial Sequence
  Description of Artificial Sequence: Synthetic polypeptide
DEEEIRTTNPVATEQYGSVCSPTNLERGNID

SEQ ID NO: 11257 - protein, 31 aa, Artificial Sequence
  Description of Artificial Sequence: Synthetic polypeptide
DEEEIRTTNPVATEQYGSVSDTMLYQRSENR

SEQ ID NO: 11258 - protein, 31 aa, Artificial Sequence
  Description of Artificial Sequence: Synthetic polypeptide
DEEEIRTTNPVATEQYGSVSDTILMQRSQNR

SEQ ID NO: 11259 - protein, 30 aa, Artificial Sequence
  Description of Artificial Sequence: Synthetic polypeptide
DEEEIRTTNPVATEQYGSVSTTNILQRETI

SEQ ID NO: 11260 - protein, 31 aa, Artificial Sequence
  Description of Artificial Sequence: Synthetic polypeptide
DEEEIRTTNPVATEQYGSVSTTNLARQGMVR

SEQ ID NO: 11261 - protein, 30 aa, Artificial Sequence
  Description of Artificial Sequence: Synthetic polypeptide
DEEEIRTTNPVATEQYGSVSTTNLDDGNNE

SEQ ID NO: 11262 - protein, 30 aa, Artificial Sequence
  Description of Artificial Sequence: Synthetic polypeptide
DEEEIRTTNPVATEQYGSVSTTNLDNGDIR

SEQ ID NO: 11263 - protein, 31 aa, Artificial Sequence
  Description of Artificial Sequence: Synthetic polypeptide
DEEEIRTTNPVATEQYGSVSTTNLDQSGSNQ

SEQ ID NO: 11264 - protein, 32 aa, Artificial Sequence
  Description of Artificial Sequence: Synthetic polypeptide
DEEEIRTTNPVATEQYGSVSTTNLDRSGNIRD

SEQ ID NO: 11265 - protein, 30 aa, Artificial Sequence
  Description of Artificial Sequence: Synthetic polypeptide
DEEEIRTTNPVATEQYGSVSTTNLEEQGIR

SEQ ID NO: 11266 - protein, 31 aa, Artificial Sequence
  Description of Artificial Sequence: Synthetic polypeptide
DEEEIRTTNPVATEQYGSVSTTNLEFRGPER

SEQ ID NO: 11267 - protein, 31 aa, Artificial Sequence
  Description of Artificial Sequence: Synthetic polypeptide
DEEEIRTTNPVATEQYGSVSTTNLEQVFGQR

SEQ ID NO: 11268 - protein, 29 aa, Artificial Sequence
  Description of Artificial Sequence: Synthetic peptide
DEEEIRTTNPVATEQYGSVSDTEMQRGEI

SEQ ID NO: 11269 - protein, 28 aa, Artificial Sequence
  Description of Artificial Sequence: Synthetic peptide
DENEIATTNPVATEQYGCVSTNLQVGNL

SEQ ID NO: 11270 - protein, 28 aa, Artificial Sequence
  Description of Artificial Sequence: Synthetic peptide
DENEIRTTNPVATEIYGSVSNNLQRGAS

SEQ ID NO: 11271 - protein, 28 aa, Artificial Sequence
  Description of Artificial Sequence: Synthetic peptide
DENEIRTTNPVATEIYGSVSNNLQRGDL

SEQ ID NO: 11272 - protein, 28 aa, Artificial Sequence
  Description of Artificial Sequence: Synthetic peptide
DENEIRTTNPVATEIYGSVSNNLQRGES

SEQ ID NO: 11273 - protein, 28 aa, Artificial Sequence
  Description of Artificial Sequence: Synthetic peptide
DENEIRTTNPVATEIYGSVSNNLQRGGS

SEQ ID NO: 11274 - protein, 29 aa, Artificial Sequence
  Description of Artificial Sequence: Synthetic peptide
DENEIRTTNPVATEQYGSVSSNLFQNMNR

SEQ ID NO: 11275 - protein, 29 aa, Artificial Sequence
  Description of Artificial Sequence: Synthetic peptide
DENEIRTTNPVATEQYGSVSSNLERNMNR

SEQ ID NO: 11276 - protein, 29 aa, Artificial Sequence
  Description of Artificial Sequence: Synthetic peptide
DENEIRTTNPVATEQYGSVSQNLPRNNNR

SEQ ID NO: 11277 - protein, 30 aa, Artificial Sequence
  Description of Artificial Sequence: Synthetic polypeptide
CEEEIRTTNPVATEWYGSVVSTGLQRGNNR

SEQ ID NO: 11278 - protein, 29 aa, Artificial Sequence
  Description of Artificial Sequence: Synthetic peptide
DENEIRTTNPVATEQYGSVSQNLFRNQNR

SEQ ID NO: 11279 - protein, 29 aa, Artificial Sequence
  Description of Artificial Sequence: Synthetic peptide
DENEIRTTNPVATEQYGSVSQNLFREDNR

SEQ ID NO: 11280 - protein, 30 aa, Artificial Sequence
  Description of Artificial Sequence: Synthetic polypeptide
DEEEIRTTNPVATEQYGSVSTSNLQITINT

SEQ ID NO: 11281 - protein, 31 aa, Artificial Sequence
  Description of Artificial Sequence: Synthetic polypeptide
DEEEIRTTNPVATEQYGSVCDTNLQDRGDRQ

SEQ ID NO: 11282 - protein, 29 aa, Artificial Sequence
  Description of Artificial Sequence: Synthetic peptide
DEEEIRTTNPVATEQYGSVCELLQRGNID

SEQ ID NO: 11283 - protein, 31 aa, Artificial Sequence
  Description of Artificial Sequence: Synthetic polypeptide
DEEEIRTTNPVATEQYGSVSTSNLQREFNEA

SEQ ID NO: 11284 - protein, 31 aa, Artificial Sequence
  Description of Artificial Sequence: Synthetic polypeptide
DEEEIRTTNPVATEQYGSVCENLQRGDNPRL

SEQ ID NO: 11285 - protein, 30 aa, Artificial Sequence
  Description of Artificial Sequence: Synthetic polypeptide
DEEEIRTTNPVATEQYGSVCENLQRPGENN

SEQ ID NO: 11286 - protein, 32 aa, Artificial Sequence
  Description of Artificial Sequence: Synthetic polypeptide
DEEEIRTTNPVATEQYGSVSTSNLQREGGNEE

SEQ ID NO: 11287 - protein, 31 aa, Artificial Sequence
  Description of Artificial Sequence: Synthetic polypeptide
DEEEIRTTNPVATEQYGSVSTSNLQFGGNQP

SEQ ID NO: 11288 - protein, 31 aa, Artificial Sequence
  Description of Artificial Sequence: Synthetic polypeptide
DEEEIRTTNPVATEQYGSVCETNLEQRQGNL

SEQ ID NO: 11289 - protein, 31 aa, Artificial Sequence
  Description of Artificial Sequence: Synthetic polypeptide
DEEEIRTTNPVATEQYGSVCETYLQRVGVNR

SEQ ID NO: 11290 - protein, 32 aa, Artificial Sequence
  Description of Artificial Sequence: Synthetic polypeptide
DEEEIRTTNPVATEQYGSVSTSNLQTGTGTNR

SEQ ID NO: 11291 - protein, 32 aa, Artificial Sequence
  Description of Artificial Sequence: Synthetic polypeptide
DEEEIRTTNPVATEQYGSVSTSNLQVGIGTNR

SEQ ID NO: 11292 - protein, 32 aa, Artificial Sequence
  Description of Artificial Sequence: Synthetic polypeptide
DEEEIRTTNPVATEQYGSVSTSNLQVGSGGNR

SEQ ID NO: 11293 - protein, 31 aa, Artificial Sequence
  Description of Artificial Sequence: Synthetic polypeptide
DEEEIRTTNPVATEQYGSVSTSNLTRGGGNG

SEQ ID NO: 11294 - protein, 28 aa, Artificial Sequence
  Description of Artificial Sequence: Synthetic peptide
DENEIRTTNPVATEQYGSVQTGLIRINR

SEQ ID NO: 11295 - protein, 29 aa, Artificial Sequence
  Description of Artificial Sequence: Synthetic peptide
DEEEIRTTNPVATEQYGSVCFTGLQRMNQ

SEQ ID NO: 11296 - protein, 30 aa, Artificial Sequence
  Description of Artificial Sequence: Synthetic polypeptide
CEEEIRTTNPVAYEQYGSVSTNLQNFGNRI

SEQ ID NO: 11297 - protein, 30 aa, Artificial Sequence
  Description of Artificial Sequence: Synthetic polypeptide
DEEEIRTTNPVATEQYGSVSELNLQTGNND

SEQ ID NO: 11298 - protein, 29 aa, Artificial Sequence
  Description of Artificial Sequence: Synthetic peptide
DENEIRTTNPVATEQYGSVNQNLFRNGNR

SEQ ID NO: 11299 - protein, 30 aa, Artificial Sequence
  Description of Artificial Sequence: Synthetic polypeptide
DEEEIRTTNPVATEQYGSVSELIQRGENQR

SEQ ID NO: 11300 - protein, 30 aa, Artificial Sequence
  Description of Artificial Sequence: Synthetic polypeptide
DEEEIRTTNPVATEQYGSVCGNLQREGVND

SEQ ID NO: 11301 - protein, 30 aa, Artificial Sequence
  Description of Artificial Sequence: Synthetic polypeptide
DEEEIRTTNPVATEQYGSVSELIQRGENER

SEQ ID NO: 11302 - protein, 32 aa, Artificial Sequence
  Description of Artificial Sequence: Synthetic polypeptide
DEEEIRTTNPVATEQYGSVSTSNLQRIGGNED

SEQ ID NO: 11303 - protein, 31 aa, Artificial Sequence
  Description of Artificial Sequence: Synthetic polypeptide
DEEEIRTTNPVATEQYGSVSTSNLQFGGNEE

SEQ ID NO: 11304 - protein, 31 aa, Artificial Sequence
  Description of Artificial Sequence: Synthetic polypeptide
DEEEIRTTNPVATEQYGSVSTSNLQDPEGNQ

SEQ ID NO: 11305 - protein, 31 aa, Artificial Sequence
  Description of Artificial Sequence: Synthetic polypeptide
DEEEIRTTNPVATEQYGSVSTSNLQAGGNME

SEQ ID NO: 11306 - protein, 31 aa, Artificial Sequence
  Description of Artificial Sequence: Synthetic polypeptide
CEEEIRTTNPVATEQYGSVSTNLFQRFGNDE

SEQ ID NO: 11307 - protein, 29 aa, Artificial Sequence
  Description of Artificial Sequence: Synthetic peptide
CEEEIRTTNPVATEQYGSVSTNLQAGDQQ

SEQ ID NO: 11308 - protein, 29 aa, Artificial Sequence
  Description of Artificial Sequence: Synthetic peptide
CEEEIRTTNPVATEQYGSVSTNLQFENDE

SEQ ID NO: 11309 - protein, 31 aa, Artificial Sequence
  Description of Artificial Sequence: Synthetic polypeptide
CEEEIRTTNPVATEQYGSVSTNLQMGGNDRI

SEQ ID NO: 11310 - protein, 30 aa, Artificial Sequence
  Description of Artificial Sequence: Synthetic polypeptide
CEEEIRTTNPVATEQYGSVSTNLQNEGNLQ

SEQ ID NO: 11311 - protein, 30 aa, Artificial Sequence
  Description of Artificial Sequence: Synthetic polypeptide
CEEEIRTTNPVATEQYGSVSTNLQNLGNLQ

SEQ ID NO: 11312 - protein, 30 aa, Artificial Sequence
  Description of Artificial Sequence: Synthetic polypeptide
CEEEIRTTNPVATEQYGSVSTNLQRNANMQ

SEQ ID NO: 11313 - protein, 30 aa, Artificial Sequence
  Description of Artificial Sequence: Synthetic polypeptide
CEEEIRTTNPVATEQYGSVSTNLQRNNTQS

SEQ ID NO: 11314 - protein, 29 aa, Artificial Sequence
  Description of Artificial Sequence: Synthetic peptide
CEEEIRTTNPVATEQYGSVSTNLSTDGNE

SEQ ID NO: 11315 - protein, 29 aa, Artificial Sequence
  Description of Artificial Sequence: Synthetic peptide
CEEEIRTTNPVATEQYGSVSTNLTEGGNN

SEQ ID NO: 11316 - protein, 30 aa, Artificial Sequence
  Description of Artificial Sequence: Synthetic polypeptide
CEEEIRTTNPVATEQYGSVSTNMDQHGNRF

SEQ ID NO: 11317 - protein, 32 aa, Artificial Sequence
  Description of Artificial Sequence: Synthetic polypeptide
CEEEIRTTNPVATEQYGSVSTSNLEQRGDNPR

SEQ ID NO: 11318 - protein, 32 aa, Artificial Sequence
  Description of Artificial Sequence: Synthetic polypeptide
CEEEIRTTNPVATEQYGSVSTSNLSQRGENER

SEQ ID NO: 11319 - protein, 30 aa, Artificial Sequence
  Description of Artificial Sequence: Synthetic polypeptide
DENEIRTTNPVATEQYGSVSTNLQHDNGPR

SEQ ID NO: 11320 - protein, 32 aa, Artificial Sequence
  Description of Artificial Sequence: Synthetic polypeptide
CEEEIRTTNPVATEQYGSVSTVNLNQRGSNTR

SEQ ID NO: 11321 - protein, 30 aa, Artificial Sequence
  Description of Artificial Sequence: Synthetic polypeptide
DENEIRTTNPVATEQYGSVSTNLQGGSNVI

SEQ ID NO: 11322 - protein, 31 aa, Artificial Sequence
  Description of Artificial Sequence: Synthetic polypeptide
DENEIRTTNPVATEQYGSVSTNLQGFGSNRT

SEQ ID NO: 11323 - protein, 31 aa, Artificial Sequence
  Description of Artificial Sequence: Synthetic polypeptide
CEEEIRTTNPVATEQYGSVSVTNLQQEGNNR

SEQ ID NO: 11324 - protein, 29 aa, Artificial Sequence
  Description of Artificial Sequence: Synthetic peptide
DENEIRTTNPVATEQYGSVSTNLDQDVDR

SEQ ID NO: 11325 - protein, 30 aa, Artificial Sequence
  Description of Artificial Sequence: Synthetic polypeptide
DENEIRTTNPVATEQYGSVSTNDTQGGNRN

SEQ ID NO: 11326 - protein, 30 aa, Artificial Sequence
  Description of Artificial Sequence: Synthetic polypeptide
DENEIRTTNPVATEQYGSVSTNDQRGENTE

SEQ ID NO: 11327 - protein, 29 aa, Artificial Sequence
  Description of Artificial Sequence: Synthetic peptide
DENEIRTTNPVATEQYGSVSTNAQDGNEM

SEQ ID NO: 11328 - protein, 30 aa, Artificial Sequence
  Description of Artificial Sequence: Synthetic polypeptide
DEEEIRTTNPVATEQYGSVSTSLQYGQNQE

SEQ ID NO: 11329 - protein, 30 aa, Artificial Sequence
  Description of Artificial Sequence: Synthetic polypeptide
DEEEIRTTNPVATEQYGSVSTSNDLQDGFS

SEQ ID NO: 11330 - protein, 31 aa, Artificial Sequence
  Description of Artificial Sequence: Synthetic polypeptide
DEEEIRTTNPVATEQYGSVSTSNGLEQPGNG

SEQ ID NO: 11331 - protein, 29 aa, Artificial Sequence
  Description of Artificial Sequence: Synthetic peptide
DENEIRTTNPVATEQYGSVSTGLQIGDNL

SEQ ID NO: 11332 - protein, 30 aa, Artificial Sequence
  Description of Artificial Sequence: Synthetic polypeptide
DEEEIRTTNPVATEQYGSVSEMDLQRGEER

SEQ ID NO: 11333 - protein, 30 aa, Artificial Sequence
  Description of Artificial Sequence: Synthetic polypeptide
DEEEIRTTNPVATEQYGSVSTSNLDEMGNM

SEQ ID NO: 11334 - protein, 31 aa, Artificial Sequence
  Description of Artificial Sequence: Synthetic polypeptide
DEEEIRTTNPVATEQYGSVSTSNLQAGGNGN

SEQ ID NO: 11335 - protein, 28 aa, Artificial Sequence
  Description of Artificial Sequence: Synthetic peptide
DEEEIRTTNPVATEQYGSVSELDDEGNR

SEQ ID NO: 11336 - protein, 29 aa, Artificial Sequence
  Description of Artificial Sequence: Synthetic peptide
DEEEIRTTNPVATEQYGSVATNGQPGNDM

SEQ ID NO: 11337 - protein, 29 aa, Artificial Sequence
  Description of Artificial Sequence: Synthetic peptide
DENEIRTTNPVATEQYGSVGTNLERGSER

SEQ ID NO: 11338 - protein, 30 aa, Artificial Sequence
  Description of Artificial Sequence: Synthetic polypeptide
DENEIRTTNPVATEQYGSVFSTNLQGDNRI

SEQ ID NO: 11339 - protein, 31 aa, Artificial Sequence
  Description of Artificial Sequence: Synthetic polypeptide
DEEEIRTTNPVATEQYGSVSDTWLYQRATNR

SEQ ID NO: 11340 - protein, 31 aa, Artificial Sequence
  Description of Artificial Sequence: Synthetic polypeptide
DEEEIRTTNPVATEQYGSVSTTELAQRSQNR

SEQ ID NO: 11341 - protein, 29 aa, Artificial Sequence
  Description of Artificial Sequence: Synthetic peptide
DEEEIRTTNPVATEQYGSVSTTELDPGER

SEQ ID NO: 11342 - protein, 32 aa, Artificial Sequence
  Description of Artificial Sequence: Synthetic polypeptide
DEEEIRTTNPVATEQYGSVSTTENLQQRDNVR

SEQ ID NO: 11343 - protein, 32 aa, Artificial Sequence
  Description of Artificial Sequence: Synthetic polypeptide
DEEEIRTTNPVATEQYGSVSTTFNLGQNGGNR

SEQ ID NO: 11344 - protein, 31 aa, Artificial Sequence
  Description of Artificial Sequence: Synthetic polypeptide
DEEEIRTTNPVATEQYGSVSTTFNLGQNGNA

SEQ ID NO: 11345 - protein, 29 aa, Artificial Sequence
  Description of Artificial Sequence: Synthetic peptide
DEEEIATTNPVAYEQYGSTVSTNLQSGNM

SEQ ID NO: 11346 - protein, 28 aa, Artificial Sequence
  Description of Artificial Sequence: Synthetic peptide
DENEIRTTNPVATEPYGSVSNNLQRGSV

SEQ ID NO: 11347 - protein, 31 aa, Artificial Sequence
  Description of Artificial Sequence: Synthetic polypeptide
DEEEIRTTNPVATEQYGSVSDTWLQQRSMNR

SEQ ID NO: 11348 - protein, 28 aa, Artificial Sequence
  Description of Artificial Sequence: Synthetic peptide
DENEIRTTNPVATEPYGSVSANLQRGTW

SEQ ID NO: 11349 - protein, 31 aa, Artificial Sequence
  Description of Artificial Sequence: Synthetic polypeptide
DENEIRTTNPVATEPYGSVCSCTNLSQRGNR

SEQ ID NO: 11350 - protein, 31 aa, Artificial Sequence
  Description of Artificial Sequence: Synthetic polypeptide
DEEEIRTTNPVATEQYGSVSTTGLNQRGNND

SEQ ID NO: 11351 - protein, 31 aa, Artificial Sequence
  Description of Artificial Sequence: Synthetic polypeptide
DEEEIRTTNPVATEQYGSVSTTGLQRFGERE

SEQ ID NO: 11352 - protein, 28 aa, Artificial Sequence
  Description of Artificial Sequence: Synthetic peptide
DENEIRTTNPVATEQWGSVSTNEMQGNR

SEQ ID NO: 11353 - protein, 31 aa, Artificial Sequence
  Description of Artificial Sequence: Synthetic polypeptide
DEEEIRTTNPVATEQYGSVSTTGLQRMGARQ

SEQ ID NO: 11354 - protein, 28 aa, Artificial Sequence
  Description of Artificial Sequence: Synthetic peptide
DENEIRTTNPVATEIYGSVSYNLQRGEI

SEQ ID NO: 11355 - protein, 28 aa, Artificial Sequence
  Description of Artificial Sequence: Synthetic peptide
DENEIRTTNPVATEIYGSVSVNLQRGTM

SEQ ID NO: 11356 - protein, 31 aa, Artificial Sequence
  Description of Artificial Sequence: Synthetic polypeptide
DEEEIRTTNPVATEQYGSVSDTVLYQRMQNR

SEQ ID NO: 11357 - protein, 30 aa, Artificial Sequence
  Description of Artificial Sequence: Synthetic polypeptide
DEEEIRTTNPVATEQYGSVCNTNMNRNGNR

SEQ ID NO: 11358 - protein, 28 aa, Artificial Sequence
  Description of Artificial Sequence: Synthetic peptide
DENEIRTTNPVATEIYGSVSSNLQRGTG

SEQ ID NO: 11359 - protein, 31 aa, Artificial Sequence
  Description of Artificial Sequence: Synthetic polypeptide
DEEEIRTTNPVATEQYGSVSTTGNLQRGLLE

SEQ ID NO: 11360 - protein, 31 aa, Artificial Sequence
  Description of Artificial Sequence: Synthetic polypeptide
DEEEIRTTNPVATEQYGSVSDTVLTQRSQNR

SEQ ID NO: 11361 - protein, 29 aa, Artificial Sequence
  Description of Artificial Sequence: Synthetic peptide
DEEEIRTTNPVATEQYGSVSTTGQSGVNE

SEQ ID NO: 11362 - protein, 31 aa, Artificial Sequence
  Description of Artificial Sequence: Synthetic polypeptide
DEEEIRTTNPVATEQYGSVSDTTLVQRSQNR

SEQ ID NO: 11363 - protein, 30 aa, Artificial Sequence
  Description of Artificial Sequence: Synthetic polypeptide
DEEEIRTTNPVATEQYGSVCPTNLQPGNEE

SEQ ID NO: 11364 - protein, 31 aa, Artificial Sequence
  Description of Artificial Sequence: Synthetic polypeptide
DEEEIRTTNPVATEQYGSVSDTSNGLQEGNG

SEQ ID NO: 11365 - protein, 31 aa, Artificial Sequence
  Description of Artificial Sequence: Synthetic polypeptide
DEEEIRTTNPVATEQYGSVSDTSLYQRSTNR

SEQ ID NO: 11366 - protein, 31 aa, Artificial Sequence
  Description of Artificial Sequence: Synthetic polypeptide
DEEEIRTTNPVATEQYGSVSDTSLQRQLNER

SEQ ID NO: 11367 - protein, 31 aa, Artificial Sequence
  Description of Artificial Sequence: Synthetic polypeptide
DEEEIRTTNPVATEQYGSVSTTGLQRSGTRA

SEQ ID NO: 11368 - protein, 29 aa, Artificial Sequence
  Description of Artificial Sequence: Synthetic peptide
DENEIRTTNPVATEQWGSVSTNLQMVGNF

SEQ ID NO: 11369 - protein, 28 aa, Artificial Sequence
  Description of Artificial Sequence: Synthetic peptide
DENEIRTTNPVATEQYGATSTNLQRGDD

SEQ ID NO: 11370 - protein, 30 aa, Artificial Sequence
  Description of Artificial Sequence: Synthetic polypeptide
DEEEIRTTNPVATEQYGSVSTTDLQRDSRS

SEQ ID NO: 11371 - protein, 31 aa, Artificial Sequence
  Description of Artificial Sequence: Synthetic polypeptide
DEEEIRTTNPVATEQYGSVCITENLQRGLRQ

SEQ ID NO: 11372 - protein, 31 aa, Artificial Sequence
  Description of Artificial Sequence: Synthetic polypeptide
DENEIRTTNPVATEQYGSVCSTNLQRSGNLM

SEQ ID NO: 11373 - protein, 29 aa, Artificial Sequence
  Description of Artificial Sequence: Synthetic peptide
CEEEIRYTNPVATEQYGQVSTNLQQRGNC

SEQ ID NO: 11374 - protein, 29 aa, Artificial Sequence
  Description of Artificial Sequence: Synthetic peptide
DENEIRTTNPVATEQYGSVCSTNLQNGVA

SEQ ID NO: 11375 - protein, 31 aa, Artificial Sequence
  Description of Artificial Sequence: Synthetic polypeptide
DEEEIRTTNPVATEQYGSVSTSNVLQQGNEP

SEQ ID NO: 11376 - protein, 30 aa, Artificial Sequence
  Description of Artificial Sequence: Synthetic polypeptide
DEEEIRTTNPVATEQYGSVSEFLQRGVNDD

SEQ ID NO: 11377 - protein, 29 aa, Artificial Sequence
  Description of Artificial Sequence: Synthetic peptide
DEEEIRTTNPVATEQYGSVCITNEQLGNQ

SEQ ID NO: 11378 - protein, 29 aa, Artificial Sequence
  Description of Artificial Sequence: Synthetic peptide
DENEIRTTNPVATEQYGSVATNLQGGNVM

SEQ ID NO: 11379 - protein, 30 aa, Artificial Sequence
  Description of Artificial Sequence: Synthetic polypeptide
DEEEIRTTNPVATEQYGSVSEDPLQRDNQR

SEQ ID NO: 11380 - protein, 29 aa, Artificial Sequence
  Description of Artificial Sequence: Synthetic peptide
DEEEIATTNPVAYEQYGSVATALQREGNR

SEQ ID NO: 11381 - protein, 30 aa, Artificial Sequence
  Description of Artificial Sequence: Synthetic polypeptide
DEEEIRTTNPVATEQYGSVSTSTLQAGNGT

SEQ ID NO: 11382 - protein, 30 aa, Artificial Sequence
  Description of Artificial Sequence: Synthetic polypeptide
DEEEIRTTNPVATEQYGSVCMTNDQRGNLN

SEQ ID NO: 11383 - protein, 30 aa, Artificial Sequence
  Description of Artificial Sequence: Synthetic polypeptide
DEEEIRTTNPVATEQYGSVSEDNLQEGNGE

SEQ ID NO: 11384 - protein, 31 aa, Artificial Sequence
  Description of Artificial Sequence: Synthetic polypeptide
DEEEIRTTNPVATEQYGSVCMTNPQRGSNPR

SEQ ID NO: 11385 - protein, 30 aa, Artificial Sequence
  Description of Artificial Sequence: Synthetic polypeptide
DENEIRTTNPVATEQYGSCSTNLEQMRGDR

SEQ ID NO: 11386 - protein, 28 aa, Artificial Sequence
  Description of Artificial Sequence: Synthetic peptide
DEEEIRTTNPVATEQYGSVSEDLCAGNN

SEQ ID NO: 11387 - protein, 29 aa, Artificial Sequence
  Description of Artificial Sequence: Synthetic peptide
DENEIRTTNPVATEQYGSASTNEQREGLR

SEQ ID NO: 11388 - protein, 28 aa, Artificial Sequence
  Description of Artificial Sequence: Synthetic peptide
DEEEIRTTNPVATEQYGSVSEALERGQE

SEQ ID NO: 11389 - protein, 31 aa, Artificial Sequence
  Description of Artificial Sequence: Synthetic polypeptide
DEEEIRTTNPVATEQYGSVSTSVDLQRINNR

SEQ ID NO: 11390 - protein, 29 aa, Artificial Sequence
  Description of Artificial Sequence: Synthetic peptide
DEEEIRTTNPVATEQYGSVSTSVDQRTNQ

SEQ ID NO: 11391 - protein, 29 aa, Artificial Sequence
  Description of Artificial Sequence: Synthetic peptide
DEEEIRTTNPVATEQYGSVSEAGPMRGNR

SEQ ID NO: 11392 - protein, 30 aa, Artificial Sequence
  Description of Artificial Sequence: Synthetic polypeptide
DEEEIRTTNPVATEQYGSVSTSVLQGPGNT

SEQ ID NO: 11393 - protein, 29 aa, Artificial Sequence
  Description of Artificial Sequence: Synthetic peptide
DEEEIRTTNPVATEQYGSVSTTADQFNNR

SEQ ID NO: 11394 - protein, 28 aa, Artificial Sequence
  Description of Artificial Sequence: Synthetic peptide
DENEIRTTNPVATEQYGDVSTTLQRPNQ

SEQ ID NO: 11395 - protein, 31 aa, Artificial Sequence
  Description of Artificial Sequence: Synthetic polypeptide
DEEEIRTTNPVATEQYGSVSTTALEQRTTNR

SEQ ID NO: 11396 - protein, 31 aa, Artificial Sequence
  Description of Artificial Sequence: Synthetic polypeptide
DEEEIRTTNPVATEQYGSVSTTALNQRGNQL

SEQ ID NO: 11397 - protein, 29 aa, Artificial Sequence
  Description of Artificial Sequence: Synthetic peptide
DEEEIRTTNPVATEQYGSVSDVNLQRFDQ

SEQ ID NO: 11398 - protein, 29 aa, Artificial Sequence
  Description of Artificial Sequence: Synthetic peptide
DENEIRTTNPVATEQYGCVSTTLQNGSNR

SEQ ID NO: 11399 - protein, 28 aa, Artificial Sequence
  Description of Artificial Sequence: Synthetic peptide
DENEIRTTNPVATEQYGCVSTNSQSGND

SEQ ID NO: 11400 - protein, 28 aa, Artificial Sequence
  Description of Artificial Sequence: Synthetic peptide
DENEIRTTNPVATEQYGSVGTALIRENR

SEQ ID NO: 11401 - protein, 31 aa, Artificial Sequence
  Description of Artificial Sequence: Synthetic polypeptide
DEEEIRTTNPVATEQYGSVSTNDQFRGNNQL

SEQ ID NO: 11402 - protein, 29 aa, Artificial Sequence
  Description of Artificial Sequence: Synthetic peptide
DEEEIRTTNPVATEQYGSCSINDDRGNVR

SEQ ID NO: 11403 - protein, 30 aa, Artificial Sequence
  Description of Artificial Sequence: Synthetic polypeptide
DEEEIRTTNPVATEQYGSYSLPNMLQRDNR

SEQ ID NO: 11404 - protein, 29 aa, Artificial Sequence
  Description of Artificial Sequence: Synthetic peptide
DEEEIRTTNPVATEQYGSVSTDQQVGNNA

SEQ ID NO: 11405 - protein, 32 aa, Artificial Sequence
  Description of Artificial Sequence: Synthetic polypeptide
DEEEIRTTNPVATEQYGSVSTDSLDQDRGNRI

SEQ ID NO: 11406 - protein, 32 aa, Artificial Sequence
  Description of Artificial Sequence: Synthetic polypeptide
DEEEIRTTNPVATEQYGSVSTDSLVQERGNRD

SEQ ID NO: 11407 - protein, 29 aa, Artificial Sequence
  Description of Artificial Sequence: Synthetic peptide
DEEEIRTTNPVATEQYGSVSTDSPQRGEE

SEQ ID NO: 11408 - protein, 28 aa, Artificial Sequence
  Description of Artificial Sequence: Synthetic peptide
SEEEIRCTNPVATEQYGSVATNLQAGNH

SEQ ID NO: 11409 - protein, 28 aa, Artificial Sequence
  Description of Artificial Sequence: Synthetic peptide
AEEEIRCTNPIATEQYGSVSENLMRGNR

SEQ ID NO: 11410 - protein, 28 aa, Artificial Sequence
  Description of Artificial Sequence: Synthetic peptide
SEEEIRCTNPVATEQYGSASENLMRGNR

SEQ ID NO: 11411 - protein, 28 aa, Artificial Sequence
  Description of Artificial Sequence: Synthetic peptide
SEEEIRCTNPVATEQYGSAPENLQRGNR

SEQ ID NO: 11412 - protein, 29 aa, Artificial Sequence
  Description of Artificial Sequence: Synthetic peptide
DEEEIRTTNPIATEQYGSVSCNLMREGNG

SEQ ID NO: 11413 - protein, 30 aa, Artificial Sequence
  Description of Artificial Sequence: Synthetic polypeptide
DEEEIRTTNPIATEQYGSVSCNEPQREGNR

SEQ ID NO: 11414 - protein, 28 aa, Artificial Sequence
  Description of Artificial Sequence: Synthetic peptide
AEEEIRCTNPIATEQYGSVSENLGRGNR

SEQ ID NO: 11415 - protein, 28 aa, Artificial Sequence
  Description of Artificial Sequence: Synthetic peptide
AEEEIRCTNPIATEQYGEVSENLQRGNR

SEQ ID NO: 11416 - protein, 29 aa, Artificial Sequence
  Description of Artificial Sequence: Synthetic peptide
DEEEIRTTNPVATEQYGSVSITPDQDSNR

SEQ ID NO: 11417 - protein, 31 aa, Artificial Sequence
  Description of Artificial Sequence: Synthetic polypeptide
DEEEIRTTNPVATEQYGCVDSTNLQRGSNIN

SEQ ID NO: 11418 - protein, 31 aa, Artificial Sequence
  Description of Artificial Sequence: Synthetic polypeptide
DEEEIRTTNPVATEQYGCVDSTNLQSGDNRM

SEQ ID NO: 11419 - protein, 31 aa, Artificial Sequence
  Description of Artificial Sequence: Synthetic polypeptide
DEEEIRTTNPVATEQYGSVSNDNSLQRGNAE

SEQ ID NO: 11420 - protein, 28 aa, Artificial Sequence
  Description of Artificial Sequence: Synthetic peptide
SEEEIRCTNPVATEQYGSVSEILMRGNR

SEQ ID NO: 11421 - protein, 28 aa, Artificial Sequence
  Description of Artificial Sequence: Synthetic peptide
SEEEIRCTNPVATEQYGSVSENEMRGNR

SEQ ID NO: 11422 - protein, 28 aa, Artificial Sequence
  Description of Artificial Sequence: Synthetic peptide
DEEEIRTTNPIATEQYGSVSEDLERGER

SEQ ID NO: 11423 - protein, 28 aa, Artificial Sequence
  Description of Artificial Sequence: Synthetic peptide
SEEEIRCTNPVATEQYGSVSETLMRGNR

SEQ ID NO: 11424 - protein, 29 aa, Artificial Sequence
  Description of Artificial Sequence: Synthetic peptide
DEEEIRTTNPIATEQYGSVSENGMRGNPR

SEQ ID NO: 11425 - protein, 29 aa, Artificial Sequence
  Description of Artificial Sequence: Synthetic peptide
SEEEIRCTNPVATEQYGSVSENLVMRGNR

SEQ ID NO: 11426 - protein, 28 aa, Artificial Sequence
  Description of Artificial Sequence: Synthetic peptide
TEEEIRTTNPVATEQYGSMSTHLQRVGR

SEQ ID NO: 11427 - protein, 29 aa, Artificial Sequence
  Description of Artificial Sequence: Synthetic peptide
SEEEIRCTNPVATEQYGSVSENLVERGNR

SEQ ID NO: 11428 - protein, 29 aa, Artificial Sequence
  Description of Artificial Sequence: Synthetic peptide
SEEEIRCTNPVATEQYGSVSENLPMRGNR

SEQ ID NO: 11429 - protein, 29 aa, Artificial Sequence
  Description of Artificial Sequence: Synthetic peptide
DEEEIRTTNPVATEQYGSVSTDQQEGNDP

SEQ ID NO: 11430 - protein, 31 aa, Artificial Sequence
  Description of Artificial Sequence: Synthetic polypeptide
DEEEIRTTNPVATEQYGSVSPTSLLQPGSNR

SEQ ID NO: 11431 - protein, 28 aa, Artificial Sequence
  Description of Artificial Sequence: Synthetic peptide
SEEEIRCTNPVATEQYGSVSENLMRGGR

SEQ ID NO: 11432 - protein, 28 aa, Artificial Sequence
  Description of Artificial Sequence: Synthetic peptide
SEEEIRCTNPVATEQYGSVSENLMRENR

SEQ ID NO: 11433 - protein, 28 aa, Artificial Sequence
  Description of Artificial Sequence: Synthetic peptide
SEEEIRCTNPVATEQYGSVSENLMFGNR

SEQ ID NO: 11434 - protein, 28 aa, Artificial Sequence
  Description of Artificial Sequence: Synthetic peptide
SEEEIRCTNPVATEQYGSVSENLMAGNR

SEQ ID NO: 11435 - protein, 28 aa, Artificial Sequence
  Description of Artificial Sequence: Synthetic peptide
TEEEIRTTNPVATEQYGSTSTALQRQER

SEQ ID NO: 11436 - protein, 28 aa, Artificial Sequence
  Description of Artificial Sequence: Synthetic peptide
AEEEIRCTNPVATEQYGEVSENLMRGNR

SEQ ID NO: 11437 - protein, 31 aa, Artificial Sequence
  Description of Artificial Sequence: Synthetic polypeptide
DEEEIRTTNPVATEQYGAYTDSTNELQRGNR

SEQ ID NO: 11438 - protein, 28 aa, Artificial Sequence
  Description of Artificial Sequence: Synthetic peptide
SEEEIRCTNPVATEQYGSVSENGMRGNR

SEQ ID NO: 11439 - protein, 28 aa, Artificial Sequence
  Description of Artificial Sequence: Synthetic peptide
SEEEIRCTNPVATEQYGSVSENLMRGER

SEQ ID NO: 11440 - protein, 31 aa, Artificial Sequence
  Description of Artificial Sequence: Synthetic polypeptide
DEEEIRTTNPVATEQYGCVDSTNLQYGSNRQ

SEQ ID NO: 11441 - protein, 30 aa, Artificial Sequence
  Description of Artificial Sequence: Synthetic polypeptide
DEEEIRTTNPVATEQYGSVSPTQLQRSNVA

SEQ ID NO: 11442 - protein, 30 aa, Artificial Sequence
  Description of Artificial Sequence: Synthetic polypeptide
DEEEIRTTNPVATEQYGSVSPTQLQRQERI

SEQ ID NO: 11443 - protein, 28 aa, Artificial Sequence
  Description of Artificial Sequence: Synthetic peptide
SEEEIRCTNPSATEQYGSVSCNLMRGNR

SEQ ID NO: 11444 - protein, 28 aa, Artificial Sequence
  Description of Artificial Sequence: Synthetic peptide
SEEEIRCTNPQATEQYGSVSENLMRGNR

SEQ ID NO: 11445 - protein, 28 aa, Artificial Sequence
  Description of Artificial Sequence: Synthetic peptide
SEEEIRCTNPNATEQYGSVSENLMRGNR

SEQ ID NO: 11446 - protein, 28 aa, Artificial Sequence
  Description of Artificial Sequence: Synthetic peptide
SEEEIRCTNPMATEQYGSVSENLMRGNR

SEQ ID NO: 11447 - protein, 31 aa, Artificial Sequence
  Description of Artificial Sequence: Synthetic polypeptide
DEEEIRTTNPVATEQYGSVSTEADLQRIGER

SEQ ID NO: 11448 - protein, 28 aa, Artificial Sequence
  Description of Artificial Sequence: Synthetic peptide
SEEEIRCTNPLATEQYGSVSENLMRGNR

SEQ ID NO: 11449 - protein, 30 aa, Artificial Sequence
  Description of Artificial Sequence: Synthetic polypeptide
DEEEIRTTNPVATEQYGSVSTEAGPMRGNR

SEQ ID NO: 11450 - protein, 28 aa, Artificial Sequence
  Description of Artificial Sequence: Synthetic peptide
SEEEIRCTNPSATEQYGSVSENLMRGNR

SEQ ID NO: 11451 - protein, 30 aa, Artificial Sequence
  Description of Artificial Sequence: Synthetic polypeptide
DEEEIRTTNPVATEQYGCVGTGNLQYGNRD

SEQ ID NO: 11452 - protein, 28 aa, Artificial Sequence
  Description of Artificial Sequence: Synthetic peptide
TEEEIRTTNPVATEQYGSVATALQSGVR

SEQ ID NO: 11453 - protein, 28 aa, Artificial Sequence
  Description of Artificial Sequence: Synthetic peptide
TEEEIRTTNPVATEQYGSVATALQYGFR

SEQ ID NO: 11454 - protein, 30 aa, Artificial Sequence
  Description of Artificial Sequence: Synthetic polypeptide
DEEEIRTTNPVATEQYGCVGWTNLMRGENR

SEQ ID NO: 11455 - protein, 29 aa, Artificial Sequence
  Description of Artificial Sequence: Synthetic peptide
DEEEIRTTNPVATEQYGSVSTEDLEGGNH

SEQ ID NO: 11456 - protein, 29 aa, Artificial Sequence
  Description of Artificial Sequence: Synthetic peptide
TEEEIRTTNPVATEQYGSVATNHSQRGNM

SEQ ID NO: 11457 - protein, 30 aa, Artificial Sequence
  Description of Artificial Sequence: Synthetic polypeptide
DEEEIRTTNPVATEQYGSVSTEDLEQQGND

SEQ ID NO: 11458 - protein, 31 aa, Artificial Sequence
  Description of Artificial Sequence: Synthetic polypeptide
DEEEIRTTNPVATEQYGSVSTEDLQRFGFER

SEQ ID NO: 11459 - protein, 28 aa, Artificial Sequence
  Description of Artificial Sequence: Synthetic peptide
DEEEIRTTNPVATEQYGCVGTNLQNGDQ

SEQ ID NO: 11460 - protein, 28 aa, Artificial Sequence
  Description of Artificial Sequence: Synthetic peptide
SEEEIRCTNPVATEQYGSVSETLQHGNR

SEQ ID NO: 11461 - protein, 28 aa, Artificial Sequence
  Description of Artificial Sequence: Synthetic peptide
DEDEIRTTNPVATEQYGYTSTNLQRGDD

SEQ ID NO: 11462 - protein, 30 aa, Artificial Sequence
  Description of Artificial Sequence: Synthetic polypeptide
DEDEIRTTNPVATEQYGWVSATDLQRGNLR

SEQ ID NO: 11463 - protein, 30 aa, Artificial Sequence
  Description of Artificial Sequence: Synthetic polypeptide
DEEEIRTTNPIATEQYGSVIATNLQRGNTA

SEQ ID NO: 11464 - protein, 30 aa, Artificial Sequence
  Description of Artificial Sequence: Synthetic polypeptide
DEEEIRTTNPVATEQYGSVSNGNLQQGGNI

SEQ ID NO: 11465 - protein, 30 aa, Artificial Sequence
  Description of Artificial Sequence: Synthetic polypeptide
DEEEIRTTNPVATEQYGSVSPTPNMQRPNQ

SEQ ID NO: 11466 - protein, 29 aa, Artificial Sequence
  Description of Artificial Sequence: Synthetic peptide
SEEEIRCTNPVATEMYGSVSTNLQNGNRQ

SEQ ID NO: 11467 - protein, 31 aa, Artificial Sequence
  Description of Artificial Sequence: Synthetic polypeptide
DEEEIRTTNPVATEQYGCVDSTNLQYSGNRM

SEQ ID NO: 11468 - protein, 29 aa, Artificial Sequence
  Description of Artificial Sequence: Synthetic peptide
AEEEIRATNPVATEQYGSVATNLQRENRV

SEQ ID NO: 11469 - protein, 31 aa, Artificial Sequence
  Description of Artificial Sequence: Synthetic polypeptide
DEEEIRTTNPVATEQYGSVSNLNSLQRGNIE

SEQ ID NO: 11470 - protein, 28 aa, Artificial Sequence
  Description of Artificial Sequence: Synthetic peptide
SEEEIRCTNPSATEQYGSVSENLVRGNR

SEQ ID NO: 11471 - protein, 30 aa, Artificial Sequence
  Description of Artificial Sequence: Synthetic polypeptide
DEEEIRTTNPVATEQYGCVEDTNLQRGNAT

SEQ ID NO: 11472 - protein, 30 aa, Artificial Sequence
  Description of Artificial Sequence: Synthetic polypeptide
DEEEIRTTNPVATEQYGSVSITNVQEGGNM

SEQ ID NO: 11473 - protein, 28 aa, Artificial Sequence
  Description of Artificial Sequence: Synthetic peptide
SEEEIRCTNPTATEQYGSVSENLMRGNR

SEQ ID NO: 11474 - protein, 30 aa, Artificial Sequence
  Description of Artificial Sequence: Synthetic polypeptide
DEEEIRTTNPVATEQYGSVSITNTQNGGNS

SEQ ID NO: 11475 - protein, 31 aa, Artificial Sequence
  Description of Artificial Sequence: Synthetic polypeptide
DEEEIRTTNPVATEQYGAVSYTNLQRGSERF

SEQ ID NO: 11476 - protein, 30 aa, Artificial Sequence
  Description of Artificial Sequence: Synthetic polypeptide
DEEEIRTTNPVATEQYGSVSPTPLQRLQSR

SEQ ID NO: 11477 - protein, 30 aa, Artificial Sequence
  Description of Artificial Sequence: Synthetic polypeptide
TEEEIRTTNPVATEQYGSTVSTNLTRVGDR

SEQ ID NO: 11478 - protein, 31 aa, Artificial Sequence
  Description of Artificial Sequence: Synthetic polypeptide
DEEEIRTTNPVATEQYGAVSWTNPLNRGMNR

SEQ ID NO: 11479 - protein, 31 aa, Artificial Sequence
  Description of Artificial Sequence: Synthetic polypeptide
DEEEIRTTNPVATEQYGSVSPTPNLQQRLQR

SEQ ID NO: 11480 - protein, 29 aa, Artificial Sequence
  Description of Artificial Sequence: Synthetic peptide
DEEEIRTTNPIATEQYGSVSENLMNRENR

SEQ ID NO: 11481 - protein, 28 aa, Artificial Sequence
  Description of Artificial Sequence: Synthetic peptide
SEEEIRCTNPVATEQYGSVSSNLQRGDI

SEQ ID NO: 11482 - protein, 30 aa, Artificial Sequence
  Description of Artificial Sequence: Synthetic polypeptide
TEEEIRTTNPVATEQYGSIVSTNLTRGGPR

SEQ ID NO: 11483 - protein, 28 aa, Artificial Sequence
  Description of Artificial Sequence: Synthetic peptide
DEEEIRTTNPIATEQYGSVSYNSFRGND

SEQ ID NO: 11484 - protein, 31 aa, Artificial Sequence
  Description of Artificial Sequence: Synthetic polypeptide
DEEEIRTTNPVATEQYGSVSPTTNLTRGNNP

SEQ ID NO: 11485 - protein, 28 aa, Artificial Sequence
  Description of Artificial Sequence: Synthetic peptide
SEEEIRSTNPVATEQYGVVSDNLQSGNR

SEQ ID NO: 11486 - protein, 28 aa, Artificial Sequence
  Description of Artificial Sequence: Synthetic peptide
SEEEIRSTNPVATEQYGVVSDNLQRGNQ

SEQ ID NO: 11487 - protein, 31 aa, Artificial Sequence
  Description of Artificial Sequence: Synthetic polypeptide
DEEEIRTTNPVATEQYGSVSPTTNLQRQNYE

SEQ ID NO: 11488 - protein, 28 aa, Artificial Sequence
  Description of Artificial Sequence: Synthetic peptide
SEEEIRSTNPVATEQYGVVSDNLMRGNR

SEQ ID NO: 11489 - protein, 30 aa, Artificial Sequence
  Description of Artificial Sequence: Synthetic polypeptide
TEEEIRTTNPVATEQYGCVCSTNLQRGNDP

SEQ ID NO: 11490 - protein, 30 aa, Artificial Sequence
  Description of Artificial Sequence: Synthetic polypeptide
DEEEIRTTNPVATEQYGCIVSTELQHGNRS

SEQ ID NO: 11491 - protein, 30 aa, Artificial Sequence
  Description of Artificial Sequence: Synthetic polypeptide
TEEEIRTTNPVATEQYGCVCSTVNLQRGND

SEQ ID NO: 11492 - protein, 31 aa, Artificial Sequence
  Description of Artificial Sequence: Synthetic polypeptide
TEEEIRTTNPVATEQYGCVSCTNLSQRGSNR

SEQ ID NO: 11493 - protein, 32 aa, Artificial Sequence
  Description of Artificial Sequence: Synthetic polypeptide
DEEEIRTTNPVATEQYGSVSPTTNLQRGNVLE

SEQ ID NO: 11494 - protein, 32 aa, Artificial Sequence
  Description of Artificial Sequence: Synthetic polypeptide
DEEEIRTTNPVATEQYGSVSITVNLQRGEQRD

SEQ ID NO: 11495 - protein, 30 aa, Artificial Sequence
  Description of Artificial Sequence: Synthetic polypeptide
TEEEIRTTNPVATEQYGCVSTNHQRGSNFR

SEQ ID NO: 11496 - protein, 30 aa, Artificial Sequence
  Description of Artificial Sequence: Synthetic polypeptide
TEEEIRTTNPVATEQYGCVSTNLQEGGNRM

SEQ ID NO: 11497 - protein, 32 aa, Artificial Sequence
  Description of Artificial Sequence: Synthetic polypeptide
DEEEIRTTNPVATEQYGSVSPTTNLQRGNSLF

SEQ ID NO: 11498 - protein, 32 aa, Artificial Sequence
  Description of Artificial Sequence: Synthetic polypeptide
DEEEIRTTNPVATEQYGSVSPTTNLQRGNLNA

SEQ ID NO: 11499 - protein, 31 aa, Artificial Sequence
  Description of Artificial Sequence: Synthetic polypeptide
DEEEIRTTNPVATEQYGCISTNLSQRGGNER

SEQ ID NO: 11500 - protein, 28 aa, Artificial Sequence
  Description of Artificial Sequence: Synthetic peptide
DEEEIRTTNPIATEQYGSVSVNIIRGND

SEQ ID NO: 11501 - protein, 30 aa, Artificial Sequence
  Description of Artificial Sequence: Synthetic polypeptide
DEEEIRTTNPVATEQYGSVSNCNDLQRVNS

SEQ ID NO: 11502 - protein, 28 aa, Artificial Sequence
  Description of Artificial Sequence: Synthetic peptide
SEEEIRSTNPVATEVYGSVSTNLQRGTY

SEQ ID NO: 11503 - protein, 30 aa, Artificial Sequence
  Description of Artificial Sequence: Synthetic polypeptide
DEEEIRTTNPVATEQYGSVSTDNLQTVGPV

SEQ ID NO: 11504 - protein, 31 aa, Artificial Sequence
  Description of Artificial Sequence: Synthetic polypeptide
DEEEIRTTNPVATEQYGSVSKTDLSQREQNR

SEQ ID NO: 11505 - protein, 29 aa, Artificial Sequence
  Description of Artificial Sequence: Synthetic peptide
AEEEIRTTNPVATEAYGSVSTNLQCGNNI

SEQ ID NO: 11506 - protein, 28 aa, Artificial Sequence
  Description of Artificial Sequence: Synthetic peptide
SEEEIRTTNPIATEQWGSVSCNLMRGNR

SEQ ID NO: 11507 - protein, 28 aa, Artificial Sequence
  Description of Artificial Sequence: Synthetic peptide
AEEEIRTTNPVATEAYGSVSTNLNRGES

SEQ ID NO: 11508 - protein, 31 aa, Artificial Sequence
  Description of Artificial Sequence: Synthetic polypeptide
DEEEIRTTNPVATEQYGSVSPTVLQRGQQRD

SEQ ID NO: 11509 - protein, 29 aa, Artificial Sequence
  Description of Artificial Sequence: Synthetic peptide
DEEEIRTTNPIATEQYGTVSAENLMRGNR

SEQ ID NO: 11510 - protein, 28 aa, Artificial Sequence
  Description of Artificial Sequence: Synthetic peptide
DEEEIRTTNPIATEQYGSVSYNVERGND

SEQ ID NO: 11511 - protein, 29 aa, Artificial Sequence
  Description of Artificial Sequence: Synthetic peptide
DEEEIRTTNPVATEQYGSVSMVDLQRVER

SEQ ID NO: 11512 - protein, 30 aa, Artificial Sequence
  Description of Artificial Sequence: Synthetic polypeptide
DEEEIRTTNPVATEQYGSVSPTVLARLGNL

SEQ ID NO: 11513 - protein, 29 aa, Artificial Sequence
  Description of Artificial Sequence: Synthetic peptide
AEEEIRTTNPVATEAYGSVSSSNLQRGNA

SEQ ID NO: 11514 - protein, 29 aa, Artificial Sequence
  Description of Artificial Sequence: Synthetic peptide
AEEEIRTTNPVATEAYGSVISTNLQSGNT

SEQ ID NO: 11515 - protein, 28 aa, Artificial Sequence
  Description of Artificial Sequence: Synthetic peptide
DEECIRSTNPVATEQYGSVSWNFQRGNL

SEQ ID NO: 11516 - protein, 30 aa, Artificial Sequence
  Description of Artificial Sequence: Synthetic polypeptide
DEEEIRTTNPVATEQYGSVSIVNLQMGNNM

SEQ ID NO: 11517 - protein, 28 aa, Artificial Sequence
  Description of Artificial Sequence: Synthetic peptide
SEEEIRSTNPVCTEQYGSVSENLQRGNQ

SEQ ID NO: 11518 - protein, 28 aa, Artificial Sequence
  Description of Artificial Sequence: Synthetic peptide
DEEEIRTTNPVATEQYGSVSNALQTGPF

SEQ ID NO: 11519 - protein, 29 aa, Artificial Sequence
  Description of Artificial Sequence: Synthetic peptide
DEEEIRTTNPVATEQYGSVSIYNLQRVVQ

SEQ ID NO: 11520 - protein, 30 aa, Artificial Sequence
  Description of Artificial Sequence: Synthetic polypeptide
DEEEIRTTNPVATEQYGSVSTEDLTQHGNG

SEQ ID NO: 11521 - protein, 31 aa, Artificial Sequence
  Description of Artificial Sequence: Synthetic polypeptide
DEEEIRTTNPVATEQYGSVSPTTNLQQGDRM

SEQ ID NO: 11522 - protein, 30 aa, Artificial Sequence
  Description of Artificial Sequence: Synthetic polypeptide
TEEEIRTTNPVATEQYGISVSTNASQRGSR

SEQ ID NO: 11523 - protein, 30 aa, Artificial Sequence
  Description of Artificial Sequence: Synthetic polypeptide
DEEEIRTTNPVATEQYGSVSTDNVQELGNV

SEQ ID NO: 11524 - protein, 28 aa, Artificial Sequence
  Description of Artificial Sequence: Synthetic peptide
SEEEIRCTNPVGTEQYGVVSSNLQRGNR

SEQ ID NO: 11525 - protein, 30 aa, Artificial Sequence
  Description of Artificial Sequence: Synthetic polypeptide
TEEEIRTTNPVATEQYGQSVSCTNLVGGNR

SEQ ID NO: 11526 - protein, 28 aa, Artificial Sequence
  Description of Artificial Sequence: Synthetic peptide
SEEEIRCTNPVGTEQYGSVSSNLMRGNR

SEQ ID NO: 11527 - protein, 29 aa, Artificial Sequence
  Description of Artificial Sequence: Synthetic peptide
DEEEIRTTNPIATEQYGSVSSENLNRGNV

SEQ ID NO: 11528 - protein, 30 aa, Artificial Sequence
  Description of Artificial Sequence: Synthetic polypeptide
DEEEIRTTNPVATEQYGSVSNDNLQFGNNP

SEQ ID NO: 11529 - protein, 28 aa, Artificial Sequence
  Description of Artificial Sequence: Synthetic peptide
SEEEIRCTNPVCTEQYGSVSENLMRGNR

SEQ ID NO: 11530 - protein, 29 aa, Artificial Sequence
  Description of Artificial Sequence: Synthetic peptide
DEEEIRTTNPVATEQYGCVCTNLDIGGNR

SEQ ID NO: 11531 - protein, 28 aa, Artificial Sequence
  Description of Artificial Sequence: Synthetic peptide
SEEEIRCTNPVATEQYGVVSENLQSGNR

SEQ ID NO: 11532 - protein, 28 aa, Artificial Sequence
  Description of Artificial Sequence: Synthetic peptide
SEEEIRCTNPVATEQYGVVSENLMRGNR

SEQ ID NO: 11533 - protein, 28 aa, Artificial Sequence
  Description of Artificial Sequence: Synthetic peptide
SEEEIRCTNPVATEQYGVVSDNLMRGNR

SEQ ID NO: 11534 - protein, 28 aa, Artificial Sequence
  Description of Artificial Sequence: Synthetic peptide
SEEEIRCTNPVATEQYGTVSMNLMRGNR

SEQ ID NO: 11535 - protein, 29 aa, Artificial Sequence
  Description of Artificial Sequence: Synthetic peptide
SEEEIRCTNPVATEQYGSVSTNLQRVNQD

SEQ ID NO: 11536 - protein, 29 aa, Artificial Sequence
  Description of Artificial Sequence: Synthetic peptide
SEEEIRCTNPVATEQYGSVSTNLQRENIA

SEQ ID NO: 11537 - protein, 30 aa, Artificial Sequence
  Description of Artificial Sequence: Synthetic polypeptide
DEEEIRTTNPVATEQYGSVSNDNLQGPGNL

SEQ ID NO: 11538 - protein, 30 aa, Artificial Sequence
  Description of Artificial Sequence: Synthetic polypeptide
AEEEIRCTNPVATEQYGSVSTNLQRGNQDS

SEQ ID NO: 11539 - protein, 29 aa, Artificial Sequence
  Description of Artificial Sequence: Synthetic peptide
TEEEIRTTNPVATEQYGSCSTPLQRGNDN

SEQ ID NO: 11540 - protein, 30 aa, Artificial Sequence
  Description of Artificial Sequence: Synthetic polypeptide
TEEEIRTTNPVATEQYGISVSTGNLQQGND

SEQ ID NO: 11541 - protein, 31 aa, Artificial Sequence
  Description of Artificial Sequence: Synthetic polypeptide
DEEEIRTTNPVATEQYGSVSITSNLQGEGNT

SEQ ID NO: 11542 - protein, 28 aa, Artificial Sequence
  Description of Artificial Sequence: Synthetic peptide
SEEEIRGTNPIATEQYGSVSENLMRGNR

SEQ ID NO: 11543 - protein, 30 aa, Artificial Sequence
  Description of Artificial Sequence: Synthetic polypeptide
DEEEIRTTNPVATEQYGSVSTDNPQIGQNM

SEQ ID NO: 11544 - protein, 31 aa, Artificial Sequence
  Description of Artificial Sequence: Synthetic polypeptide
TEEEIRTTNPVATEQYGISVSTNVSQRGSNR

SEQ ID NO: 11545 - protein, 31 aa, Artificial Sequence
  Description of Artificial Sequence: Synthetic polypeptide
DEEEIRTTNPIATEQYGSVSTTNLPMRNGNR

SEQ ID NO: 11546 - protein, 30 aa, Artificial Sequence
  Description of Artificial Sequence: Synthetic polypeptide
DEEEIRTTNPVATEQYGCEISTNELQRGER

SEQ ID NO: 11547 - protein, 28 aa, Artificial Sequence
  Description of Artificial Sequence: Synthetic peptide
SEEEIRSTNPIATEQYGVVSENLQRGNR

SEQ ID NO: 11548 - protein, 31 aa, Artificial Sequence
  Description of Artificial Sequence: Synthetic polypeptide
DEEEIRTTNPVATEQYGSVSPTTNLQPGNPQ

SEQ ID NO: 11549 - protein, 31 aa, Artificial Sequence
  Description of Artificial Sequence: Synthetic polypeptide
DEEEIRTTNPVATEQYGSVSPTTNLQPGNEL

SEQ ID NO: 11550 - protein, 31 aa, Artificial Sequence
  Description of Artificial Sequence: Synthetic polypeptide
DEEEIRTTNPIATEQYGSVSTENLPMRNGNR

SEQ ID NO: 11551 - protein, 28 aa, Artificial Sequence
  Description of Artificial Sequence: Synthetic peptide
SEEEIRSTNPIATEQYGSVSENLMRGNR

SEQ ID NO: 11552 - protein, 31 aa, Artificial Sequence
  Description of Artificial Sequence: Synthetic polypeptide
DEEEIRTTNPVATEQYGSVSPTTNLQMGNLL

SEQ ID NO: 11553 - protein, 31 aa, Artificial Sequence
  Description of Artificial Sequence: Synthetic polypeptide
DEEEIRTTNPVATEQYGSVSPTTNLPRGNPQ

SEQ ID NO: 11554 - protein, 31 aa, Artificial Sequence
  Description of Artificial Sequence: Synthetic polypeptide
DEEEIRTTNPVATEQYGSVSITTDQRGNDRD

SEQ ID NO: 11555 - protein, 28 aa, Artificial Sequence
  Description of Artificial Sequence: Synthetic peptide
SEEEIRQTNPIATEQYGSVSENLMRGNR

SEQ ID NO: 11556 - protein, 28 aa, Artificial Sequence
  Description of Artificial Sequence: Synthetic peptide
SEEEIRPTNPIATEQYGSVSENLMRGNR

SEQ ID NO: 11557 - protein, 28 aa, Artificial Sequence
  Description of Artificial Sequence: Synthetic peptide
SEEEIRPTNPIASEQYGSVSENLQRGNR

SEQ ID NO: 11558 - protein, 30 aa, Artificial Sequence
  Description of Artificial Sequence: Synthetic polypeptide
DEEEIRTTNPVATEQYGSVSTDNTQREQDR

SEQ ID NO: 11559 - protein, 30 aa, Artificial Sequence
  Description of Artificial Sequence: Synthetic polypeptide
DEEEIRTTNPVATEQYGSVSITVDLQEGDR

SEQ ID NO: 11560 - protein, 28 aa, Artificial Sequence
  Description of Artificial Sequence: Synthetic peptide
AEEEIRTTNPVATEAYGSVSTNLQGVNM

SEQ ID NO: 11561 - protein, 30 aa, Artificial Sequence
  Description of Artificial Sequence: Synthetic polypeptide
DEEEIRTTNPVATEQYGAVSTTNLQQGPNE

SEQ ID NO: 11562 - protein, 29 aa, Artificial Sequence
  Description of Artificial Sequence: Synthetic peptide
TEEEIRTTNPVATEQYGSVCTSLQPGGNR

SEQ ID NO: 11563 - protein, 28 aa, Artificial Sequence
  Description of Artificial Sequence: Synthetic peptide
DEDEIRTTNPVATTQYGCVSTNLERGND

SEQ ID NO: 11564 - protein, 31 aa, Artificial Sequence
  Description of Artificial Sequence: Synthetic polypeptide
DEEEIRTTNPVATEQYGAVSGTNLQRGGNNV

SEQ ID NO: 11565 - protein, 31 aa, Artificial Sequence
  Description of Artificial Sequence: Synthetic polypeptide
DEEEIRTTNPVATEQYGSVSPTNNQRVNEPR

SEQ ID NO: 11566 - protein, 29 aa, Artificial Sequence
  Description of Artificial Sequence: Synthetic peptide
SEEEIRCTNPIATEQYGSVSSNLQMRGNR

SEQ ID NO: 11567 - protein, 30 aa, Artificial Sequence
  Description of Artificial Sequence: Synthetic polypeptide
DEEEIRTTNPVATEQYGSVSPTNNQRSLNI

SEQ ID NO: 11568 - protein, 30 aa, Artificial Sequence
  Description of Artificial Sequence: Synthetic polypeptide
TEEEIRTTNPVATEQYGSVSTNLQNGSNPN

SEQ ID NO: 11569 - protein, 28 aa, Artificial Sequence
  Description of Artificial Sequence: Synthetic peptide
SEEEIRCTNPIATEQYGSVSSNLMRGNR

SEQ ID NO: 11570 - protein, 30 aa, Artificial Sequence
  Description of Artificial Sequence: Synthetic polypeptide
TEEEIRTTNPVATEQYGSVSTNLQQDGNQE

SEQ ID NO: 11571 - protein, 30 aa, Artificial Sequence
  Description of Artificial Sequence: Synthetic polypeptide
DEEEIRTTNPVATEQYGSVSPTNNQRNLNN

SEQ ID NO: 11572 - protein, 30 aa, Artificial Sequence
  Description of Artificial Sequence: Synthetic polypeptide
TEEEIRTTNPVATEQYGSVSTNLQRAANFY

SEQ ID NO: 11573 - protein, 31 aa, Artificial Sequence
  Description of Artificial Sequence: Synthetic polypeptide
DEEEIRTTNPVATEQYGSVSPTNNQRGNLVS

SEQ ID NO: 11574 - protein, 31 aa, Artificial Sequence
  Description of Artificial Sequence: Synthetic polypeptide
DEEEIRTTNPVATEQYGCVSDTLLDQRGSNR

SEQ ID NO: 11575 - protein, 31 aa, Artificial Sequence
  Description of Artificial Sequence: Synthetic polypeptide
DEEEIRTTNPVATEQYGSVSITNLTVRGNET

SEQ ID NO: 11576 - protein, 32 aa, Artificial Sequence
  Description of Artificial Sequence: Synthetic polypeptide
DEEEIRTTNPVATEQYGSVSTENELQVGSNRL

SEQ ID NO: 11577 - protein, 30 aa, Artificial Sequence
  Description of Artificial Sequence: Synthetic polypeptide
DEEAIRTTNPVATEQYYYSVSINLQRGDNR

SEQ ID NO: 11578 - protein, 31 aa, Artificial Sequence
  Description of Artificial Sequence: Synthetic polypeptide
DEEEIRTTNPVATEQYGAVSGTNLQRGNGNE

SEQ ID NO: 11579 - protein, 30 aa, Artificial Sequence
  Description of Artificial Sequence: Synthetic polypeptide
TEEEIRTTNPVATEQYGSVSTNLQMEGNES

SEQ ID NO: 11580 - protein, 29 aa, Artificial Sequence
  Description of Artificial Sequence: Synthetic peptide
DEEEIRTTNPVATEQYGSVSTENDQNNER

SEQ ID NO: 11581 - protein, 30 aa, Artificial Sequence
  Description of Artificial Sequence: Synthetic polypeptide
TEEEIRTTNPVATEQYGSVSTNLQGGGNQQ

SEQ ID NO: 11582 - protein, 28 aa, Artificial Sequence
  Description of Artificial Sequence: Synthetic peptide
SEEEIRCTNPIATEQYGSVSYNLMRGNR

SEQ ID NO: 11583 - protein, 32 aa, Artificial Sequence
  Description of Artificial Sequence: Synthetic polypeptide
DEEEIRTTNPVATEQYGCVSCTNLSQRGTNER

SEQ ID NO: 11584 - protein, 32 aa, Artificial Sequence
  Description of Artificial Sequence: Synthetic polypeptide
TEEEIRTTNPVATEQYGSVSTNALPQREGNER

SEQ ID NO: 11585 - protein, 31 aa, Artificial Sequence
  Description of Artificial Sequence: Synthetic polypeptide
DEEEIRTTNPVATEQYGSVSPTNPLQRGGFM

SEQ ID NO: 11586 - protein, 28 aa, Artificial Sequence
  Description of Artificial Sequence: Synthetic peptide
SEEEIRCTNPIATEQYGSVSVNLMRGNR

SEQ ID NO: 11587 - protein, 31 aa, Artificial Sequence
  Description of Artificial Sequence: Synthetic polypeptide
DEEEIRTTNPVATEQYGAVSNTNLQRGSERF

SEQ ID NO: 11588 - protein, 28 aa, Artificial Sequence
  Description of Artificial Sequence: Synthetic peptide
SEEEIRCTNPIATEQYGSVSVNLDRGNR

SEQ ID NO: 11589 - protein, 30 aa, Artificial Sequence
  Description of Artificial Sequence: Synthetic polypeptide
TEEEIRTTNPVATEQYGSVSTNLQRNDNDY

SEQ ID NO: 11590 - protein, 30 aa, Artificial Sequence
  Description of Artificial Sequence: Synthetic polypeptide
TEEEIRTTNPVATEQYGSVSTNELQEGGNP

SEQ ID NO: 11591 - protein, 29 aa, Artificial Sequence
  Description of Artificial Sequence: Synthetic peptide
SEEEIRCTNPIATEQYGSVSTNLMRNGNR

SEQ ID NO: 11592 - protein, 28 aa, Artificial Sequence
  Description of Artificial Sequence: Synthetic peptide
SEEEIRCTNPIATEQYGSVSTNLMRINR

SEQ ID NO: 11593 - protein, 29 aa, Artificial Sequence
  Description of Artificial Sequence: Synthetic peptide
SEEEIRCTNPIATEQYGSVSTNLMREGNR

SEQ ID NO: 11594 - protein, 28 aa, Artificial Sequence
  Description of Artificial Sequence: Synthetic peptide
SEEEIRCTNPIATEQYGSVSTNLERGNL

SEQ ID NO: 11595 - protein, 30 aa, Artificial Sequence
  Description of Artificial Sequence: Synthetic polypeptide
DEEEIRTTNPVATEQYGAVSNTNLNVGMNR

SEQ ID NO: 11596 - protein, 29 aa, Artificial Sequence
  Description of Artificial Sequence: Synthetic peptide
SEEEIRCTNPIATEQYGSVSTENLNRGNR

SEQ ID NO: 11597 - protein, 30 aa, Artificial Sequence
  Description of Artificial Sequence: Synthetic polypeptide
TEEEIRTTNPVATEQYGSVSTNLEQDGNDN

SEQ ID NO: 11598 - protein, 28 aa, Artificial Sequence
  Description of Artificial Sequence: Synthetic peptide
SEEEIRCTNPIATEQYGSVSTNLMWGNR

SEQ ID NO: 11599 - protein, 31 aa, Artificial Sequence
  Description of Artificial Sequence: Synthetic polypeptide
DEEEIRTTNPVATEQYGSVSITNLTQNGINE

SEQ ID NO: 11600 - protein, 31 aa, Artificial Sequence
  Description of Artificial Sequence: Synthetic polypeptide
DEEEIRTTNPVATEQYGAVQNTNLQRGSNRQ

SEQ ID NO: 11601 - protein, 30 aa, Artificial Sequence
  Description of Artificial Sequence: Synthetic polypeptide
DEEEIRTTNPVATEQYGCVSDTYLQRGIRT

SEQ ID NO: 11602 - protein, 30 aa, Artificial Sequence
  Description of Artificial Sequence: Synthetic polypeptide
DEEEIRTTNPVATEQYGATLSTYELQRGNR

SEQ ID NO: 11603 - protein, 30 aa, Artificial Sequence
  Description of Artificial Sequence: Synthetic polypeptide
DEEEIRTTNPVATEQYGATISTNLLQRGER

SEQ ID NO: 11604 - protein, 30 aa, Artificial Sequence
  Description of Artificial Sequence: Synthetic polypeptide
DEEEIRTTNPVATEQYGATISTNELQMGNR

SEQ ID NO: 11605 - protein, 31 aa, Artificial Sequence
  Description of Artificial Sequence: Synthetic polypeptide
TEEEIRTTNPVATEQYGSVSVTNLQHGGNYR

SEQ ID NO: 11606 - protein, 30 aa, Artificial Sequence
  Description of Artificial Sequence: Synthetic polypeptide
DEEEIRTTNPVATEQYGATISTEELQRGNR

SEQ ID NO: 11607 - protein, 31 aa, Artificial Sequence
  Description of Artificial Sequence: Synthetic polypeptide
TEEEIRTTNPVATEQYGSVSYANLSQRVGNR

SEQ ID NO: 11608 - protein, 28 aa, Artificial Sequence
  Description of Artificial Sequence: Synthetic peptide
SEEEIRCTNPIATEQYGSVSNNLMRGNR

SEQ ID NO: 11609 - protein, 28 aa, Artificial Sequence
  Description of Artificial Sequence: Synthetic peptide
SEEEIRCTNPIATEQYGSVSPNLMRGNR

SEQ ID NO: 11610 - protein, 31 aa, Artificial Sequence
  Description of Artificial Sequence: Synthetic polypeptide
TEEEIRTTNPVATEQYGSVSYTNLQRGGNNH

SEQ ID NO: 11611 - protein, 30 aa, Artificial Sequence
  Description of Artificial Sequence: Synthetic polypeptide
DEEEIRTTNPVATEQYGSVSTENLEGGNDP

SEQ ID NO: 11612 - protein, 30 aa, Artificial Sequence
  Description of Artificial Sequence: Synthetic polypeptide
DEEEIRTTNPVATEQYGASVSTNLIRGSSD

SEQ ID NO: 11613 - protein, 28 aa, Artificial Sequence
  Description of Artificial Sequence: Synthetic peptide
DEEEIRTTNPVATEQYGSVSNNDQRDEE

SEQ ID NO: 11614 - protein, 32 aa, Artificial Sequence
  Description of Artificial Sequence: Synthetic polypeptide
DEEEIRTTNPVATEQYGSVSTENLERFGNNRA

SEQ ID NO: 11615 - protein, 29 aa, Artificial Sequence
  Description of Artificial Sequence: Synthetic peptide
SEEEIRCTNPIATEQYGSVSMNLQMRGNR

SEQ ID NO: 11616 - protein, 28 aa, Artificial Sequence
  Description of Artificial Sequence: Synthetic peptide
SEEEIRCTNPIATEQYGSVSMNLMRGNR

SEQ ID NO: 11617 - protein, 31 aa, Artificial Sequence
  Description of Artificial Sequence: Synthetic polypeptide
TEEEIRTTNPVATEQYGSVYSCTNLQRGNTS

SEQ ID NO: 11618 - protein, 31 aa, Artificial Sequence
  Description of Artificial Sequence: Synthetic polypeptide
TEEEIRTTNPVATEQYGSVSYTNLQRGGSNH

SEQ ID NO: 11619 - protein, 30 aa, Artificial Sequence
  Description of Artificial Sequence: Synthetic polypeptide
TEEEIRTTNPVATEQYGSVSTENPQRGVRG

SEQ ID NO: 11620 - protein, 32 aa, Artificial Sequence
  Description of Artificial Sequence: Synthetic polypeptide
TEEEIRTTNPVATEQYGSVSTSNLIQRGENPR

SEQ ID NO: 11621 - protein, 28 aa, Artificial Sequence
  Description of Artificial Sequence: Synthetic peptide
SEEEIRCTNPIATEQYGSVSQNLMRGNR

SEQ ID NO: 11622 - protein, 31 aa, Artificial Sequence
  Description of Artificial Sequence: Synthetic polypeptide
DEEEIRTTNPVATEQYGSVSTENETRIGNRY

SEQ ID NO: 11623 - protein, 29 aa, Artificial Sequence
  Description of Artificial Sequence: Synthetic peptide
DEEEIRTTNPVATEQYGSVSTENFEGGNI

SEQ ID NO: 11624 - protein, 30 aa, Artificial Sequence
  Description of Artificial Sequence: Synthetic polypeptide
TEEEIRTTNPVATEQYGSVSTNLQRNENPY

SEQ ID NO: 11625 - protein, 29 aa, Artificial Sequence
  Description of Artificial Sequence: Synthetic peptide
DEEEIRTTNPVATEQYGCVSENLQRGEIY

SEQ ID NO: 11626 - protein, 31 aa, Artificial Sequence
  Description of Artificial Sequence: Synthetic polypeptide
DEEEIRTTNPVATEQYGSVSTENGLQESSNR

SEQ ID NO: 11627 - protein, 30 aa, Artificial Sequence
  Description of Artificial Sequence: Synthetic polypeptide
TEEEIRTTNPVATEQYGSVSTNLQRNLNFE

SEQ ID NO: 11628 - protein, 30 aa, Artificial Sequence
  Description of Artificial Sequence: Synthetic polypeptide
TEEEIRTTNPVATEQYGSVSTNLQRNMNES

SEQ ID NO: 11629 - protein, 29 aa, Artificial Sequence
  Description of Artificial Sequence: Synthetic peptide
DEECIRTTNPVATEAYGQVWTNLQRGGNR

SEQ ID NO: 11630 - protein, 30 aa, Artificial Sequence
  Description of Artificial Sequence: Synthetic polypeptide
TEEEIRTTNPVATEQYGSVSTNLQRNTNFS

SEQ ID NO: 11631 - protein, 30 aa, Artificial Sequence
  Description of Artificial Sequence: Synthetic polypeptide
TEEEIRTTNPVATEQYGSVSTNLQRVTNND

SEQ ID NO: 11632 - protein, 30 aa, Artificial Sequence
  Description of Artificial Sequence: Synthetic polypeptide
TEEEIRTTNPVATEQYGSVSTNLQTSGNGS

SEQ ID NO: 11633 - protein, 32 aa, Artificial Sequence
  Description of Artificial Sequence: Synthetic polypeptide
TEEEIRTTNPVATEQYGSVSTNLSQARGGNRI

SEQ ID NO: 11634 - protein, 29 aa, Artificial Sequence
  Description of Artificial Sequence: Synthetic peptide
TEEEIRTTNPVATEQYGSVSTNLSQLSNP

SEQ ID NO: 11635 - protein, 30 aa, Artificial Sequence
  Description of Artificial Sequence: Synthetic polypeptide
TEEEIRTTNPVATEQYGSVSTNLSVAGNRD

SEQ ID NO: 11636 - protein, 30 aa, Artificial Sequence
  Description of Artificial Sequence: Synthetic polypeptide
TEEEIRTTNPVATEQYGSVSTNMLQPGGNV

SEQ ID NO: 11637 - protein, 31 aa, Artificial Sequence
  Description of Artificial Sequence: Synthetic polypeptide
DEEEIRTTNPVATEQYGSVSITNLQTTGFNN

SEQ ID NO: 11638 - protein, 30 aa, Artificial Sequence
  Description of Artificial Sequence: Synthetic polypeptide
TEEEIRTTNPVATEQYGSVSTNLQRNVNLY

SEQ ID NO: 11639 - protein, 31 aa, Artificial Sequence
  Description of Artificial Sequence: Synthetic polypeptide
TEEEIRTTNPVATEQYGSVSTENLQRGNELV

SEQ ID NO: 11640 - protein, 30 aa, Artificial Sequence
  Description of Artificial Sequence: Synthetic polypeptide
DEEEIRTTNPVATEQYGAVSSTNLQRNNEG

SEQ ID NO: 11641 - protein, 30 aa, Artificial Sequence
  Description of Artificial Sequence: Synthetic polypeptide
DEEEIRTTNPVATEQYGAVSSTNLQTDGNT

SEQ ID NO: 11642 - protein, 29 aa, Artificial Sequence
  Description of Artificial Sequence: Synthetic peptide
DEEEIRTTNPVATEQYGSVSTELAIGNDA

SEQ ID NO: 11643 - protein, 30 aa, Artificial Sequence
  Description of Artificial Sequence: Synthetic polypeptide
DEEEIRTTNPVATEQYGAVSTNLQMAGNET

SEQ ID NO: 11644 - protein, 30 aa, Artificial Sequence
  Description of Artificial Sequence: Synthetic polypeptide
DEEEIRTTNPVATEQYGSVSTELDLQRSNL

SEQ ID NO: 11645 - protein, 29 aa, Artificial Sequence
  Description of Artificial Sequence: Synthetic peptide
AEEEIRTTNPVATEQYGSVSTDVQAGINR

SEQ ID NO: 11646 - protein, 30 aa, Artificial Sequence
  Description of Artificial Sequence: Synthetic polypeptide
DEEEIRTTNPVATEQYGSVSITNMQRQDNE

SEQ ID NO: 11647 - protein, 28 aa, Artificial Sequence
  Description of Artificial Sequence: Synthetic peptide
DEDEIRTTNPVATEVYGEVSTNLQAGNA

SEQ ID NO: 11648 - protein, 30 aa, Artificial Sequence
  Description of Artificial Sequence: Synthetic polypeptide
TEEEIRTTNPVATEQYGSVPATNWQRGGNR

SEQ ID NO: 11649 - protein, 31 aa, Artificial Sequence
  Description of Artificial Sequence: Synthetic polypeptide
DEEEIRTTNPVATEQYGSVSPTNWLERGNVP

SEQ ID NO: 11650 - protein, 30 aa, Artificial Sequence
  Description of Artificial Sequence: Synthetic polypeptide
TEEEIRTTNPVATEQYGSVPPTNWQRGGNR

SEQ ID NO: 11651 - protein, 29 aa, Artificial Sequence
  Description of Artificial Sequence: Synthetic peptide
DEDEIRTTNPVATEWYGSVSTNLQAAGNA

SEQ ID NO: 11652 - protein, 29 aa, Artificial Sequence
  Description of Artificial Sequence: Synthetic peptide
DEEEIRTTNPVATEQYGSVSTELLGGNDD

SEQ ID NO: 11653 - protein, 29 aa, Artificial Sequence
  Description of Artificial Sequence: Synthetic peptide
DEEEIRTTNPVATEQYGSVSTELLLRTNE

SEQ ID NO: 11654 - protein, 30 aa, Artificial Sequence
  Description of Artificial Sequence: Synthetic polypeptide
DEDEIRTTNPVATEYYGSVSTNLQRGNEGD

SEQ ID NO: 11655 - protein, 31 aa, Artificial Sequence
  Description of Artificial Sequence: Synthetic polypeptide
TEEEIRTTNPVATEQYGSVPSTNLQLGNNRP

SEQ ID NO: 11656 - protein, 30 aa, Artificial Sequence
  Description of Artificial Sequence: Synthetic polypeptide
DEEEIRTTNPVATEQYGSVSTELQCVAGNN

SEQ ID NO: 11657 - protein, 28 aa, Artificial Sequence
  Description of Artificial Sequence: Synthetic peptide
DEEEIRTTNPVATEQYGAVSTNLQFDEA

SEQ ID NO: 11658 - protein, 31 aa, Artificial Sequence
  Description of Artificial Sequence: Synthetic polypeptide
DEEEIRTTNPVATEQYGSVSTELEQRGMNIE

SEQ ID NO: 11659 - protein, 28 aa, Artificial Sequence
  Description of Artificial Sequence: Synthetic peptide
DEDEIRTTNPVATGHYGSVSTNLQRTNM

SEQ ID NO: 11660 - protein, 29 aa, Artificial Sequence
  Description of Artificial Sequence: Synthetic peptide
DEEEIRTTNPVATEQYGSVSTEIQAGSNL

SEQ ID NO: 11661 - protein, 30 aa, Artificial Sequence
  Description of Artificial Sequence: Synthetic polypeptide
DEEEIRTTNPVATEQYGAVSTNLQRIEERF

SEQ ID NO: 11662 - protein, 31 aa, Artificial Sequence
  Description of Artificial Sequence: Synthetic polypeptide
DEEEIRTTNPVATEQYGSVSTEELQGFGNRS

SEQ ID NO: 11663 - protein, 29 aa, Artificial Sequence
  Description of Artificial Sequence: Synthetic peptide
DEEEIRTTNPVATEQYGAVSTNTQGMGNN

SEQ ID NO: 11664 - protein, 28 aa, Artificial Sequence
  Description of Artificial Sequence: Synthetic peptide
DEEEIRTTNPVATEQYGCVNTNTQNTNR

SEQ ID NO: 11665 - protein, 29 aa, Artificial Sequence
  Description of Artificial Sequence: Synthetic peptide
DEEEIRTTNPVATEQYGAVSTNQQRGDQT

SEQ ID NO: 11666 - protein, 32 aa, Artificial Sequence
  Description of Artificial Sequence: Synthetic polypeptide
DEEEIRTTNPVATEQYGCVPSTGNLSQRGNRE

SEQ ID NO: 11667 - protein, 29 aa, Artificial Sequence
  Description of Artificial Sequence: Synthetic peptide
TEEEIRTTNPVATEQYGSVGTNLQYGNDM

SEQ ID NO: 11668 - protein, 28 aa, Artificial Sequence
  Description of Artificial Sequence: Synthetic peptide
TEEEIRTTNPVATEQYGSVGTTLQQGFR

SEQ ID NO: 11669 - protein, 29 aa, Artificial Sequence
  Description of Artificial Sequence: Synthetic peptide
TEEEIRTTNPVATEQYGSVNTALQNGNER

SEQ ID NO: 11670 - protein, 28 aa, Artificial Sequence
  Description of Artificial Sequence: Synthetic peptide
DEEEIRTTNPVATEQYGCVPTYTQYGNR

SEQ ID NO: 11671 - protein, 29 aa, Artificial Sequence
  Description of Artificial Sequence: Synthetic peptide
DEEEIRTTNPVATEQYGSVSTEGLESGNE

SEQ ID NO: 11672 - protein, 31 aa, Artificial Sequence
  Description of Artificial Sequence: Synthetic polypeptide
DEEEIRTTNPVATEQYGAVSTNLSQRGGSRS

SEQ ID NO: 11673 - protein, 28 aa, Artificial Sequence
  Description of Artificial Sequence: Synthetic peptide
DEEEIRTTNPVATEQYGAVSTNLQYSQA

SEQ ID NO: 11674 - protein, 32 aa, Artificial Sequence
  Description of Artificial Sequence: Synthetic polypeptide
DEEEIRTTNPVATEQYGSVSPTPDLQRGSNQR

SEQ ID NO: 11675 - protein, 30 aa, Artificial Sequence
  Description of Artificial Sequence: Synthetic polypeptide
DEEEIRTTNPVATEQYGAVSTNLQTDGNAT

SEQ ID NO: 11676 - protein, 31 aa, Artificial Sequence
  Description of Artificial Sequence: Synthetic polypeptide
DEEEIRTTNPVATEQYGSVSITNNLQAGNAD

SEQ ID NO: 11677 - protein, 30 aa, Artificial Sequence
  Description of Artificial Sequence: Synthetic polypeptide
DEEEIRTTNPVATEQYGAVSTNLQRINAQQ

SEQ ID NO: 11678 - protein, 30 aa, Artificial Sequence
  Description of Artificial Sequence: Synthetic polypeptide
DEEEIRTTNPVATEQYGSVSITNNMQRVNE

SEQ ID NO: 11679 - protein, 30 aa, Artificial Sequence
  Description of Artificial Sequence: Synthetic polypeptide
DEEEIRTTNPVATEQYGCVNPTNPQRGGNR

SEQ ID NO: 11680 - protein, 30 aa, Artificial Sequence
  Description of Artificial Sequence: Synthetic polypeptide
DEEEIRTTNPVATEQYGSVSTELQERGQLG

SEQ ID NO: 11681 - protein, 30 aa, Artificial Sequence
  Description of Artificial Sequence: Synthetic polypeptide
TEEEIRTTNPVATEQYGSVSATNLSQSGND

SEQ ID NO: 11682 - protein, 29 aa, Artificial Sequence
  Description of Artificial Sequence: Synthetic peptide
DEEEIRTTNPVATEQYGSVSTELQSGEDV

SEQ ID NO: 11683 - protein, 30 aa, Artificial Sequence
  Description of Artificial Sequence: Synthetic polypeptide
DEEEIRTTNPVATEQYGSVSTELQTEGNDQ

SEQ ID NO: 11684 - protein, 30 aa, Artificial Sequence
  Description of Artificial Sequence: Synthetic polypeptide
DEEEIRTTNPVATEQYGSVSTELQTGGDNG

SEQ ID NO: 11685 - protein, 31 aa, Artificial Sequence
  Description of Artificial Sequence: Synthetic polypeptide
TEEEIRTTNPVATEQYGSVSCWGNLQRGGNR

SEQ ID NO: 11686 - protein, 30 aa, Artificial Sequence
  Description of Artificial Sequence: Synthetic polypeptide
DEEEIRTTNPVATEQYGSVSTELQTTGNEE

SEQ ID NO: 11687 - protein, 30 aa, Artificial Sequence
  Description of Artificial Sequence: Synthetic polypeptide
DEEEIRTTNPVATEQYGCVSATNLDRGNVE

SEQ ID NO: 11688 - protein, 30 aa, Artificial Sequence
  Description of Artificial Sequence: Synthetic polypeptide
DEEEIRTTNPVATEQYGSVSTELTQGFGNQ

SEQ ID NO: 11689 - protein, 30 aa, Artificial Sequence
  Description of Artificial Sequence: Synthetic polypeptide
DEEEIRTTNPVATEQYGSVSNMNLQEGGNQ

SEQ ID NO: 11690 - protein, 30 aa, Artificial Sequence
  Description of Artificial Sequence: Synthetic polypeptide
DEEEIRTTNPVATEQYGAVSTDNLQEFGNP

SEQ ID NO: 11691 - protein, 30 aa, Artificial Sequence
  Description of Artificial Sequence: Synthetic polypeptide
DEEEIRTTNPVATEQYGAVSTDLQRDNQRQ

SEQ ID NO: 11692 - protein, 30 aa, Artificial Sequence
  Description of Artificial Sequence: Synthetic polypeptide
DEEEIRTTNPVATEQYGCVSCNLQRFGNVG

SEQ ID NO: 11693 - protein, 30 aa, Artificial Sequence
  Description of Artificial Sequence: Synthetic polypeptide
DEEEIRTTNPVATEQYGAVSTDLQRDNIRQ

SEQ ID NO: 11694 - protein, 30 aa, Artificial Sequence
  Description of Artificial Sequence: Synthetic polypeptide
DEEEIRTTNPVATEQYGSVSTEMLQGGEER

SEQ ID NO: 11695 - protein, 32 aa, Artificial Sequence
  Description of Artificial Sequence: Synthetic polypeptide
DEEEIRTTNPVATEQYGSVSPTNSQRGEENRA

SEQ ID NO: 11696 - protein, 30 aa, Artificial Sequence
  Description of Artificial Sequence: Synthetic polypeptide
DEEEIRTTNPVATEQYGAVSTALQRGNNMS

SEQ ID NO: 11697 - protein, 30 aa, Artificial Sequence
  Description of Artificial Sequence: Synthetic polypeptide
TEEEIRTTNPVATEQYGSVSSNHSQRTGNR

SEQ ID NO: 11698 - protein, 29 aa, Artificial Sequence
  Description of Artificial Sequence: Synthetic peptide
DEEEIRTTNPVATEQYGSVSTEMHQRGEE

SEQ ID NO: 11699 - protein, 28 aa, Artificial Sequence
  Description of Artificial Sequence: Synthetic peptide
DEDEIRTTNPVATKTYGSVSTNLQRTND

SEQ ID NO: 11700 - protein, 29 aa, Artificial Sequence
  Description of Artificial Sequence: Synthetic peptide
DEEEIRTTNPVATEQYGAVSTNEQRGGDH

SEQ ID NO: 11701 - protein, 30 aa, Artificial Sequence
  Description of Artificial Sequence: Synthetic polypeptide
DEEEIRTTNPVATEQYGCVQTNLQRGSERT

SEQ ID NO: 11702 - protein, 28 aa, Artificial Sequence
  Description of Artificial Sequence: Synthetic peptide
DEDEIRTTNPVATMHYGSVSTNLQRTNT

SEQ ID NO: 11703 - protein, 28 aa, Artificial Sequence
  Description of Artificial Sequence: Synthetic peptide
SEEEIRCTNPIATEQYGVVSENLQRGNR

SEQ ID NO: 11704 - protein, 30 aa, Artificial Sequence
  Description of Artificial Sequence: Synthetic polypeptide
DEEEIRTTNPVATEQYGCVQTNLQFYGSNR

SEQ ID NO: 11705 - protein, 30 aa, Artificial Sequence
  Description of Artificial Sequence: Synthetic polypeptide
DEEEIRTTNPVATEQYGSVSTELQHFGENL

SEQ ID NO: 11706 - protein, 30 aa, Artificial Sequence
  Description of Artificial Sequence: Synthetic polypeptide
DEEEIRTTNPVATEQYGAVSTNLIQGFGNG

SEQ ID NO: 11707 - protein, 29 aa, Artificial Sequence
  Description of Artificial Sequence: Synthetic peptide
DEEEIRTTNPVATEQYGSVSTELQHGDQA

SEQ ID NO: 11708 - protein, 28 aa, Artificial Sequence
  Description of Artificial Sequence: Synthetic peptide
DEEEIRTTNPIATEPYGSVSEDLMRGNR

SEQ ID NO: 11709 - protein, 28 aa, Artificial Sequence
  Description of Artificial Sequence: Synthetic peptide
DEEEIRTTNPVATEQYGCVQTNTQSFNR

SEQ ID NO: 11710 - protein, 31 aa, Artificial Sequence
  Description of Artificial Sequence: Synthetic polypeptide
DEEEIRTTNPVATEQYGSVSTELQHIGSNDR

SEQ ID NO: 11711 - protein, 30 aa, Artificial Sequence
  Description of Artificial Sequence: Synthetic polypeptide
TEEEIRTTNPVATEQYGSVSCTNLQTPGNH

SEQ ID NO: 11712 - protein, 28 aa, Artificial Sequence
  Description of Artificial Sequence: Synthetic peptide
DEEEIRTTNPIATEGYGSCSTNLDRGNI

SEQ ID NO: 11713 - protein, 28 aa, Artificial Sequence
  Description of Artificial Sequence: Synthetic peptide
DEEEIRTTNPIATEGYGSASTNLARGNA

SEQ ID NO: 11714 - protein, 30 aa, Artificial Sequence
  Description of Artificial Sequence: Synthetic polypeptide
DEEEIRTTNPVATEQYGSVSTELQMIGNTE

SEQ ID NO: 11715 - protein, 30 aa, Artificial Sequence
  Description of Artificial Sequence: Synthetic polypeptide
DEEEIRTTNPVATEQYGSVSTELQQDGNTV

SEQ ID NO: 11716 - protein, 31 aa, Artificial Sequence
  Description of Artificial Sequence: Synthetic polypeptide
DEEEIRTTNPVATEQYGSVSTELQREGEQRQ

SEQ ID NO: 11717 - protein, 30 aa, Artificial Sequence
  Description of Artificial Sequence: Synthetic polypeptide
DEEEIRTTNPVATEQYGSVSTELQREIERE

SEQ ID NO: 11718 - protein, 30 aa, Artificial Sequence
  Description of Artificial Sequence: Synthetic polypeptide
TEEEIRTTNPVATEQYGSVSCTNLQMTGNE

SEQ ID NO: 11719 - protein, 30 aa, Artificial Sequence
  Description of Artificial Sequence: Synthetic polypeptide
DEEEIRTTNPVATEQYGSVSTENLGDGNQM

SEQ ID NO: 11720 - protein, 28 aa, Artificial Sequence
  Description of Artificial Sequence: Synthetic peptide
AEEEIRTTNPVATEAYGSVSTNLQLFNV

SEQ ID NO: 11721 - protein, 30 aa, Artificial Sequence
  Description of Artificial Sequence: Synthetic polypeptide
AEEEIRTTNPVATEAYGSVSTNLQPAGNLR

SEQ ID NO: 11722 - protein, 30 aa, Artificial Sequence
  Description of Artificial Sequence: Synthetic polypeptide
DEEEIRTTNPVATEQYGSVSTDLQQGNGEG

SEQ ID NO: 11723 - protein, 28 aa, Artificial Sequence
  Description of Artificial Sequence: Synthetic peptide
DEEEIRTTNPMATEQYGSVSYNIVRGND

SEQ ID NO: 11724 - protein, 32 aa, Artificial Sequence
  Description of Artificial Sequence: Synthetic polypeptide
DEEEIRTTNPVATEQYGSVSQTNDLQRLGSNF

SEQ ID NO: 11725 - protein, 32 aa, Artificial Sequence
  Description of Artificial Sequence: Synthetic polypeptide
DEEEIRTTNPVATEQYGSVSQTNDLQRGPLRN

SEQ ID NO: 11726 - protein, 30 aa, Artificial Sequence
  Description of Artificial Sequence: Synthetic polypeptide
DEEEIRTTNPVATEQYGSVSTDLQQGNMIG

SEQ ID NO: 11727 - protein, 31 aa, Artificial Sequence
  Description of Artificial Sequence: Synthetic polypeptide
DEEEIRTTNPVATEQYGSVSQTMLQRGTTRD

SEQ ID NO: 11728 - protein, 31 aa, Artificial Sequence
  Description of Artificial Sequence: Synthetic polypeptide
DEEEIRTTNPVATEQYGSVSTDLQREDNIRD

SEQ ID NO: 11729 - protein, 28 aa, Artificial Sequence
  Description of Artificial Sequence: Synthetic peptide
SEEEIRTTNPVATEQFGSVSTNLQIGTN

SEQ ID NO: 11730 - protein, 28 aa, Artificial Sequence
  Description of Artificial Sequence: Synthetic peptide
SEEEIRTTNPVATEQFGSVSTNLQAGPL

SEQ ID NO: 11731 - protein, 29 aa, Artificial Sequence
  Description of Artificial Sequence: Synthetic peptide
SEEEIRTTNPVATEQFGSVSTNEPQRGTR

SEQ ID NO: 11732 - protein, 30 aa, Artificial Sequence
  Description of Artificial Sequence: Synthetic polypeptide
DEEEIRTTNPVATEQYGSVSQTILQRQERN

SEQ ID NO: 11733 - protein, 28 aa, Artificial Sequence
  Description of Artificial Sequence: Synthetic peptide
SEEEIRTTNPVATEPYGSVSTNLQRPGH

SEQ ID NO: 11734 - protein, 29 aa, Artificial Sequence
  Description of Artificial Sequence: Synthetic peptide
SEEEIRTTNPVATEPYGSVSTNLQNGDRM

SEQ ID NO: 11735 - protein, 31 aa, Artificial Sequence
  Description of Artificial Sequence: Synthetic polypeptide
DEEEIRTTNPVATEQYGSVSQTGNLQRGVLM

SEQ ID NO: 11736 - protein, 28 aa, Artificial Sequence
  Description of Artificial Sequence: Synthetic peptide
SEEEIRTTNPVATEPYGSVSTNLQANNG

SEQ ID NO: 11737 - protein, 30 aa, Artificial Sequence
  Description of Artificial Sequence: Synthetic polypeptide
DEEEIRTTNPVATEQYGSVSTDLQQGDGNI

SEQ ID NO: 11738 - protein, 28 aa, Artificial Sequence
  Description of Artificial Sequence: Synthetic peptide
DEDEIRTTNPVATEQYGVVSTSLQRVND

SEQ ID NO: 11739 - protein, 28 aa, Artificial Sequence
  Description of Artificial Sequence: Synthetic peptide
DEDEIRTTNPVATEQYGVVSTSLQRPNN

SEQ ID NO: 11740 - protein, 31 aa, Artificial Sequence
  Description of Artificial Sequence: Synthetic polypeptide
DEDEIRTTNPVATEQYGVVSTNLQRGDNDRQ

SEQ ID NO: 11741 - protein, 30 aa, Artificial Sequence
  Description of Artificial Sequence: Synthetic polypeptide
DEEEIRTTNPVATEQYGSVSTDLQLIGNIP

SEQ ID NO: 11742 - protein, 31 aa, Artificial Sequence
  Description of Artificial Sequence: Synthetic polypeptide
DEEEIRTTNPVATEQYGSVSQTNEQRGNSGF

SEQ ID NO: 11743 - protein, 31 aa, Artificial Sequence
  Description of Artificial Sequence: Synthetic polypeptide
DEEEIRTTNPVATEQYGSVSQTNEQRGNFPT

SEQ ID NO: 11744 - protein, 29 aa, Artificial Sequence
  Description of Artificial Sequence: Synthetic peptide
DEEEIRTTNPVATEQYGSVSTDLQMMERD

SEQ ID NO: 11745 - protein, 30 aa, Artificial Sequence
  Description of Artificial Sequence: Synthetic polypeptide
DEEEIRTTNPVATEQYGSVSTDLQNGNPPA

SEQ ID NO: 11746 - protein, 31 aa, Artificial Sequence
  Description of Artificial Sequence: Synthetic polypeptide
DEEEIRTTNPVATEQYGSVSTDLQNIGENAR

SEQ ID NO: 11747 - protein, 30 aa, Artificial Sequence
  Description of Artificial Sequence: Synthetic polypeptide
SEEEIRTTNPVATEQYGCTISTNELQRGNR

SEQ ID NO: 11748 - protein, 30 aa, Artificial Sequence
  Description of Artificial Sequence: Synthetic polypeptide
DEEEIRTTNPVATEQYGSVSTDLQRGDTSF

SEQ ID NO: 11749 - protein, 30 aa, Artificial Sequence
  Description of Artificial Sequence: Synthetic polypeptide
SEEEIRTTNPVATEQYGAVSTNLQRVNGRI

SEQ ID NO: 11750 - protein, 29 aa, Artificial Sequence
  Description of Artificial Sequence: Synthetic peptide
DEDEIRTTNPVATEQYGVVSTNLQFGPND

SEQ ID NO: 11751 - protein, 29 aa, Artificial Sequence
  Description of Artificial Sequence: Synthetic peptide
SEEEIRTTNPVATEQWGSVSTDNLQNGNE

SEQ ID NO: 11752 - protein, 31 aa, Artificial Sequence
  Description of Artificial Sequence: Synthetic polypeptide
DEEEIRTTNPVATEQYGSVSTDLQNRGSNAQ

SEQ ID NO: 11753 - protein, 30 aa, Artificial Sequence
  Description of Artificial Sequence: Synthetic polypeptide
DEDEIRTTNPVATEQYGVVSTNLQGDGNSR

SEQ ID NO: 11754 - protein, 29 aa, Artificial Sequence
  Description of Artificial Sequence: Synthetic peptide
DEDEIRTTNPVATEQYGVVSTNLQHAGNQ

SEQ ID NO: 11755 - protein, 30 aa, Artificial Sequence
  Description of Artificial Sequence: Synthetic polypeptide
DEEEIRTTNPMATEQYGSVWATNLQRGNSA

SEQ ID NO: 11756 - protein, 29 aa, Artificial Sequence
  Description of Artificial Sequence: Synthetic peptide
DEEEIRTTNPVATEQYGSVSTDLQPGPQV

SEQ ID NO: 11757 - protein, 28 aa, Artificial Sequence
  Description of Artificial Sequence: Synthetic peptide
DEDEIRTTNPVATEQYGVVSTKLQRPNH

SEQ ID NO: 11758 - protein, 30 aa, Artificial Sequence
  Description of Artificial Sequence: Synthetic polypeptide
SEEEIRTTNPVATEPYGSVSSTNLQTGNIR

SEQ ID NO: 11759 - protein, 31 aa, Artificial Sequence
  Description of Artificial Sequence: Synthetic polypeptide
DEEEIRTTNPVATEQYGSVSQTALYQRSQNR

SEQ ID NO: 11760 - protein, 30 aa, Artificial Sequence
  Description of Artificial Sequence: Synthetic polypeptide
AEEEIRTTNPVATEQYGSVSTTNLQAGNES

SEQ ID NO: 11761 - protein, 30 aa, Artificial Sequence
  Description of Artificial Sequence: Synthetic polypeptide
SEEEIRTTNPVATEMYGSVSTNLQTRGNDF

SEQ ID NO: 11762 - protein, 31 aa, Artificial Sequence
  Description of Artificial Sequence: Synthetic polypeptide
AEEEIRTTNPVATEQYGSVSTTNLQEVGNPR

SEQ ID NO: 11763 - protein, 29 aa, Artificial Sequence
  Description of Artificial Sequence: Synthetic peptide
SEEEIRTTNPVATEMYGSVSTNLQSGNAV

SEQ ID NO: 11764 - protein, 30 aa, Artificial Sequence
  Description of Artificial Sequence: Synthetic polypeptide
AEEEIRTTNPVATEQYGSVSTTNLQFGENE

SEQ ID NO: 11765 - protein, 30 aa, Artificial Sequence
  Description of Artificial Sequence: Synthetic polypeptide
AEEEIRTTNPVATEQYGSVSTTNLQFIGNN

SEQ ID NO: 11766 - protein, 31 aa, Artificial Sequence
  Description of Artificial Sequence: Synthetic polypeptide
TEEEIQTTNPVATEQYGSVSCTNLSQNRGNR

SEQ ID NO: 11767 - protein, 30 aa, Artificial Sequence
  Description of Artificial Sequence: Synthetic polypeptide
DEEEIRTTNPVATEQYGSVSTDLQSFGNMQ

SEQ ID NO: 11768 - protein, 30 aa, Artificial Sequence
  Description of Artificial Sequence: Synthetic polypeptide
DEEEIRTTNPVATEQYGSVSMTDDQTGNRV

SEQ ID NO: 11769 - protein, 30 aa, Artificial Sequence
  Description of Artificial Sequence: Synthetic polypeptide
AEEEIRTTNPVATEQYGSVSTTNLQGGNDN

SEQ ID NO: 11770 - protein, 31 aa, Artificial Sequence
  Description of Artificial Sequence: Synthetic polypeptide
AEEEIRTTNPVATEQYGSVSTTNLQGGVNMR

SEQ ID NO: 11771 - protein, 30 aa, Artificial Sequence
  Description of Artificial Sequence: Synthetic polypeptide
DEEEIRTTNPVATEQYGSVSQNLQHGNADG

SEQ ID NO: 11772 - protein, 30 aa, Artificial Sequence
  Description of Artificial Sequence: Synthetic polypeptide
DEEEIRTTNPMATEQYGSVSATNLQRGEEA

SEQ ID NO: 11773 - protein, 30 aa, Artificial Sequence
  Description of Artificial Sequence: Synthetic polypeptide
DEEEIRTTNPVATEQYGSVSQNLQDSGNPD

SEQ ID NO: 11774 - protein, 31 aa, Artificial Sequence
  Description of Artificial Sequence: Synthetic polypeptide
AEEEIRTTNPVATEQYGSVSTTNLQGNGNRE

SEQ ID NO: 11775 - protein, 29 aa, Artificial Sequence
  Description of Artificial Sequence: Synthetic peptide
SEEEIRTTNPVATEMYGSVSTNLQRDGDV

SEQ ID NO: 11776 - protein, 30 aa, Artificial Sequence
  Description of Artificial Sequence: Synthetic polypeptide
DEEEIRTTNPVATEQYGSVSTDLQTEGNVG

SEQ ID NO: 11777 - protein, 30 aa, Artificial Sequence
  Description of Artificial Sequence: Synthetic polypeptide
DEEEIRTTNPVATEQYGSVSTDLQSLGNPQ

SEQ ID NO: 11778 - protein, 30 aa, Artificial Sequence
  Description of Artificial Sequence: Synthetic polypeptide
DEEEIRTTNPVATEQYGSVSQTNGGQRGSF

SEQ ID NO: 11779 - protein, 31 aa, Artificial Sequence
  Description of Artificial Sequence: Synthetic polypeptide
DEEEIRTTNPVATEQYGSVSTDLQRYMENRD

SEQ ID NO: 11780 - protein, 30 aa, Artificial Sequence
  Description of Artificial Sequence: Synthetic polypeptide
DEEEIRTTNPVATEQYGSVSMSVNLQRVNI

SEQ ID NO: 11781 - protein, 28 aa, Artificial Sequence
  Description of Artificial Sequence: Synthetic peptide
TEEEICTTNPVATEQYGSVSTNIQRGPM

SEQ ID NO: 11782 - protein, 31 aa, Artificial Sequence
  Description of Artificial Sequence: Synthetic polypeptide
DEEEIRTTNPVATEQYGSVSTDLQRLDENRL

SEQ ID NO: 11783 - protein, 30 aa, Artificial Sequence
  Description of Artificial Sequence: Synthetic polypeptide
AEEEIRTTNPVATEQYGSVSTTNLQDGNDL

SEQ ID NO: 11784 - protein, 29 aa, Artificial Sequence
  Description of Artificial Sequence: Synthetic peptide
TEEEICTTNPVATEQYGSVSTNLQHGNDL

SEQ ID NO: 11785 - protein, 30 aa, Artificial Sequence
  Description of Artificial Sequence: Synthetic polypeptide
AEEEIRTTNPVATEQYGSVSTTNLQDGNQY

SEQ ID NO: 11786 - protein, 30 aa, Artificial Sequence
  Description of Artificial Sequence: Synthetic polypeptide
AEEEIRTTNPVATEQYGSVSTTNLQDGNVS

SEQ ID NO: 11787 - protein, 29 aa, Artificial Sequence
  Description of Artificial Sequence: Synthetic peptide
TEEEICTTNPVATEQYGSVSTNLQHGNVQ

SEQ ID NO: 11788 - protein, 29 aa, Artificial Sequence
  Description of Artificial Sequence: Synthetic peptide
DEEEIRTTNPVATEQYGSVSQNVQEQGNQ

SEQ ID NO: 11789 - protein, 28 aa, Artificial Sequence
  Description of Artificial Sequence: Synthetic peptide
TEEEICTTNPVATEQYGSVSTNLQMGHT

SEQ ID NO: 11790 - protein, 31 aa, Artificial Sequence
  Description of Artificial Sequence: Synthetic polypeptide
DEEEIRTTNPMATEQYGSVSTNLQGSGSNRG

SEQ ID NO: 11791 - protein, 30 aa, Artificial Sequence
  Description of Artificial Sequence: Synthetic polypeptide
DEEEIRTTNPVATEQYGSVSMSLGQRGENE

SEQ ID NO: 11792 - protein, 30 aa, Artificial Sequence
  Description of Artificial Sequence: Synthetic polypeptide
DEEEIRTTNPVATEQYGSVSTDLQRQSIRD

SEQ ID NO: 11793 - protein, 31 aa, Artificial Sequence
  Description of Artificial Sequence: Synthetic polypeptide
DEEEIRTTNPVATEQYGSVSTDLQRSIGNQS

SEQ ID NO: 11794 - protein, 31 aa, Artificial Sequence
  Description of Artificial Sequence: Synthetic polypeptide
DEEEIRTTNPVATEQYGSVSMSSNLQRGDNE

SEQ ID NO: 11795 - protein, 30 aa, Artificial Sequence
  Description of Artificial Sequence: Synthetic polypeptide
DEEEIRTTNPVATEQYGSVSTDLQRTMNME

SEQ ID NO: 11796 - protein, 30 aa, Artificial Sequence
  Description of Artificial Sequence: Synthetic polypeptide
DEEEIRTTNPVATEQYGSVSTDLQRTSIRI

SEQ ID NO: 11797 - protein, 28 aa, Artificial Sequence
  Description of Artificial Sequence: Synthetic peptide
TEEEICTTNPVATEQYGSVSTNLQTGVD

SEQ ID NO: 11798 - protein, 28 aa, Artificial Sequence
  Description of Artificial Sequence: Synthetic peptide
DEDEIRTTNPVATEQYGVTSTNLQRGTQ

SEQ ID NO: 11799 - protein, 30 aa, Artificial Sequence
  Description of Artificial Sequence: Synthetic polypeptide
DEEEIRTTNPVATEQYGSVSTDLQGVGNIQ

SEQ ID NO: 11800 - protein, 31 aa, Artificial Sequence
  Description of Artificial Sequence: Synthetic polypeptide
DEDEIRTTNPVATEQYGVSVSTNLSQLGGNR

SEQ ID NO: 11801 - protein, 31 aa, Artificial Sequence
  Description of Artificial Sequence: Synthetic polypeptide
SEEEIRTTNPVATEQYGSTVSTNLQRVGNNQ

SEQ ID NO: 11802 - protein, 29 aa, Artificial Sequence
  Description of Artificial Sequence: Synthetic peptide
DEDEIRTTNPVATEQYGSVSTYLQRGDDH

SEQ ID NO: 11803 - protein, 30 aa, Artificial Sequence
  Description of Artificial Sequence: Synthetic polypeptide
DEEEIRTTNPVATEQYGSVSLINLQRGADI

SEQ ID NO: 11804 - protein, 28 aa, Artificial Sequence
  Description of Artificial Sequence: Synthetic peptide
SEEEIRTTNPVATEQYGSSSTHLQRQGR

SEQ ID NO: 11805 - protein, 29 aa, Artificial Sequence
  Description of Artificial Sequence: Synthetic peptide
SEEEIRTTNPVATEQYGSNSTDLQRGNDD

SEQ ID NO: 11806 - protein, 28 aa, Artificial Sequence
  Description of Artificial Sequence: Synthetic peptide
SEEEIRTTNPVATEQYGSLSTHLQRIGR

SEQ ID NO: 11807 - protein, 28 aa, Artificial Sequence
  Description of Artificial Sequence: Synthetic peptide
SEEEIRTTNPVATEQYGSFSTHLQRQGR

SEQ ID NO: 11808 - protein, 30 aa, Artificial Sequence
  Description of Artificial Sequence: Synthetic polypeptide
DEDEIRTTNPVATEQYGSVSTYLQREGNNQ

SEQ ID NO: 11809 - protein, 29 aa, Artificial Sequence
  Description of Artificial Sequence: Synthetic peptide
DEEEIRTTNPVATEQYGSVSTDLERIDFR

SEQ ID NO: 11810 - protein, 28 aa, Artificial Sequence
  Description of Artificial Sequence: Synthetic peptide
SEEEIRTTNPVATEQYGSAPENCQRGNR

SEQ ID NO: 11811 - protein, 31 aa, Artificial Sequence
  Description of Artificial Sequence: Synthetic polypeptide
DEEEIRTTNPVATEQYGSVSMNLQRTGNEDD

SEQ ID NO: 11812 - protein, 29 aa, Artificial Sequence
  Description of Artificial Sequence: Synthetic peptide
DEEEIRTTNPVATEQYGSVSTDLERNPQR

SEQ ID NO: 11813 - protein, 30 aa, Artificial Sequence
  Description of Artificial Sequence: Synthetic polypeptide
DEEEIRTTNPVATEQYGSVSTDLGDGRGSR

SEQ ID NO: 11814 - protein, 30 aa, Artificial Sequence
  Description of Artificial Sequence: Synthetic polypeptide
DEEEIRTTNPVATEQYGSVSTDLGQRQENV

SEQ ID NO: 11815 - protein, 29 aa, Artificial Sequence
  Description of Artificial Sequence: Synthetic peptide
AEEEIRTTNPVATEEYGCVNSENLQRGNR

SEQ ID NO: 11816 - protein, 30 aa, Artificial Sequence
  Description of Artificial Sequence: Synthetic polypeptide
DEEEIRTTNPVATEQYGSVSQTNLQHVAER

SEQ ID NO: 11817 - protein, 28 aa, Artificial Sequence
  Description of Artificial Sequence: Synthetic peptide
SEEEIRTTNPVATEQYGSASENLQRGEK

SEQ ID NO: 11818 - protein, 31 aa, Artificial Sequence
  Description of Artificial Sequence: Synthetic polypeptide
AEEEIRTTNPVATEQYGSVSTTNLDQTSGNR

SEQ ID NO: 11819 - protein, 28 aa, Artificial Sequence
  Description of Artificial Sequence: Synthetic peptide
SEEEIRTTNPVATEQYGSVAMNLQEGMR

SEQ ID NO: 11820 - protein, 28 aa, Artificial Sequence
  Description of Artificial Sequence: Synthetic peptide
DEEEIRTTNPVATEQYGSVSTDLEDGEF

SEQ ID NO: 11821 - protein, 29 aa, Artificial Sequence
  Description of Artificial Sequence: Synthetic peptide
AEEEIRTTNPVATEEYGSVSTNLQYGNIT

SEQ ID NO: 11822 - protein, 29 aa, Artificial Sequence
  Description of Artificial Sequence: Synthetic peptide
AEEEIRTTNPVATEEYGSVSTNLQTGNGM

SEQ ID NO: 11823 - protein, 29 aa, Artificial Sequence
  Description of Artificial Sequence: Synthetic peptide
SEEEIRTTNPVATEQYGSVATNDQRGQDR

SEQ ID NO: 11824 - protein, 29 aa, Artificial Sequence
  Description of Artificial Sequence: Synthetic peptide
AEEEIRTTNPVATEEYGSVSTNLQQYGSR

SEQ ID NO: 11825 - protein, 28 aa, Artificial Sequence
  Description of Artificial Sequence: Synthetic peptide
DEEEIRTTNPSATEGYGSCSTNLARGNL

SEQ ID NO: 11826 - protein, 30 aa, Artificial Sequence
  Description of Artificial Sequence: Synthetic polypeptide
AEEEIRTTNPVATEEYGSVSTNLQQYGNER

SEQ ID NO: 11827 - protein, 29 aa, Artificial Sequence
  Description of Artificial Sequence: Synthetic peptide
AEEEIRTTNPVATEEYGSVSTNLQQGNQI

SEQ ID NO: 11828 - protein, 30 aa, Artificial Sequence
  Description of Artificial Sequence: Synthetic polypeptide
SEEEIRTTNPVATEQYGSVASTNLQLVGND

SEQ ID NO: 11829 - protein, 30 aa, Artificial Sequence
  Description of Artificial Sequence: Synthetic polypeptide
AEEEIRTTNPVATEEYGSVSTNLQQEGNLR

SEQ ID NO: 11830 - protein, 30 aa, Artificial Sequence
  Description of Artificial Sequence: Synthetic polypeptide
AEEEIRTTNPVATEEYGSVSTNLQGVGNAR

SEQ ID NO: 11831 - protein, 29 aa, Artificial Sequence
  Description of Artificial Sequence: Synthetic peptide
AEEEIRTTNPVATEEYGSVSTNLQCGNED

SEQ ID NO: 11832 - protein, 28 aa, Artificial Sequence
  Description of Artificial Sequence: Synthetic peptide
AEEEIRTTNPVATEEYGSVSTNLDTGNM

SEQ ID NO: 11833 - protein, 29 aa, Artificial Sequence
  Description of Artificial Sequence: Synthetic peptide
AEEEIRTTNPVATEEYGSVSTEALQGGNR

SEQ ID NO: 11834 - protein, 30 aa, Artificial Sequence
  Description of Artificial Sequence: Synthetic polypeptide
DEEEIRTTNPVATEQYGSVSQTNLQNPENQ

SEQ ID NO: 11835 - protein, 31 aa, Artificial Sequence
  Description of Artificial Sequence: Synthetic polypeptide
DEEEIRTTNPVATEQYGSVSQTNLQNGLNTQ

SEQ ID NO: 11836 - protein, 28 aa, Artificial Sequence
  Description of Artificial Sequence: Synthetic peptide
DEEEIRTTNPVATEQYGSVSTDLDYGEA

SEQ ID NO: 11837 - protein, 28 aa, Artificial Sequence
  Description of Artificial Sequence: Synthetic peptide
AEEEIRTTNPVATEEYGSVSTNLQIGTP

SEQ ID NO: 11838 - protein, 30 aa, Artificial Sequence
  Description of Artificial Sequence: Synthetic polypeptide
DEEEIRTTNPMATEQYGSVMATNLQRGNGA

SEQ ID NO: 11839 - protein, 30 aa, Artificial Sequence
  Description of Artificial Sequence: Synthetic polypeptide
DEEEIRTTNPVATEQYGSVSQTNLQHNIMR

SEQ ID NO: 11840 - protein, 31 aa, Artificial Sequence
  Description of Artificial Sequence: Synthetic polypeptide
AEEEIRTTNPVATEQYGSVSTTNLEQLEGNR

SEQ ID NO: 11841 - protein, 31 aa, Artificial Sequence
  Description of Artificial Sequence: Synthetic polypeptide
DEEEIRTTNPVATEQYGSVSTDLQDFGNERT

SEQ ID NO: 11842 - protein, 31 aa, Artificial Sequence
  Description of Artificial Sequence: Synthetic polypeptide
AEEEIRTTNPVATEQYGSVSTTNLLQGGLNR

SEQ ID NO: 11843 - protein, 30 aa, Artificial Sequence
  Description of Artificial Sequence: Synthetic polypeptide
DEEEIRTTNPVATEQYGSVSTDLQDHGNEG

SEQ ID NO: 11844 - protein, 30 aa, Artificial Sequence
  Description of Artificial Sequence: Synthetic polypeptide
DEEEIRTTNPVATEQYGSVSTDLQEGGNEF

SEQ ID NO: 11845 - protein, 31 aa, Artificial Sequence
  Description of Artificial Sequence: Synthetic polypeptide
DEEEIRTTNPVATEQYGSVSTDLQEGSNERP

SEQ ID NO: 11846 - protein, 29 aa, Artificial Sequence
  Description of Artificial Sequence: Synthetic peptide
DEEEIRTTNPVATEQYGSVSTDLQFENEL

SEQ ID NO: 11847 - protein, 28 aa, Artificial Sequence
  Description of Artificial Sequence: Synthetic peptide
AEEEIRTTNPVATEEYGCASCNLQRGNR

SEQ ID NO: 11848 - protein, 31 aa, Artificial Sequence
  Description of Artificial Sequence: Synthetic polypeptide
AEEEIRTTNPVATEQYGSVSTTNLLQENGNR

SEQ ID NO: 11849 - protein, 28 aa, Artificial Sequence
  Description of Artificial Sequence: Synthetic peptide
AEEEIRTTNPVATEDYGCTSINLQRGNR

SEQ ID NO: 11850 - protein, 29 aa, Artificial Sequence
  Description of Artificial Sequence: Synthetic peptide
DEEEIRTTNPVATEQYGSVSTDLQGENNQ

SEQ ID NO: 11851 - protein, 29 aa, Artificial Sequence
  Description of Artificial Sequence: Synthetic peptide
AEEEIRTTNPVATECYGSVSTNLQMGNGI

SEQ ID NO: 11852 - protein, 28 aa, Artificial Sequence
  Description of Artificial Sequence: Synthetic peptide
AEEEIRTTNPVATECYGSVSTNLNRGIT

SEQ ID NO: 11853 - protein, 30 aa, Artificial Sequence
  Description of Artificial Sequence: Synthetic polypeptide
AEEEIRTTNPVATECYGSVSNTNLQRGNNT

SEQ ID NO: 11854 - protein, 30 aa, Artificial Sequence
  Description of Artificial Sequence: Synthetic polypeptide
DEEEIRTTNPVATEQYGSVSMPLQRSGNEF

SEQ ID NO: 11855 - protein, 30 aa, Artificial Sequence
  Description of Artificial Sequence: Synthetic polypeptide
DEEEIRTTNPVATEQYGSVSTDLQGGNINS

SEQ ID NO: 11856 - protein, 30 aa, Artificial Sequence
  Description of Artificial Sequence: Synthetic polypeptide
DEEEIRTTNPVATEQYGSVSTDLQGGNTDS

SEQ ID NO: 11857 - protein, 29 aa, Artificial Sequence
  Description of Artificial Sequence: Synthetic peptide
AEEEIRTTNPVATECYGSVSTNLSGGNNR

SEQ ID NO: 11858 - protein, 30 aa, Artificial Sequence
  Description of Artificial Sequence: Synthetic polypeptide
SEEEIRTTNPVATEQYGEVSCTNLQKGGNR

SEQ ID NO: 11859 - protein, 28 aa, Artificial Sequence
  Description of Artificial Sequence: Synthetic peptide
DEDEIRTTNPVATEQYGTVSTQLQREND

SEQ ID NO: 11860 - protein, 30 aa, Artificial Sequence
  Description of Artificial Sequence: Synthetic polypeptide
DEEEIRTTNPVATEQYGSVSTDLNRLGDNA

SEQ ID NO: 11861 - protein, 29 aa, Artificial Sequence
  Description of Artificial Sequence: Synthetic peptide
AEEEIRTTNPVATEQYGSVSTTNLESGNS

SEQ ID NO: 11862 - protein, 31 aa, Artificial Sequence
  Description of Artificial Sequence: Synthetic polypeptide
DEEEIRTTNPVATEQYGSVSQTNLQFGIQRQ

SEQ ID NO: 11863 - protein, 30 aa, Artificial Sequence
  Description of Artificial Sequence: Synthetic polypeptide
DEDEIRTTNPVATEQYGSVSYTNLDVGNDR

SEQ ID NO: 11864 - protein, 28 aa, Artificial Sequence
  Description of Artificial Sequence: Synthetic peptide
DEDEIRTTNPVATEQYGSVTTNLQGGQE

SEQ ID NO: 11865 - protein, 28 aa, Artificial Sequence
  Description of Artificial Sequence: Synthetic peptide
DEEEIRTTNPNATEQYGSVSVNTFRGND

SEQ ID NO: 11866 - protein, 30 aa, Artificial Sequence
  Description of Artificial Sequence: Synthetic polypeptide
DEEEIRTTNPVATEQYGSVSQTNLARGEQL

SEQ ID NO: 11867 - protein, 28 aa, Artificial Sequence
  Description of Artificial Sequence: Synthetic peptide
DEDEIRTTNPVATEQYGSVVTNLQLGEE

SEQ ID NO: 11868 - protein, 31 aa, Artificial Sequence
  Description of Artificial Sequence: Synthetic polypeptide
DEEEIRTTNPVATEQYGSVSMNNLVQRLNER

SEQ ID NO: 11869 - protein, 29 aa, Artificial Sequence
  Description of Artificial Sequence: Synthetic peptide
DEEEIRTTNPVATEQYGSVSLGTLQRING

SEQ ID NO: 11870 - protein, 29 aa, Artificial Sequence
  Description of Artificial Sequence: Synthetic peptide
SEEEIRTTNPVATEQYGCVSTNLQGGNQN

SEQ ID NO: 11871 - protein, 30 aa, Artificial Sequence
  Description of Artificial Sequence: Synthetic polypeptide
AEEEIRTTNPVATEQYGSVSTTNLGQVGNQ

SEQ ID NO: 11872 - protein, 30 aa, Artificial Sequence
  Description of Artificial Sequence: Synthetic polypeptide
DEEEIRTTNPVATEQYGSVSQTNGQPRINN

SEQ ID NO: 11873 - protein, 31 aa, Artificial Sequence
  Description of Artificial Sequence: Synthetic polypeptide
DEEEIRTTNPVATEQYGSVSTDLNQGGGNSR

SEQ ID NO: 11874 - protein, 28 aa, Artificial Sequence
  Description of Artificial Sequence: Synthetic peptide
AEEEIRTTNPVATEEYGCISCNLQRGNR

SEQ ID NO: 11875 - protein, 31 aa, Artificial Sequence
  Description of Artificial Sequence: Synthetic polypeptide
DEEEIRTTNPVATEQYGSVSTDLNQGTGNFR

SEQ ID NO: 11876 - protein, 30 aa, Artificial Sequence
  Description of Artificial Sequence: Synthetic polypeptide
DEEEIRTTNPVATEQYGSVSTDLNRGGDNL

SEQ ID NO: 11877 - protein, 30 aa, Artificial Sequence
  Description of Artificial Sequence: Synthetic polypeptide
DEEEIRTTNPVATEQYGSVSMNLQTEGQTR

SEQ ID NO: 11878 - protein, 28 aa, Artificial Sequence
  Description of Artificial Sequence: Synthetic peptide
SEEEIRTTNPIATEQWGSVSENLMRGNR

SEQ ID NO: 11879 - protein, 30 aa, Artificial Sequence
  Description of Artificial Sequence: Synthetic polypeptide
DEEEIRTTNPVATEQYGSVSQNDQRGGTRM

SEQ ID NO: 11880 - protein, 30 aa, Artificial Sequence
  Description of Artificial Sequence: Synthetic polypeptide
DEEEIRTTNPMATEQYGSVITTNLQRGNHT

SEQ ID NO: 11881 - protein, 31 aa, Artificial Sequence
  Description of Artificial Sequence: Synthetic polypeptide
DEEEIRTTNPVATEQYGCSVATNLSTTRGNR

SEQ ID NO: 11882 - protein, 31 aa, Artificial Sequence
  Description of Artificial Sequence: Synthetic polypeptide
DEEEIRTTNPVATEQYGSVSMTNLQNGGVRV

SEQ ID NO: 11883 - protein, 31 aa, Artificial Sequence
  Description of Artificial Sequence: Synthetic polypeptide
DEEEIRTTNPVATEQYGSVSMTNLQNIGIRE

SEQ ID NO: 11884 - protein, 31 aa, Artificial Sequence
  Description of Artificial Sequence: Synthetic polypeptide
DEEEIRTTNPVATEQYGSVSTDNLQENGNND

SEQ ID NO: 11885 - protein, 32 aa, Artificial Sequence
  Description of Artificial Sequence: Synthetic polypeptide
AEEEIRTTNPVATEQYGSVSTTNLTQRGENYR

SEQ ID NO: 11886 - protein, 29 aa, Artificial Sequence
  Description of Artificial Sequence: Synthetic peptide
AEEEIRTTNPVATEQYGSVSTTNLVGNNR

SEQ ID NO: 11887 - protein, 31 aa, Artificial Sequence
  Description of Artificial Sequence: Synthetic polypeptide
DEEEIRTTNPVATEQYGSVSMTNLQNRSMNV

SEQ ID NO: 11888 - protein, 28 aa, Artificial Sequence
  Description of Artificial Sequence: Synthetic peptide
DEEEIRTTNPLATEQYGSVSCNIGRGND

SEQ ID NO: 11889 - protein, 28 aa, Artificial Sequence
  Description of Artificial Sequence: Synthetic peptide
SEEEIRTTNPTATELYGSVSTNLQNGNT

SEQ ID NO: 11890 - protein, 31 aa, Artificial Sequence
  Description of Artificial Sequence: Synthetic polypeptide
DEEEIRTTNPVATEQYGSVSTDNLQETGGNS

SEQ ID NO: 11891 - protein, 30 aa, Artificial Sequence
  Description of Artificial Sequence: Synthetic polypeptide
AEEEIRTTNPVATEAYGSVSTTNLQRGNNN

SEQ ID NO: 11892 - protein, 31 aa, Artificial Sequence
  Description of Artificial Sequence: Synthetic polypeptide
DEEEIRTTNPVATEQYGSVSMTNLQTRGDTG

SEQ ID NO: 11893 - protein, 29 aa, Artificial Sequence
  Description of Artificial Sequence: Synthetic peptide
DEDEICTTNPVATEQYGSVSTNLQRLDNA

SEQ ID NO: 11894 - protein, 29 aa, Artificial Sequence
  Description of Artificial Sequence: Synthetic peptide
SEEEIRTTNPIATEQYGSVSTNLEDRGNL

SEQ ID NO: 11895 - protein, 29 aa, Artificial Sequence
  Description of Artificial Sequence: Synthetic peptide
DEDEICTTNPVATEQYGSVSTNLQRINEE

SEQ ID NO: 11896 - protein, 30 aa, Artificial Sequence
  Description of Artificial Sequence: Synthetic polypeptide
AEEEIRTTNPVATEQYGSVSTTNLQYGNNE

SEQ ID NO: 11897 - protein, 31 aa, Artificial Sequence
  Description of Artificial Sequence: Synthetic polypeptide
DEEEIRTTNPVATEQYGSVSMTNLPQRMGLM

SEQ ID NO: 11898 - protein, 31 aa, Artificial Sequence
  Description of Artificial Sequence: Synthetic polypeptide
AEEEIRTTNPVATEQYGSVSTTNLQVQGNRE

SEQ ID NO: 11899 - protein, 33 aa, Artificial Sequence
  Description of Artificial Sequence: Synthetic polypeptide
DEEEIRTTNPVATEQYGCSVSTNELSQNRGNNR

SEQ ID NO: 11900 - protein, 29 aa, Artificial Sequence
  Description of Artificial Sequence: Synthetic peptide
SEEEIRTTNPVATECYGSVSENEQRGENR

SEQ ID NO: 11901 - protein, 31 aa, Artificial Sequence
  Description of Artificial Sequence: Synthetic polypeptide
DEEEIRTTNPVATEQYGSVSMTNGLQTGNTT

SEQ ID NO: 11902 - protein, 29 aa, Artificial Sequence
  Description of Artificial Sequence: Synthetic peptide
SEEEIRTTNPVATEAYGSVSTNLQQGGNP

SEQ ID NO: 11903 - protein, 31 aa, Artificial Sequence
  Description of Artificial Sequence: Synthetic polypeptide
DEEEIRTTNPVATEQYGSVSTDNLDQRGEHV

SEQ ID NO: 11904 - protein, 29 aa, Artificial Sequence
  Description of Artificial Sequence: Synthetic peptide
SEEEIRTTNPVATEAYGSVSTNLQPGNGM

SEQ ID NO: 11905 - protein, 28 aa, Artificial Sequence
  Description of Artificial Sequence: Synthetic peptide
DEEEIRTTNPLATEQYGSVSYNIERGND

SEQ ID NO: 11906 - protein, 31 aa, Artificial Sequence
  Description of Artificial Sequence: Synthetic polypeptide
AEEEIRTTNPVATEQYGSVSTTNLQQSGDNR

SEQ ID NO: 11907 - protein, 30 aa, Artificial Sequence
  Description of Artificial Sequence: Synthetic polypeptide
DEEEIRTTNPLATEQYGSVIGTNLQRGNHA

SEQ ID NO: 11908 - protein, 30 aa, Artificial Sequence
  Description of Artificial Sequence: Synthetic polypeptide
DEEEIRTTNPVATEQYGSVSMTNGPQRGKF

SEQ ID NO: 11909 - protein, 30 aa, Artificial Sequence
  Description of Artificial Sequence: Synthetic polypeptide
DEEEIRTTNPVATEQYGCTCSTNELQRINR

SEQ ID NO: 11910 - protein, 31 aa, Artificial Sequence
  Description of Artificial Sequence: Synthetic polypeptide
AEEEIRTTNPVATEQYGSVSTTNLQTEGNER

SEQ ID NO: 11911 - protein, 30 aa, Artificial Sequence
  Description of Artificial Sequence: Synthetic polypeptide
AEEEIRTTNPVATEQYGSVSTTNLQTTGNM

SEQ ID NO: 11912 - protein, 31 aa, Artificial Sequence
  Description of Artificial Sequence: Synthetic polypeptide
AEEEIRTTNPVATEQYGSVSTTNLQTVGNQR

SEQ ID NO: 11913 - protein, 31 aa, Artificial Sequence
  Description of Artificial Sequence: Synthetic polypeptide
DEEEIRTTNPVATEQYGCSVSTNMLSQTGSR

SEQ ID NO: 11914 - protein, 31 aa, Artificial Sequence
  Description of Artificial Sequence: Synthetic polypeptide
DEEEIRTTNPVATEQYGSVSTDNLQDGNANA

SEQ ID NO: 11915 - protein, 31 aa, Artificial Sequence
  Description of Artificial Sequence: Synthetic polypeptide
DEEEIRTTNPVATEQYGSVSTDNLQEEGNNS

SEQ ID NO: 11916 - protein, 31 aa, Artificial Sequence
  Description of Artificial Sequence: Synthetic polypeptide
AEEEIRTTNPVATEQYGSVSTTNLQQVGNRE

SEQ ID NO: 11917 - protein, 30 aa, Artificial Sequence
  Description of Artificial Sequence: Synthetic polypeptide
DEEEIRTTNPLATEQYGSVIATNLQRGNYA

SEQ ID NO: 11918 - protein, 30 aa, Artificial Sequence
  Description of Artificial Sequence: Synthetic polypeptide
DEDEICTTNPVATEQYGSVSTNLQHEGNER

SEQ ID NO: 11919 - protein, 31 aa, Artificial Sequence
  Description of Artificial Sequence: Synthetic polypeptide
DEEEIRTTNPVATEQYGSVSMTNLQVTSGNV

SEQ ID NO: 11920 - protein, 28 aa, Artificial Sequence
  Description of Artificial Sequence: Synthetic peptide
SEEEIRTTNPIATEQYGSVSEDLMRGNR

SEQ ID NO: 11921 - protein, 28 aa, Artificial Sequence
  Description of Artificial Sequence: Synthetic peptide
SEEEIRTTNPIATEQYGSVSECLQHGNR

SEQ ID NO: 11922 - protein, 28 aa, Artificial Sequence
  Description of Artificial Sequence: Synthetic peptide
AEEEIRTTNPVATEAYGSVSTNPQLGNE

SEQ ID NO: 11923 - protein, 31 aa, Artificial Sequence
  Description of Artificial Sequence: Synthetic polypeptide
DEEEIRTTNPVATEQYGSVSTDNLQQEFGNA

SEQ ID NO: 11924 - protein, 31 aa, Artificial Sequence
  Description of Artificial Sequence: Synthetic polypeptide
DEEEIRTTNPVATEQYGSVSMTWLQQRSQNR

SEQ ID NO: 11925 - protein, 30 aa, Artificial Sequence
  Description of Artificial Sequence: Synthetic polypeptide
AEEEIRTTNPVATEAYGSVSTNNLVQEGNR

SEQ ID NO: 11926 - protein, 31 aa, Artificial Sequence
  Description of Artificial Sequence: Synthetic polypeptide
DEEEIRTTNPVATEQYGSVSTDNLQQEFGNQ

SEQ ID NO: 11927 - protein, 31 aa, Artificial Sequence
  Description of Artificial Sequence: Synthetic polypeptide
DEEEIRTTNPVATEQYGCIVSTNLQRFNSER

SEQ ID NO: 11928 - protein, 32 aa, Artificial Sequence
  Description of Artificial Sequence: Synthetic polypeptide
DEEEIRTTNPVATEQYGSVSKTNDLGQRSQNR

SEQ ID NO: 11929 - protein, 29 aa, Artificial Sequence
  Description of Artificial Sequence: Synthetic peptide
SEEEIRTTNPIATEQYGSVCSENLMRGNR

SEQ ID NO: 11930 - protein, 29 aa, Artificial Sequence
  Description of Artificial Sequence: Synthetic peptide
SEEEIRTTNPIATEQYGSISENLQQRGNR

SEQ ID NO: 11931 - protein, 28 aa, Artificial Sequence
  Description of Artificial Sequence: Synthetic peptide
SEEEIRTTNPIATEQYGSISENLMRGNR

SEQ ID NO: 11932 - protein, 30 aa, Artificial Sequence
  Description of Artificial Sequence: Synthetic polypeptide
DEEEIRTTNPVATEQYGSVSMTWLQREGDQ

SEQ ID NO: 11933 - protein, 28 aa, Artificial Sequence
  Description of Artificial Sequence: Synthetic peptide
SEEEIRTTNPIATEQYGEVSENLMRGNR

SEQ ID NO: 11934 - protein, 30 aa, Artificial Sequence
  Description of Artificial Sequence: Synthetic polypeptide
DEEEIRTTNPVATEQYGSVSTDNLQQSVNV

SEQ ID NO: 11935 - protein, 29 aa, Artificial Sequence
  Description of Artificial Sequence: Synthetic peptide
AEEEIRTTNPVATEAYGSVSTNLQQGDRL

SEQ ID NO: 11936 - protein, 28 aa, Artificial Sequence
  Description of Artificial Sequence: Synthetic peptide
AEEEIRTTNPVATEAYGSVSTNLQREIQ

SEQ ID NO: 11937 - protein, 30 aa, Artificial Sequence
  Description of Artificial Sequence: Synthetic polypeptide
DEEEIRTTNPVATEQYGSVSMTNGGQRGPQ

SEQ ID NO: 11938 - protein, 28 aa, Artificial Sequence
  Description of Artificial Sequence: Synthetic peptide
SEEEIRTTNPIATEQYGSVSENGMRGNR

SEQ ID NO: 11939 - protein, 31 aa, Artificial Sequence
  Description of Artificial Sequence: Synthetic polypeptide
DEEEIRTTNPVATEQYGCIVSTNLQRGSNIS

SEQ ID NO: 11940 - protein, 32 aa, Artificial Sequence
  Description of Artificial Sequence: Synthetic polypeptide
DEEEIRTTNPVATEQYGSVSMTPLGQRMGSNR

SEQ ID NO: 11941 - protein, 28 aa, Artificial Sequence
  Description of Artificial Sequence: Synthetic peptide
SEEEIRTTNPIATEQYGSVSENLQREER

SEQ ID NO: 11942 - protein, 28 aa, Artificial Sequence
  Description of Artificial Sequence: Synthetic peptide
SEEEIRTTNPIATEQYGSVSENLNRGNV

SEQ ID NO: 11943 - protein, 29 aa, Artificial Sequence
  Description of Artificial Sequence: Synthetic peptide
SEEEIRTTNPIATEQYGSVSENLMRNGNR

SEQ ID NO: 11944 - protein, 28 aa, Artificial Sequence
  Description of Artificial Sequence: Synthetic peptide
SEEEIRTTNPIATEQYGSVSENLMRGNL

SEQ ID NO: 11945 - protein, 32 aa, Artificial Sequence
  Description of Artificial Sequence: Synthetic polypeptide
DEEEIRTTNPVATEQYGSVSPTVNLQRGNILQ

SEQ ID NO: 11946 - protein, 28 aa, Artificial Sequence
  Description of Artificial Sequence: Synthetic peptide
SEEEIRTTNPIATEQYGSVSENLMRGER

SEQ ID NO: 11947 - protein, 28 aa, Artificial Sequence
  Description of Artificial Sequence: Synthetic peptide
SEEEIRTTNPIATEQYGSVSENGNRGNR

SEQ ID NO: 11948 - protein, 28 aa, Artificial Sequence
  Description of Artificial Sequence: Synthetic peptide
SEEEIRTTNPIATEQYGSVSENLMRENR

SEQ ID NO: 11949 - protein, 28 aa, Artificial Sequence
  Description of Artificial Sequence: Synthetic peptide
SEEEIRTTNPIATEQYGSVSENLMHGNR

SEQ ID NO: 11950 - protein, 30 aa, Artificial Sequence
  Description of Artificial Sequence: Synthetic polypeptide
DEEEIRTTNPVATEQYGCNVSTNLFRGGNQ

SEQ ID NO: 11951 - protein, 31 aa, Artificial Sequence
  Description of Artificial Sequence: Synthetic polypeptide
DEEEIRTTNPVATEQYGSVSMTSNLQRNNFE

SEQ ID NO: 11952 - protein, 28 aa, Artificial Sequence
  Description of Artificial Sequence: Synthetic peptide
DEDEICTTNPVATEGYGSVSTNLDRGNE

SEQ ID NO: 11953 - protein, 31 aa, Artificial Sequence
  Description of Artificial Sequence: Synthetic polypeptide
DEEEIRTTNPVATEQYGSVSTDNLQMGNEGG

SEQ ID NO: 11954 - protein, 29 aa, Artificial Sequence
  Description of Artificial Sequence: Synthetic peptide
SEEEIRTTNPIATEQYGSVSENLMDRGNR

SEQ ID NO: 11955 - protein, 29 aa, Artificial Sequence
  Description of Artificial Sequence: Synthetic peptide
SEEEIRTTNPIATEQYGSVSENLEDRGNR

SEQ ID NO: 11956 - protein, 29 aa, Artificial Sequence
  Description of Artificial Sequence: Synthetic peptide
SEEEIRTTNPIATEQYGSVSENLMNRGNR

SEQ ID NO: 11957 - protein, 28 aa, Artificial Sequence
  Description of Artificial Sequence: Synthetic peptide
SEEEIRTTNPVATECYGSVSENLMRENR

SEQ ID NO: 11958 - protein, 28 aa, Artificial Sequence
  Description of Artificial Sequence: Synthetic peptide
DEDEIKTTNPVATEQYGSVSTNLNGGNT

SEQ ID NO: 11959 - protein, 31 aa, Artificial Sequence
  Description of Artificial Sequence: Synthetic polypeptide
DEEEIRTTNPVATEQYGSVSMTNDQRNNDRN

SEQ ID NO: 11960 - protein, 30 aa, Artificial Sequence
  Description of Artificial Sequence: Synthetic polypeptide
DEEEIRTTNPVATEQYGSVSTDLTQRSVND

SEQ ID NO: 11961 - protein, 29 aa, Artificial Sequence
  Description of Artificial Sequence: Synthetic peptide
SEEEIRTTNPVATEIYGSVVSTNLQQQNR

SEQ ID NO: 11962 - protein, 30 aa, Artificial Sequence
  Description of Artificial Sequence: Synthetic polypeptide
DEEEIRTTNPVATEQYGSVSTDLVNGNLRE

SEQ ID NO: 11963 - protein, 30 aa, Artificial Sequence
  Description of Artificial Sequence: Synthetic polypeptide
TEEEIRCTNPVATEQYGSVSTNLQRGNQQV

SEQ ID NO: 11964 - protein, 29 aa, Artificial Sequence
  Description of Artificial Sequence: Synthetic peptide
SEEEIRTTNPVATEIYGSVSTQTLQNGNR

SEQ ID NO: 11965 - protein, 29 aa, Artificial Sequence
  Description of Artificial Sequence: Synthetic peptide
SEEEIRTTNPVATEIYGSVSTNLQRGEGE

SEQ ID NO: 11966 - protein, 29 aa, Artificial Sequence
  Description of Artificial Sequence: Synthetic peptide
DEEEIRTTNPVATEQYGCVATNLQRFNSP

SEQ ID NO: 11967 - protein, 32 aa, Artificial Sequence
  Description of Artificial Sequence: Synthetic polypeptide
DEEEIRTTNPVATEQYGSVSTDLTQRSGNDRD

SEQ ID NO: 11968 - protein, 29 aa, Artificial Sequence
  Description of Artificial Sequence: Synthetic peptide
DEEEIRTTNPVATEQYGCVATNLQRENDD

SEQ ID NO: 11969 - protein, 29 aa, Artificial Sequence
  Description of Artificial Sequence: Synthetic peptide
DEEEIRTTNPVATEQYGCVATNLQRANNF

SEQ ID NO: 11970 - protein, 29 aa, Artificial Sequence
  Description of Artificial Sequence: Synthetic peptide
SEEEIRTTNPVATEHYGSVSTNLQSGNAM

SEQ ID NO: 11971 - protein, 31 aa, Artificial Sequence
  Description of Artificial Sequence: Synthetic polypeptide
DEEEIRTTNPVATEQYGSVSLENLTQRGEDR

SEQ ID NO: 11972 - protein, 30 aa, Artificial Sequence
  Description of Artificial Sequence: Synthetic polypeptide
AEEEIRTTNPVATEQYGSVSTTNLQNVNFR

SEQ ID NO: 11973 - protein, 30 aa, Artificial Sequence
  Description of Artificial Sequence: Synthetic polypeptide
AEEEIRTTNPVATEQYGSVSTTNLQPDNAR

SEQ ID NO: 11974 - protein, 30 aa, Artificial Sequence
  Description of Artificial Sequence: Synthetic polypeptide
AEEEIRTTNPVATEQYGSVSTTNLQPGNVP

SEQ ID NO: 11975 - protein, 30 aa, Artificial Sequence
  Description of Artificial Sequence: Synthetic polypeptide
DEEEIRTTNPVATEQYGSVSMTDLQNGVRD

SEQ ID NO: 11976 - protein, 29 aa, Artificial Sequence
  Description of Artificial Sequence: Synthetic peptide
SEEEIRTTNPVATEIYGSVSTNLQGGGNM

SEQ ID NO: 11977 - protein, 30 aa, Artificial Sequence
  Description of Artificial Sequence: Synthetic polypeptide
DEEEIRTTNPMATEQYGSVCFTNLQRGNFA

SEQ ID NO: 11978 - protein, 29 aa, Artificial Sequence
  Description of Artificial Sequence: Synthetic peptide
DEEEIRTTNPVATEQYGCVATNLQRGPDQ

SEQ ID NO: 11979 - protein, 30 aa, Artificial Sequence
  Description of Artificial Sequence: Synthetic polypeptide
AEEEIRTTNPVATEQYGSVSTTNLQMGIRE

SEQ ID NO: 11980 - protein, 30 aa, Artificial Sequence
  Description of Artificial Sequence: Synthetic polypeptide
AEEEIRTTNPVATEQYGSVSTTNLQGQGTR

SEQ ID NO: 11981 - protein, 30 aa, Artificial Sequence
  Description of Artificial Sequence: Synthetic polypeptide
DEEEIRTTNPMATEQYGSVIQTNLQRGNHQ

SEQ ID NO: 11982 - protein, 30 aa, Artificial Sequence
  Description of Artificial Sequence: Synthetic polypeptide
DEEEIRTTNPVATEQYGSVSTDLQTNGNEI

SEQ ID NO: 11983 - protein, 28 aa, Artificial Sequence
  Description of Artificial Sequence: Synthetic peptide
TEEEIRCTNPIATEQYGSVSENLMRGNR

SEQ ID NO: 11984 - protein, 30 aa, Artificial Sequence
  Description of Artificial Sequence: Synthetic polypeptide
DEEEIRTTNPMATEQYGSVIGTNLQRGNNQ

SEQ ID NO: 11985 - protein, 30 aa, Artificial Sequence
  Description of Artificial Sequence: Synthetic polypeptide
DEEEIRTTNPMATEQYGSVIETNLQRGNDA

SEQ ID NO: 11986 - protein, 30 aa, Artificial Sequence
  Description of Artificial Sequence: Synthetic polypeptide
DEEEIRTTNPVATEQYGSVSTDLQVRNSQR

SEQ ID NO: 11987 - protein, 30 aa, Artificial Sequence
  Description of Artificial Sequence: Synthetic polypeptide
DEEEIRTTNPVATEQYGSVSTDLSQDGNAG

SEQ ID NO: 11988 - protein, 30 aa, Artificial Sequence
  Description of Artificial Sequence: Synthetic polypeptide
AEEEIRTTNPVATEAYGSVVSVTNLQRGNL

SEQ ID NO: 11989 - protein, 31 aa, Artificial Sequence
  Description of Artificial Sequence: Synthetic polypeptide
DEEEIRTTNPVATEQYGSVSQINDEQRGNRL

SEQ ID NO: 11990 - protein, 30 aa, Artificial Sequence
  Description of Artificial Sequence: Synthetic polypeptide
DEEEIRTTNPMATEQYGSVIATNLQRGNSV

SEQ ID NO: 11991 - protein, 30 aa, Artificial Sequence
  Description of Artificial Sequence: Synthetic polypeptide
DEEEIRTTNPMATEQYGSVIATNLQRGNLI

SEQ ID NO: 11992 - protein, 30 aa, Artificial Sequence
  Description of Artificial Sequence: Synthetic polypeptide
DEEEIRTTNPMATEQYGSVIATNLQRGNEV

SEQ ID NO: 11993 - protein, 29 aa, Artificial Sequence
  Description of Artificial Sequence: Synthetic peptide
DEEEIRTTNPVATEQYGSVSTDLQWESNV

SEQ ID NO: 11994 - protein, 31 aa, Artificial Sequence
  Description of Artificial Sequence: Synthetic polypeptide
AEEEIRTTNPVATEQYGSVSTTNLQLYGNER

SEQ ID NO: 11995 - protein, 29 aa, Artificial Sequence
  Description of Artificial Sequence: Synthetic peptide
DEEEIRTTNPVATEQYGCVATNLQTPENR

SEQ ID NO: 11996 - protein, 30 aa, Artificial Sequence
  Description of Artificial Sequence: Synthetic polypeptide
DEEEIRTTNPMATEQYGSVIATNLQRGNTV

SEQ ID NO: 11997 - protein, 30 aa, Artificial Sequence
  Description of Artificial Sequence: Synthetic polypeptide
DEEEIRTTNPVATEQYGSVSQNDQRGDNHQ

SEQ ID NO: 11998 - protein, 30 aa, Artificial Sequence
  Description of Artificial Sequence: Synthetic polypeptide
DEEEIRTTNPMATEQYGSVCATNLQRGNFA

SEQ ID NO: 11999 - protein, 30 aa, Artificial Sequence
  Description of Artificial Sequence: Synthetic polypeptide
SEEEIRTTNPVATEHYGSVSNTNLHRGDNR

SEQ ID NO: 12000 - protein, 30 aa, Artificial Sequence
  Description of Artificial Sequence: Synthetic polypeptide
TEEEIRTTNPVATEAYGSVSTNALQQRGNT

SEQ ID NO: 12001 - protein, 28 aa, Artificial Sequence
  Description of Artificial Sequence: Synthetic peptide
SEEEIRTTNPVATEEYGSVSTNLQIGAE

SEQ ID NO: 12002 - protein, 28 aa, Artificial Sequence
  Description of Artificial Sequence: Synthetic peptide
TEEEIRTTNPVATEAYGSVSTNLQEGSQ

SEQ ID NO: 12003 - protein, 30 aa, Artificial Sequence
  Description of Artificial Sequence: Synthetic polypeptide
TEEEIRTTNPVATEAYGSVSTNLQRGNEED

SEQ ID NO: 12004 - protein, 30 aa, Artificial Sequence
  Description of Artificial Sequence: Synthetic polypeptide
TEEEIRTTNPVATEAYGSVSTNLQRGNYEA

SEQ ID NO: 12005 - protein, 28 aa, Artificial Sequence
  Description of Artificial Sequence: Synthetic peptide
DEECIRCTNPVATEQYGSVSWNNQRGNV

SEQ ID NO: 12006 - protein, 30 aa, Artificial Sequence
  Description of Artificial Sequence: Synthetic polypeptide
SEEEIRTTNPVATEEYGSVSTNLAQVGNNR

SEQ ID NO: 12007 - protein, 30 aa, Artificial Sequence
  Description of Artificial Sequence: Synthetic polypeptide
DEEEIRTTNPVATEQYGSVSPVNLDQSGLR

SEQ ID NO: 12008 - protein, 29 aa, Artificial Sequence
  Description of Artificial Sequence: Synthetic peptide
DEEEIRTTNPVATEQYGSVSPVLQRGEDG

SEQ ID NO: 12009 - protein, 31 aa, Artificial Sequence
  Description of Artificial Sequence: Synthetic polypeptide
DEEEIRTTNPVATEQYGSVSPVFNEQRGNER

SEQ ID NO: 12010 - protein, 28 aa, Artificial Sequence
  Description of Artificial Sequence: Synthetic peptide
SEEEIRTTNPVATEEYGSVSTNDQTGNY

SEQ ID NO: 12011 - protein, 28 aa, Artificial Sequence
  Description of Artificial Sequence: Synthetic peptide
DEECIRCTNPVATEQYGSVSWNQQRGNI

SEQ ID NO: 12012 - protein, 28 aa, Artificial Sequence
  Description of Artificial Sequence: Synthetic peptide
DEECIRCTNPVATEQYGSVSWNSQRGNE

SEQ ID NO: 12013 - protein, 28 aa, Artificial Sequence
  Description of Artificial Sequence: Synthetic peptide
SEEEIRTTNPVATEEYGCSSINLQRGNR

SEQ ID NO: 12014 - protein, 30 aa, Artificial Sequence
  Description of Artificial Sequence: Synthetic polypeptide
TEEEIRTTNPVATEAYGSVVSITNLQGGNR

SEQ ID NO: 12015 - protein, 30 aa, Artificial Sequence
  Description of Artificial Sequence: Synthetic polypeptide
DEEEIRTTNPVATEQYGSVSMTNDQRNDRM

SEQ ID NO: 12016 - protein, 32 aa, Artificial Sequence
  Description of Artificial Sequence: Synthetic polypeptide
DEEEIRTTNPVATEQYGSVSPVFNLQRGENRE

SEQ ID NO: 12017 - protein, 29 aa, Artificial Sequence
  Description of Artificial Sequence: Synthetic peptide
DEEEIRTTNPVATEQYGSVSTDMQEGEDR

SEQ ID NO: 12018 - protein, 30 aa, Artificial Sequence
  Description of Artificial Sequence: Synthetic polypeptide
SEEEIRTTNPVATEEYGSVSTNLQQQGNER

SEQ ID NO: 12019 - protein, 31 aa, Artificial Sequence
  Description of Artificial Sequence: Synthetic polypeptide
DEEEIRTTNPVATEQYGCVCSTTLNQRGSNR

SEQ ID NO: 12020 - protein, 30 aa, Artificial Sequence
  Description of Artificial Sequence: Synthetic polypeptide
AEEEIRTTNPVATEQYGSVSTTNLQQGNGN

SEQ ID NO: 12021 - protein, 31 aa, Artificial Sequence
  Description of Artificial Sequence: Synthetic polypeptide
DEEEIRTTNPVATEQYGSVSTDNDLYREGTR

SEQ ID NO: 12022 - protein, 29 aa, Artificial Sequence
  Description of Artificial Sequence: Synthetic peptide
DEEEIRTTNPVATEQYGSVSLENLQTIDR

SEQ ID NO: 12023 - protein, 29 aa, Artificial Sequence
  Description of Artificial Sequence: Synthetic peptide
TEEEIRTTNPVATEAYGSISTHLQRQGNR

SEQ ID NO: 12024 - protein, 32 aa, Artificial Sequence
  Description of Artificial Sequence: Synthetic polypeptide
DEEEIRTTNPVATEQYGSVSTDNGDQRGGNDR

SEQ ID NO: 12025 - protein, 29 aa, Artificial Sequence
  Description of Artificial Sequence: Synthetic peptide
DEEEIRTTNPVATEQYGCVATNGQRPENR

SEQ ID NO: 12026 - protein, 28 aa, Artificial Sequence
  Description of Artificial Sequence: Synthetic peptide
DEECIRCTNPVATEQYGSVSWNEQRGNT

SEQ ID NO: 12027 - protein, 29 aa, Artificial Sequence
  Description of Artificial Sequence: Synthetic peptide
SEEEIRTTNPVATEEYGSVSTTNLQDGNT

SEQ ID NO: 12028 - protein, 28 aa, Artificial Sequence
  Description of Artificial Sequence: Synthetic peptide
DEECIRCTNPVATEQYGSVSWNFQRGNF

SEQ ID NO: 12029 - protein, 28 aa, Artificial Sequence
  Description of Artificial Sequence: Synthetic peptide
DEEEIRTTNPMATEAYGSCSTNLARGNP

SEQ ID NO: 12030 - protein, 31 aa, Artificial Sequence
  Description of Artificial Sequence: Synthetic polypeptide
DEEEIRTTNPVATEQYGSVSPVNLVQRGNTI

SEQ ID NO: 12031 - protein, 29 aa, Artificial Sequence
  Description of Artificial Sequence: Synthetic peptide
DEEEIRTTNPVATEQYGSVSPVNLQRLDE

SEQ ID NO: 12032 - protein, 29 aa, Artificial Sequence
  Description of Artificial Sequence: Synthetic peptide
DEEEIRTTNPVATEQYGCVANNLQPRGND

SEQ ID NO: 12033 - protein, 31 aa, Artificial Sequence
  Description of Artificial Sequence: Synthetic polypeptide
DEEEIRTTNPVATEQYGSVSPVNLQRGNNQL

SEQ ID NO: 12034 - protein, 31 aa, Artificial Sequence
  Description of Artificial Sequence: Synthetic polypeptide
DEEEIRTTNPVATEQYGCVCSTTLNQRGNNR

SEQ ID NO: 12035 - protein, 30 aa, Artificial Sequence
  Description of Artificial Sequence: Synthetic polypeptide
DEEEIRTTNPVATEQYGSVSPVNLDQVGER

SEQ ID NO: 12036 - protein, 30 aa, Artificial Sequence
  Description of Artificial Sequence: Synthetic polypeptide
DEEEIRTTNPMATEAYGSVSTNLSQGTGNR

SEQ ID NO: 12037 - protein, 29 aa, Artificial Sequence
  Description of Artificial Sequence: Synthetic peptide
DEEEIRTTNPVATEQYGAASTNLQRGETE

SEQ ID NO: 12038 - protein, 28 aa, Artificial Sequence
  Description of Artificial Sequence: Synthetic peptide
DEEEIRTTNPVATEQYGAASGLLQRGDR

SEQ ID NO: 12039 - protein, 28 aa, Artificial Sequence
  Description of Artificial Sequence: Synthetic peptide
SEEEIRCTNPIATEQYGSVSLNLMRGNR

SEQ ID NO: 12040 - protein, 31 aa, Artificial Sequence
  Description of Artificial Sequence: Synthetic polypeptide
DEEEIRTTNPVATEQYGSVSPTHLNQRSQNR

SEQ ID NO: 12041 - protein, 29 aa, Artificial Sequence
  Description of Artificial Sequence: Synthetic peptide
DEEEIRTTNPVATEQYGSVSTHNQGGSNT

SEQ ID NO: 12042 - protein, 31 aa, Artificial Sequence
  Description of Artificial Sequence: Synthetic polypeptide
DEEEIRTTNPVATEQYGSVSITGNLDQGDNR

SEQ ID NO: 12043 - protein, 30 aa, Artificial Sequence
  Description of Artificial Sequence: Synthetic polypeptide
DEEEIRTTNPVATEQYGCVSSNLQRFGNDN

SEQ ID NO: 12044 - protein, 28 aa, Artificial Sequence
  Description of Artificial Sequence: Synthetic peptide
DEEAIRTTNPVATEQYGCVSTNEQHGNQ

SEQ ID NO: 12045 - protein, 33 aa, Artificial Sequence
  Description of Artificial Sequence: Synthetic polypeptide
DEEEIRTTNPVATEQYGSVSPTGNSLQQRGNRQ

SEQ ID NO: 12046 - protein, 28 aa, Artificial Sequence
  Description of Artificial Sequence: Synthetic peptide
SEEEIRCTNPIATEQWGSVSENLQRGNR

SEQ ID NO: 12047 - protein, 28 aa, Artificial Sequence
  Description of Artificial Sequence: Synthetic peptide
DEEAIRTTNPVATEQYGCVSTNDQFGNE

SEQ ID NO: 12048 - protein, 30 aa, Artificial Sequence
  Description of Artificial Sequence: Synthetic polypeptide
DEEEIRTTNPVATEQYGSVSTILDQIRNNE

SEQ ID NO: 12049 - protein, 30 aa, Artificial Sequence
  Description of Artificial Sequence: Synthetic polypeptide
DEEEIRTTNPVATEQYGSVSTILDQRGEMD

SEQ ID NO: 12050 - protein, 32 aa, Artificial Sequence
  Description of Artificial Sequence: Synthetic polypeptide
DEEEIRTTNPEATEQYGSVISTENLQERGPNR

SEQ ID NO: 12051 - protein, 30 aa, Artificial Sequence
  Description of Artificial Sequence: Synthetic polypeptide
DEEEIRTTNPEATEQYGSVIATNLQRGNQA

SEQ ID NO: 12052 - protein, 30 aa, Artificial Sequence
  Description of Artificial Sequence: Synthetic polypeptide
DEEEIRTTNPVATEQYGSVSPTGLQRIMVR

SEQ ID NO: 12053 - protein, 29 aa, Artificial Sequence
  Description of Artificial Sequence: Synthetic peptide
AEEEIRTTNPVATEQYGSVSTVGQVGVNR

SEQ ID NO: 12054 - protein, 31 aa, Artificial Sequence
  Description of Artificial Sequence: Synthetic polypeptide
DEEEIRTTNPVATEQYGSVSTILQYRGVERA

SEQ ID NO: 12055 - protein, 28 aa, Artificial Sequence
  Description of Artificial Sequence: Synthetic peptide
AEEEIRTTNPVATEQYGSVSTVDQRGIH

SEQ ID NO: 12056 - protein, 31 aa, Artificial Sequence
  Description of Artificial Sequence: Synthetic polypeptide
DEEEIRTTNPVATEQYGSVSTHLSQRGNQSM

SEQ ID NO: 12057 - protein, 31 aa, Artificial Sequence
  Description of Artificial Sequence: Synthetic polypeptide
DEEEIRTTNPVATEQYGSVSITGNLQRGVLE

SEQ ID NO: 12058 - protein, 28 aa, Artificial Sequence
  Description of Artificial Sequence: Synthetic peptide
DEEAIRTTNPVATEQYGCVSTNPQPGNC

SEQ ID NO: 12059 - protein, 30 aa, Artificial Sequence
  Description of Artificial Sequence: Synthetic polypeptide
DEEEIRTTNPVATEQYGSVSTGNPQYFGER

SEQ ID NO: 12060 - protein, 29 aa, Artificial Sequence
  Description of Artificial Sequence: Synthetic peptide
DEEEIRTTNPVATECYGSVCSTEDQNGNR

SEQ ID NO: 12061 - protein, 29 aa, Artificial Sequence
  Description of Artificial Sequence: Synthetic peptide
DEEEIRTTNPVATEQYGSVSITMDQRGEI

SEQ ID NO: 12062 - protein, 29 aa, Artificial Sequence
  Description of Artificial Sequence: Synthetic peptide
DEEEIRTTNPVATEQWGSVASNLNRGNER

SEQ ID NO: 12063 - protein, 29 aa, Artificial Sequence
  Description of Artificial Sequence: Synthetic peptide
DEEEIRTTNPVATEQWGSVAMNLDRGNPR

SEQ ID NO: 12064 - protein, 28 aa, Artificial Sequence
  Description of Artificial Sequence: Synthetic peptide
DEEEIRTTNPVATEQYGSVSPTLDRGDM

SEQ ID NO: 12065 - protein, 31 aa, Artificial Sequence
  Description of Artificial Sequence: Synthetic polypeptide
DEEEIRTTNPVATEQYGSVSTGPLERLGSNR

SEQ ID NO: 12066 - protein, 28 aa, Artificial Sequence
  Description of Artificial Sequence: Synthetic peptide
SEEEIRCTNPIATEPYGSVSTNLMRGNR

SEQ ID NO: 12067 - protein, 28 aa, Artificial Sequence
  Description of Artificial Sequence: Synthetic peptide
TSEEIRTTNPVATDQYGSVSTHLQRGNF

SEQ ID NO: 12068 - protein, 28 aa, Artificial Sequence
  Description of Artificial Sequence: Synthetic peptide
SEEEIRCTNPIATEQYGEVSENLQRGNR

SEQ ID NO: 12069 - protein, 28 aa, Artificial Sequence
  Description of Artificial Sequence: Synthetic peptide
AEEEIAQTNPVATEQYGSVSTGLERGNR

SEQ ID NO: 12070 - protein, 30 aa, Artificial Sequence
  Description of Artificial Sequence: Synthetic polypeptide
DEEEIRTTNPVATEQYGSVSTGTLQYGNNT

SEQ ID NO: 12071 - protein, 30 aa, Artificial Sequence
  Description of Artificial Sequence: Synthetic polypeptide
DEEEIRTTNPVATEQYGSVSTGVLQRQDVR

SEQ ID NO: 12072 - protein, 29 aa, Artificial Sequence
  Description of Artificial Sequence: Synthetic peptide
DEEEIRTTNPVATEQYGSVSTGYHVRGNL

SEQ ID NO: 12073 - protein, 30 aa, Artificial Sequence
  Description of Artificial Sequence: Synthetic polypeptide
DEEEIRTTNPVATEQYGSVSTHLDQNGERS

SEQ ID NO: 12074 - protein, 30 aa, Artificial Sequence
  Description of Artificial Sequence: Synthetic polypeptide
DEEEIRTTNPVATEQYGSVSTHLQFGQNQS

SEQ ID NO: 12075 - protein, 29 aa, Artificial Sequence
  Description of Artificial Sequence: Synthetic peptide
DEEEIRTTNPVATEQYGSVSPTLDQRGEH

SEQ ID NO: 12076 - protein, 30 aa, Artificial Sequence
  Description of Artificial Sequence: Synthetic polypeptide
DEEEIRTTNPVATEQYGSVSTILVREGQND

SEQ ID NO: 12077 - protein, 31 aa, Artificial Sequence
  Description of Artificial Sequence: Synthetic polypeptide
DEEEIRTTNPVATEQYGSVSTINDDQRGERI

SEQ ID NO: 12078 - protein, 28 aa, Artificial Sequence
  Description of Artificial Sequence: Synthetic peptide
AEEEIRTTNPVATEQYGSVSTVLFSGNV

SEQ ID NO: 12079 - protein, 30 aa, Artificial Sequence
  Description of Artificial Sequence: Synthetic polypeptide
DEEEIRTTNPVATEQYGSVSTIVLQRQDER

SEQ ID NO: 12080 - protein, 29 aa, Artificial Sequence
  Description of Artificial Sequence: Synthetic peptide
TSEEIRTTNPVATEQYGVVSTNLQDGMNR

SEQ ID NO: 12081 - protein, 29 aa, Artificial Sequence
  Description of Artificial Sequence: Synthetic peptide
DEEEIRTTNPVATEQWGSTATNLQREGNS

SEQ ID NO: 12082 - protein, 29 aa, Artificial Sequence
  Description of Artificial Sequence: Synthetic peptide
DEEEIRTTNPVATEQYGSVSTLDQLGLMR

SEQ ID NO: 12083 - protein, 33 aa, Artificial Sequence
  Description of Artificial Sequence: Synthetic polypeptide
DEEEIRTTNPVATEQYGSVSITFNNLQRGENRL

SEQ ID NO: 12084 - protein, 32 aa, Artificial Sequence
  Description of Artificial Sequence: Synthetic polypeptide
DEEEIRTTNPVATEQYGSVSITENLQTRGNPE

SEQ ID NO: 12085 - protein, 31 aa, Artificial Sequence
  Description of Artificial Sequence: Synthetic polypeptide
DEEEIRTTNPVATEQYGSVSTLEDLQRINTR

SEQ ID NO: 12086 - protein, 30 aa, Artificial Sequence
  Description of Artificial Sequence: Synthetic polypeptide
DEEEIRTTNPVATEQYGSVSTINTQNEGER

SEQ ID NO: 12087 - protein, 32 aa, Artificial Sequence
  Description of Artificial Sequence: Synthetic polypeptide
DEEEIRTTNPVATEQYGSVSITENLQRGNDTD

SEQ ID NO: 12088 - protein, 30 aa, Artificial Sequence
  Description of Artificial Sequence: Synthetic polypeptide
DEEEIRTTNPVATEQYGSVSITELQRGLQG

SEQ ID NO: 12089 - protein, 30 aa, Artificial Sequence
  Description of Artificial Sequence: Synthetic polypeptide
DEEEIRTTNPVATEQYGSVSNPFNLQRVNI

SEQ ID NO: 12090 - protein, 29 aa, Artificial Sequence
  Description of Artificial Sequence: Synthetic peptide
DEEEIRTTNPVATEQYGSVSTLLDRQEER

SEQ ID NO: 12091 - protein, 29 aa, Artificial Sequence
  Description of Artificial Sequence: Synthetic peptide
AEEEIRTTNPVATEQYGSVSTVNGQTGNY

SEQ ID NO: 12092 - protein, 30 aa, Artificial Sequence
  Description of Artificial Sequence: Synthetic polypeptide
DEEEIRTTNPVATEQWGNVSTNLQDRGTNE

SEQ ID NO: 12093 - protein, 29 aa, Artificial Sequence
  Description of Artificial Sequence: Synthetic peptide
DEEEIRTTNPVATEQYGSVSTLLENIGDR

SEQ ID NO: 12094 - protein, 32 aa, Artificial Sequence
  Description of Artificial Sequence: Synthetic polypeptide
DEEEIRTTNPVATEQYGSVSPTELLQRGNQRT

SEQ ID NO: 12095 - protein, 31 aa, Artificial Sequence
  Description of Artificial Sequence: Synthetic polypeptide
DEEEIRTTNPVATEQYGSVSPTENLQTGDRI

SEQ ID NO: 12096 - protein, 31 aa, Artificial Sequence
  Description of Artificial Sequence: Synthetic polypeptide
DEEEIRTTNPVATEQYGSVSTGNNQFGSNRI

SEQ ID NO: 12097 - protein, 31 aa, Artificial Sequence
  Description of Artificial Sequence: Synthetic polypeptide
DEEEIRTTNPVATEQYGSVSTINLTQMGNGG

SEQ ID NO: 12098 - protein, 30 aa, Artificial Sequence
  Description of Artificial Sequence: Synthetic polypeptide
DEEEIRTTNPVATECYGSVSENLSQQGGNR

SEQ ID NO: 12099 - protein, 28 aa, Artificial Sequence
  Description of Artificial Sequence: Synthetic peptide
DEEAIRTTNPVATEQYGCVSTNAQFGND

SEQ ID NO: 12100 - protein, 28 aa, Artificial Sequence
  Description of Artificial Sequence: Synthetic peptide
AEEEIRTTNPVATEQYGSVSTVLNQGNV

SEQ ID NO: 12101 - protein, 30 aa, Artificial Sequence
  Description of Artificial Sequence: Synthetic polypeptide
DEEEIRTTNPVATEQYGSVSPTGDLQRENN

SEQ ID NO: 12102 - protein, 30 aa, Artificial Sequence
  Description of Artificial Sequence: Synthetic polypeptide
DEEEIRTTNPVATEQYGSVSTINDQNGNQS

SEQ ID NO: 12103 - protein, 28 aa, Artificial Sequence
  Description of Artificial Sequence: Synthetic peptide
DEEAIRTTNPVATEQYGCVSTNAQDGNA

SEQ ID NO: 12104 - protein, 30 aa, Artificial Sequence
  Description of Artificial Sequence: Synthetic polypeptide
DEEEIRTTNPVATEQYGSVSTINDQQGNIT

SEQ ID NO: 12105 - protein, 29 aa, Artificial Sequence
  Description of Artificial Sequence: Synthetic peptide
AEEEIRTTNPVATEQYGSVSTVLQDIGNV

SEQ ID NO: 12106 - protein, 31 aa, Artificial Sequence
  Description of Artificial Sequence: Synthetic polypeptide
DEEEIRTTNPVATEQYGSVSTINLQSIGNYQ

SEQ ID NO: 12107 - protein, 28 aa, Artificial Sequence
  Description of Artificial Sequence: Synthetic peptide
AEEEIRTTNPVATEQYGSVSTVLQHGIA

SEQ ID NO: 12108 - protein, 31 aa, Artificial Sequence
  Description of Artificial Sequence: Synthetic polypeptide
DEEEIRTTNPVATEQYGSVSPTFNMQRNNNR

SEQ ID NO: 12109 - protein, 32 aa, Artificial Sequence
  Description of Artificial Sequence: Synthetic polypeptide
DEEEIRTTNPVATEQYGSVSTINLQNRFGNAD

SEQ ID NO: 12110 - protein, 30 aa, Artificial Sequence
  Description of Artificial Sequence: Synthetic polypeptide
DEEEIRTTNPVATEQYGSVSTINLQQVLNV

SEQ ID NO: 12111 - protein, 29 aa, Artificial Sequence
  Description of Artificial Sequence: Synthetic peptide
AEEEIRTTNPVATEQYGSVSTVLQYGANN

SEQ ID NO: 12112 - protein, 29 aa, Artificial Sequence
  Description of Artificial Sequence: Synthetic peptide
AEEEIRTTNPVATEQYGSVSTVLQYGNNT

SEQ ID NO: 12113 - protein, 30 aa, Artificial Sequence
  Description of Artificial Sequence: Synthetic polypeptide
AEEEIRTTNPVATEQYGSVSTVLVQDGSNR

SEQ ID NO: 12114 - protein, 28 aa, Artificial Sequence
  Description of Artificial Sequence: Synthetic peptide
DEEEIRTTNPVATECYGSVSEELQRGEM

SEQ ID NO: 12115 - protein, 29 aa, Artificial Sequence
  Description of Artificial Sequence: Synthetic peptide
AEEEIRTTNPVATEQYGSVSTVLQIGGNT

SEQ ID NO: 12116 - protein, 31 aa, Artificial Sequence
  Description of Artificial Sequence: Synthetic polypeptide
DEEEIRTTNPVATEQYGSVSTGNNQFGSNRF

SEQ ID NO: 12117 - protein, 30 aa, Artificial Sequence
  Description of Artificial Sequence: Synthetic polypeptide
DEEAIRTTNPVATEQYGESVSIELQRGDNR

SEQ ID NO: 12118 - protein, 31 aa, Artificial Sequence
  Description of Artificial Sequence: Synthetic polypeptide
DEEEIRTTNPVATEQYGSVSITMLQRGESRD

SEQ ID NO: 12119 - protein, 30 aa, Artificial Sequence
  Description of Artificial Sequence: Synthetic polypeptide
DEEEIRTTNPVATEQYGSVSTGNLNGGNTL

SEQ ID NO: 12120 - protein, 31 aa, Artificial Sequence
  Description of Artificial Sequence: Synthetic polypeptide
DEEEIRTTNPVATEQYGSVSPTMNLQLGDRL

SEQ ID NO: 12121 - protein, 30 aa, Artificial Sequence
  Description of Artificial Sequence: Synthetic polypeptide
DEEEIRTTNPVATEQYGSVSNNLQRGPGFQ

SEQ ID NO: 12122 - protein, 28 aa, Artificial Sequence
  Description of Artificial Sequence: Synthetic peptide
SEEEIRCTNPIATEQYGSVGTNLMRGNR

SEQ ID NO: 12123 - protein, 31 aa, Artificial Sequence
  Description of Artificial Sequence: Synthetic polypeptide
DEEEIRTTNPVATEQYGSVSTGNLNQQEGNA

SEQ ID NO: 12124 - protein, 31 aa, Artificial Sequence
  Description of Artificial Sequence: Synthetic polypeptide
DEEEIRTTNPVATEQYGSVSPTMNLIQRGML

SEQ ID NO: 12125 - protein, 32 aa, Artificial Sequence
  Description of Artificial Sequence: Synthetic polypeptide
DEEEIRTTNPVATEQYGSVSTGNLQDRGNEGM

SEQ ID NO: 12126 - protein, 30 aa, Artificial Sequence
  Description of Artificial Sequence: Synthetic polypeptide
DEEEIRTTNPVATEQYGSVSTGNLNEFGNT

SEQ ID NO: 12127 - protein, 31 aa, Artificial Sequence
  Description of Artificial Sequence: Synthetic polypeptide
DEEEIRTTNPVATEQYGSVSTGNLQEDGNDA

SEQ ID NO: 12128 - protein, 30 aa, Artificial Sequence
  Description of Artificial Sequence: Synthetic polypeptide
TESEIRTTNPVATEQYGSVSETFLQNRGNR

SEQ ID NO: 12129 - protein, 31 aa, Artificial Sequence
  Description of Artificial Sequence: Synthetic polypeptide
DEEEIRTTNPEATEQYGVVSTLNLPQRGNFR

SEQ ID NO: 12130 - protein, 30 aa, Artificial Sequence
  Description of Artificial Sequence: Synthetic polypeptide
DEEEIRTTNPEATEQYGVTISTNELQRGNR

SEQ ID NO: 12131 - protein, 31 aa, Artificial Sequence
  Description of Artificial Sequence: Synthetic polypeptide
DEEEIRTTNPVATEQYGSVSTGNLQFEGSNI

SEQ ID NO: 12132 - protein, 30 aa, Artificial Sequence
  Description of Artificial Sequence: Synthetic polypeptide
DEEEIRTTNPVATEQYGSVSTGNLQFINFQ

SEQ ID NO: 12133 - protein, 31 aa, Artificial Sequence
  Description of Artificial Sequence: Synthetic polypeptide
DEEEIRTTNPVATEQYGSVSTGNLQGDGNMQ

SEQ ID NO: 12134 - protein, 31 aa, Artificial Sequence
  Description of Artificial Sequence: Synthetic polypeptide
DEEEIRTTNPVATEQYGSVSTGNLQGDPGND

SEQ ID NO: 12135 - protein, 28 aa, Artificial Sequence
  Description of Artificial Sequence: Synthetic peptide
DEEEIRTTNPEATEQYWSVSTNDERGNM

SEQ ID NO: 12136 - protein, 28 aa, Artificial Sequence
  Description of Artificial Sequence: Synthetic peptide
DEEEIRTTNPEATEQYGSVSYNQSRGND

SEQ ID NO: 12137 - protein, 30 aa, Artificial Sequence
  Description of Artificial Sequence: Synthetic polypeptide
DEEEIRTTNPVATEQYGSVSTGNLINGNTQ

SEQ ID NO: 12138 - protein, 30 aa, Artificial Sequence
  Description of Artificial Sequence: Synthetic polypeptide
DEEEIRTTNPVATEQYGSVSTGNLGDTGNG

SEQ ID NO: 12139 - protein, 32 aa, Artificial Sequence
  Description of Artificial Sequence: Synthetic polypeptide
DEEEIRTTNPVATEQYGSVSITNALQRGGSDR

SEQ ID NO: 12140 - protein, 32 aa, Artificial Sequence
  Description of Artificial Sequence: Synthetic polypeptide
DEEEIRTTNPVATEQYGSVSTGNGLEQRGNNV

SEQ ID NO: 12141 - protein, 30 aa, Artificial Sequence
  Description of Artificial Sequence: Synthetic polypeptide
DEEEIRTTNPVATEQYGSVSNNLQREGSPI

SEQ ID NO: 12142 - protein, 30 aa, Artificial Sequence
  Description of Artificial Sequence: Synthetic polypeptide
TEKEIRTTNPVATEQYGSVSTNLEQLVGNR

SEQ ID NO: 12143 - protein, 30 aa, Artificial Sequence
  Description of Artificial Sequence: Synthetic polypeptide
TEKEIRTTNPVATEQYGSVSTNLGQRGMNQ

SEQ ID NO: 12144 - protein, 28 aa, Artificial Sequence
  Description of Artificial Sequence: Synthetic peptide
TELEIRTTNPVATEQYGSVSTNLQEGGI

SEQ ID NO: 12145 - protein, 30 aa, Artificial Sequence
  Description of Artificial Sequence: Synthetic polypeptide
DEEEIRTTNPVATEQYGSVSPTNDGQRGKF

SEQ ID NO: 12146 - protein, 30 aa, Artificial Sequence
  Description of Artificial Sequence: Synthetic polypeptide
DEEEIRTTNPVATEQYGSVSNNLQRGPELF

SEQ ID NO: 12147 - protein, 29 aa, Artificial Sequence
  Description of Artificial Sequence: Synthetic peptide
AEEEIATTNPVATEMYGSVSTNLQAGNNR

SEQ ID NO: 12148 - protein, 30 aa, Artificial Sequence
  Description of Artificial Sequence: Synthetic polypeptide
DEEEIRTTNPVATEQYGSVSNNLQRGEQPN

SEQ ID NO: 12149 - protein, 32 aa, Artificial Sequence
  Description of Artificial Sequence: Synthetic polypeptide
DEEEIRTTNPVATEQYGSVSPTNALQRGLIRN

SEQ ID NO: 12150 - protein, 31 aa, Artificial Sequence
  Description of Artificial Sequence: Synthetic polypeptide
DEEEIRTTNPVATEQYGSVSITMNDQEKGNR

SEQ ID NO: 12151 - protein, 30 aa, Artificial Sequence
  Description of Artificial Sequence: Synthetic polypeptide
DEEEIRTTNPVATEQYGSVSTGNLEAGNQP

SEQ ID NO: 12152 - protein, 31 aa, Artificial Sequence
  Description of Artificial Sequence: Synthetic polypeptide
DEEEIRTTNPVATEQYGSVSTGNLEPRGDNP

SEQ ID NO: 12153 - protein, 30 aa, Artificial Sequence
  Description of Artificial Sequence: Synthetic polypeptide
DEEEIRTTNPVATEQYGSVSTGNLESGNDA

SEQ ID NO: 12154 - protein, 29 aa, Artificial Sequence
  Description of Artificial Sequence: Synthetic peptide
DEEEIRTTNPVATEQYGSVSTGNLGDGMA

SEQ ID NO: 12155 - protein, 28 aa, Artificial Sequence
  Description of Artificial Sequence: Synthetic peptide
AEEEIATTNPVATEMYGSVSTNLDRGNQ

SEQ ID NO: 12156 - protein, 31 aa, Artificial Sequence
  Description of Artificial Sequence: Synthetic polypeptide
DEEEIRTTNPVATEQYGSVSTLLEQRGNDED

SEQ ID NO: 12157 - protein, 28 aa, Artificial Sequence
  Description of Artificial Sequence: Synthetic peptide
DEEEIRTTNPEATEQYGSVSYNIHRGND

SEQ ID NO: 12158 - protein, 30 aa, Artificial Sequence
  Description of Artificial Sequence: Synthetic polypeptide
DEEEIRTTNPVATEQYGSVSTGNLQGVNGD

SEQ ID NO: 12159 - protein, 28 aa, Artificial Sequence
  Description of Artificial Sequence: Synthetic peptide
SEEEIRCTNPIATEQYGSMSTNLMRGNR

SEQ ID NO: 12160 - protein, 30 aa, Artificial Sequence
  Description of Artificial Sequence: Synthetic polypeptide
TNEEIRTTNPVATEQYGSVSTNLQTGGENR

SEQ ID NO: 12161 - protein, 31 aa, Artificial Sequence
  Description of Artificial Sequence: Synthetic polypeptide
DEEEIRTTNPVATEQYGSVSTGNLQSNDGNN

SEQ ID NO: 12162 - protein, 29 aa, Artificial Sequence
  Description of Artificial Sequence: Synthetic peptide
TNEEIRTTNPVATEQYGTVSTNLQDGPNR

SEQ ID NO: 12163 - protein, 29 aa, Artificial Sequence
  Description of Artificial Sequence: Synthetic peptide
TNEEIRTTNPVATEQYGVVSTNLQDGRNR

SEQ ID NO: 12164 - protein, 31 aa, Artificial Sequence
  Description of Artificial Sequence: Synthetic polypeptide
DEEEIRTTNPVATEQYGSVSTGNLQSTGDNE

SEQ ID NO: 12165 - protein, 31 aa, Artificial Sequence
  Description of Artificial Sequence: Synthetic polypeptide
DEEEIRTTNPVATEQYGSVSPTLNEQRVNNR

SEQ ID NO: 12166 - protein, 30 aa, Artificial Sequence
  Description of Artificial Sequence: Synthetic polypeptide
TNEEIRTTNPVATEQYGSVSTNLQMGGNNR

SEQ ID NO: 12167 - protein, 29 aa, Artificial Sequence
  Description of Artificial Sequence: Synthetic peptide
TNEEIRTTNPVATEQYGVVSTNLQVGPNR

SEQ ID NO: 12168 - protein, 29 aa, Artificial Sequence
  Description of Artificial Sequence: Synthetic peptide
DEEEIRTTNPVATEQYGSVSPTLLQRSSP

SEQ ID NO: 12169 - protein, 31 aa, Artificial Sequence
  Description of Artificial Sequence: Synthetic polypeptide
DEEEIRTTNPVATEQYGSVSTGNLTQDGENF

SEQ ID NO: 12170 - protein, 30 aa, Artificial Sequence
  Description of Artificial Sequence: Synthetic polypeptide
DEEEIRTTNPVATEQWGSVATNLGRGDNRI

SEQ ID NO: 12171 - protein, 31 aa, Artificial Sequence
  Description of Artificial Sequence: Synthetic polypeptide
DEEEIRTTNPVATEQYGSVSTGNLTQTGNEG

SEQ ID NO: 12172 - protein, 30 aa, Artificial Sequence
  Description of Artificial Sequence: Synthetic polypeptide
DEEEIRTTNPVATEQYGSVSNNNLEQRDND

SEQ ID NO: 12173 - protein, 31 aa, Artificial Sequence
  Description of Artificial Sequence: Synthetic polypeptide
DEEEIRTTNPVATEQYGSVSTGNMQGNGGNR

SEQ ID NO: 12174 - protein, 31 aa, Artificial Sequence
  Description of Artificial Sequence: Synthetic polypeptide
DEEEIRTTNPVATEQYGSVSTGNMQRGEDRG

SEQ ID NO: 12175 - protein, 31 aa, Artificial Sequence
  Description of Artificial Sequence: Synthetic polypeptide
DEEEIRTTNPVATEQYGSVSTGNLQTEGNNS

SEQ ID NO: 12176 - protein, 32 aa, Artificial Sequence
  Description of Artificial Sequence: Synthetic polypeptide
DEEEIRTTNPVATEQYGSVSPTMNLEQGRENR

SEQ ID NO: 12177 - protein, 31 aa, Artificial Sequence
  Description of Artificial Sequence: Synthetic polypeptide
DEEEIRTTNPVATEQYGSVSTGNLQRFINLQ

SEQ ID NO: 12178 - protein, 31 aa, Artificial Sequence
  Description of Artificial Sequence: Synthetic polypeptide
DEEEIRTTNPVATEQYGSVSPTLNLQPGNEL

SEQ ID NO: 12179 - protein, 30 aa, Artificial Sequence
  Description of Artificial Sequence: Synthetic polypeptide
DEEEIRTTNPVATEQYGSVSTGNLQINNGE

SEQ ID NO: 12180 - protein, 30 aa, Artificial Sequence
  Description of Artificial Sequence: Synthetic polypeptide
DEEEIRTTNPVATEQYGSVSNNLQRGPQDE

SEQ ID NO: 12181 - protein, 31 aa, Artificial Sequence
  Description of Artificial Sequence: Synthetic polypeptide
DEEEIRTTNPVATEQYGSVSTGNLQNAGNEF

SEQ ID NO: 12182 - protein, 30 aa, Artificial Sequence
  Description of Artificial Sequence: Synthetic polypeptide
DEEEIRTTNPVATEQYGSVSNNLQRGPQIF

SEQ ID NO: 12183 - protein, 28 aa, Artificial Sequence
  Description of Artificial Sequence: Synthetic peptide
DEEEIRTTNPVATEQWGSVGTNLQQGDS

SEQ ID NO: 12184 - protein, 30 aa, Artificial Sequence
  Description of Artificial Sequence: Synthetic polypeptide
DEEEIRTTNPVATEQYGSVSNNLQRGPTEV

SEQ ID NO: 12185 - protein, 32 aa, Artificial Sequence
  Description of Artificial Sequence: Synthetic polypeptide
DEEEIRTTNPVATEQYGSVSTGNLQPGIGTNR

SEQ ID NO: 12186 - protein, 32 aa, Artificial Sequence
  Description of Artificial Sequence: Synthetic polypeptide
DEEEIRTTNPVATEQYGSVSTGNLQRFGGNAP

SEQ ID NO: 12187 - protein, 32 aa, Artificial Sequence
  Description of Artificial Sequence: Synthetic polypeptide
DEEEIRTTNPVATEQYGSVSPTMGLQRGNDRW

SEQ ID NO: 12188 - protein, 31 aa, Artificial Sequence
  Description of Artificial Sequence: Synthetic polypeptide
DEEEIRTTNPVATEQYGSVSNNLQTGFNLRE

SEQ ID NO: 12189 - protein, 29 aa, Artificial Sequence
  Description of Artificial Sequence: Synthetic peptide
TLEEIGTTNPVATEQYGSVSTNLQRGLGR

SEQ ID NO: 12190 - protein, 29 aa, Artificial Sequence
  Description of Artificial Sequence: Synthetic peptide
DEEEIRTTNPEATEQYGSVSTELQIQGER

SEQ ID NO: 12191 - protein, 29 aa, Artificial Sequence
  Description of Artificial Sequence: Synthetic peptide
DEEEIRTTNPVATEQYGSVSNNLQTGLDD

SEQ ID NO: 12192 - protein, 29 aa, Artificial Sequence
  Description of Artificial Sequence: Synthetic peptide
DEEEIRTTNPVATEQYGSVSNNLQTGPEF

SEQ ID NO: 12193 - protein, 31 aa, Artificial Sequence
  Description of Artificial Sequence: Synthetic polypeptide
DEEEIRTTNPVATEQYGSVSTGNLQQVDGNN

SEQ ID NO: 12194 - protein, 30 aa, Artificial Sequence
  Description of Artificial Sequence: Synthetic polypeptide
DEEEIRTTNPVATEQYGSVSPTLQRGVNDV

SEQ ID NO: 12195 - protein, 31 aa, Artificial Sequence
  Description of Artificial Sequence: Synthetic polypeptide
DEEEIRTTNPVATEQYGSVSTGNLQQGDGNI

SEQ ID NO: 12196 - protein, 30 aa, Artificial Sequence
  Description of Artificial Sequence: Synthetic polypeptide
DEEEIRTTNPVATEQYGSVSNNLQREGAIF

SEQ ID NO: 12197 - protein, 30 aa, Artificial Sequence
  Description of Artificial Sequence: Synthetic polypeptide
DEEEIRTTNPVATEQYGSVSPTDYQRGEVR

SEQ ID NO: 12198 - protein, 31 aa, Artificial Sequence
  Description of Artificial Sequence: Synthetic polypeptide
DEEEIRTTNPVATEQYGSVSTLLERDGYNER

SEQ ID NO: 12199 - protein, 30 aa, Artificial Sequence
  Description of Artificial Sequence: Synthetic polypeptide
DEEEIRTTNPVATEQYGSVSTLQLGQGGNA

SEQ ID NO: 12200 - protein, 29 aa, Artificial Sequence
  Description of Artificial Sequence: Synthetic peptide
DEEEIRTTNPVATEQYGSVSISNLESGNE

SEQ ID NO: 12201 - protein, 31 aa, Artificial Sequence
  Description of Artificial Sequence: Synthetic polypeptide
DEEEIRTTNPVATEQYGSVSISNEHQRGNRV

SEQ ID NO: 12202 - protein, 28 aa, Artificial Sequence
  Description of Artificial Sequence: Synthetic peptide
DEEEIRTTNPVATEQYGSVSTLTQMGEK

SEQ ID NO: 12203 - protein, 31 aa, Artificial Sequence
  Description of Artificial Sequence: Synthetic polypeptide
VEEEIRTTNPVATEQYGSVSDLNLQRGENER

SEQ ID NO: 12204 - protein, 28 aa, Artificial Sequence
  Description of Artificial Sequence: Synthetic peptide
DEEEIRTTNPDATEGYGSCSTNLTRGNW

SEQ ID NO: 12205 - protein, 31 aa, Artificial Sequence
  Description of Artificial Sequence: Synthetic polypeptide
VEEEIRTTNPVATEQYGSVSITNLQRSLNRM

SEQ ID NO: 12206 - protein, 30 aa, Artificial Sequence
  Description of Artificial Sequence: Synthetic polypeptide
DEEEIRTTNPVATEQYGSVSISENLQRVNI

SEQ ID NO: 12207 - protein, 31 aa, Artificial Sequence
  Description of Artificial Sequence: Synthetic polypeptide
DEEEIRTTNPVATEQYGSVSTMDDQGRGDNR

SEQ ID NO: 12208 - protein, 30 aa, Artificial Sequence
  Description of Artificial Sequence: Synthetic polypeptide
DEEAIRTTNPVATEQYAYSVSINLQRGDNR

SEQ ID NO: 12209 - protein, 30 aa, Artificial Sequence
  Description of Artificial Sequence: Synthetic polypeptide
DEEEIRTTNPVATEQYGSVSPTDGLRGNNR

SEQ ID NO: 12210 - protein, 29 aa, Artificial Sequence
  Description of Artificial Sequence: Synthetic peptide
DEEEIRTTNPVATEQWGEVSTNAQRGGNE

SEQ ID NO: 12211 - protein, 31 aa, Artificial Sequence
  Description of Artificial Sequence: Synthetic polypeptide
VEEEIRTTNPVATEQYGSVSQTNLQTGENRD

SEQ ID NO: 12212 - protein, 29 aa, Artificial Sequence
  Description of Artificial Sequence: Synthetic peptide
DEEEIRTTNPVATEQYGSVSIPLGRGVER

SEQ ID NO: 12213 - protein, 28 aa, Artificial Sequence
  Description of Artificial Sequence: Synthetic peptide
SEEEIEATNPVATETYGSVSENLQRGNR

SEQ ID NO: 12214 - protein, 29 aa, Artificial Sequence
  Description of Artificial Sequence: Synthetic peptide
DEEEIRTTNPVATEQYGCVSTELARGNDG

SEQ ID NO: 12215 - protein, 30 aa, Artificial Sequence
  Description of Artificial Sequence: Synthetic polypeptide
DEEEIRTTNPVATEQYGSVSISNLQHMGNQ

SEQ ID NO: 12216 - protein, 29 aa, Artificial Sequence
  Description of Artificial Sequence: Synthetic peptide
DEEEIRTTNPVATEQYGSVSTLPQSGVRP

SEQ ID NO: 12217 - protein, 30 aa, Artificial Sequence
  Description of Artificial Sequence: Synthetic polypeptide
VEEEIRTTNPVATEQYGSVNSTTLQRGNQG

SEQ ID NO: 12218 - protein, 28 aa, Artificial Sequence
  Description of Artificial Sequence: Synthetic peptide
VEEEIRTTNPVATEQYGSVATALQGGDR

SEQ ID NO: 12219 - protein, 28 aa, Artificial Sequence
  Description of Artificial Sequence: Synthetic peptide
DEEEIRTTNPDATEQYGSVSTCLQREEI

SEQ ID NO: 12220 - protein, 29 aa, Artificial Sequence
  Description of Artificial Sequence: Synthetic peptide
DEEEIRTTNPVATECYGVVSTNLQNENRV

SEQ ID NO: 12221 - protein, 31 aa, Artificial Sequence
  Description of Artificial Sequence: Synthetic polypeptide
AEEEIRTTNPVATEQYGSVSTVNLQSQGNRG

SEQ ID NO: 12222 - protein, 29 aa, Artificial Sequence
  Description of Artificial Sequence: Synthetic peptide
DEEEIRTTNPVATECYGVVSTNLQNGGRV

SEQ ID NO: 12223 - protein, 29 aa, Artificial Sequence
  Description of Artificial Sequence: Synthetic peptide
AEEEIRTTNPVATEQYGSVSTVNLQTGQN

SEQ ID NO: 12224 - protein, 28 aa, Artificial Sequence
  Description of Artificial Sequence: Synthetic peptide
DEEEIRTTNPDATEQYGSVDTNDQSGDR

SEQ ID NO: 12225 - protein, 29 aa, Artificial Sequence
  Description of Artificial Sequence: Synthetic peptide
DEEEIRTTNPVATEQWGCVSTELQHGNRA

SEQ ID NO: 12226 - protein, 31 aa, Artificial Sequence
  Description of Artificial Sequence: Synthetic polypeptide
VEEEIRTTNPVATEQYGSVGSTNLQRGNGQE

SEQ ID NO: 12227 - protein, 30 aa, Artificial Sequence
  Description of Artificial Sequence: Synthetic polypeptide
VEEEIRTTNPVATEQYGSVGTNLQRGNGDG

SEQ ID NO: 12228 - protein, 32 aa, Artificial Sequence
  Description of Artificial Sequence: Synthetic polypeptide
DEEEIRTTNPVATEQYGSVSTLPNNLQAGDNR

SEQ ID NO: 12229 - protein, 28 aa, Artificial Sequence
  Description of Artificial Sequence: Synthetic peptide
SEEEIRATNPIATEQYGSVSENLMRGNR

SEQ ID NO: 12230 - protein, 30 aa, Artificial Sequence
  Description of Artificial Sequence: Synthetic polypeptide
DEEEIRTTNPVATEQYGSVSNSNLQRPNLD

SEQ ID NO: 12231 - protein, 28 aa, Artificial Sequence
  Description of Artificial Sequence: Synthetic peptide
DEEEIRTTNPDATEPYGSCSTNLARGNF

SEQ ID NO: 12232 - protein, 28 aa, Artificial Sequence
  Description of Artificial Sequence: Synthetic peptide
DEEEIRTTNPDATENYGSCSTNLPRGNE

SEQ ID NO: 12233 - protein, 29 aa, Artificial Sequence
  Description of Artificial Sequence: Synthetic peptide
DEEEIRTTNPDATEGYGSVCSTNLDRGND

SEQ ID NO: 12234 - protein, 29 aa, Artificial Sequence
  Description of Artificial Sequence: Synthetic peptide
DEEEIRTTNPVATECYGVVSTNLQSDNRF

SEQ ID NO: 12235 - protein, 30 aa, Artificial Sequence
  Description of Artificial Sequence: Synthetic polypeptide
DEEEIRTTNPVATEQYGSVSINQDQRGGNE

SEQ ID NO: 12236 - protein, 31 aa, Artificial Sequence
  Description of Artificial Sequence: Synthetic polypeptide
DEEEIRTTNPVATEQYGSVSNTALQRISNRP

SEQ ID NO: 12237 - protein, 29 aa, Artificial Sequence
  Description of Artificial Sequence: Synthetic peptide
DEEEIRTTNPVATEQYGSVSTMDLQAGVV

SEQ ID NO: 12238 - protein, 30 aa, Artificial Sequence
  Description of Artificial Sequence: Synthetic polypeptide
DEEEIRTTNPVATEQYGSVSTMDVQYRGER

SEQ ID NO: 12239 - protein, 30 aa, Artificial Sequence
  Description of Artificial Sequence: Synthetic polypeptide
VEEEIRTTNPVATEQYGSVSTNGQRGMVRD

SEQ ID NO: 12240 - protein, 29 aa, Artificial Sequence
  Description of Artificial Sequence: Synthetic peptide
SEEEICTTNPVATEQYGSVATNLQRSNDR

SEQ ID NO: 12241 - protein, 31 aa, Artificial Sequence
  Description of Artificial Sequence: Synthetic polypeptide
DEEEIRTTNPVATEQYGCVSTELQRFGNDRA

SEQ ID NO: 12242 - protein, 30 aa, Artificial Sequence
  Description of Artificial Sequence: Synthetic polypeptide
VEEEIRTTNPVATEQYGSVSTNLQEEGNDF

SEQ ID NO: 12243 - protein, 30 aa, Artificial Sequence
  Description of Artificial Sequence: Synthetic polypeptide
DEEEIRTTNPVATEQYGSVSINLQVGNETQ

SEQ ID NO: 12244 - protein, 30 aa, Artificial Sequence
  Description of Artificial Sequence: Synthetic polypeptide
VEEEIRTTNPVATEQYGSVSTNLQQGQNND

SEQ ID NO: 12245 - protein, 29 aa, Artificial Sequence
  Description of Artificial Sequence: Synthetic peptide
DEEEIRTTNPVATEQYGSVSTMDQRSNPG

SEQ ID NO: 12246 - protein, 30 aa, Artificial Sequence
  Description of Artificial Sequence: Synthetic polypeptide
VEEEIRTTNPVATEQYGSVSTNLQRNAGFY

SEQ ID NO: 12247 - protein, 31 aa, Artificial Sequence
  Description of Artificial Sequence: Synthetic polypeptide
AEEEIRTTNPVATEQYGSVSTVNPLQEGNER

SEQ ID NO: 12248 - protein, 30 aa, Artificial Sequence
  Description of Artificial Sequence: Synthetic polypeptide
VEEEIRTTNPVATEQYGSVSTNLQTTGNES

SEQ ID NO: 12249 - protein, 32 aa, Artificial Sequence
  Description of Artificial Sequence: Synthetic polypeptide
DEEEIRTTNPVATEQYGSVSNTANLQTGNQRQ

SEQ ID NO: 12250 - protein, 30 aa, Artificial Sequence
  Description of Artificial Sequence: Synthetic polypeptide
VEEEIRTTNPVATEQYGSVSTPNLQRNENA

SEQ ID NO: 12251 - protein, 30 aa, Artificial Sequence
  Description of Artificial Sequence: Synthetic polypeptide
VEEEIRTTNPVATEQYGSVSTPPQLQRGER

SEQ ID NO: 12252 - protein, 30 aa, Artificial Sequence
  Description of Artificial Sequence: Synthetic polypeptide
DEEEIRTTNPVATEQYGSVSPSPLQNGNER

SEQ ID NO: 12253 - protein, 32 aa, Artificial Sequence
  Description of Artificial Sequence: Synthetic polypeptide
VEEEIRTTNPVATEQYGSVSTSNLDQRGENQR

SEQ ID NO: 12254 - protein, 31 aa, Artificial Sequence
  Description of Artificial Sequence: Synthetic polypeptide
DEEEIRTTNPVATEQYGSVSINLQRTVNARD

SEQ ID NO: 12255 - protein, 29 aa, Artificial Sequence
  Description of Artificial Sequence: Synthetic peptide
SEEEIRATNPVATEQYGSVSTNLQRGEEF

SEQ ID NO: 12256 - protein, 31 aa, Artificial Sequence
  Description of Artificial Sequence: Synthetic polypeptide
DEEEIRTTNPVATEEYGISVSTNELSQSGNR

SEQ ID NO: 12257 - protein, 29 aa, Artificial Sequence
  Description of Artificial Sequence: Synthetic peptide
DEEEIRTTNPVATEQYGSVSPTALQGSNE

SEQ ID NO: 12258 - protein, 30 aa, Artificial Sequence
  Description of Artificial Sequence: Synthetic polypeptide
DEEEIRTTNPVATEQYGSVSTMDLQDGNDP

SEQ ID NO: 12259 - protein, 30 aa, Artificial Sequence
  Description of Artificial Sequence: Synthetic polypeptide
VEEEIRTTNPVATEQYGSVSTDLQRMGNGD

SEQ ID NO: 12260 - protein, 30 aa, Artificial Sequence
  Description of Artificial Sequence: Synthetic polypeptide
DEEEIRTTNPCSTLQYGSVSTNLQRNGNDR

SEQ ID NO: 12261 - protein, 29 aa, Artificial Sequence
  Description of Artificial Sequence: Synthetic peptide
DEEEIRTTNPVATEQWGCSVSTPLLRGNS

SEQ ID NO: 12262 - protein, 29 aa, Artificial Sequence
  Description of Artificial Sequence: Synthetic peptide
DEEEIRTTNPVATEEYGCVSTALQRGNQF

SEQ ID NO: 12263 - protein, 30 aa, Artificial Sequence
  Description of Artificial Sequence: Synthetic polypeptide
DEEEIRTTNPVATEQYGSVSTMDLQSGNNP

SEQ ID NO: 12264 - protein, 30 aa, Artificial Sequence
  Description of Artificial Sequence: Synthetic polypeptide
DEEEIRTTNPVATEEYGCVSTNGLQHGGNR

SEQ ID NO: 12265 - protein, 31 aa, Artificial Sequence
  Description of Artificial Sequence: Synthetic polypeptide
VEEEIRTTNPVATEQYGSVSTMNLQRGNEES

SEQ ID NO: 12266 - protein, 31 aa, Artificial Sequence
  Description of Artificial Sequence: Synthetic polypeptide
DEEEIRTTNPVATEQYGSVSTMDLWRGNDRD

SEQ ID NO: 12267 - protein, 32 aa, Artificial Sequence
  Description of Artificial Sequence: Synthetic polypeptide
DEEEIRTTNPVATEQYGSVSINNLQRGQNMRD

SEQ ID NO: 12268 - protein, 31 aa, Artificial Sequence
  Description of Artificial Sequence: Synthetic polypeptide
DEEEIRTTNPVATEQYGSVSPTALQSGENRE

SEQ ID NO: 12269 - protein, 28 aa, Artificial Sequence
  Description of Artificial Sequence: Synthetic peptide
SEEEICTTNPVATEQYGSVSTSLQNGNH

SEQ ID NO: 12270 - protein, 30 aa, Artificial Sequence
  Description of Artificial Sequence: Synthetic polypeptide
DEEEIRTTNPVATEEYGCVSTNGLQHGSNR

SEQ ID NO: 12271 - protein, 29 aa, Artificial Sequence
  Description of Artificial Sequence: Synthetic peptide
SEEEICTTNPVATEQYGSVSTNQQAGNRG

SEQ ID NO: 12272 - protein, 29 aa, Artificial Sequence
  Description of Artificial Sequence: Synthetic peptide
DEEEIRTTNPVATEEYGDVSTNLQSGSNQ

SEQ ID NO: 12273 - protein, 31 aa, Artificial Sequence
  Description of Artificial Sequence: Synthetic polypeptide
SEEEICTTNPVATEQYGSVSTNLQREGNPRD

SEQ ID NO: 12274 - protein, 31 aa, Artificial Sequence
  Description of Artificial Sequence: Synthetic polypeptide
DEEEIRTTNPVATEQYGSVSTMDMQQRGNDR

SEQ ID NO: 12275 - protein, 28 aa, Artificial Sequence
  Description of Artificial Sequence: Synthetic peptide
VEEEIRTTNPVATEQYGSVATALQAGMR

SEQ ID NO: 12276 - protein, 29 aa, Artificial Sequence
  Description of Artificial Sequence: Synthetic peptide
AEEEIAATNPVATEQYGSVVTNLQRGNVR

SEQ ID NO: 12277 - protein, 30 aa, Artificial Sequence
  Description of Artificial Sequence: Synthetic polypeptide
DEEEIRTTNPVATEQYGSVSTLNQQEGGNV

SEQ ID NO: 12278 - protein, 28 aa, Artificial Sequence
  Description of Artificial Sequence: Synthetic peptide
DEEEIRTTNPVATEQYGCVSTDTQIGNV

SEQ ID NO: 12279 - protein, 30 aa, Artificial Sequence
  Description of Artificial Sequence: Synthetic polypeptide
DEEEIRTTNPVATEQYGSVSNPPLQRMNDR

SEQ ID NO: 12280 - protein, 30 aa, Artificial Sequence
  Description of Artificial Sequence: Synthetic polypeptide
DEEEIRTTNPVATECYGSVSTNLVQTGGNS

SEQ ID NO: 12281 - protein, 30 aa, Artificial Sequence
  Description of Artificial Sequence: Synthetic polypeptide
DEEEIRTTNPVATEQYGSVSTLLQIGNDQD

SEQ ID NO: 12282 - protein, 28 aa, Artificial Sequence
  Description of Artificial Sequence: Synthetic peptide
SEEEIRCTNPEATEQYGSVSENLMRGNR

SEQ ID NO: 12283 - protein, 31 aa, Artificial Sequence
  Description of Artificial Sequence: Synthetic polypeptide
DEEEIRTTNPVATEQYGSVSITEDLQRGNAY

SEQ ID NO: 12284 - protein, 31 aa, Artificial Sequence
  Description of Artificial Sequence: Synthetic polypeptide
DEEEIRTTNPVATEQYGSVSPTDNLERIVNR

SEQ ID NO: 12285 - protein, 30 aa, Artificial Sequence
  Description of Artificial Sequence: Synthetic polypeptide
DEEEIRTTNPVATECYGSVSTNLQRGETGT

SEQ ID NO: 12286 - protein, 30 aa, Artificial Sequence
  Description of Artificial Sequence: Synthetic polypeptide
DEEEIRTTNPVATEQYGSVSTLLQNVSGNS

SEQ ID NO: 12287 - protein, 29 aa, Artificial Sequence
  Description of Artificial Sequence: Synthetic peptide
DEEEIRTTNPVATEQYGSVSTLLQQGGQG

SEQ ID NO: 12288 - protein, 30 aa, Artificial Sequence
  Description of Artificial Sequence: Synthetic polypeptide
DEEEIRTTNPVATEQYGSVSTLLQQGNSSE

SEQ ID NO: 12289 - protein, 29 aa, Artificial Sequence
  Description of Artificial Sequence: Synthetic peptide
DEEEIRTTNPVATEQWGIVSENLQMRGNQ

SEQ ID NO: 12290 - protein, 30 aa, Artificial Sequence
  Description of Artificial Sequence: Synthetic polypeptide
DEEEIRTTNPVATEQYGSVSTLLQQPGNDD

SEQ ID NO: 12291 - protein, 30 aa, Artificial Sequence
  Description of Artificial Sequence: Synthetic polypeptide
DEEEIRTTNPVATEQYGCVSTECHQRGGNR

SEQ ID NO: 12292 - protein, 31 aa, Artificial Sequence
  Description of Artificial Sequence: Synthetic polypeptide
DEEEIRTTNPVATEQYGSVSTLLQQRGGNEQ

SEQ ID NO: 12293 - protein, 31 aa, Artificial Sequence
  Description of Artificial Sequence: Synthetic polypeptide
DEEEIRTTNPVATEQYGSVSTLLQQRGNNED

SEQ ID NO: 12294 - protein, 28 aa, Artificial Sequence
  Description of Artificial Sequence: Synthetic peptide
SEEEIRCTNPDATEQYGSVSENLMRGNR

SEQ ID NO: 12295 - protein, 30 aa, Artificial Sequence
  Description of Artificial Sequence: Synthetic polypeptide
DEEEIRTTNPVATEQYGSVSTLLQRGSQQF

SEQ ID NO: 12296 - protein, 30 aa, Artificial Sequence
  Description of Artificial Sequence: Synthetic polypeptide
DEEEIRTTNPVATECYGSVSTNLQNNGFNG

SEQ ID NO: 12297 - protein, 30 aa, Artificial Sequence
  Description of Artificial Sequence: Synthetic polypeptide
DEEEIRTTNPVATEQYGSVSTLLQEDGGNF

SEQ ID NO: 12298 - protein, 28 aa, Artificial Sequence
  Description of Artificial Sequence: Synthetic peptide
DEEEIRTTNPVATEQYGSVSPTDQRMNV

SEQ ID NO: 12299 - protein, 29 aa, Artificial Sequence
  Description of Artificial Sequence: Synthetic peptide
DEEEIRTTNPVATEQYGSVSTLLERINEK

SEQ ID NO: 12300 - protein, 31 aa, Artificial Sequence
  Description of Artificial Sequence: Synthetic polypeptide
DEEEIRTTNPVATEQYGSVSTLLERYGDNQR

SEQ ID NO: 12301 - protein, 30 aa, Artificial Sequence
  Description of Artificial Sequence: Synthetic polypeptide
DEEEIRTTNPVATEQYGSVSTLLESNGNFR

SEQ ID NO: 12302 - protein, 30 aa, Artificial Sequence
  Description of Artificial Sequence: Synthetic polypeptide
DEEEIRTTNPVATECYGSVSTNLQDGNIDI

SEQ ID NO: 12303 - protein, 30 aa, Artificial Sequence
  Description of Artificial Sequence: Synthetic polypeptide
DEEEIRTTNPVATECYGSVSTNLQDHNGNA

SEQ ID NO: 12304 - protein, 31 aa, Artificial Sequence
  Description of Artificial Sequence: Synthetic polypeptide
DEEEIRTTNPVATEQYGSVSTLLIQRGNQEM

SEQ ID NO: 12305 - protein, 30 aa, Artificial Sequence
  Description of Artificial Sequence: Synthetic polypeptide
DEEEIRTTNPVATECYGSVSTNLQIMGENM

SEQ ID NO: 12306 - protein, 30 aa, Artificial Sequence
  Description of Artificial Sequence: Synthetic polypeptide
DEEEIRTTNPVATECYGSVSTNLQEGGNVH

SEQ ID NO: 12307 - protein, 31 aa, Artificial Sequence
  Description of Artificial Sequence: Synthetic polypeptide
DEEEIRTTNPVATECYGSVSTNLQGDGGNYR

SEQ ID NO: 12308 - protein, 30 aa, Artificial Sequence
  Description of Artificial Sequence: Synthetic polypeptide
DEEEIRTTNPVATEQYGSVSTLLLQGIGNE

SEQ ID NO: 12309 - protein, 30 aa, Artificial Sequence
  Description of Artificial Sequence: Synthetic polypeptide
AEEEIRTTNPVATEQYGSVSTVNLLQAGQR

SEQ ID NO: 12310 - protein, 31 aa, Artificial Sequence
  Description of Artificial Sequence: Synthetic polypeptide
DEEEIRTTNPVATEQYGSVSTLLNRGGNFRD

SEQ ID NO: 12311 - protein, 29 aa, Artificial Sequence
  Description of Artificial Sequence: Synthetic peptide
DEEEIRTTNPVATEQYGSVSTLLNRNQIR

SEQ ID NO: 12312 - protein, 30 aa, Artificial Sequence
  Description of Artificial Sequence: Synthetic polypeptide
DEEEIRTTNPVATECYGSVSTNLQGMGNNG

SEQ ID NO: 12313 - protein, 31 aa, Artificial Sequence
  Description of Artificial Sequence: Synthetic polypeptide
DEEEIRTTNPVATEQYGSVSPTDNNQDGNRS

SEQ ID NO: 12314 - protein, 32 aa, Artificial Sequence
  Description of Artificial Sequence: Synthetic polypeptide
DEEEIRTTNPVATECYGSVSTNLQERDGDNRN

SEQ ID NO: 12315 - protein, 30 aa, Artificial Sequence
  Description of Artificial Sequence: Synthetic polypeptide
AEEEIRTTNPVATEQYGSVSTVNLENNGNR

SEQ ID NO: 12316 - protein, 30 aa, Artificial Sequence
  Description of Artificial Sequence: Synthetic polypeptide
DEEEIRTTNPVATEQYGSVSTLLQRNNLAH

SEQ ID NO: 12317 - protein, 28 aa, Artificial Sequence
  Description of Artificial Sequence: Synthetic peptide
SEEEIRCTNPCATEQYGSVSENLMRGNR

SEQ ID NO: 12318 - protein, 29 aa, Artificial Sequence
  Description of Artificial Sequence: Synthetic peptide
VEEEICTTNPVATEQYGSVATNLQRNNPR

SEQ ID NO: 12319 - protein, 31 aa, Artificial Sequence
  Description of Artificial Sequence: Synthetic polypeptide
DEEEIRTTNPVATEQYGSVSTLNLDQEMGNN

SEQ ID NO: 12320 - protein, 28 aa, Artificial Sequence
  Description of Artificial Sequence: Synthetic peptide
SEEEIRCTNPAATEQYGSVSENLMRGNR

SEQ ID NO: 12321 - protein, 31 aa, Artificial Sequence
  Description of Artificial Sequence: Synthetic polypeptide
DEEEIRTTNPVATEQYGSVSPTDLQRQVNER

SEQ ID NO: 12322 - protein, 28 aa, Artificial Sequence
  Description of Artificial Sequence: Synthetic peptide
VEEEIRATNPVATEQYGSVATNLQAGND

SEQ ID NO: 12323 - protein, 31 aa, Artificial Sequence
  Description of Artificial Sequence: Synthetic polypeptide
DEEEIRTTNPVATEQYGSVSTLNLGQDSGNH

SEQ ID NO: 12324 - protein, 31 aa, Artificial Sequence
  Description of Artificial Sequence: Synthetic polypeptide
DEEEIRTTNPVATEQYGSVSTLNLLDRGNPQ

SEQ ID NO: 12325 - protein, 31 aa, Artificial Sequence
  Description of Artificial Sequence: Synthetic polypeptide
DEEEIRTTNPVATEQYGSVSTLNILGQTGNT

SEQ ID NO: 12326 - protein, 30 aa, Artificial Sequence
  Description of Artificial Sequence: Synthetic polypeptide
DEEEIRTTNPVATEQYGSVSPTDLQRDQVR

SEQ ID NO: 12327 - protein, 32 aa, Artificial Sequence
  Description of Artificial Sequence: Synthetic polypeptide
DEEEIRTTNPVATEQYGSVSTLNLQFRSGDFR

SEQ ID NO: 12328 - protein, 32 aa, Artificial Sequence
  Description of Artificial Sequence: Synthetic polypeptide
DEEEIRTTNPVATEQYGSVSTLNLQQRGGDER

SEQ ID NO: 12329 - protein, 30 aa, Artificial Sequence
  Description of Artificial Sequence: Synthetic polypeptide
DEEEIRTTNPVATEQYGSVSNSNHQFGNRS

SEQ ID NO: 12330 - protein, 29 aa, Artificial Sequence
  Description of Artificial Sequence: Synthetic peptide
VEEEIRTTNPVATEGYGSVSTNLQVGNNS

SEQ ID NO: 12331 - protein, 28 aa, Artificial Sequence
  Description of Artificial Sequence: Synthetic peptide
DEEEIRTTNPDATEYYGSCSTNLARGNN

SEQ ID NO: 12332 - protein, 28 aa, Artificial Sequence
  Description of Artificial Sequence: Synthetic peptide
DEEEIRTTNPDATESYGSCSTNLNRGNQ

SEQ ID NO: 12333 - protein, 30 aa, Artificial Sequence
  Description of Artificial Sequence: Synthetic polypeptide
DEEEIRTTNPVATEQYGSVSPTDLQGNDRD

SEQ ID NO: 12334 - protein, 28 aa, Artificial Sequence
  Description of Artificial Sequence: Synthetic peptide
VEEEIRCTNPIATEQYGSVSENLMRGNR

SEQ ID NO: 12335 - protein, 30 aa, Artificial Sequence
  Description of Artificial Sequence: Synthetic polypeptide
DEEEIRTTNPVATEQYGSVSTLLQRNNLQD

SEQ ID NO: 12336 - protein, 30 aa, Artificial Sequence
  Description of Artificial Sequence: Synthetic polypeptide
DEEEIRTTNPVATEQYGSVSISNLQTNGNN

SEQ ID NO: 12337 - protein, 31 aa, Artificial Sequence
  Description of Artificial Sequence: Synthetic polypeptide
DEEEIRTTNPVATEQYGSVSTLNELGRGGNE

SEQ ID NO: 12338 - protein, 32 aa, Artificial Sequence
  Description of Artificial Sequence: Synthetic polypeptide
DEEEIRTTNPVATEQYGSVSPTDNLEQGRDNR

SEQ ID NO: 12339 - protein, 29 aa, Artificial Sequence
  Description of Artificial Sequence: Synthetic peptide
DEEEIRTTNPVATEQWGISVSTLLNRGNA

SEQ ID NO: 12340 - protein, 30 aa, Artificial Sequence
  Description of Artificial Sequence: Synthetic polypeptide
DEECIRTTNPVATEQWGSVSCTNIQRGGNR

SEQ ID NO: 12341 - protein, 30 aa, Artificial Sequence
  Description of Artificial Sequence: Synthetic polypeptide
DEEEIRTTNPVATEQYGSVSTLLQRTMNEM

SEQ ID NO: 12342 - protein, 28 aa, Artificial Sequence
  Description of Artificial Sequence: Synthetic peptide
DEEEIRTTNPEATECYGSCSTNLARGNA

SEQ ID NO: 12343 - protein, 31 aa, Artificial Sequence
  Description of Artificial Sequence: Synthetic polypeptide
DEEEIRTTNPVATEQYGSVSPTDNHGQRGNQ

SEQ ID NO: 12344 - protein, 31 aa, Artificial Sequence
  Description of Artificial Sequence: Synthetic polypeptide
DEEEIRTTNPVATEQYGSVSTLLQRVGVTER

SEQ ID NO: 12345 - protein, 30 aa, Artificial Sequence
  Description of Artificial Sequence: Synthetic polypeptide
DEEEIRTTNPVATEQYGSVSTLNGQSGNDE

SEQ ID NO: 12346 - protein, 28 aa, Artificial Sequence
  Description of Artificial Sequence: Synthetic peptide
DEEEIRTTNPVATEQYGSVSNSLDHGNM

SEQ ID NO: 12347 - protein, 32 aa, Artificial Sequence
  Description of Artificial Sequence: Synthetic polypeptide
DEEEIRTTNPVATEQYGSVSTLNDLQNGNSRL

SEQ ID NO: 12348 - protein, 29 aa, Artificial Sequence
  Description of Artificial Sequence: Synthetic peptide
VEEEIATTNPVATEQYGEVSTNLQRGDND

SEQ ID NO: 12349 - protein, 29 aa, Artificial Sequence
  Description of Artificial Sequence: Synthetic peptide
DEDEIATTNPVATEQYGSVSTNLQRSNDL

SEQ ID NO: 12350 - protein, 29 aa, Artificial Sequence
  Description of Artificial Sequence: Synthetic peptide
DEDEIATTNPVATEQYGSVSTNLQRENTQ

SEQ ID NO: 12351 - protein, 29 aa, Artificial Sequence
  Description of Artificial Sequence: Synthetic peptide
DEDEIATTNPVATEQYGSVSTNLQRDDND

SEQ ID NO: 12352 - protein, 29 aa, Artificial Sequence
  Description of Artificial Sequence: Synthetic peptide
VEEEIATTNPVATEQYGSVSANLQQGNPR

SEQ ID NO: 12353 - protein, 29 aa, Artificial Sequence
  Description of Artificial Sequence: Synthetic peptide
VEEEIATTNPVATEQYGSVSTNLQNGDND

SEQ ID NO: 12354 - protein, 31 aa, Artificial Sequence
  Description of Artificial Sequence: Synthetic polypeptide
DEEEIRTTNPVATEQYGSVSTLNDLQISSNR

SEQ ID NO: 12355 - protein, 30 aa, Artificial Sequence
  Description of Artificial Sequence: Synthetic polypeptide
DEEEIRTTNPVATEQYGSVSTGNGGQDGNE

SEQ ID NO: 12356 - protein, 29 aa, Artificial Sequence
  Description of Artificial Sequence: Synthetic peptide
DEEEIRTTNPVATEQYGSVSNNLQQGVVF

SEQ ID NO: 12357 - protein, 30 aa, Artificial Sequence
  Description of Artificial Sequence: Synthetic polypeptide
DEEEIRTTNPVATEQYGSVSITNDDRGTNS

SEQ ID NO: 12358 - protein, 30 aa, Artificial Sequence
  Description of Artificial Sequence: Synthetic polypeptide
DEEEIRTTNPVATEQYGSVSPTNLQIGAAE

SEQ ID NO: 12359 - protein, 30 aa, Artificial Sequence
  Description of Artificial Sequence: Synthetic polypeptide
DEEEIRTTNPVATEQYGSVSPTNLQIATNF

SEQ ID NO: 12360 - protein, 28 aa, Artificial Sequence
  Description of Artificial Sequence: Synthetic peptide
SEEEIRCTNPIATEQYGSVSENLNRGNR

SEQ ID NO: 12361 - protein, 29 aa, Artificial Sequence
  Description of Artificial Sequence: Synthetic peptide
DEEEIRTTNPVATEQYGSVSPTNLQIAAN

SEQ ID NO: 12362 - protein, 29 aa, Artificial Sequence
  Description of Artificial Sequence: Synthetic peptide
DEEEIRTTNPVATEQYGSVSNNLDRNSDR

SEQ ID NO: 12363 - protein, 32 aa, Artificial Sequence
  Description of Artificial Sequence: Synthetic polypeptide
DEEEIRTTNPVATEQYGSVSPTNLQERGSQLR

SEQ ID NO: 12364 - protein, 29 aa, Artificial Sequence
  Description of Artificial Sequence: Synthetic peptide
DEEEIRTTNPVATEQYGSVSTESLTRNNE

SEQ ID NO: 12365 - protein, 30 aa, Artificial Sequence
  Description of Artificial Sequence: Synthetic polypeptide
DEEEIRTTNPVATEAYGWVSVTNLSGRGNR

SEQ ID NO: 12366 - protein, 32 aa, Artificial Sequence
  Description of Artificial Sequence: Synthetic polypeptide
DEEEIRTTNPVATEQYGSVSPTNLQDRGENVL

SEQ ID NO: 12367 - protein, 30 aa, Artificial Sequence
  Description of Artificial Sequence: Synthetic polypeptide
DEEEIRTTNPVATEQYGSVSPTNLQDNGEK

SEQ ID NO: 12368 - protein, 29 aa, Artificial Sequence
  Description of Artificial Sequence: Synthetic peptide
DEEEIRTTNPVATEQYGSVSTETQSSNNR

SEQ ID NO: 12369 - protein, 31 aa, Artificial Sequence
  Description of Artificial Sequence: Synthetic polypeptide
DEEEIRTTNPVATEQYGSVSTEYHQRGSNRD

SEQ ID NO: 12370 - protein, 30 aa, Artificial Sequence
  Description of Artificial Sequence: Synthetic polypeptide
DEEEIRTTNPVATEQYGSVSTEYLQRGSVL

SEQ ID NO: 12371 - protein, 28 aa, Artificial Sequence
  Description of Artificial Sequence: Synthetic peptide
DEEEIRTTNPFATEQYGSVSYNYDRGND

SEQ ID NO: 12372 - protein, 30 aa, Artificial Sequence
  Description of Artificial Sequence: Synthetic polypeptide
TEEEIRTTNPVAYEQYGSVSTNLQRTEGNV

SEQ ID NO: 12373 - protein, 31 aa, Artificial Sequence
  Description of Artificial Sequence: Synthetic polypeptide
DEEEIRTTNPVATEQYGSVSPTNLQIGFNIQ

SEQ ID NO: 12374 - protein, 30 aa, Artificial Sequence
  Description of Artificial Sequence: Synthetic polypeptide
DEEEIRTTNPVATEQWGSVSTPNLQPGNVD

SEQ ID NO: 12375 - protein, 29 aa, Artificial Sequence
  Description of Artificial Sequence: Synthetic peptide
DEEEIRTTNPVATEQYGSVSPTNLQIPAA

SEQ ID NO: 12376 - protein, 30 aa, Artificial Sequence
  Description of Artificial Sequence: Synthetic polypeptide
DEEEIRTTNPVATEQYGSVSPTNLQIVGDV

SEQ ID NO: 12377 - protein, 32 aa, Artificial Sequence
  Description of Artificial Sequence: Synthetic polypeptide
DEEEIRTTNPVATEQYGSVSPTNLQNRGENQV

SEQ ID NO: 12378 - protein, 28 aa, Artificial Sequence
  Description of Artificial Sequence: Synthetic peptide
SEEEIRCTNPIATEQYGSVSENLVRGNR

SEQ ID NO: 12379 - protein, 31 aa, Artificial Sequence
  Description of Artificial Sequence: Synthetic polypeptide
DEEEIRTTNPVATEQYGSVSPTNLQNGQELR

SEQ ID NO: 12380 - protein, 31 aa, Artificial Sequence
  Description of Artificial Sequence: Synthetic polypeptide
DEEEIRTTNPVATEQYGSVSITNLQRMGDLD

SEQ ID NO: 12381 - protein, 28 aa, Artificial Sequence
  Description of Artificial Sequence: Synthetic peptide
SEEEIRCTNPIATEQYGSVSENLTRGNR

SEQ ID NO: 12382 - protein, 28 aa, Artificial Sequence
  Description of Artificial Sequence: Synthetic peptide
SEEEIRCTNPIATEQYGSVSENLSRGNR

SEQ ID NO: 12383 - protein, 28 aa, Artificial Sequence
  Description of Artificial Sequence: Synthetic peptide
SEEEIRCTNPIATEQYGSVSENLQSGNR

SEQ ID NO: 12384 - protein, 31 aa, Artificial Sequence
  Description of Artificial Sequence: Synthetic polypeptide
DEEEIRTTNPVATEQYGSVSITNLQRFGTED

SEQ ID NO: 12385 - protein, 28 aa, Artificial Sequence
  Description of Artificial Sequence: Synthetic peptide
SEEEIRCTNPIATEQYGSVSENLQRGTR

SEQ ID NO: 12386 - protein, 31 aa, Artificial Sequence
  Description of Artificial Sequence: Synthetic polypeptide
DEEEIRTTNPVATEQYGSVSITNLQRIGLQE

SEQ ID NO: 12387 - protein, 30 aa, Artificial Sequence
  Description of Artificial Sequence: Synthetic polypeptide
DEEEIRTTNPVATEQYGSVSPTNLQLNGME

SEQ ID NO: 12388 - protein, 28 aa, Artificial Sequence
  Description of Artificial Sequence: Synthetic peptide
SEEEIRCTNPIATEQYGSVSENLQRENR

SEQ ID NO: 12389 - protein, 29 aa, Artificial Sequence
  Description of Artificial Sequence: Synthetic peptide
SEEEIRCTNPIATEQYGSVSENLQQRGNR

SEQ ID NO: 12390 - protein, 29 aa, Artificial Sequence
  Description of Artificial Sequence: Synthetic peptide
SEEEIRCTNPIATEQYGSVSENLQMRGNR

SEQ ID NO: 12391 - protein, 28 aa, Artificial Sequence
  Description of Artificial Sequence: Synthetic peptide
SEEEIRCTNPIATEQYGSVSENLPRGNR

SEQ ID NO: 12392 - protein, 28 aa, Artificial Sequence
  Description of Artificial Sequence: Synthetic peptide
DEEEIRTTNPGATEGYGSCSTNLARGNN

SEQ ID NO: 12393 - protein, 28 aa, Artificial Sequence
  Description of Artificial Sequence: Synthetic peptide
SEEEIRCTNPIATEQYGSVSENLQRGQR

SEQ ID NO: 12394 - protein, 31 aa, Artificial Sequence
  Description of Artificial Sequence: Synthetic polypeptide
DEEEIRTTNPVATEQYGSVSITNLQRFGAFD

SEQ ID NO: 12395 - protein, 28 aa, Artificial Sequence
  Description of Artificial Sequence: Synthetic peptide
AEEEIATTNPVAYEPYGSVSTNLQRGNV

SEQ ID NO: 12396 - protein, 31 aa, Artificial Sequence
  Description of Artificial Sequence: Synthetic polypeptide
DEEEIRTTNPVATEQYGSVSITNLQRFGADF

SEQ ID NO: 12397 - protein, 31 aa, Artificial Sequence
  Description of Artificial Sequence: Synthetic polypeptide
DEEEIRTTNPVATEQYGSVSPTNLLRIGEMR

SEQ ID NO: 12398 - protein, 31 aa, Artificial Sequence
  Description of Artificial Sequence: Synthetic polypeptide
DEEEIRTTNPVATEQYGSVSPTNLLQRGEFM

SEQ ID NO: 12399 - protein, 30 aa, Artificial Sequence
  Description of Artificial Sequence: Synthetic polypeptide
DEEEIRTTNPVATEQWGSVSTNEQRGQDRD

SEQ ID NO: 12400 - protein, 29 aa, Artificial Sequence
  Description of Artificial Sequence: Synthetic peptide
DEEEIRTTNPVATEQYGSVSNNLDRTIQR

SEQ ID NO: 12401 - protein, 29 aa, Artificial Sequence
  Description of Artificial Sequence: Synthetic peptide
DEEEIRTTNPVATEQYGSVSNNLDVGNSG

SEQ ID NO: 12402 - protein, 28 aa, Artificial Sequence
  Description of Artificial Sequence: Synthetic peptide
DEEEIRTTNPVATEQWGSVSTNEMQGNW

SEQ ID NO: 12403 - protein, 28 aa, Artificial Sequence
  Description of Artificial Sequence: Synthetic peptide
DEEEIRTTNPVATEQWGSVSTNEMQGNM

SEQ ID NO: 12404 - protein, 31 aa, Artificial Sequence
  Description of Artificial Sequence: Synthetic polypeptide
DEEEIRTTNPVATEQYGSVSPTNLLRTGEQR

SEQ ID NO: 12405 - protein, 29 aa, Artificial Sequence
  Description of Artificial Sequence: Synthetic peptide
DEEEIRTTNPVATEQYGSVSNNLEFGNEQ

SEQ ID NO: 12406 - protein, 28 aa, Artificial Sequence
  Description of Artificial Sequence: Synthetic peptide
DEEEIRTTNPFATEQYGSVSWNITRGND

SEQ ID NO: 12407 - protein, 30 aa, Artificial Sequence
  Description of Artificial Sequence: Synthetic polypeptide
DEEEIRTTNPVATEQYGSVSTFNLFNSGNG

SEQ ID NO: 12408 - protein, 31 aa, Artificial Sequence
  Description of Artificial Sequence: Synthetic polypeptide
DEEEIRTTNPVATEQYGSVSITNLQPGNLGE

SEQ ID NO: 12409 - protein, 28 aa, Artificial Sequence
  Description of Artificial Sequence: Synthetic peptide
DEEEIRTTNPFATEQYGSVSWNIFRGND

SEQ ID NO: 12410 - protein, 28 aa, Artificial Sequence
  Description of Artificial Sequence: Synthetic peptide
DEEEIRTTNPFATEQYGSVSVNQFRGND

SEQ ID NO: 12411 - protein, 28 aa, Artificial Sequence
  Description of Artificial Sequence: Synthetic peptide
TEEEISTTNPVATEQYGPVSTNLQVGNV

SEQ ID NO: 12412 - protein, 31 aa, Artificial Sequence
  Description of Artificial Sequence: Synthetic polypeptide
DEEEIRTTNPVATEQYGSVSPTNLLERGERI

SEQ ID NO: 12413 - protein, 29 aa, Artificial Sequence
  Description of Artificial Sequence: Synthetic peptide
DEEEIRTTNPVATEQWGSVSTNEMNRGNM

SEQ ID NO: 12414 - protein, 28 aa, Artificial Sequence
  Description of Artificial Sequence: Synthetic peptide
SEEEIRCTNPIATEQYGSVSENLYRGNR

SEQ ID NO: 12415 - protein, 30 aa, Artificial Sequence
  Description of Artificial Sequence: Synthetic polypeptide
TEEEIRTTNPVAYESYGSVSTNLSQRGNRV

SEQ ID NO: 12416 - protein, 32 aa, Artificial Sequence
  Description of Artificial Sequence: Synthetic polypeptide
DEEEIRTTNPVATEQWGSVSTNLQNRGDNERT

SEQ ID NO: 12417 - protein, 31 aa, Artificial Sequence
  Description of Artificial Sequence: Synthetic polypeptide
DEEEIRTTNPVATEQYGSVSITNLQRENLDD

SEQ ID NO: 12418 - protein, 30 aa, Artificial Sequence
  Description of Artificial Sequence: Synthetic polypeptide
DEEAIRTTNPVATEQYGSVSTGNTQRGNAP

SEQ ID NO: 12419 - protein, 30 aa, Artificial Sequence
  Description of Artificial Sequence: Synthetic polypeptide
DEEAIRTTNPVATEQYGSVSTGNPQRGSNT

SEQ ID NO: 12420 - protein, 31 aa, Artificial Sequence
  Description of Artificial Sequence: Synthetic polypeptide
DEEEIRTTNPVATEQYGSVSITNLQREAERD

SEQ ID NO: 12421 - protein, 32 aa, Artificial Sequence
  Description of Artificial Sequence: Synthetic polypeptide
DEEEIRTTNPVATEQYGSVSTFNDLQRIENRQ

SEQ ID NO: 12422 - protein, 31 aa, Artificial Sequence
  Description of Artificial Sequence: Synthetic polypeptide
DEEEIRTTNPVATEQYGSVSITNLQQNGNTP

SEQ ID NO: 12423 - protein, 30 aa, Artificial Sequence
  Description of Artificial Sequence: Synthetic polypeptide
DEEAIRTTNPVATEQYGSVSTGNIQRGNQG

SEQ ID NO: 12424 - protein, 29 aa, Artificial Sequence
  Description of Artificial Sequence: Synthetic peptide
AEEEIATTNPVATEQYGVVSTNLQRQNRQ

SEQ ID NO: 12425 - protein, 30 aa, Artificial Sequence
  Description of Artificial Sequence: Synthetic polypeptide
DEEEIRTTNPVATEQYGSVSTFNLDFSGNQ

SEQ ID NO: 12426 - protein, 30 aa, Artificial Sequence
  Description of Artificial Sequence: Synthetic polypeptide
DEEEIRTTNPVATEQYGSVSTFNLDNNGND

SEQ ID NO: 12427 - protein, 29 aa, Artificial Sequence
  Description of Artificial Sequence: Synthetic peptide
AEEEIATTNPVATEVYGSVSTNLQRGNIS

SEQ ID NO: 12428 - protein, 31 aa, Artificial Sequence
  Description of Artificial Sequence: Synthetic polypeptide
DEEEIRTTNPVATEQYGSVSTFNLEQDGFNE

SEQ ID NO: 12429 - protein, 31 aa, Artificial Sequence
  Description of Artificial Sequence: Synthetic polypeptide
DEEEIRTTNPVATEQYGSVSPTNLNRLNQRD

SEQ ID NO: 12430 - protein, 30 aa, Artificial Sequence
  Description of Artificial Sequence: Synthetic polypeptide
DEEEIRTTNPVATEQYGSVSPTNLNNVNFR

SEQ ID NO: 12431 - protein, 28 aa, Artificial Sequence
  Description of Artificial Sequence: Synthetic peptide
DEEEIRTTNPFATEQYGSVSYNIARGNF

SEQ ID NO: 12432 - protein, 30 aa, Artificial Sequence
  Description of Artificial Sequence: Synthetic polypeptide
DEEEIRTTNPVATEQYGSVSTFNLFEAGNM

SEQ ID NO: 12433 - protein, 30 aa, Artificial Sequence
  Description of Artificial Sequence: Synthetic polypeptide
DEEEIRTTNPVATEQYGSVSTFNLDGEGNE

SEQ ID NO: 12434 - protein, 31 aa, Artificial Sequence
  Description of Artificial Sequence: Synthetic polypeptide
DEEEIRTTNPVATEQYGSVSTEPLERLGSNR

SEQ ID NO: 12435 - protein, 29 aa, Artificial Sequence
  Description of Artificial Sequence: Synthetic peptide
AEEEICTTNPVATEQYGSVSTNLQHGNDS

SEQ ID NO: 12436 - protein, 29 aa, Artificial Sequence
  Description of Artificial Sequence: Synthetic peptide
AEEEICTTNPVATEQYGSVSTNLQQGDRL

SEQ ID NO: 12437 - protein, 30 aa, Artificial Sequence
  Description of Artificial Sequence: Synthetic polypeptide
DEEEIRTTNPVATEQYGCVSNDNLQHGNRM

SEQ ID NO: 12438 - protein, 31 aa, Artificial Sequence
  Description of Artificial Sequence: Synthetic polypeptide
DEEEIRTTNPVATEQYGSVSTENLQEDGNGT

SEQ ID NO: 12439 - protein, 29 aa, Artificial Sequence
  Description of Artificial Sequence: Synthetic peptide
DEEEIRTTNPVATEQYGCVSNNLQDGDER

SEQ ID NO: 12440 - protein, 30 aa, Artificial Sequence
  Description of Artificial Sequence: Synthetic polypeptide
DEEEIRTTNPVATEQYGSVSTENLQELVNG

SEQ ID NO: 12441 - protein, 28 aa, Artificial Sequence
  Description of Artificial Sequence: Synthetic peptide
SEEEIRCTNPIATEQYGSVSFNLMRGNR

SEQ ID NO: 12442 - protein, 32 aa, Artificial Sequence
  Description of Artificial Sequence: Synthetic polypeptide
DEEEIRTTNPVATEQYGSVSTENLQENGNNRL

SEQ ID NO: 12443 - protein, 31 aa, Artificial Sequence
  Description of Artificial Sequence: Synthetic polypeptide
DEEEIRTTNPVATEQYGSVSPTNLQYGLELR

SEQ ID NO: 12444 - protein, 28 aa, Artificial Sequence
  Description of Artificial Sequence: Synthetic peptide
DEDEIRTTNPVATTQYGVVSTNLERGNG

SEQ ID NO: 12445 - protein, 31 aa, Artificial Sequence
  Description of Artificial Sequence: Synthetic polypeptide
DEEEIRTTNPVATEQYGSVSPTNLQVRIDTR

SEQ ID NO: 12446 - protein, 30 aa, Artificial Sequence
  Description of Artificial Sequence: Synthetic polypeptide
DEEEIRTTNPVATEQYGSVSPTNLQVINDQ

SEQ ID NO: 12447 - protein, 31 aa, Artificial Sequence
  Description of Artificial Sequence: Synthetic polypeptide
DEEEIRTTNPVATEQYGSVSTENLQFEGNNL

SEQ ID NO: 12448 - protein, 30 aa, Artificial Sequence
  Description of Artificial Sequence: Synthetic polypeptide
DEEEIRTTNPVATEQYGSVSTENLQFNINT

SEQ ID NO: 12449 - protein, 28 aa, Artificial Sequence
  Description of Artificial Sequence: Synthetic peptide
DEEEIRTTNPIATEAYGSCSTNLARGND

SEQ ID NO: 12450 - protein, 30 aa, Artificial Sequence
  Description of Artificial Sequence: Synthetic polypeptide
DEEEIRTTNPVATEQWGTVSWTNLNRGGNR

SEQ ID NO: 12451 - protein, 30 aa, Artificial Sequence
  Description of Artificial Sequence: Synthetic polypeptide
DEEEIRTTNPVATEQYGSVSITNLQSSGQV

SEQ ID NO: 12452 - protein, 31 aa, Artificial Sequence
  Description of Artificial Sequence: Synthetic polypeptide
DEEEIRTTNPVATEQYGSVSPTNLQTVVNRQ

SEQ ID NO: 12453 - protein, 30 aa, Artificial Sequence
  Description of Artificial Sequence: Synthetic polypeptide
AEEEIRTTNPVATEQYGSVSTTNQLERGNT

SEQ ID NO: 12454 - protein, 30 aa, Artificial Sequence
  Description of Artificial Sequence: Synthetic polypeptide
DEEEIRTTNPVATEQYGSVSTENLQFTVNP

SEQ ID NO: 12455 - protein, 30 aa, Artificial Sequence
  Description of Artificial Sequence: Synthetic polypeptide
AEEEIRTTNPVATEQYGSVSTTNPQANGNR

SEQ ID NO: 12456 - protein, 31 aa, Artificial Sequence
  Description of Artificial Sequence: Synthetic polypeptide
DEEEIRTTNPVATEQYGSVSPTNLVRSGEER

SEQ ID NO: 12457 - protein, 30 aa, Artificial Sequence
  Description of Artificial Sequence: Synthetic polypeptide
DEEEIRTTNPVATEQYGSVSNNEQRGNQTD

SEQ ID NO: 12458 - protein, 30 aa, Artificial Sequence
  Description of Artificial Sequence: Synthetic polypeptide
DEEEIRTTNPVATEQYGCVSINLQRFGNDG

SEQ ID NO: 12459 - protein, 28 aa, Artificial Sequence
  Description of Artificial Sequence: Synthetic peptide
SEEEIRCTNPIATEQYGSVSINLMRGNR

SEQ ID NO: 12460 - protein, 31 aa, Artificial Sequence
  Description of Artificial Sequence: Synthetic polypeptide
TEEEIRTTNPVATEQYGVVPSCTNLQRVGNR

SEQ ID NO: 12461 - protein, 31 aa, Artificial Sequence
  Description of Artificial Sequence: Synthetic polypeptide
DEEEIRTTNPVATEQYGSVSPTNMQRVVNRI

SEQ ID NO: 12462 - protein, 31 aa, Artificial Sequence
  Description of Artificial Sequence: Synthetic polypeptide
DEEEIRTTNPVATEQYGSVSTENLQAFNNRM

SEQ ID NO: 12463 - protein, 31 aa, Artificial Sequence
  Description of Artificial Sequence: Synthetic polypeptide
DEEEIRTTNPVATEQYGSVSTENLQAGGNSY

SEQ ID NO: 12464 - protein, 31 aa, Artificial Sequence
  Description of Artificial Sequence: Synthetic polypeptide
AEEEIRTTNPVATEQYGSVSTTNNVLQGGNR

SEQ ID NO: 12465 - protein, 32 aa, Artificial Sequence
  Description of Artificial Sequence: Synthetic polypeptide
DEEEIRTTNPVATEQYGSVSPTNMLQRGVLRN

SEQ ID NO: 12466 - protein, 31 aa, Artificial Sequence
  Description of Artificial Sequence: Synthetic polypeptide
DEEEIRTTNPVATEQYGSVSTENLQAGSNSY

SEQ ID NO: 12467 - protein, 28 aa, Artificial Sequence
  Description of Artificial Sequence: Synthetic peptide
SEEEIRCTNPIATEQYGSVSGNLMRGNR

SEQ ID NO: 12468 - protein, 31 aa, Artificial Sequence
  Description of Artificial Sequence: Synthetic polypeptide
DEEEIRTTNPVATEQYGSVSTENLQARIGII

SEQ ID NO: 12469 - protein, 29 aa, Artificial Sequence
  Description of Artificial Sequence: Synthetic peptide
TEEEIRTTNPVATTQYGSVSTNFLERVNR

SEQ ID NO: 12470 - protein, 29 aa, Artificial Sequence
  Description of Artificial Sequence: Synthetic peptide
TEEEIRTTNPVAVEQYGHVSTNLERGNRG

SEQ ID NO: 12471 - protein, 31 aa, Artificial Sequence
  Description of Artificial Sequence: Synthetic polypeptide
DEEEIRTTNPVATEQYGSVSTENLQDPGNQV

SEQ ID NO: 12472 - protein, 31 aa, Artificial Sequence
  Description of Artificial Sequence: Synthetic polypeptide
DEEAIRTTNPVATEQYGSVSTNNLQRGSNDF

SEQ ID NO: 12473 - protein, 31 aa, Artificial Sequence
  Description of Artificial Sequence: Synthetic polypeptide
DEEEIRTTNPVATEQYGSVSTENLQAGSNLM

SEQ ID NO: 12474 - protein, 28 aa, Artificial Sequence
  Description of Artificial Sequence: Synthetic peptide
DEEEIRTTNPFATEQYGSVSTPLQIEND

SEQ ID NO: 12475 - protein, 30 aa, Artificial Sequence
  Description of Artificial Sequence: Synthetic polypeptide
DEEEIRTTNPVATEQWGTVSTNLQTRGPNE

SEQ ID NO: 12476 - protein, 30 aa, Artificial Sequence
  Description of Artificial Sequence: Synthetic polypeptide
DEEEIRTTNPVATEQYGSVSPTNLQSIVRD

SEQ ID NO: 12477 - protein, 32 aa, Artificial Sequence
  Description of Artificial Sequence: Synthetic polypeptide
DEEEIRTTNPVATEQYGSVSPTNLQRGAENLM

SEQ ID NO: 12478 - protein, 31 aa, Artificial Sequence
  Description of Artificial Sequence: Synthetic polypeptide
DEEEIRTTNPVATEQYGSVSITNLQRQNVTD

SEQ ID NO: 12479 - protein, 30 aa, Artificial Sequence
  Description of Artificial Sequence: Synthetic polypeptide
DEEEIRTTNPVATEQYGSVSPTNLQREQSM

SEQ ID NO: 12480 - protein, 30 aa, Artificial Sequence
  Description of Artificial Sequence: Synthetic polypeptide
DEEEIRTTNPVATEQYGSVSTENNINGNPR

SEQ ID NO: 12481 - protein, 30 aa, Artificial Sequence
  Description of Artificial Sequence: Synthetic polypeptide
DEEEIRTTNPVATEQYGSVSPTNLQREELW

SEQ ID NO: 12482 - protein, 31 aa, Artificial Sequence
  Description of Artificial Sequence: Synthetic polypeptide
DEEEIRTTNPVATEQYGSVSPTNLQRDNNTP

SEQ ID NO: 12483 - protein, 31 aa, Artificial Sequence
  Description of Artificial Sequence: Synthetic polypeptide
DEEEIRTTNPVATEQYGSVSITNLQRQNLLD

SEQ ID NO: 12484 - protein, 31 aa, Artificial Sequence
  Description of Artificial Sequence: Synthetic polypeptide
DEEEIRTTNPVATEQYGSVSITNLQSDGNGD

SEQ ID NO: 12485 - protein, 32 aa, Artificial Sequence
  Description of Artificial Sequence: Synthetic polypeptide
DEEEIRTTNPVATEQYGSVSTENPLQSGSNRA

SEQ ID NO: 12486 - protein, 30 aa, Artificial Sequence
  Description of Artificial Sequence: Synthetic polypeptide
DEEEIRTTNPVATEQYGSVSTENTQQMGNS

SEQ ID NO: 12487 - protein, 30 aa, Artificial Sequence
  Description of Artificial Sequence: Synthetic polypeptide
DEEEIRTTNPVATEQWGSVVSTTLSQGGNR

SEQ ID NO: 12488 - protein, 31 aa, Artificial Sequence
  Description of Artificial Sequence: Synthetic polypeptide
DEEEIRTTNPVATEQYGSVSTENTTRFGNRS

SEQ ID NO: 12489 - protein, 31 aa, Artificial Sequence
  Description of Artificial Sequence: Synthetic polypeptide
DEEEIRTTNPVATEQYGSVSITNLQRQGPFD

SEQ ID NO: 12490 - protein, 30 aa, Artificial Sequence
  Description of Artificial Sequence: Synthetic polypeptide
DEEEIRTTNPVATEQWGSVVSTNALQAGNH

SEQ ID NO: 12491 - protein, 31 aa, Artificial Sequence
  Description of Artificial Sequence: Synthetic polypeptide
DEEEIRTTNPVATEQYGSVSTENWLQVSENR

SEQ ID NO: 12492 - protein, 28 aa, Artificial Sequence
  Description of Artificial Sequence: Synthetic peptide
AEEEICTTNPVATEQYGSVSTNLQYGPD

SEQ ID NO: 12493 - protein, 30 aa, Artificial Sequence
  Description of Artificial Sequence: Synthetic polypeptide
DEEEIRTTNPVATEQYGSVSTENSQMMGNN

SEQ ID NO: 12494 - protein, 31 aa, Artificial Sequence
  Description of Artificial Sequence: Synthetic polypeptide
DEEEIRTTNPVATEQYGSVSTENLQGDGNDS

SEQ ID NO: 12495 - protein, 29 aa, Artificial Sequence
  Description of Artificial Sequence: Synthetic peptide
DEECIRTTNPVATECYGQVTTNLQRGENR

SEQ ID NO: 12496 - protein, 30 aa, Artificial Sequence
  Description of Artificial Sequence: Synthetic polypeptide
DEEEIRTTNPVATEQWGTSVSTALDQRGNS

SEQ ID NO: 12497 - protein, 32 aa, Artificial Sequence
  Description of Artificial Sequence: Synthetic polypeptide
DEEEIRTTNPVATEQYGSVSPTNLQRVNVNRS

SEQ ID NO: 12498 - protein, 31 aa, Artificial Sequence
  Description of Artificial Sequence: Synthetic polypeptide
DEEEIRTTNPVATEQYGSVSPTNLQRVENQA

SEQ ID NO: 12499 - protein, 31 aa, Artificial Sequence
  Description of Artificial Sequence: Synthetic polypeptide
DEEEIRTTNPVATEQYGSVSPTNLQRQNVIM

SEQ ID NO: 12500 - protein, 30 aa, Artificial Sequence
  Description of Artificial Sequence: Synthetic polypeptide
DEEEIRTTNPVATEQYGSVSTENLQNQDRN

SEQ ID NO: 12501 - protein, 28 aa, Artificial Sequence
  Description of Artificial Sequence: Synthetic peptide
DEDEIRTTNPVATWQYGVVSTNLERGNG

SEQ ID NO: 12502 - protein, 29 aa, Artificial Sequence
  Description of Artificial Sequence: Synthetic peptide
SEEEIRCTNPIATEQYGSVSETNLMRGNR

SEQ ID NO: 12503 - protein, 32 aa, Artificial Sequence
  Description of Artificial Sequence: Synthetic polypeptide
DEEEIRTTNPVATEQYGSVSPTNLQRNEENRG

SEQ ID NO: 12504 - protein, 32 aa, Artificial Sequence
  Description of Artificial Sequence: Synthetic polypeptide
DEEEIRTTNPVATEQYGSVSPTNLQRGEENTE

SEQ ID NO: 12505 - protein, 29 aa, Artificial Sequence
  Description of Artificial Sequence: Synthetic peptide
SEEEIRCTNPIATEQYGSVSETNLFRGNR

SEQ ID NO: 12506 - protein, 31 aa, Artificial Sequence
  Description of Artificial Sequence: Synthetic polypeptide
DEEEIRTTNPVATEQYGSVSPTNLQRILNFD

SEQ ID NO: 12507 - protein, 31 aa, Artificial Sequence
  Description of Artificial Sequence: Synthetic polypeptide
DEEEIRTTNPVATEQYGSVSTENLQRQGDQL

SEQ ID NO: 12508 - protein, 31 aa, Artificial Sequence
  Description of Artificial Sequence: Synthetic polypeptide
DEEEIRTTNPVATEQYGSVSTENLQRSMSQR

SEQ ID NO: 12509 - protein, 29 aa, Artificial Sequence
  Description of Artificial Sequence: Synthetic peptide
DEEEIRTTNPVATEQWGTSVSTELDRGNE

SEQ ID NO: 12510 - protein, 31 aa, Artificial Sequence
  Description of Artificial Sequence: Synthetic polypeptide
DEEEIRTTNPVATEQYGSVSTENLQSVGGNI

SEQ ID NO: 12511 - protein, 31 aa, Artificial Sequence
  Description of Artificial Sequence: Synthetic polypeptide
DEEEIRTTNPVATEQYGSVSTENLQYGSNQY

SEQ ID NO: 12512 - protein, 31 aa, Artificial Sequence
  Description of Artificial Sequence: Synthetic polypeptide
DEEEIRTTNPVATEQYGSVSTENLTQGGNIF

SEQ ID NO: 12513 - protein, 31 aa, Artificial Sequence
  Description of Artificial Sequence: Synthetic polypeptide
AEEEIRTTNPVATEQYGSVSTTNQLQNGTNR

SEQ ID NO: 12514 - protein, 28 aa, Artificial Sequence
  Description of Artificial Sequence: Synthetic peptide
AEEEIATTNPVATEQYGSVSTNLQQGPQ

SEQ ID NO: 12515 - protein, 28 aa, Artificial Sequence
  Description of Artificial Sequence: Synthetic peptide
AEEEIATTNPVATEQYGSVSTNLQNGVD

SEQ ID NO: 12516 - protein, 31 aa, Artificial Sequence
  Description of Artificial Sequence: Synthetic polypeptide
DEEEIRTTNPVATEQYGSVSPTNLHQRVENE

SEQ ID NO: 12517 - protein, 29 aa, Artificial Sequence
  Description of Artificial Sequence: Synthetic peptide
DEEEIRTTNPVATEQYGSVSTGLNINGND

SEQ ID NO: 12518 - protein, 30 aa, Artificial Sequence
  Description of Artificial Sequence: Synthetic polypeptide
DEEEIRTTNPVATEQYGSVSITNGTQRGDF

SEQ ID NO: 12519 - protein, 30 aa, Artificial Sequence
  Description of Artificial Sequence: Synthetic polypeptide
DEEEIRTTNPVATEQYGSVSTGLPQRGEDI

SEQ ID NO: 12520 - protein, 32 aa, Artificial Sequence
  Description of Artificial Sequence: Synthetic polypeptide
DEEEIRTTNPVATEQWGSVSCTNLAQRGGSNR

SEQ ID NO: 12521 - protein, 32 aa, Artificial Sequence
  Description of Artificial Sequence: Synthetic polypeptide
DEEEIRTTNPVATEQWGSVSCTNELQRTGNRI

SEQ ID NO: 12522 - protein, 31 aa, Artificial Sequence
  Description of Artificial Sequence: Synthetic polypeptide
DEEEIRTTNPVATEQYGSVSTGLPQRGEDNG

SEQ ID NO: 12523 - protein, 30 aa, Artificial Sequence
  Description of Artificial Sequence: Synthetic polypeptide
DEEEIRTTNPVATEQYGSVSTGLQAQGDNN

SEQ ID NO: 12524 - protein, 28 aa, Artificial Sequence
  Description of Artificial Sequence: Synthetic peptide
SEEEIRCTNPIATEQYGSVSENCQRGNR

SEQ ID NO: 12525 - protein, 32 aa, Artificial Sequence
  Description of Artificial Sequence: Synthetic polypeptide
DEEEIRTTNPVATEQWGSVSCTNALQRTGNRI

SEQ ID NO: 12526 - protein, 30 aa, Artificial Sequence
  Description of Artificial Sequence: Synthetic polypeptide
DEEEIRTTNPVATEQYGSVSTGLQIGENGG

SEQ ID NO: 12527 - protein, 30 aa, Artificial Sequence
  Description of Artificial Sequence: Synthetic polypeptide
DEEEIRTTNPVATEQYGSVSTGLQNESGNT

SEQ ID NO: 12528 - protein, 30 aa, Artificial Sequence
  Description of Artificial Sequence: Synthetic polypeptide
DEEEIRTTNPVATEQYGSVSTGLQQGNGDL

SEQ ID NO: 12529 - protein, 28 aa, Artificial Sequence
  Description of Artificial Sequence: Synthetic peptide
TEEIIRTTNPVATEQYGSVSTNLSVLNR

SEQ ID NO: 12530 - protein, 29 aa, Artificial Sequence
  Description of Artificial Sequence: Synthetic peptide
TEEKIRTTNPVATEQYGSVYSTNLEHGNR

SEQ ID NO: 12531 - protein, 31 aa, Artificial Sequence
  Description of Artificial Sequence: Synthetic polypeptide
DEEEIRTTNPVATEQYGSVSTGLQRGGNVTQ

SEQ ID NO: 12532 - protein, 30 aa, Artificial Sequence
  Description of Artificial Sequence: Synthetic polypeptide
DEEEIRTTNPVATEQYGCVSNTNLQGGTRA

SEQ ID NO: 12533 - protein, 30 aa, Artificial Sequence
  Description of Artificial Sequence: Synthetic polypeptide
DEEEIRTTNPVATEQYGSVSTGLQHGINSG

SEQ ID NO: 12534 - protein, 30 aa, Artificial Sequence
  Description of Artificial Sequence: Synthetic polypeptide
DEEEIRTTNPVATEQYGSVSTGLQRGIGDV

SEQ ID NO: 12535 - protein, 29 aa, Artificial Sequence
  Description of Artificial Sequence: Synthetic peptide
TEEGIRTTNPVATEQYGSVSTNLSVVGNR

SEQ ID NO: 12536 - protein, 31 aa, Artificial Sequence
  Description of Artificial Sequence: Synthetic polypeptide
DEEEIRTTNPVATEQYGSVSTGLHQRGNQEG

SEQ ID NO: 12537 - protein, 29 aa, Artificial Sequence
  Description of Artificial Sequence: Synthetic peptide
TEEGIRTTNPVATEQYGSVSTNLEGGLNR

SEQ ID NO: 12538 - protein, 30 aa, Artificial Sequence
  Description of Artificial Sequence: Synthetic polypeptide
DEEEIRTTNPVATEQYGSVSITNLDMGEIR

SEQ ID NO: 12539 - protein, 29 aa, Artificial Sequence
  Description of Artificial Sequence: Synthetic peptide
DEEEIRTTNPVATEQYGSVSNNLQGTEQR

SEQ ID NO: 12540 - protein, 30 aa, Artificial Sequence
  Description of Artificial Sequence: Synthetic polypeptide
DEEEIRTTNPVATEQYGSVSPTNGTQRGAF

SEQ ID NO: 12541 - protein, 28 aa, Artificial Sequence
  Description of Artificial Sequence: Synthetic peptide
TEEGIRTTNPVATEQYGSVSTNLEYVNR

SEQ ID NO: 12542 - protein, 28 aa, Artificial Sequence
  Description of Artificial Sequence: Synthetic peptide
TEEGIRTTNPVATEQYGSVSTNLGDLNR

SEQ ID NO: 12543 - protein, 29 aa, Artificial Sequence
  Description of Artificial Sequence: Synthetic peptide
TEEGIRTTNPVATEQYGSVSTNLLEGENR

SEQ ID NO: 12544 - protein, 30 aa, Artificial Sequence
  Description of Artificial Sequence: Synthetic polypeptide
DEEEIRTTNPVATEQYGSVSTGLLARGNQT

SEQ ID NO: 12545 - protein, 28 aa, Artificial Sequence
  Description of Artificial Sequence: Synthetic peptide
TEEGIRTTNPVATEQYGSVSTNLNMSNR

SEQ ID NO: 12546 - protein, 30 aa, Artificial Sequence
  Description of Artificial Sequence: Synthetic polypeptide
DEEEIRTTNPVATEQYGSVSNNLQNEGPTR

SEQ ID NO: 12547 - protein, 29 aa, Artificial Sequence
  Description of Artificial Sequence: Synthetic peptide
TEEGIRTTNPVATEQYGSVSTNLQIMLNR

SEQ ID NO: 12548 - protein, 29 aa, Artificial Sequence
  Description of Artificial Sequence: Synthetic peptide
TEEGIRTTNPVATEQYGSVSTNLQSFENR

SEQ ID NO: 12549 - protein, 30 aa, Artificial Sequence
  Description of Artificial Sequence: Synthetic polypeptide
DEEEIRTTNPVATEQYGSVSTGLEQRMVRE

SEQ ID NO: 12550 - protein, 30 aa, Artificial Sequence
  Description of Artificial Sequence: Synthetic polypeptide
DEEEIRTTNPVATEQYGSVSNNLQPRGEDE

SEQ ID NO: 12551 - protein, 29 aa, Artificial Sequence
  Description of Artificial Sequence: Synthetic peptide
DEEEIRTTNPVATEQYGSVSTGLGIGNNE

SEQ ID NO: 12552 - protein, 28 aa, Artificial Sequence
  Description of Artificial Sequence: Synthetic peptide
SEEEIRCTNPIATEQYGSVSENEQRGNR

SEQ ID NO: 12553 - protein, 30 aa, Artificial Sequence
  Description of Artificial Sequence: Synthetic polypeptide
DEEEIRTTNPVATEQYGSVSTGLEQRIVRS

SEQ ID NO: 12554 - protein, 28 aa, Artificial Sequence
  Description of Artificial Sequence: Synthetic peptide
TEEGIRTTNPVATEQYGSVSTNLAGLNR

SEQ ID NO: 12555 - protein, 28 aa, Artificial Sequence
  Description of Artificial Sequence: Synthetic peptide
TEENIRTTNPVATEQYGSVSTNLAMLNR

SEQ ID NO: 12556 - protein, 30 aa, Artificial Sequence
  Description of Artificial Sequence: Synthetic polypeptide
TEENIRTTNPVATEQYGSVSTNLQRGNEPP

SEQ ID NO: 12557 - protein, 30 aa, Artificial Sequence
  Description of Artificial Sequence: Synthetic polypeptide
DEEEIRTTNPVATEQYGSVSITNGGQRGIS

SEQ ID NO: 12558 - protein, 28 aa, Artificial Sequence
  Description of Artificial Sequence: Synthetic peptide
SEEEIRCTNPIATEQYGSVSDNLMRGNR

SEQ ID NO: 12559 - protein, 30 aa, Artificial Sequence
  Description of Artificial Sequence: Synthetic polypeptide
TEEVIRTTNPVATEQYGYSCSTNLQRGNVR

SEQ ID NO: 12560 - protein, 28 aa, Artificial Sequence
  Description of Artificial Sequence: Synthetic peptide
TEFEIRTTNPVATEQYGSVSTALERGNK

SEQ ID NO: 12561 - protein, 29 aa, Artificial Sequence
  Description of Artificial Sequence: Synthetic peptide
DEEEIRTTNPVATECYGCVSTNLQNPNRP

SEQ ID NO: 12562 - protein, 32 aa, Artificial Sequence
  Description of Artificial Sequence: Synthetic polypeptide
DEEEIRTTNPVATEQYGSVSITNELQRGGDLR

SEQ ID NO: 12563 - protein, 28 aa, Artificial Sequence
  Description of Artificial Sequence: Synthetic peptide
SEEEIRCTNPIATEQYGSVSCNLMRGNR

SEQ ID NO: 12564 - protein, 31 aa, Artificial Sequence
  Description of Artificial Sequence: Synthetic polypeptide
DEEEIRTTNPVATEQYGSVSTGLSQRGNYEA

SEQ ID NO: 12565 - protein, 30 aa, Artificial Sequence
  Description of Artificial Sequence: Synthetic polypeptide
DEEEIRTTNPVATEQWGSVSCEHLSQRGNR

SEQ ID NO: 12566 - protein, 30 aa, Artificial Sequence
  Description of Artificial Sequence: Synthetic polypeptide
DEEEIRTTNPVATEQYGSVSITNDQVGGNE

SEQ ID NO: 12567 - protein, 29 aa, Artificial Sequence
  Description of Artificial Sequence: Synthetic peptide
DEEEIRTTNPVATEQWGSVSATNLQHNND

SEQ ID NO: 12568 - protein, 29 aa, Artificial Sequence
  Description of Artificial Sequence: Synthetic peptide
DEEEIRTTNPVATEQWGSVSAENLQQGNN

SEQ ID NO: 12569 - protein, 28 aa, Artificial Sequence
  Description of Artificial Sequence: Synthetic peptide
SEEEIRCTNPIATEQYGSVSANLMRGNR

SEQ ID NO: 12570 - protein, 31 aa, Artificial Sequence
  Description of Artificial Sequence: Synthetic polypeptide
TEHEIRTTNPVATEQYGSVSCTNMLSQRGNR

SEQ ID NO: 12571 - protein, 29 aa, Artificial Sequence
  Description of Artificial Sequence: Synthetic peptide
DEEEIRTTNPVATEQWGSVSAENLQPGNA

SEQ ID NO: 12572 - protein, 30 aa, Artificial Sequence
  Description of Artificial Sequence: Synthetic polypeptide
DEEEIRTTNPVATEQYGCVSNTYLQRGDRG

SEQ ID NO: 12573 - protein, 30 aa, Artificial Sequence
  Description of Artificial Sequence: Synthetic polypeptide
TEGEIRTTNPVATEQYGSVSTNLDQRGNPG

SEQ ID NO: 12574 - protein, 30 aa, Artificial Sequence
  Description of Artificial Sequence: Synthetic polypeptide
DEEEIRTTNPVATEQYGSVSTGLQRGMGDV

SEQ ID NO: 12575 - protein, 31 aa, Artificial Sequence
  Description of Artificial Sequence: Synthetic polypeptide
DEEAIRTTNPVATEQYGSVCSMTNLQFGNRI

SEQ ID NO: 12576 - protein, 30 aa, Artificial Sequence
  Description of Artificial Sequence: Synthetic polypeptide
DEEEIRTTNPVATEQYGSVSTGLSQRGEQT

SEQ ID NO: 12577 - protein, 31 aa, Artificial Sequence
  Description of Artificial Sequence: Synthetic polypeptide
DEEEIRTTNPVATEQWGSVSCTLNGQRGGNR

SEQ ID NO: 12578 - protein, 30 aa, Artificial Sequence
  Description of Artificial Sequence: Synthetic polypeptide
DEEEIRTTNPVATEQYGSVSTGLQRGSTDV

SEQ ID NO: 12579 - protein, 30 aa, Artificial Sequence
  Description of Artificial Sequence: Synthetic polypeptide
DEEEIRTTNPVATEQYGSVSTGLQRGSTEQ

SEQ ID NO: 12580 - protein, 30 aa, Artificial Sequence
  Description of Artificial Sequence: Synthetic polypeptide
DEEEIRTTNPVATEQYGSVSTGLQRGTEES

SEQ ID NO: 12581 - protein, 31 aa, Artificial Sequence
  Description of Artificial Sequence: Synthetic polypeptide
DEEEIRTTNPVATEQYGSVSTGLQRGTNGQQ

SEQ ID NO: 12582 - protein, 31 aa, Artificial Sequence
  Description of Artificial Sequence: Synthetic polypeptide
DEEEIRTTNPVATEQYGSVSTGLQRGTNVIQ

SEQ ID NO: 12583 - protein, 31 aa, Artificial Sequence
  Description of Artificial Sequence: Synthetic polypeptide
DEEEIRTTNPVATEQYGSVSTGLQRIGNNNI

SEQ ID NO: 12584 - protein, 31 aa, Artificial Sequence
  Description of Artificial Sequence: Synthetic polypeptide
DEEEIRTTNPVATEQYGSVSTGLSQRGNPEV

SEQ ID NO: 12585 - protein, 31 aa, Artificial Sequence
  Description of Artificial Sequence: Synthetic polypeptide
DEEEIRTTNPVATEQYGSVSTGLQRMDNGRD

SEQ ID NO: 12586 - protein, 31 aa, Artificial Sequence
  Description of Artificial Sequence: Synthetic polypeptide
DEEEIRTTNPVATEQWGSVSCTGNHQRVGNR

SEQ ID NO: 12587 - protein, 31 aa, Artificial Sequence
  Description of Artificial Sequence: Synthetic polypeptide
DEEEIRTTNPVATEQYGSVSTGLQRVINNRD

SEQ ID NO: 12588 - protein, 30 aa, Artificial Sequence
  Description of Artificial Sequence: Synthetic polypeptide
DEEEIRTTNPVATEQYGCVSNTNLVRGNFE

SEQ ID NO: 12589 - protein, 30 aa, Artificial Sequence
  Description of Artificial Sequence: Synthetic polypeptide
DEEEIRTTNPVATEQYGSVSTGLQTGGNVQ

SEQ ID NO: 12590 - protein, 30 aa, Artificial Sequence
  Description of Artificial Sequence: Synthetic polypeptide
DEEEIRTTNPVATEQWGSVSCQTLSQRGNR

SEQ ID NO: 12591 - protein, 30 aa, Artificial Sequence
  Description of Artificial Sequence: Synthetic polypeptide
DEEEIRTTNPVATEQYGSVSTGLQTNGNTS

SEQ ID NO: 12592 - protein, 30 aa, Artificial Sequence
  Description of Artificial Sequence: Synthetic polypeptide
TEESIRTTNPVATEQYGSVSTNLQRQGSNS

SEQ ID NO: 12593 - protein, 31 aa, Artificial Sequence
  Description of Artificial Sequence: Synthetic polypeptide
DEEEIRTTNPVATEQYGSVSTGLQRVGNGDE

SEQ ID NO: 12594 - protein, 30 aa, Artificial Sequence
  Description of Artificial Sequence: Synthetic polypeptide
DEEEIRTTNPVATEQYGSVSTDLDQQRDER

SEQ ID NO: 12595 - protein, 28 aa, Artificial Sequence
  Description of Artificial Sequence: Synthetic peptide
SEEEIRCTNPIATEQYGSVSENLARGNR

SEQ ID NO: 12596 - protein, 30 aa, Artificial Sequence
  Description of Artificial Sequence: Synthetic polypeptide
DEEEIRTTNPVATEQYGSVSITNLELGDHR

SEQ ID NO: 12597 - protein, 30 aa, Artificial Sequence
  Description of Artificial Sequence: Synthetic polypeptide
DEEEIRTTNPVATEQYGSVSTFNLQRNEVL

SEQ ID NO: 12598 - protein, 31 aa, Artificial Sequence
  Description of Artificial Sequence: Synthetic polypeptide
DEEEIRTTNPVATEQWGSVSTGNLSQRGNPG

SEQ ID NO: 12599 - protein, 29 aa, Artificial Sequence
  Description of Artificial Sequence: Synthetic peptide
DEEEIRTTNPFATEQYGSVSTGPLQPGND

SEQ ID NO: 12600 - protein, 30 aa, Artificial Sequence
  Description of Artificial Sequence: Synthetic polypeptide
DEEEIRTTNPVATEQWGSVSTELQTGDNRL

SEQ ID NO: 12601 - protein, 30 aa, Artificial Sequence
  Description of Artificial Sequence: Synthetic polypeptide
DEEEIRTTNPVATEQYGSVSTFNLTNGNPP

SEQ ID NO: 12602 - protein, 30 aa, Artificial Sequence
  Description of Artificial Sequence: Synthetic polypeptide
DEEEIRTTNPVATEQYGSVSTFNLTNIGNI

SEQ ID NO: 12603 - protein, 28 aa, Artificial Sequence
  Description of Artificial Sequence: Synthetic peptide
DEEEIRTTNPFATEQYGSVSTGLILGER

SEQ ID NO: 12604 - protein, 30 aa, Artificial Sequence
  Description of Artificial Sequence: Synthetic polypeptide
AEEEIRTTNPVATEQYGSVSTTSNEQRGNQ

SEQ ID NO: 12605 - protein, 28 aa, Artificial Sequence
  Description of Artificial Sequence: Synthetic peptide
DEEEIRTTNPFATEQYGSVSPNIFRGND

SEQ ID NO: 12606 - protein, 29 aa, Artificial Sequence
  Description of Artificial Sequence: Synthetic peptide
DEDEIRTTNPVAYEHYGSVSTNLQRGNNP

SEQ ID NO: 12607 - protein, 31 aa, Artificial Sequence
  Description of Artificial Sequence: Synthetic polypeptide
DEEEIRTTNPVATEQYGSVSITNLQFGTNEA

SEQ ID NO: 12608 - protein, 31 aa, Artificial Sequence
  Description of Artificial Sequence: Synthetic polypeptide
AEEEIRTTNPVATEQYGSVSTTSNLQQEGNR

SEQ ID NO: 12609 - protein, 30 aa, Artificial Sequence
  Description of Artificial Sequence: Synthetic polypeptide
DEEEIRTTNPVATEQWGSVSTELQFGGNRF

SEQ ID NO: 12610 - protein, 29 aa, Artificial Sequence
  Description of Artificial Sequence: Synthetic peptide
DEEEIRTTNPVATEQWGSVSTDLQRGPGA

SEQ ID NO: 12611 - protein, 30 aa, Artificial Sequence
  Description of Artificial Sequence: Synthetic polypeptide
DEEEIRTTNPVATEQWGSVSTDLPQRGGND

SEQ ID NO: 12612 - protein, 29 aa, Artificial Sequence
  Description of Artificial Sequence: Synthetic peptide
DEEEIRTTNPVATEQWGSVSTDLDRGNIV

SEQ ID NO: 12613 - protein, 28 aa, Artificial Sequence
  Description of Artificial Sequence: Synthetic peptide
DEEEIRTTNPFATEQYGSVSINIARGND

SEQ ID NO: 12614 - protein, 29 aa, Artificial Sequence
  Description of Artificial Sequence: Synthetic peptide
DEEEIRTTNPVATEQWGSVSQNLQDGNVD

SEQ ID NO: 12615 - protein, 31 aa, Artificial Sequence
  Description of Artificial Sequence: Synthetic polypeptide
DEEEIRTTNPVATEQWGSVSTGNLSQSGNRW

SEQ ID NO: 12616 - protein, 28 aa, Artificial Sequence
  Description of Artificial Sequence: Synthetic peptide
AEEEIRTTNPVATEQYGSVSTTQQRGIT

SEQ ID NO: 12617 - protein, 28 aa, Artificial Sequence
  Description of Artificial Sequence: Synthetic peptide
AEEEIATTNPVATEQYGSVSTNLQDGDF

SEQ ID NO: 12618 - protein, 31 aa, Artificial Sequence
  Description of Artificial Sequence: Synthetic polypeptide
DEEEIRTTNPVATEQYGSVSTFNLQDEGNNI

SEQ ID NO: 12619 - protein, 28 aa, Artificial Sequence
  Description of Artificial Sequence: Synthetic peptide
AEEEIATTNPVATEQYGSVSTHLQLGNA

SEQ ID NO: 12620 - protein, 28 aa, Artificial Sequence
  Description of Artificial Sequence: Synthetic peptide
AEEEIATTNPVATEQYGSVSTGLQWGNT

SEQ ID NO: 12621 - protein, 30 aa, Artificial Sequence
  Description of Artificial Sequence: Synthetic polypeptide
TEEEIYTTNPVATEQYGSVSLTNLQNNGNR

SEQ ID NO: 12622 - protein, 29 aa, Artificial Sequence
  Description of Artificial Sequence: Synthetic peptide
AEEEIATTNPVATEQYGSVSMNLQDGNRN

SEQ ID NO: 12623 - protein, 31 aa, Artificial Sequence
  Description of Artificial Sequence: Synthetic polypeptide
DEEEIRTTNPVATEQYGSVSTFNLQGIGQNQ

SEQ ID NO: 12624 - protein, 30 aa, Artificial Sequence
  Description of Artificial Sequence: Synthetic polypeptide
DEEEIRTTNPVATEQYGSVSPTNLENGERS

SEQ ID NO: 12625 - protein, 29 aa, Artificial Sequence
  Description of Artificial Sequence: Synthetic peptide
AEEEIATTNPVATEQYGSVSANLQGGNRV

SEQ ID NO: 12626 - protein, 29 aa, Artificial Sequence
  Description of Artificial Sequence: Synthetic peptide
AEEEIATTNPVATEQYGSVPTNLQQGNRE

SEQ ID NO: 12627 - protein, 29 aa, Artificial Sequence
  Description of Artificial Sequence: Synthetic peptide
SEEEIRCTNPIATEQYGSVSENLMQRGNR

SEQ ID NO: 12628 - protein, 29 aa, Artificial Sequence
  Description of Artificial Sequence: Synthetic peptide
DEEEIRTTNPVATEQYGSVSNNLGFGNDG

SEQ ID NO: 12629 - protein, 29 aa, Artificial Sequence
  Description of Artificial Sequence: Synthetic peptide
AEEEIATTNPVATEQYGSVCTNLQDGNRE

SEQ ID NO: 12630 - protein, 31 aa, Artificial Sequence
  Description of Artificial Sequence: Synthetic polypeptide
DEEEIRTTNPVATEQYGSVSPTNLEQTGENI

SEQ ID NO: 12631 - protein, 31 aa, Artificial Sequence
  Description of Artificial Sequence: Synthetic polypeptide
DEEEIRTTNPVATEQYGSVSPTNLEQRDENS

SEQ ID NO: 12632 - protein, 31 aa, Artificial Sequence
  Description of Artificial Sequence: Synthetic polypeptide
DEEEIRTTNPVATEQYGSVSTFNLQPGNIAN

SEQ ID NO: 12633 - protein, 30 aa, Artificial Sequence
  Description of Artificial Sequence: Synthetic polypeptide
DEEEIRTTNPVATEQYGSVSTFNLQGVNED

SEQ ID NO: 12634 - protein, 30 aa, Artificial Sequence
  Description of Artificial Sequence: Synthetic polypeptide
DEEEIRTTNPVATEQYGSVSITNLEEYGER

SEQ ID NO: 12635 - protein, 30 aa, Artificial Sequence
  Description of Artificial Sequence: Synthetic polypeptide
DEEEIRTTNPVATEQYGSVSITNLQELTNL

SEQ ID NO: 12636 - protein, 30 aa, Artificial Sequence
  Description of Artificial Sequence: Synthetic polypeptide
DEEEIRTTNPVATEQWGSVSPNLQRGENMA

SEQ ID NO: 12637 - protein, 29 aa, Artificial Sequence
  Description of Artificial Sequence: Synthetic peptide
DEEEIRTTNPVATEQWGSVSENLQAGNVD

SEQ ID NO: 12638 - protein, 28 aa, Artificial Sequence
  Description of Artificial Sequence: Synthetic peptide
SEEEIRCTNPIATEQYGSVSENLFRGNR

SEQ ID NO: 12639 - protein, 31 aa, Artificial Sequence
  Description of Artificial Sequence: Synthetic polypeptide
DEEEIRTTNPVATECWGSVSCTNLSQRGTNR

SEQ ID NO: 12640 - protein, 28 aa, Artificial Sequence
  Description of Artificial Sequence: Synthetic peptide
SEEEIRCTNPIATEQYGSVSENLERGNR

SEQ ID NO: 12641 - protein, 29 aa, Artificial Sequence
  Description of Artificial Sequence: Synthetic peptide
DEEEIRTTNPVATEQWGSVSENLQAGNTQ

SEQ ID NO: 12642 - protein, 30 aa, Artificial Sequence
  Description of Artificial Sequence: Synthetic polypeptide
DEEEIRTTNPVATEQYGSVSPTNIERNGDR

SEQ ID NO: 12643 - protein, 30 aa, Artificial Sequence
  Description of Artificial Sequence: Synthetic polypeptide
DEEEIRTTNPVATEQYGSVSNNLQDGNNEE

SEQ ID NO: 12644 - protein, 29 aa, Artificial Sequence
  Description of Artificial Sequence: Synthetic peptide
DEEEIRTTNPVATEQYGSVSTGDQTGNND

SEQ ID NO: 12645 - protein, 31 aa, Artificial Sequence
  Description of Artificial Sequence: Synthetic polypeptide
DEEEIRTTNPVATEQYGSVSITNLIQEGSNE

SEQ ID NO: 12646 - protein, 28 aa, Artificial Sequence
  Description of Artificial Sequence: Synthetic peptide
DEEEIRTTNPVATEQWGSVSENGQEGER

SEQ ID NO: 12647 - protein, 28 aa, Artificial Sequence
  Description of Artificial Sequence: Synthetic peptide
DEEEIRTTNPVATEQWGSVSENEQTGPR

SEQ ID NO: 12648 - protein, 31 aa, Artificial Sequence
  Description of Artificial Sequence: Synthetic polypeptide
DEEEIRTTNPVATEQYGSVSPTNHLQLGLIR

SEQ ID NO: 12649 - protein, 28 aa, Artificial Sequence
  Description of Artificial Sequence: Synthetic peptide
SEEEIRCTNPIATEQYGSVSENLDRGNR

SEQ ID NO: 12650 - protein, 29 aa, Artificial Sequence
  Description of Artificial Sequence: Synthetic peptide
DEEEIRTTNPVATEQWGSVSDTNLQAPND

SEQ ID NO: 12651 - protein, 31 aa, Artificial Sequence
  Description of Artificial Sequence: Synthetic polypeptide
DEEEIRTTNPVATEQWGSVSCTQNSQRGGNR

SEQ ID NO: 12652 - protein, 28 aa, Artificial Sequence
  Description of Artificial Sequence: Synthetic peptide
SEEEIRCTNPIATEQYGSVSENLCRGNR

SEQ ID NO: 12653 - protein, 30 aa, Artificial Sequence
  Description of Artificial Sequence: Synthetic polypeptide
DEEEIRTTNPVATEQYGSVSITNLEQRLPF

SEQ ID NO: 12654 - protein, 28 aa, Artificial Sequence
  Description of Artificial Sequence: Synthetic peptide
DEEEIRTTNPFATEQYGSVSEDQQRGND

SEQ ID NO: 12655 - protein, 30 aa, Artificial Sequence
  Description of Artificial Sequence: Synthetic polypeptide
DEEEIRTTNPVATEQYGSVSITNLLPGDIR

SEQ ID NO: 12656 - protein, 29 aa, Artificial Sequence
  Description of Artificial Sequence: Synthetic peptide
DEEEIRTTNPVATEQWGSVSENLQMRGTM

SEQ ID NO: 12657 - protein, 28 aa, Artificial Sequence
  Description of Artificial Sequence: Synthetic peptide
DEEEIRTTNPFATEQYGSVSANIPRGND

SEQ ID NO: 12658 - protein, 30 aa, Artificial Sequence
  Description of Artificial Sequence: Synthetic polypeptide
DEEEIRTTNPVATEQYGSVSITNLQDGGGD

SEQ ID NO: 12659 - protein, 30 aa, Artificial Sequence
  Description of Artificial Sequence: Synthetic polypeptide
DEEEIRTTNPFATEQYGSVIATNLQRGNGA

SEQ ID NO: 12660 - protein, 29 aa, Artificial Sequence
  Description of Artificial Sequence: Synthetic peptide
AEEEIRTTNPVATEQYGSVSTTSQAGINR

SEQ ID NO: 12661 - protein, 28 aa, Artificial Sequence
  Description of Artificial Sequence: Synthetic peptide
SEEEIRCTNPIATEQYGSVSENLLRGNR

SEQ ID NO: 12662 - protein, 28 aa, Artificial Sequence
  Description of Artificial Sequence: Synthetic peptide
SEEEIRCTNPIATEQYGSVSENLKRGNR

SEQ ID NO: 12663 - protein, 30 aa, Artificial Sequence
  Description of Artificial Sequence: Synthetic polypeptide
DEEEIRTTNPVATEQWGSVSMNLQRGPNQS

SEQ ID NO: 12664 - protein, 31 aa, Artificial Sequence
  Description of Artificial Sequence: Synthetic polypeptide
DEEEIRTTNPVATEQYGSVSTGDLQIGLNMR

SEQ ID NO: 12665 - protein, 28 aa, Artificial Sequence
  Description of Artificial Sequence: Synthetic peptide
SEEEIRCTNPIATEQYGSVSENLIRGNR

SEQ ID NO: 12666 - protein, 30 aa, Artificial Sequence
  Description of Artificial Sequence: Synthetic polypeptide
DEEEIRTTNPVATEQYGSVSITNLNGQGNE

SEQ ID NO: 12667 - protein, 28 aa, Artificial Sequence
  Description of Artificial Sequence: Synthetic peptide
SEEEIRCTNPIATEQYGSVSENLHRGNR

SEQ ID NO: 12668 - protein, 30 aa, Artificial Sequence
  Description of Artificial Sequence: Synthetic polypeptide
DEEEIRTTNPVATEQYGSVSTGAHQRLGNF

SEQ ID NO: 12669 - protein, 29 aa, Artificial Sequence
  Description of Artificial Sequence: Synthetic peptide
DEEEIRTTNPVATEQWGSVSENLQVGNMD

SEQ ID NO: 12670 - protein, 30 aa, Artificial Sequence
  Description of Artificial Sequence: Synthetic polypeptide
DEEEIRTTNPVATEQWGSVSENLQQKGNDR

SEQ ID NO: 12671 - protein, 28 aa, Artificial Sequence
  Description of Artificial Sequence: Synthetic peptide
SEEEIRCTNPIATEQYGSVSENLGRGNR

SEQ ID NO: 12672 - protein, 29 aa, Artificial Sequence
  Description of Artificial Sequence: Synthetic peptide
DEEEIRTTNPVATEQYGSVSNNLNDGNEQ

SEQ ID NO: 12673 - protein, 30 aa, Artificial Sequence
  Description of Artificial Sequence: Synthetic polypeptide
DEEEIRTTNPVATEQWGSVSGNLQRGDNMS

SEQ ID NO: 12674 - protein, 28 aa, Artificial Sequence
  Description of Artificial Sequence: Synthetic peptide
VEEEIRTTNPVATEQYGSVSTTLEEGNN

SEQ ID NO: 12675 - protein, 28 aa, Artificial Sequence
  Description of Artificial Sequence: Synthetic peptide
DEEEIRTTNPSATEGYGSCSTNLPRGND

SEQ ID NO: 12676 - protein, 31 aa, Artificial Sequence
  Description of Artificial Sequence: Synthetic polypeptide
DEEEIRTTNPVATEQYGSVSTDLDQQGSNER

SEQ ID NO: 12677 - protein, 29 aa, Artificial Sequence
  Description of Artificial Sequence: Synthetic peptide
AEEEIRTTNPVATEQYGSVSTNLQQGEQF

SEQ ID NO: 12678 - protein, 29 aa, Artificial Sequence
  Description of Artificial Sequence: Synthetic peptide
DEDEIRTTNPVATEQYGSVSINLARNMNR

SEQ ID NO: 12679 - protein, 29 aa, Artificial Sequence
  Description of Artificial Sequence: Synthetic peptide
AEEEIRTTNPVATEQYGSVSTNLQQGESV

SEQ ID NO: 12680 - protein, 29 aa, Artificial Sequence
  Description of Artificial Sequence: Synthetic peptide
DEDEIRTTNPVATEQYGSVSKNDQRGSND

SEQ ID NO: 12681 - protein, 30 aa, Artificial Sequence
  Description of Artificial Sequence: Synthetic polypeptide
DEDEIRTTNPVATEQYGSVSMNDLQDRGNQ

SEQ ID NO: 12682 - protein, 30 aa, Artificial Sequence
  Description of Artificial Sequence: Synthetic polypeptide
AEEEIRTTNPVATEQYGSVSTNLQQGGNDM

SEQ ID NO: 12683 - protein, 29 aa, Artificial Sequence
  Description of Artificial Sequence: Synthetic peptide
AEEEIRTTNPVATEQYGSVSNVNGQTGNR

SEQ ID NO: 12684 - protein, 30 aa, Artificial Sequence
  Description of Artificial Sequence: Synthetic polypeptide
DEDEIRTTNPVATEQYGSVSNNDLGQMGNR

SEQ ID NO: 12685 - protein, 30 aa, Artificial Sequence
  Description of Artificial Sequence: Synthetic polypeptide
DEEEIRTTNPVATEQYGSVSLTNGQRQDNT

SEQ ID NO: 12686 - protein, 31 aa, Artificial Sequence
  Description of Artificial Sequence: Synthetic polypeptide
AEEEIRTTNPVATEQYGSVSTNLQQIGINRI

SEQ ID NO: 12687 - protein, 30 aa, Artificial Sequence
  Description of Artificial Sequence: Synthetic polypeptide
DEDEIRTTNPVATEQYGSVSNNQLQERGNQ

SEQ ID NO: 12688 - protein, 31 aa, Artificial Sequence
  Description of Artificial Sequence: Synthetic polypeptide
AEEEIRTTNPVATEQYGSVSNTTNLQEGENR

SEQ ID NO: 12689 - protein, 30 aa, Artificial Sequence
  Description of Artificial Sequence: Synthetic polypeptide
AEEEIRTTNPVATEQYGSVSTNLQQLGNMD

SEQ ID NO: 12690 - protein, 30 aa, Artificial Sequence
  Description of Artificial Sequence: Synthetic polypeptide
DEEEIRTTNPVATEQYGSVSLVLLQRDNER

SEQ ID NO: 12691 - protein, 30 aa, Artificial Sequence
  Description of Artificial Sequence: Synthetic polypeptide
DEEEIRTTNPVATEQYGSVSLVNMQRGVER

SEQ ID NO: 12692 - protein, 29 aa, Artificial Sequence
  Description of Artificial Sequence: Synthetic peptide
DEEEIRTTNPVATEQYGSVSSTQDQEGNQ

SEQ ID NO: 12693 - protein, 29 aa, Artificial Sequence
  Description of Artificial Sequence: Synthetic peptide
AEEEIRTTNPVATEQYGSVSTNLQQEGLG

SEQ ID NO: 12694 - protein, 30 aa, Artificial Sequence
  Description of Artificial Sequence: Synthetic polypeptide
AEEEIRTTNPVATEQYGSVSTNLQQEGGNG

SEQ ID NO: 12695 - protein, 30 aa, Artificial Sequence
  Description of Artificial Sequence: Synthetic polypeptide
DEEEIRTTNPVATEQYGSVSLTNLDRMINQ

SEQ ID NO: 12696 - protein, 29 aa, Artificial Sequence
  Description of Artificial Sequence: Synthetic peptide
AEEEIRTTNPVATEQYGSVSSNLLQVGER

SEQ ID NO: 12697 - protein, 30 aa, Artificial Sequence
  Description of Artificial Sequence: Synthetic polypeptide
AEEEIRTTNPVATEQYGSVSTNLQNYGNDE

SEQ ID NO: 12698 - protein, 30 aa, Artificial Sequence
  Description of Artificial Sequence: Synthetic polypeptide
AEEEIRTTNPVATEQYGSVSTNLQPAGNIP

SEQ ID NO: 12699 - protein, 30 aa, Artificial Sequence
  Description of Artificial Sequence: Synthetic polypeptide
AEEEIRTTNPVATEQYGSVSTNLQPAGNTD

SEQ ID NO: 12700 - protein, 29 aa, Artificial Sequence
  Description of Artificial Sequence: Synthetic peptide
AEEEIRTTNPVATEQYGSVSTNLQPDDNG

SEQ ID NO: 12701 - protein, 31 aa, Artificial Sequence
  Description of Artificial Sequence: Synthetic polypeptide
AEEEIRTTNPVATEQYGSVSTNLQPGGGNRN

SEQ ID NO: 12702 - protein, 29 aa, Artificial Sequence
  Description of Artificial Sequence: Synthetic peptide
AEEEIRTTNPVATEQYGSVSTNLQPGGYT

SEQ ID NO: 12703 - protein, 29 aa, Artificial Sequence
  Description of Artificial Sequence: Synthetic peptide
DEDEIRTTNPVATEQYGSVSNSLDERGNR

SEQ ID NO: 12704 - protein, 29 aa, Artificial Sequence
  Description of Artificial Sequence: Synthetic peptide
AEEEIRTTNPVATEQYGSVSSNGDQDGNR

SEQ ID NO: 12705 - protein, 31 aa, Artificial Sequence
  Description of Artificial Sequence: Synthetic polypeptide
DEEEIRTTNPVATEAYGSIVSTNELSQRGNE

SEQ ID NO: 12706 - protein, 29 aa, Artificial Sequence
  Description of Artificial Sequence: Synthetic peptide
DEDEIRTTNPVATEQYGSVSFNNQQGDNR

SEQ ID NO: 12707 - protein, 30 aa, Artificial Sequence
  Description of Artificial Sequence: Synthetic polypeptide
AEEEIRTTNPVATEQYGSVSTNLQQDNNIR

SEQ ID NO: 12708 - protein, 29 aa, Artificial Sequence
  Description of Artificial Sequence: Synthetic peptide
AEEEIRTTNPVATEQYGSVSSELQIGNRN

SEQ ID NO: 12709 - protein, 30 aa, Artificial Sequence
  Description of Artificial Sequence: Synthetic polypeptide
AEEEIRTTNPVATEQYGSVSQTNLNDVGNR

SEQ ID NO: 12710 - protein, 30 aa, Artificial Sequence
  Description of Artificial Sequence: Synthetic polypeptide
AEEEIRTTNPVATEQYGSVSQTNEQSGGNR

SEQ ID NO: 12711 - protein, 28 aa, Artificial Sequence
  Description of Artificial Sequence: Synthetic peptide
AEEEIRTTNPVATEQYGSVSQNIQQGNN

SEQ ID NO: 12712 - protein, 30 aa, Artificial Sequence
  Description of Artificial Sequence: Synthetic polypeptide
AEEEIRTTNPVATEQYGSVSTNLQPNGENV

SEQ ID NO: 12713 - protein, 31 aa, Artificial Sequence
  Description of Artificial Sequence: Synthetic polypeptide
AEEEIRTTNPVATEQYGSVSTNLQQLQTGNR

SEQ ID NO: 12714 - protein, 30 aa, Artificial Sequence
  Description of Artificial Sequence: Synthetic polypeptide
AEEEIRTTNPVATEQYGSVSTNLQQMITNR

SEQ ID NO: 12715 - protein, 29 aa, Artificial Sequence
  Description of Artificial Sequence: Synthetic peptide
DEDEIRTTNPVATEQYGSVSQNLDRNTNR

SEQ ID NO: 12716 - protein, 30 aa, Artificial Sequence
  Description of Artificial Sequence: Synthetic polypeptide
AEEEIRTTNPVATEQYGSVSTNLQQTDTNR

SEQ ID NO: 12717 - protein, 30 aa, Artificial Sequence
  Description of Artificial Sequence: Synthetic polypeptide
AEEEIRTTNPVATEQYGSVSTNLQQYGNQF

SEQ ID NO: 12718 - protein, 31 aa, Artificial Sequence
  Description of Artificial Sequence: Synthetic polypeptide
AEEEIRTTNPVATEQYGSVSTNLQREGTNMD

SEQ ID NO: 12719 - protein, 30 aa, Artificial Sequence
  Description of Artificial Sequence: Synthetic polypeptide
AEEEIRTTNPVATEQYGSVSTNLQRGAQED

SEQ ID NO: 12720 - protein, 30 aa, Artificial Sequence
  Description of Artificial Sequence: Synthetic polypeptide
AEEEIRTTNPVATEQYGSVSTNLQRGDQDE

SEQ ID NO: 12721 - protein, 30 aa, Artificial Sequence
  Description of Artificial Sequence: Synthetic polypeptide
AEEEIRTTNPVATEQYGSVSTNLQRGGGDS

SEQ ID NO: 12722 - protein, 31 aa, Artificial Sequence
  Description of Artificial Sequence: Synthetic polypeptide
AEEEIRTTNPVATEQYGSVSTNLQRGGINIF

SEQ ID NO: 12723 - protein, 30 aa, Artificial Sequence
  Description of Artificial Sequence: Synthetic polypeptide
AEEEIRTTNPVATEQYGSVSTNLQQSQGQR

SEQ ID NO: 12724 - protein, 31 aa, Artificial Sequence
  Description of Artificial Sequence: Synthetic polypeptide
AEEEIRTTNPVATEQYGSVSTNLQRGGLNDI

SEQ ID NO: 12725 - protein, 31 aa, Artificial Sequence
  Description of Artificial Sequence: Synthetic polypeptide
AEEEIRTTNPVATEQYGSVSTNLQRIGINEI

SEQ ID NO: 12726 - protein, 31 aa, Artificial Sequence
  Description of Artificial Sequence: Synthetic polypeptide
AEEEIRTTNPVATEQYGSVSTNLQRNGINMG

SEQ ID NO: 12727 - protein, 30 aa, Artificial Sequence
  Description of Artificial Sequence: Synthetic polypeptide
AEEEIRTTNPVATEQYGSVSTNLQRSGVDD

SEQ ID NO: 12728 - protein, 31 aa, Artificial Sequence
  Description of Artificial Sequence: Synthetic polypeptide
AEEEIRTTNPVATEQYGSVSTNLQRTGNNMI

SEQ ID NO: 12729 - protein, 30 aa, Artificial Sequence
  Description of Artificial Sequence: Synthetic polypeptide
AEEEIRTTNPVATEQYGSVSTNLQRTGTDI

SEQ ID NO: 12730 - protein, 30 aa, Artificial Sequence
  Description of Artificial Sequence: Synthetic polypeptide
AEEEIRTTNPVATEQYGSVSNTNLQPQNNR

SEQ ID NO: 12731 - protein, 31 aa, Artificial Sequence
  Description of Artificial Sequence: Synthetic polypeptide
AEEEIRTTNPVATEQYGSVSNTNLQPQGNPR

SEQ ID NO: 12732 - protein, 31 aa, Artificial Sequence
  Description of Artificial Sequence: Synthetic polypeptide
AEEEIRTTNPVATEQYGSVSTNLQRGNQEET

SEQ ID NO: 12733 - protein, 30 aa, Artificial Sequence
  Description of Artificial Sequence: Synthetic polypeptide
AEEEIRTTNPVATEQYGSVSTNLQNVGNYN

SEQ ID NO: 12734 - protein, 30 aa, Artificial Sequence
  Description of Artificial Sequence: Synthetic polypeptide
AEEEIRTTNPVATEQYGSVSTNLQQRNVND

SEQ ID NO: 12735 - protein, 31 aa, Artificial Sequence
  Description of Artificial Sequence: Synthetic polypeptide
AEEEIRTTNPVATEQYGSVSTNLQQRGQNDI

SEQ ID NO: 12736 - protein, 31 aa, Artificial Sequence
  Description of Artificial Sequence: Synthetic polypeptide
AEEEIRTTNPVATEQYGSVSNTNQLQGGANR

SEQ ID NO: 12737 - protein, 29 aa, Artificial Sequence
  Description of Artificial Sequence: Synthetic peptide
DEDEIRTTNPVATEQYGSVSQNLFREENR

SEQ ID NO: 12738 - protein, 29 aa, Artificial Sequence
  Description of Artificial Sequence: Synthetic peptide
DEDEIRTTNPVATEQYGSVSSNDQRDNRM

SEQ ID NO: 12739 - protein, 30 aa, Artificial Sequence
  Description of Artificial Sequence: Synthetic polypeptide
DEEEIRTTNPVATEQYGSVSLTNGGQRGAF

SEQ ID NO: 12740 - protein, 30 aa, Artificial Sequence
  Description of Artificial Sequence: Synthetic polypeptide
DEEEIRTTNPVATEQYGSVSSNALQRENQV

SEQ ID NO: 12741 - protein, 30 aa, Artificial Sequence
  Description of Artificial Sequence: Synthetic polypeptide
DEEEIRTTNPVATEQYGSVSLTNEQVMNER

SEQ ID NO: 12742 - protein, 30 aa, Artificial Sequence
  Description of Artificial Sequence: Synthetic polypeptide
AEEEIRTTNPVATEQYGSVSNTNLVQNGNE

SEQ ID NO: 12743 - protein, 30 aa, Artificial Sequence
  Description of Artificial Sequence: Synthetic polypeptide
AEEEIRTTNPVATEQYGSVSNTNLQQGNAA

SEQ ID NO: 12744 - protein, 31 aa, Artificial Sequence
  Description of Artificial Sequence: Synthetic polypeptide
AEEEIRTTNPVATEQYGSVSNTNLQYGANIR

SEQ ID NO: 12745 - protein, 29 aa, Artificial Sequence
  Description of Artificial Sequence: Synthetic peptide
DEEEIRTTNPVATEQYGSVSMDDQRQNER

SEQ ID NO: 12746 - protein, 29 aa, Artificial Sequence
  Description of Artificial Sequence: Synthetic peptide
DEECIRATNPVATEQYGSVSATNTQRGNL

SEQ ID NO: 12747 - protein, 31 aa, Artificial Sequence
  Description of Artificial Sequence: Synthetic polypeptide
DEEEIRTTNPVATEQYGSVSSLTNTLQGDNR

SEQ ID NO: 12748 - protein, 31 aa, Artificial Sequence
  Description of Artificial Sequence: Synthetic polypeptide
AEEEIRTTNPVATEQYGSVSNTNLQQMGENR

SEQ ID NO: 12749 - protein, 31 aa, Artificial Sequence
  Description of Artificial Sequence: Synthetic polypeptide
AEEEIRTTNPVATEQYGSVSNTNLQQGTNNR

SEQ ID NO: 12750 - protein, 28 aa, Artificial Sequence
  Description of Artificial Sequence: Synthetic peptide
DEDEIRTTNPVATEPYGSVSTDLQDGNM

SEQ ID NO: 12751 - protein, 31 aa, Artificial Sequence
  Description of Artificial Sequence: Synthetic polypeptide
AEEEIRTTNPVATEQYGSVSTNLQQRGNNSE

SEQ ID NO: 12752 - protein, 30 aa, Artificial Sequence
  Description of Artificial Sequence: Synthetic polypeptide
AEEEIRTTNPVATEQYGSVSNTNLQSGNVS

SEQ ID NO: 12753 - protein, 30 aa, Artificial Sequence
  Description of Artificial Sequence: Synthetic polypeptide
AEEEIRTTNPVATEQYGSVSTNLQNTGVGR

SEQ ID NO: 12754 - protein, 29 aa, Artificial Sequence
  Description of Artificial Sequence: Synthetic peptide
DEEEIRTTNPVATEAYGSISTNLSQIGNE

SEQ ID NO: 12755 - protein, 30 aa, Artificial Sequence
  Description of Artificial Sequence: Synthetic polypeptide
AEEEIRTTNPVATEQYGSVSTNLQNSGNIF

SEQ ID NO: 12756 - protein, 32 aa, Artificial Sequence
  Description of Artificial Sequence: Synthetic polypeptide
DEEEIRTTNPVATEQYGSVSLTQNGLQRGIGR

SEQ ID NO: 12757 - protein, 30 aa, Artificial Sequence
  Description of Artificial Sequence: Synthetic polypeptide
AEEEIRTTNPVATEQYGSVSTNLQGGMNQN

SEQ ID NO: 12758 - protein, 30 aa, Artificial Sequence
  Description of Artificial Sequence: Synthetic polypeptide
AEEEIRTTNPVATEQYGSVSTNLQGGNIPN

SEQ ID NO: 12759 - protein, 30 aa, Artificial Sequence
  Description of Artificial Sequence: Synthetic polypeptide
AEEEIRTTNPVATEQYGSVSTNLQGGNNQN

SEQ ID NO: 12760 - protein, 30 aa, Artificial Sequence
  Description of Artificial Sequence: Synthetic polypeptide
AEEEIRTTNPVATEQYGSVSTNLQGGPNNM

SEQ ID NO: 12761 - protein, 30 aa, Artificial Sequence
  Description of Artificial Sequence: Synthetic polypeptide
AEEEIRTTNPVATEQYGSVSTNLQGMTANR

SEQ ID NO: 12762 - protein, 30 aa, Artificial Sequence
  Description of Artificial Sequence: Synthetic polypeptide
DEEEIRTTNPVATEQYGSVSSNLQNIGVND

SEQ ID NO: 12763 - protein, 30 aa, Artificial Sequence
  Description of Artificial Sequence: Synthetic polypeptide
AEEEIRTTNPVATEQYGSVSSTNLEVGNSR

SEQ ID NO: 12764 - protein, 28 aa, Artificial Sequence
  Description of Artificial Sequence: Synthetic peptide
DEDEIRTTNPVATEQYGSVQTDLIRDNR

SEQ ID NO: 12765 - protein, 30 aa, Artificial Sequence
  Description of Artificial Sequence: Synthetic polypeptide
AEEEIRTTNPVATEQYGSVSSTNIQIGNTR

SEQ ID NO: 12766 - protein, 30 aa, Artificial Sequence
  Description of Artificial Sequence: Synthetic polypeptide
DEEEIRTTNPVATEQYGSVSSNLQLTDGNP

SEQ ID NO: 12767 - protein, 29 aa, Artificial Sequence
  Description of Artificial Sequence: Synthetic peptide
AEEEIRTTNPVATEQYGSVSTNLQGSGEN

SEQ ID NO: 12768 - protein, 30 aa, Artificial Sequence
  Description of Artificial Sequence: Synthetic polypeptide
AEEEIRTTNPVATEQYGSVSTNLQGVGNDF

SEQ ID NO: 12769 - protein, 29 aa, Artificial Sequence
  Description of Artificial Sequence: Synthetic peptide
AEEEIRTTNPVATEQYGSVSTNLQHGDVP

SEQ ID NO: 12770 - protein, 29 aa, Artificial Sequence
  Description of Artificial Sequence: Synthetic peptide
AEEEIRTTNPVATEQYGSVSTNLQHGEQP

SEQ ID NO: 12771 - protein, 29 aa, Artificial Sequence
  Description of Artificial Sequence: Synthetic peptide
AEEEIRTTNPVATEQYGSVSTNLQHGESN

SEQ ID NO: 12772 - protein, 30 aa, Artificial Sequence
  Description of Artificial Sequence: Synthetic polypeptide
AEEEIRTTNPVATEQYGSVSSTNIQNGNLR

SEQ ID NO: 12773 - protein, 30 aa, Artificial Sequence
  Description of Artificial Sequence: Synthetic polypeptide
AEEEIRTTNPVATEQYGSVSTNLQIFGNIS

SEQ ID NO: 12774 - protein, 29 aa, Artificial Sequence
  Description of Artificial Sequence: Synthetic peptide
AEEEIRTTNPVATEQYGSVSTNLQGGAQH

SEQ ID NO: 12775 - protein, 31 aa, Artificial Sequence
  Description of Artificial Sequence: Synthetic polypeptide
AEEEIRTTNPVATEQYGSVSTNLQGDTGNLR

SEQ ID NO: 12776 - protein, 29 aa, Artificial Sequence
  Description of Artificial Sequence: Synthetic peptide
DEDEIRTTNPVATEQYGSVNTNLERGNQP

SEQ ID NO: 12777 - protein, 29 aa, Artificial Sequence
  Description of Artificial Sequence: Synthetic peptide
AEEEIRTTNPVATEQYGSVSTNLQEADNS

SEQ ID NO: 12778 - protein, 29 aa, Artificial Sequence
  Description of Artificial Sequence: Synthetic peptide
AEEEIRTTNPVATEQYGSVSTNLQEEQNG

SEQ ID NO: 12779 - protein, 30 aa, Artificial Sequence
  Description of Artificial Sequence: Synthetic polypeptide
AEEEIRTTNPVATEQYGSVSSTNLGQGNNR

SEQ ID NO: 12780 - protein, 30 aa, Artificial Sequence
  Description of Artificial Sequence: Synthetic polypeptide
AEEEIRTTNPVATEQYGSVSTNLQEGANGN

SEQ ID NO: 12781 - protein, 30 aa, Artificial Sequence
  Description of Artificial Sequence: Synthetic polypeptide
AEEEIRTTNPVATEQYGSVSTNLQEGSNIA

SEQ ID NO: 12782 - protein, 30 aa, Artificial Sequence
  Description of Artificial Sequence: Synthetic polypeptide
AEEEIRTTNPVATEQYGSVSSTNLGQGGNI

SEQ ID NO: 12783 - protein, 30 aa, Artificial Sequence
  Description of Artificial Sequence: Synthetic polypeptide
AEEEIRTTNPVATEQYGSVSTNLQGEGNLG

SEQ ID NO: 12784 - protein, 32 aa, Artificial Sequence
  Description of Artificial Sequence: Synthetic polypeptide
AEEEIRTTNPVATEQYGSVSTNLQERMGSNPR

SEQ ID NO: 12785 - protein, 29 aa, Artificial Sequence
  Description of Artificial Sequence: Synthetic peptide
DEEEIRTTNPVATEQYGSVSSNLQPPDLR

SEQ ID NO: 12786 - protein, 29 aa, Artificial Sequence
  Description of Artificial Sequence: Synthetic peptide
AEEEIRTTNPVATEQYGSVSTNLQEYTNA

SEQ ID NO: 12787 - protein, 30 aa, Artificial Sequence
  Description of Artificial Sequence: Synthetic polypeptide
AEEEIRTTNPVATEQYGSVSTNLQFEIANR

SEQ ID NO: 12788 - protein, 29 aa, Artificial Sequence
  Description of Artificial Sequence: Synthetic peptide
AEEEIRTTNPVATEQYGSVSTNLQFGADA

SEQ ID NO: 12789 - protein, 29 aa, Artificial Sequence
  Description of Artificial Sequence: Synthetic peptide
AEEEIRTTNPVATEQYGSVSTNLQFGEQC

SEQ ID NO: 12790 - protein, 30 aa, Artificial Sequence
  Description of Artificial Sequence: Synthetic polypeptide
AEEEIRTTNPVATEQYGSVSTNLQFGTNAV

SEQ ID NO: 12791 - protein, 30 aa, Artificial Sequence
  Description of Artificial Sequence: Synthetic polypeptide
AEEEIRTTNPVATEQYGSVSTNLQGAGGRE

SEQ ID NO: 12792 - protein, 30 aa, Artificial Sequence
  Description of Artificial Sequence: Synthetic polypeptide
DEEEIRTTNPVATEQYGSVSLTPPLQRGDD

SEQ ID NO: 12793 - protein, 30 aa, Artificial Sequence
  Description of Artificial Sequence: Synthetic polypeptide
AEEEIRTTNPVATEQYGSVSTNLQSGNEIA

SEQ ID NO: 12794 - protein, 30 aa, Artificial Sequence
  Description of Artificial Sequence: Synthetic polypeptide
DEEEIRTTNPVATEQYGSVSSNLQFFGNIG

SEQ ID NO: 12795 - protein, 31 aa, Artificial Sequence
  Description of Artificial Sequence: Synthetic polypeptide
AEEEIRTTNPVATEQYGSVSTNLQISTGNPR

SEQ ID NO: 12796 - protein, 30 aa, Artificial Sequence
  Description of Artificial Sequence: Synthetic polypeptide
AEEEIRTTNPVATEQYGSVSSTELQRGNAE

SEQ ID NO: 12797 - protein, 30 aa, Artificial Sequence
  Description of Artificial Sequence: Synthetic polypeptide
AEEEIRTTNPVATEQYGSVSTNLQNENANR

SEQ ID NO: 12798 - protein, 30 aa, Artificial Sequence
  Description of Artificial Sequence: Synthetic polypeptide
AEEEIRTTNPVATEQYGSVSTNLQNFGNNQ

SEQ ID NO: 12799 - protein, 29 aa, Artificial Sequence
  Description of Artificial Sequence: Synthetic peptide
AEEEIRTTNPVATEQYGSVSTNLQNGDGE

SEQ ID NO: 12800 - protein, 30 aa, Artificial Sequence
  Description of Artificial Sequence: Synthetic polypeptide
DEDEIRTTNPVATEQYGSVSANLQGNGNER

SEQ ID NO: 12801 - protein, 29 aa, Artificial Sequence
  Description of Artificial Sequence: Synthetic peptide
AEEEIRTTNPVATEQYGSVSSTELQADNR

SEQ ID NO: 12802 - protein, 30 aa, Artificial Sequence
  Description of Artificial Sequence: Synthetic polypeptide
AEEEIRTTNPVATEQYGSVSSTDLQRGNSS

SEQ ID NO: 12803 - protein, 30 aa, Artificial Sequence
  Description of Artificial Sequence: Synthetic polypeptide
AEEEIRTTNPVATEQYGSVSTNLQNDGNIG

SEQ ID NO: 12804 - protein, 31 aa, Artificial Sequence
  Description of Artificial Sequence: Synthetic polypeptide
DEDEIRTTNPVATEQYGSVSATMNLQREGND

SEQ ID NO: 12805 - protein, 31 aa, Artificial Sequence
  Description of Artificial Sequence: Synthetic polypeptide
AEEEIRTTNPVATEQYGSVSTNLQNNGINRE

SEQ ID NO: 12806 - protein, 31 aa, Artificial Sequence
  Description of Artificial Sequence: Synthetic polypeptide
AEEEIRTTNPVATEQYGSVSSSTNLQREGIR

SEQ ID NO: 12807 - protein, 29 aa, Artificial Sequence
  Description of Artificial Sequence: Synthetic peptide
DEEEIRTTNPVATEQYGSVSSTPLQFSSR

SEQ ID NO: 12808 - protein, 31 aa, Artificial Sequence
  Description of Artificial Sequence: Synthetic polypeptide
DEDEIRTTNPVATEQYGSVSCTNLQHGGNRP

SEQ ID NO: 12809 - protein, 31 aa, Artificial Sequence
  Description of Artificial Sequence: Synthetic polypeptide
DEDEIRTTNPVATEQYGSVSCTNLQNEGNRE

SEQ ID NO: 12810 - protein, 30 aa, Artificial Sequence
  Description of Artificial Sequence: Synthetic polypeptide
AEEEIRTTNPVATEQYGSVSSNLQVEEGNR

SEQ ID NO: 12811 - protein, 30 aa, Artificial Sequence
  Description of Artificial Sequence: Synthetic polypeptide
AEEEIRTTNPVATEQYGSVSSNLQRGDNPA

SEQ ID NO: 12812 - protein, 30 aa, Artificial Sequence
  Description of Artificial Sequence: Synthetic polypeptide
DEEEIRTTNPVATEQYGSVSSNLERENERT

SEQ ID NO: 12813 - protein, 28 aa, Artificial Sequence
  Description of Artificial Sequence: Synthetic peptide
DEDEIRTTNPVATEQWGSVATNLQTGNE

SEQ ID NO: 12814 - protein, 29 aa, Artificial Sequence
  Description of Artificial Sequence: Synthetic peptide
AEEEIRTTNPVATEQYGSVSTNLQMGLGA

SEQ ID NO: 12815 - protein, 29 aa, Artificial Sequence
  Description of Artificial Sequence: Synthetic peptide
AEEEIRTTNPVATEQYGSVSTNLQMGELL

SEQ ID NO: 12816 - protein, 29 aa, Artificial Sequence
  Description of Artificial Sequence: Synthetic peptide
AEEEIRTTNPVATEQYGSVSTNLQLDQNA

SEQ ID NO: 12817 - protein, 30 aa, Artificial Sequence
  Description of Artificial Sequence: Synthetic polypeptide
AEEEIRTTNPVATEQYGSVSTNLQLFGDRE

SEQ ID NO: 12818 - protein, 30 aa, Artificial Sequence
  Description of Artificial Sequence: Synthetic polypeptide
AEEEIRTTNPVATEQYGSVSTNLQLGAANS

SEQ ID NO: 12819 - protein, 29 aa, Artificial Sequence
  Description of Artificial Sequence: Synthetic peptide
AEEEIRTTNPVATEQYGSVSTNLQLGATQ

SEQ ID NO: 12820 - protein, 29 aa, Artificial Sequence
  Description of Artificial Sequence: Synthetic peptide
AEEEIRTTNPVATEQYGSVSTNLQLGDSH

SEQ ID NO: 12821 - protein, 29 aa, Artificial Sequence
  Description of Artificial Sequence: Synthetic peptide
AEEEIRTTNPVATEQYGSVSTNLQLGLAM

SEQ ID NO: 12822 - protein, 30 aa, Artificial Sequence
  Description of Artificial Sequence: Synthetic polypeptide
DEEEIRTTNPVATEQYGSVSSNLQAGSNLT

SEQ ID NO: 12823 - protein, 29 aa, Artificial Sequence
  Description of Artificial Sequence: Synthetic peptide
DEEEIRTTNPVATEQYGSVSSNLNQMING

SEQ ID NO: 12824 - protein, 30 aa, Artificial Sequence
  Description of Artificial Sequence: Synthetic polypeptide
AEEEIRTTNPVATEQYGSVSTNLQLGNNIM

SEQ ID NO: 12825 - protein, 29 aa, Artificial Sequence
  Description of Artificial Sequence: Synthetic peptide
AEEEIRTTNPVATEQYGSVSTNLQLMNNS

SEQ ID NO: 12826 - protein, 29 aa, Artificial Sequence
  Description of Artificial Sequence: Synthetic peptide
AEEEIRTTNPVATEQYGSVSSTMLQDENR

SEQ ID NO: 12827 - protein, 30 aa, Artificial Sequence
  Description of Artificial Sequence: Synthetic polypeptide
AEEEIRTTNPVATEQYGSVSSTLLQRGNNT

SEQ ID NO: 12828 - protein, 29 aa, Artificial Sequence
  Description of Artificial Sequence: Synthetic peptide
AEEEIRTTNPVATEQYGSVSTNLQLNVER

SEQ ID NO: 12829 - protein, 29 aa, Artificial Sequence
  Description of Artificial Sequence: Synthetic peptide
AEEEIRTTNPVATEQYGSVSTNLQLPSNP

SEQ ID NO: 12830 - protein, 30 aa, Artificial Sequence
  Description of Artificial Sequence: Synthetic polypeptide
AEEEIRTTNPVATEQYGSVSTNLQLVGVNN

SEQ ID NO: 12831 - protein, 29 aa, Artificial Sequence
  Description of Artificial Sequence: Synthetic peptide
AEEEIRTTNPVATEQYGSVSTNLQLYANE

SEQ ID NO: 12832 - protein, 31 aa, Artificial Sequence
  Description of Artificial Sequence: Synthetic polypeptide
DEDEIRTTNPVATEQWGSTVSTNLSQRGNRE

SEQ ID NO: 12833 - protein, 30 aa, Artificial Sequence
  Description of Artificial Sequence: Synthetic polypeptide
AEEEIRTTNPVATEQYGSVSTNLQDNGSQR

SEQ ID NO: 12834 - protein, 30 aa, Artificial Sequence
  Description of Artificial Sequence: Synthetic polypeptide
AEEEIRTTNPVATEQYGSVSTNLQSLGNQF

SEQ ID NO: 12835 - protein, 29 aa, Artificial Sequence
  Description of Artificial Sequence: Synthetic peptide
AEEEIRTTNPVATEQYGSVSTNLQTGAAG

SEQ ID NO: 12836 - protein, 29 aa, Artificial Sequence
  Description of Artificial Sequence: Synthetic peptide
AEEEIRTTNPVATEQYGSVSGNLQMGTNF

SEQ ID NO: 12837 - protein, 30 aa, Artificial Sequence
  Description of Artificial Sequence: Synthetic polypeptide
AEEEIRTTNPVATEQYGSVSGNLQEEEGNR

SEQ ID NO: 12838 - protein, 28 aa, Artificial Sequence
  Description of Artificial Sequence: Synthetic peptide
AEEEIRTTNPVATEQYGSVSGNIQDGNN

SEQ ID NO: 12839 - protein, 28 aa, Artificial Sequence
  Description of Artificial Sequence: Synthetic peptide
AEEEIRTTNPVATEQYGSVSGNGQNGNN

SEQ ID NO: 12840 - protein, 28 aa, Artificial Sequence
  Description of Artificial Sequence: Synthetic peptide
AEEEIRTTNPVATEQYGSVSGNAQDGNF

SEQ ID NO: 12841 - protein, 31 aa, Artificial Sequence
  Description of Artificial Sequence: Synthetic polypeptide
AEEEIRTTNPVATEQYGSVSETNLQPGENNR

SEQ ID NO: 12842 - protein, 30 aa, Artificial Sequence
  Description of Artificial Sequence: Synthetic polypeptide
AEEEIRTTNPVATEQYGSVSETNLQNTNER

SEQ ID NO: 12843 - protein, 29 aa, Artificial Sequence
  Description of Artificial Sequence: Synthetic peptide
DEEEIRTTNPVAHEQYGLVSTWLQMEGNR

SEQ ID NO: 12844 - protein, 31 aa, Artificial Sequence
  Description of Artificial Sequence: Synthetic polypeptide
AEEEIRTTNPVATEQYGSVSETNLQLGANER

SEQ ID NO: 12845 - protein, 30 aa, Artificial Sequence
  Description of Artificial Sequence: Synthetic polypeptide
AEEEIRTTNPVATEQYGSVSETNLQGQNAR

SEQ ID NO: 12846 - protein, 30 aa, Artificial Sequence
  Description of Artificial Sequence: Synthetic polypeptide
AEEEIRTTNPVATEQYGSVSETNEQIGQNR

SEQ ID NO: 12847 - protein, 29 aa, Artificial Sequence
  Description of Artificial Sequence: Synthetic peptide
SEEKIRTTNPVATEQYGSVLSTNLENGNR

SEQ ID NO: 12848 - protein, 30 aa, Artificial Sequence
  Description of Artificial Sequence: Synthetic polypeptide
AEEEIRTTNPVATEQYGSVSTNNEQDGNRN

SEQ ID NO: 12849 - protein, 29 aa, Artificial Sequence
  Description of Artificial Sequence: Synthetic peptide
AEEEIRTTNPVATEQYGSVSEQNLQTTNR

SEQ ID NO: 12850 - protein, 30 aa, Artificial Sequence
  Description of Artificial Sequence: Synthetic polypeptide
DEDEIRTTNPVATEHYGSVTTNLQRDGNSR

SEQ ID NO: 12851 - protein, 30 aa, Artificial Sequence
  Description of Artificial Sequence: Synthetic polypeptide
AEEEIRTTNPVATEQYGSVSGNLQRGNNDA

SEQ ID NO: 12852 - protein, 31 aa, Artificial Sequence
  Description of Artificial Sequence: Synthetic polypeptide
AEEEIRTTNPVATEQYGSVSGTNLNQNSGNR

SEQ ID NO: 12853 - protein, 31 aa, Artificial Sequence
  Description of Artificial Sequence: Synthetic polypeptide
AEEEIRTTNPVATEQYGSVSGTNNLQQVGNR

SEQ ID NO: 12854 - protein, 31 aa, Artificial Sequence
  Description of Artificial Sequence: Synthetic polypeptide
AEEEIRTTNPVATEQYGSVSGTTNLQNEGNR

SEQ ID NO: 12855 - protein, 31 aa, Artificial Sequence
  Description of Artificial Sequence: Synthetic polypeptide
DEEEIRTTNPVATEAYGSVNTNMLSQRGNRD

SEQ ID NO: 12856 - protein, 29 aa, Artificial Sequence
  Description of Artificial Sequence: Synthetic peptide
AEEEIRTTNPVATEQYGSVSTNMQLEGER

SEQ ID NO: 12857 - protein, 29 aa, Artificial Sequence
  Description of Artificial Sequence: Synthetic peptide
AEEEIRTTNPVATEQYGSVSTNMQLEGIR

SEQ ID NO: 12858 - protein, 29 aa, Artificial Sequence
  Description of Artificial Sequence: Synthetic peptide
AEEEIRTTNPVATEQYGSVSTNMQLMGNG

SEQ ID NO: 12859 - protein, 29 aa, Artificial Sequence
  Description of Artificial Sequence: Synthetic peptide
AEEEIRTTNPVATEQYGSVSTNMQNGNYI

SEQ ID NO: 12860 - protein, 30 aa, Artificial Sequence
  Description of Artificial Sequence: Synthetic polypeptide
AEEEIRTTNPVATEQYGSVSMTNLQTGNLA

SEQ ID NO: 12861 - protein, 30 aa, Artificial Sequence
  Description of Artificial Sequence: Synthetic polypeptide
AEEEIRTTNPVATEQYGSVSMTNLQSGNSE

SEQ ID NO: 12862 - protein, 30 aa, Artificial Sequence
  Description of Artificial Sequence: Synthetic polypeptide
AEEEIRTTNPVATEQYGSVSTNNEQGGNVR

SEQ ID NO: 12863 - protein, 30 aa, Artificial Sequence
  Description of Artificial Sequence: Synthetic polypeptide
AEEEIRTTNPVATEQYGSVSMTNLNQGGNI

SEQ ID NO: 12864 - protein, 29 aa, Artificial Sequence
  Description of Artificial Sequence: Synthetic peptide
DEDEIRTTNPVATEIYGSVSTNLQDHGNF

SEQ ID NO: 12865 - protein, 30 aa, Artificial Sequence
  Description of Artificial Sequence: Synthetic polypeptide
AEEEIRTTNPVATEQYGSVSMTNEQAGTNR

SEQ ID NO: 12866 - protein, 30 aa, Artificial Sequence
  Description of Artificial Sequence: Synthetic polypeptide
AEEEIRTTNPVATEQYGSVSMTNDQNGQNR

SEQ ID NO: 12867 - protein, 31 aa, Artificial Sequence
  Description of Artificial Sequence: Synthetic polypeptide
AEEEIRTTNPVATEQYGSVSITNLQRGENND

SEQ ID NO: 12868 - protein, 29 aa, Artificial Sequence
  Description of Artificial Sequence: Synthetic peptide
AEEEIRTTNPVATEQYGSVSIQNLQNENR

SEQ ID NO: 12869 - protein, 29 aa, Artificial Sequence
  Description of Artificial Sequence: Synthetic peptide
AEEEIRTTNPVATEQYGSVSINLQEGDNF

SEQ ID NO: 12870 - protein, 28 aa, Artificial Sequence
  Description of Artificial Sequence: Synthetic peptide
AEEEIRTTNPVATEQYGSVSINGNDGNR

SEQ ID NO: 12871 - protein, 30 aa, Artificial Sequence
  Description of Artificial Sequence: Synthetic polypeptide
AEEEIRTTNPVATEQYGSVSTNMQQGQNRS

SEQ ID NO: 12872 - protein, 29 aa, Artificial Sequence
  Description of Artificial Sequence: Synthetic peptide
DEDEIRTTNPVATEHYGSVSTNLQQGDRN

SEQ ID NO: 12873 - protein, 29 aa, Artificial Sequence
  Description of Artificial Sequence: Synthetic peptide
AEEEIRTTNPVATEQYGSVSENLQRGTQT

SEQ ID NO: 12874 - protein, 30 aa, Artificial Sequence
  Description of Artificial Sequence: Synthetic polypeptide
AEEEIRTTNPVATEQYGSVSENLQRGTNLA

SEQ ID NO: 12875 - protein, 30 aa, Artificial Sequence
  Description of Artificial Sequence: Synthetic polypeptide
DEDEIRTTNPVATEQYGSVSTNLGSNGPNR

SEQ ID NO: 12876 - protein, 30 aa, Artificial Sequence
  Description of Artificial Sequence: Synthetic polypeptide
AEEEIRTTNPVATEQYGSVSATTNEQRGND

SEQ ID NO: 12877 - protein, 30 aa, Artificial Sequence
  Description of Artificial Sequence: Synthetic polypeptide
DEDEIRTTNPVATEQYGSVSTNLNGDGNTR

SEQ ID NO: 12878 - protein, 30 aa, Artificial Sequence
  Description of Artificial Sequence: Synthetic polypeptide
DEEEIRTTNPVATEQYGSVSMDLVQRGERD

SEQ ID NO: 12879 - protein, 30 aa, Artificial Sequence
  Description of Artificial Sequence: Synthetic polypeptide
AEEEIRTTNPVATEQYGSVSTNNLQFIGNQ

SEQ ID NO: 12880 - protein, 30 aa, Artificial Sequence
  Description of Artificial Sequence: Synthetic polypeptide
DEEEIRTTNPVATEQYGSVSLNSLERGERD

SEQ ID NO: 12881 - protein, 30 aa, Artificial Sequence
  Description of Artificial Sequence: Synthetic polypeptide
AEEEIRTTNPVATEQYGSVSTNNLQIGDER

SEQ ID NO: 12882 - protein, 31 aa, Artificial Sequence
  Description of Artificial Sequence: Synthetic polypeptide
AEEEIRTTNPVATEQYGSVSCTNELQRGNNE

SEQ ID NO: 12883 - protein, 30 aa, Artificial Sequence
  Description of Artificial Sequence: Synthetic polypeptide
AEEEIRTTNPVATEQYGSVSTNNLQNGNDD

SEQ ID NO: 12884 - protein, 31 aa, Artificial Sequence
  Description of Artificial Sequence: Synthetic polypeptide
AEEEIRTTNPVATEQYGSVSATNLQSGNNNR

SEQ ID NO: 12885 - protein, 30 aa, Artificial Sequence
  Description of Artificial Sequence: Synthetic polypeptide
DEEEIRTTNPVATEQYGSVSLNLSQKGGPR

SEQ ID NO: 12886 - protein, 30 aa, Artificial Sequence
  Description of Artificial Sequence: Synthetic polypeptide
AEEEIRTTNPVATEQYGSVSTNNLQNTGGR

SEQ ID NO: 12887 - protein, 31 aa, Artificial Sequence
  Description of Artificial Sequence: Synthetic polypeptide
AEEEIRTTNPVATEQYGSVSATNLQQGTNTR

SEQ ID NO: 12888 - protein, 30 aa, Artificial Sequence
  Description of Artificial Sequence: Synthetic polypeptide
DEDEIRTTNPVATEQYGSVSTNLNQNQGNT

SEQ ID NO: 12889 - protein, 30 aa, Artificial Sequence
  Description of Artificial Sequence: Synthetic polypeptide
AEEEIRTTNPVATEQYGSVSTNNLQQLGND

SEQ ID NO: 12890 - protein, 30 aa, Artificial Sequence
  Description of Artificial Sequence: Synthetic polypeptide
AEEEIRTTNPVATEQYGSVSTNNLQQLGNS

SEQ ID NO: 12891 - protein, 28 aa, Artificial Sequence
  Description of Artificial Sequence: Synthetic peptide
DEEEIRTTNPVATEQYGSVSMDLVRGQT

SEQ ID NO: 12892 - protein, 30 aa, Artificial Sequence
  Description of Artificial Sequence: Synthetic polypeptide
AEEEIRTTNPVATEQYGSVSTNMQIGVNRT

SEQ ID NO: 12893 - protein, 29 aa, Artificial Sequence
  Description of Artificial Sequence: Synthetic peptide
AEEEIRTTNPVATEQYGSVSDALQAGQNR

SEQ ID NO: 12894 - protein, 30 aa, Artificial Sequence
  Description of Artificial Sequence: Synthetic polypeptide
AEEEIRTTNPVATEQYGSVSDNLQEQEGNR

SEQ ID NO: 12895 - protein, 30 aa, Artificial Sequence
  Description of Artificial Sequence: Synthetic polypeptide
AEEEIRTTNPVATEQYGSVSENLQRGNNAI

SEQ ID NO: 12896 - protein, 30 aa, Artificial Sequence
  Description of Artificial Sequence: Synthetic polypeptide
DEEEIRTTNPVATEQYGSVSLPLQRGVQRS

SEQ ID NO: 12897 - protein, 30 aa, Artificial Sequence
  Description of Artificial Sequence: Synthetic polypeptide
AEEEIRTTNPVATEQYGSVSTNNEQRGNSD

SEQ ID NO: 12898 - protein, 30 aa, Artificial Sequence
  Description of Artificial Sequence: Synthetic polypeptide
AEEEIRTTNPVATEQYGSVSENLQRGDNGG

SEQ ID NO: 12899 - protein, 29 aa, Artificial Sequence
  Description of Artificial Sequence: Synthetic peptide
AEEEIRTTNPVATEQYGSVSELLQRGNIF

SEQ ID NO: 12900 - protein, 29 aa, Artificial Sequence
  Description of Artificial Sequence: Synthetic peptide
AEEEIRTTNPVATEQYGSVSEGNLQTGTR

SEQ ID NO: 12901 - protein, 28 aa, Artificial Sequence
  Description of Artificial Sequence: Synthetic peptide
AEEEIRTTNPVATEQYGSVSEDQQRGER

SEQ ID NO: 12902 - protein, 30 aa, Artificial Sequence
  Description of Artificial Sequence: Synthetic polypeptide
AEEEIRTTNPVATEQYGSVSDNLNQNGQNR

SEQ ID NO: 12903 - protein, 29 aa, Artificial Sequence
  Description of Artificial Sequence: Synthetic peptide
AEEEIRTTNPVATEQYGSVSTNNGTVGNR

SEQ ID NO: 12904 - protein, 31 aa, Artificial Sequence
  Description of Artificial Sequence: Synthetic polypeptide
AEEEIRTTNPVATEQYGSVSDTNQLQAGENR

SEQ ID NO: 12905 - protein, 31 aa, Artificial Sequence
  Description of Artificial Sequence: Synthetic polypeptide
AEEEIRTTNPVATEQYGSVSDTNNLQNGNNR

SEQ ID NO: 12906 - protein, 29 aa, Artificial Sequence
  Description of Artificial Sequence: Synthetic peptide
DEDEIRTTNPVATEHYGSVSTNLQGGERN

SEQ ID NO: 12907 - protein, 31 aa, Artificial Sequence
  Description of Artificial Sequence: Synthetic polypeptide
AEEEIRTTNPVATEQYGSVSDTNLQQGENDR

SEQ ID NO: 12908 - protein, 30 aa, Artificial Sequence
  Description of Artificial Sequence: Synthetic polypeptide
AEEEIRTTNPVATEQYGSVSDTNLQNQNQR

SEQ ID NO: 12909 - protein, 31 aa, Artificial Sequence
  Description of Artificial Sequence: Synthetic polypeptide
AEEEIRTTNPVATEQYGSVSDTGNQLQGGNR

SEQ ID NO: 12910 - protein, 29 aa, Artificial Sequence
  Description of Artificial Sequence: Synthetic peptide
AEEEIRTTNPVATEQYGSVSDNLQSGNND

SEQ ID NO: 12911 - protein, 29 aa, Artificial Sequence
  Description of Artificial Sequence: Synthetic peptide
AEEEIRTTNPVATEQYGSVSEALQQGENR

SEQ ID NO: 12912 - protein, 30 aa, Artificial Sequence
  Description of Artificial Sequence: Synthetic polypeptide
DEDEIRTTNPVATEQYGSVSTNLETMGNTR

SEQ ID NO: 12913 - protein, 30 aa, Artificial Sequence
  Description of Artificial Sequence: Synthetic polypeptide
AEEEIRTTNPVATEQYGSVSNENLQRGNDT

SEQ ID NO: 12914 - protein, 30 aa, Artificial Sequence
  Description of Artificial Sequence: Synthetic polypeptide
AEEEIRTTNPVATEQYGSVSTNMQFGDNRE

SEQ ID NO: 12915 - protein, 30 aa, Artificial Sequence
  Description of Artificial Sequence: Synthetic polypeptide
AEEEIRTTNPVATEQYGSVSNTNAQPGQNR

SEQ ID NO: 12916 - protein, 29 aa, Artificial Sequence
  Description of Artificial Sequence: Synthetic peptide
AEEEIRTTNPVATEQYGSVSNQLQIGTNR

SEQ ID NO: 12917 - protein, 30 aa, Artificial Sequence
  Description of Artificial Sequence: Synthetic polypeptide
DEDEIRTTNPVATEQYGSVSTGNLQQGMER

SEQ ID NO: 12918 - protein, 30 aa, Artificial Sequence
  Description of Artificial Sequence: Synthetic polypeptide
AEEEIRTTNPVATEQYGSVSTNLQVTGTQR

SEQ ID NO: 12919 - protein, 30 aa, Artificial Sequence
  Description of Artificial Sequence: Synthetic polypeptide
AEEEIRTTNPVATEQYGSVSTNLQYGNGGT

SEQ ID NO: 12920 - protein, 30 aa, Artificial Sequence
  Description of Artificial Sequence: Synthetic polypeptide
DEDEIRTTNPVATEQYGSVSTGNMQRGENS

SEQ ID NO: 12921 - protein, 30 aa, Artificial Sequence
  Description of Artificial Sequence: Synthetic polypeptide
AEEEIRTTNPVATEQYGSVSNNQNQRTGNR

SEQ ID NO: 12922 - protein, 32 aa, Artificial Sequence
  Description of Artificial Sequence: Synthetic polypeptide
DEEEIRTTNPVATEQYGSVSLTENLQRGLLRA

SEQ ID NO: 12923 - protein, 30 aa, Artificial Sequence
  Description of Artificial Sequence: Synthetic polypeptide
AEEEIRTTNPVATEQYGSVSTNLQYGSEND

SEQ ID NO: 12924 - protein, 29 aa, Artificial Sequence
  Description of Artificial Sequence: Synthetic peptide
DEDEIRTTNPVATENYGSVSTNLQNNGNA

SEQ ID NO: 12925 - protein, 31 aa, Artificial Sequence
  Description of Artificial Sequence: Synthetic polypeptide
DEEEIRTTNPVATEQYGSVSSLPNALQRTNR

SEQ ID NO: 12926 - protein, 30 aa, Artificial Sequence
  Description of Artificial Sequence: Synthetic polypeptide
AEEEIRTTNPVATEQYGSVSTNLQYSNGNE

SEQ ID NO: 12927 - protein, 30 aa, Artificial Sequence
  Description of Artificial Sequence: Synthetic polypeptide
DEEEIRTTNPVATEAYGSVATNLQPRGDNI

SEQ ID NO: 12928 - protein, 29 aa, Artificial Sequence
  Description of Artificial Sequence: Synthetic peptide
AEEEIRTTNPVATEQYGSVSTNLSEQGNS

SEQ ID NO: 12929 - protein, 30 aa, Artificial Sequence
  Description of Artificial Sequence: Synthetic polypeptide
DEEEIRTTNPVATEQYGSVSSLPLVQDGNR

SEQ ID NO: 12930 - protein, 30 aa, Artificial Sequence
  Description of Artificial Sequence: Synthetic polypeptide
AEEEIRTTNPVATEQYGSVSTNLSPIGNNR

SEQ ID NO: 12931 - protein, 29 aa, Artificial Sequence
  Description of Artificial Sequence: Synthetic peptide
DEDEIRTTNPVATEQYGSVSTGVLQDGDR

SEQ ID NO: 12932 - protein, 30 aa, Artificial Sequence
  Description of Artificial Sequence: Synthetic polypeptide
AEEEIRTTNPVATEQYGSVSTNLSQANTNR

SEQ ID NO: 12933 - protein, 30 aa, Artificial Sequence
  Description of Artificial Sequence: Synthetic polypeptide
AEEEIRTTNPVATEQYGSVSTNLQVQGEGR

SEQ ID NO: 12934 - protein, 31 aa, Artificial Sequence
  Description of Artificial Sequence: Synthetic polypeptide
DEEEIRTTNPVATEAYGSTVSTNALSQTGNR

SEQ ID NO: 12935 - protein, 31 aa, Artificial Sequence
  Description of Artificial Sequence: Synthetic polypeptide
AEEEIRTTNPVATEQYGSVSTNLQTGGENRE

SEQ ID NO: 12936 - protein, 29 aa, Artificial Sequence
  Description of Artificial Sequence: Synthetic peptide
AEEEIRTTNPVATEQYGSVSTNLQTGGFT

SEQ ID NO: 12937 - protein, 29 aa, Artificial Sequence
  Description of Artificial Sequence: Synthetic peptide
DEDEIRTTNPVATEQYGSVSTDDLQMGNA

SEQ ID NO: 12938 - protein, 30 aa, Artificial Sequence
  Description of Artificial Sequence: Synthetic polypeptide
AEEEIRTTNPVATEQYGSVSNTNLQDENIR

SEQ ID NO: 12939 - protein, 29 aa, Artificial Sequence
  Description of Artificial Sequence: Synthetic peptide
DEDEIRTTNPVATEQYGSVSTDLQDRGEG

SEQ ID NO: 12940 - protein, 30 aa, Artificial Sequence
  Description of Artificial Sequence: Synthetic polypeptide
AEEEIRTTNPVATEQYGSVSNTNLNGNGNR

SEQ ID NO: 12941 - protein, 29 aa, Artificial Sequence
  Description of Artificial Sequence: Synthetic peptide
AEEEIRTTNPVATEQYGSVSTNLQTGQGT

SEQ ID NO: 12942 - protein, 31 aa, Artificial Sequence
  Description of Artificial Sequence: Synthetic polypeptide
AEEEIRTTNPVATEQYGSVSTNLQVNTGNTR

SEQ ID NO: 12943 - protein, 31 aa, Artificial Sequence
  Description of Artificial Sequence: Synthetic polypeptide
DEEEIRTTNPVATEQYGSVSSTTLQRGGNNQ

SEQ ID NO: 12944 - protein, 30 aa, Artificial Sequence
  Description of Artificial Sequence: Synthetic polypeptide
AEEEIRTTNPVATEQYGSVSNTNLDEDGNR

SEQ ID NO: 12945 - protein, 32 aa, Artificial Sequence
  Description of Artificial Sequence: Synthetic polypeptide
DEEEIRTTNPVATEQYGSVSLTENSLQTGNLR

SEQ ID NO: 12946 - protein, 29 aa, Artificial Sequence
  Description of Artificial Sequence: Synthetic peptide
AEEEIRTTNPVATEQYGSVSNTNIQNGNN

SEQ ID NO: 12947 - protein, 31 aa, Artificial Sequence
  Description of Artificial Sequence: Synthetic polypeptide
AEEEIRTTNPVATEQYGSVSTNLQVDEGNDR

SEQ ID NO: 12948 - protein, 29 aa, Artificial Sequence
  Description of Artificial Sequence: Synthetic peptide
AEEEIRTTNPVATEQYGSVSTNLQVGDVN

SEQ ID NO: 12949 - protein, 29 aa, Artificial Sequence
  Description of Artificial Sequence: Synthetic peptide
AEEEIRTTNPVATEQYGSVSTNLQVGIFT

SEQ ID NO: 12950 - protein, 30 aa, Artificial Sequence
  Description of Artificial Sequence: Synthetic polypeptide
AEEEIRTTNPVATEQYGSVSTNLQVGQNQQ

SEQ ID NO: 12951 - protein, 31 aa, Artificial Sequence
  Description of Artificial Sequence: Synthetic polypeptide
AEEEIRTTNPVATEQYGSVSTNLQTNGGNRA

SEQ ID NO: 12952 - protein, 29 aa, Artificial Sequence
  Description of Artificial Sequence: Synthetic peptide
AEEEIRTTNPVATEQYGSVSTNLQTDGQT

SEQ ID NO: 12953 - protein, 30 aa, Artificial Sequence
  Description of Artificial Sequence: Synthetic polypeptide
AEEEIRTTNPVATEQYGSVSTNLSQEQGNN

SEQ ID NO: 12954 - protein, 30 aa, Artificial Sequence
  Description of Artificial Sequence: Synthetic polypeptide
AEEEIRTTNPVATEQYGSVSTNLTDSGNRA

SEQ ID NO: 12955 - protein, 30 aa, Artificial Sequence
  Description of Artificial Sequence: Synthetic polypeptide
AEEEIRTTNPVATEQYGSVSTNLVQPITNR

SEQ ID NO: 12956 - protein, 30 aa, Artificial Sequence
  Description of Artificial Sequence: Synthetic polypeptide
DEDEIRTTNPVATEQYGSVSTNIQGGNNGR

SEQ ID NO: 12957 - protein, 28 aa, Artificial Sequence
  Description of Artificial Sequence: Synthetic peptide
DEEEIRTTNPVATEQYGSVSLSLVEGNP

SEQ ID NO: 12958 - protein, 29 aa, Artificial Sequence
  Description of Artificial Sequence: Synthetic peptide
AEEEIRTTNPVATEQYGSVSNNLQLQGNQ

SEQ ID NO: 12959 - protein, 30 aa, Artificial Sequence
  Description of Artificial Sequence: Synthetic polypeptide
DEEEIRTTNPVATEAYGSVNTNLSQEGNLR

SEQ ID NO: 12960 - protein, 30 aa, Artificial Sequence
  Description of Artificial Sequence: Synthetic polypeptide
DEDEIRTTNPVATEQYGSVSTNIQHQGNDR

SEQ ID NO: 12961 - protein, 31 aa, Artificial Sequence
  Description of Artificial Sequence: Synthetic polypeptide
DEEEIRTTNPVATEQYGSVSLQTLLQRGNNV

SEQ ID NO: 12962 - protein, 29 aa, Artificial Sequence
  Description of Artificial Sequence: Synthetic peptide
AEEEIRTTNPVATEQYGSVSNNLQPGNVE

SEQ ID NO: 12963 - protein, 30 aa, Artificial Sequence
  Description of Artificial Sequence: Synthetic polypeptide
DEDEIRTTNPVATEQYGSVSTNLAQHQGNS

SEQ ID NO: 12964 - protein, 29 aa, Artificial Sequence
  Description of Artificial Sequence: Synthetic peptide
AEEEIRTTNPVATEQYGSVSTNLYTSGNL

SEQ ID NO: 12965 - protein, 30 aa, Artificial Sequence
  Description of Artificial Sequence: Synthetic polypeptide
DEDEIRTTNPVATEQYGSVSTNLEHDGNAR

SEQ ID NO: 12966 - protein, 29 aa, Artificial Sequence
  Description of Artificial Sequence: Synthetic peptide
AEEEIRTTNPVATEQYGSVSTNMLQQNNV

SEQ ID NO: 12967 - protein, 30 aa, Artificial Sequence
  Description of Artificial Sequence: Synthetic polypeptide
AEEEIRTTNPVATEQYGSVSTNMNGQNGNR

SEQ ID NO: 12968 - protein, 29 aa, Artificial Sequence
  Description of Artificial Sequence: Synthetic peptide
AEEEIRTTNPVATEQYGSVSNLLQRGNNV

SEQ ID NO: 12969 - protein, 29 aa, Artificial Sequence
  Description of Artificial Sequence: Synthetic peptide
DEDEIRTTNPVATEIYGSVSTNLQHAGNT

SEQ ID NO: 12970 - protein, 29 aa, Artificial Sequence
  Description of Artificial Sequence: Synthetic peptide
AEEEIRTTNPVATEQYGSVSTNMQDGNPE

SEQ ID NO: 12971 - protein, 30 aa, Artificial Sequence
  Description of Artificial Sequence: Synthetic polypeptide
AEEEIRTTNPVATEQYGSVSTNLYQGGNQI

SEQ ID NO: 12972 - protein, 28 aa, Artificial Sequence
  Description of Artificial Sequence: Synthetic peptide
DEDEIRTTNPVATEMYGSVSTNLQPGPH

SEQ ID NO: 12973 - protein, 29 aa, Artificial Sequence
  Description of Artificial Sequence: Synthetic peptide
AEEEIRTTNPVATEQYGSVSNNLQQGEDR

SEQ ID NO: 12974 - protein, 30 aa, Artificial Sequence
  Description of Artificial Sequence: Synthetic polypeptide
AEEEIRTTNPVATEQYGSVSNNLQQGTNNR

SEQ ID NO: 12975 - protein, 28 aa, Artificial Sequence
  Description of Artificial Sequence: Synthetic peptide
DEDEIRTTNPVATEMYGSVSTNLQGGDL

SEQ ID NO: 12976 - protein, 30 aa, Artificial Sequence
  Description of Artificial Sequence: Synthetic polypeptide
AEEEIRTTNPVATEQYGSVSTNLTFNGNRT

SEQ ID NO: 12977 - protein, 29 aa, Artificial Sequence
  Description of Artificial Sequence: Synthetic peptide
AEEEIRTTNPVATEQYGSVSTNLTGGQNQ

SEQ ID NO: 12978 - protein, 30 aa, Artificial Sequence
  Description of Artificial Sequence: Synthetic polypeptide
AEEEIRTTNPVATEQYGSVSTNLTNAGNPR

SEQ ID NO: 12979 - protein, 30 aa, Artificial Sequence
  Description of Artificial Sequence: Synthetic polypeptide
AEEEIRTTNPVATEQYGSVSNNNLQDTGNR

SEQ ID NO: 12980 - protein, 29 aa, Artificial Sequence
  Description of Artificial Sequence: Synthetic peptide
AEEEIRTTNPVATEQYGSVSTNLTPNNAR

SEQ ID NO: 12981 - protein, 29 aa, Artificial Sequence
  Description of Artificial Sequence: Synthetic peptide
DEDEIRTTNPVATEQYGSVSTNDQRDGGA

SEQ ID NO: 12982 - protein, 30 aa, Artificial Sequence
  Description of Artificial Sequence: Synthetic polypeptide
AEEEIRTTNPVATEQYGSVSTNLVLTGNNR

SEQ ID NO: 12983 - protein, 29 aa, Artificial Sequence
  Description of Artificial Sequence: Synthetic peptide
DEDEIRTTNPVATEQYGSVSTNDQRDNGA

SEQ ID NO: 12984 - protein, 30 aa, Artificial Sequence
  Description of Artificial Sequence: Synthetic polypeptide
DEDEIRTTNPVATEQYGSVSTNFQDQGNRG

SEQ ID NO: 12985 - protein, 30 aa, Artificial Sequence
  Description of Artificial Sequence: Synthetic polypeptide
DEEEIRTTNPVATEAYGSVFTNLSQAGNYR

SEQ ID NO: 12986 - protein, 29 aa, Artificial Sequence
  Description of Artificial Sequence: Synthetic peptide
AEEEIRTTNPVATEQYGSVSNNLQRGVLY

SEQ ID NO: 12987 - protein, 28 aa, Artificial Sequence
  Description of Artificial Sequence: Synthetic peptide
DEDEIRTTNPVATEMYGSVSTNLQEGED

SEQ ID NO: 12988 - protein, 30 aa, Artificial Sequence
  Description of Artificial Sequence: Synthetic polypeptide
DEEEIRTTNPVATEAYGSVNSTNLQMGNDD

SEQ ID NO: 12989 - protein, 29 aa, Artificial Sequence
  Description of Artificial Sequence: Synthetic peptide
AEEEIRTTNPVATEQYGSVSNNLQQLGNS

SEQ ID NO: 12990 - protein, 30 aa, Artificial Sequence
  Description of Artificial Sequence: Synthetic polypeptide
AEEEIRTTNPVATEQYGSVSTNLVDNGQNR

SEQ ID NO: 12991 - protein, 31 aa, Artificial Sequence
  Description of Artificial Sequence: Synthetic polypeptide
DEDEIRTTNPVATEQYGSVSTNEQRGEGNER

SEQ ID NO: 12992 - protein, 31 aa, Artificial Sequence
  Description of Artificial Sequence: Synthetic polypeptide
AEEEIRTTNPVATEQYGSVSATNLQQGENNR

SEQ ID NO: 12993 - protein, 30 aa, Artificial Sequence
  Description of Artificial Sequence: Synthetic polypeptide
AEEEIRTTNPVATEQYGSVSTNLQDLGNLP

SEQ ID NO: 12994 - protein, 30 aa, Artificial Sequence
  Description of Artificial Sequence: Synthetic polypeptide
AEEEIRTTNPVATEQYGSVSTNLQAMNENR

SEQ ID NO: 12995 - protein, 30 aa, Artificial Sequence
  Description of Artificial Sequence: Synthetic polypeptide
AEEEIRTTNPVATEQYGSVSTNAGQGGNFR

SEQ ID NO: 12996 - protein, 31 aa, Artificial Sequence
  Description of Artificial Sequence: Synthetic polypeptide
DEEEIRTTNPVATEQYGSVSLTNLQLGAGRV

SEQ ID NO: 12997 - protein, 28 aa, Artificial Sequence
  Description of Artificial Sequence: Synthetic peptide
DEDEIRTTNPVATEQYGEVSTNPQTGNM

SEQ ID NO: 12998 - protein, 32 aa, Artificial Sequence
  Description of Artificial Sequence: Synthetic polypeptide
DEEEIRTTNPVATEQYGSVSLTNLQRQGVNNE

SEQ ID NO: 12999 - protein, 30 aa, Artificial Sequence
  Description of Artificial Sequence: Synthetic polypeptide
DEEEIRTTNPVATEQYGSVSLTNLQGVVNS

SEQ ID NO: 13000 - protein, 31 aa, Artificial Sequence
  Description of Artificial Sequence: Synthetic polypeptide
DEEEIRTTNPVATEQYGSVSLTNLQRQNILA

SEQ ID NO: 13001 - protein, 30 aa, Artificial Sequence
  Description of Artificial Sequence: Synthetic polypeptide
DEEEIRTTNPVATEQYGSVSSTNLENFGND

SEQ ID NO: 13002 - protein, 28 aa, Artificial Sequence
  Description of Artificial Sequence: Synthetic peptide
DEEEIRTTNPVASEQYGAVANNLERGNR

SEQ ID NO: 13003 - protein, 32 aa, Artificial Sequence
  Description of Artificial Sequence: Synthetic polypeptide
DEEEIRTTNPVATEQYGSVSLTNLQRSGENVE

SEQ ID NO: 13004 - protein, 28 aa, Artificial Sequence
  Description of Artificial Sequence: Synthetic peptide
SENEIACTNPVATEQYGSVSENLQRGNR

SEQ ID NO: 13005 - protein, 29 aa, Artificial Sequence
  Description of Artificial Sequence: Synthetic peptide
AEEEIRTTNPVATEQYGSVSSTVLQVENR

SEQ ID NO: 13006 - protein, 29 aa, Artificial Sequence
  Description of Artificial Sequence: Synthetic peptide
AEEEIRTTNPVATEQYGSVSSTVLQGQNR

SEQ ID NO: 13007 - protein, 30 aa, Artificial Sequence
  Description of Artificial Sequence: Synthetic polypeptide
DEDEIRTTNPVATEQYGAVSTNLQIDGNQR

SEQ ID NO: 13008 - protein, 28 aa, Artificial Sequence
  Description of Artificial Sequence: Synthetic peptide
AEEEIRTTNPVATEQYGSVSTNAQMTNS

SEQ ID NO: 13009 - protein, 28 aa, Artificial Sequence
  Description of Artificial Sequence: Synthetic peptide
AEEEIRTTNPVATEQYGSVSTNAQPANE

SEQ ID NO: 13010 - protein, 28 aa, Artificial Sequence
  Description of Artificial Sequence: Synthetic peptide
AEEEIRTTNPVATEQYGSVSTMVQDGQR

SEQ ID NO: 13011 - protein, 29 aa, Artificial Sequence
  Description of Artificial Sequence: Synthetic peptide
AEEEIRTTNPVATEQYGSVSTMVQAGENR

SEQ ID NO: 13012 - protein, 29 aa, Artificial Sequence
  Description of Artificial Sequence: Synthetic peptide
AEEEIRTTNPVATEQYGSVSTMVGQNGNR

SEQ ID NO: 13013 - protein, 31 aa, Artificial Sequence
  Description of Artificial Sequence: Synthetic polypeptide
DEDEIRTTNPVATEQYGEVSTNLQRDGNEDR

SEQ ID NO: 13014 - protein, 29 aa, Artificial Sequence
  Description of Artificial Sequence: Synthetic peptide
AEEEIRTTNPVATEQYGSVSTMLQDTGNQ

SEQ ID NO: 13015 - protein, 29 aa, Artificial Sequence
  Description of Artificial Sequence: Synthetic peptide
AEEEIRTTNPVATEQYGSVSTMLQGGNIH

SEQ ID NO: 13016 - protein, 29 aa, Artificial Sequence
  Description of Artificial Sequence: Synthetic peptide
AEEEIRTTNPVATEQYGSVSTMNGQAGNQ

SEQ ID NO: 13017 - protein, 32 aa, Artificial Sequence
  Description of Artificial Sequence: Synthetic polypeptide
AEEEIRTTNPVATEQYGSVSTMNLNQRGTNYR

SEQ ID NO: 13018 - protein, 30 aa, Artificial Sequence
  Description of Artificial Sequence: Synthetic polypeptide
AEEEIRTTNPVATEQYGSVSTMNLQDGNVD

SEQ ID NO: 13019 - protein, 31 aa, Artificial Sequence
  Description of Artificial Sequence: Synthetic polypeptide
AEEEIRTTNPVATEQYGSVSTMNLVQTGTNR

SEQ ID NO: 13020 - protein, 31 aa, Artificial Sequence
  Description of Artificial Sequence: Synthetic polypeptide
DEEEIRTTNPVATEQYGSVSLTNLQRMPERS

SEQ ID NO: 13021 - protein, 29 aa, Artificial Sequence
  Description of Artificial Sequence: Synthetic peptide
AEEEIRTTNPVATEQYGSVSTNAQQEGNG

SEQ ID NO: 13022 - protein, 31 aa, Artificial Sequence
  Description of Artificial Sequence: Synthetic polypeptide
DEEEIRTTNPVATEQYGSVSLTNLQRNEERM

SEQ ID NO: 13023 - protein, 29 aa, Artificial Sequence
  Description of Artificial Sequence: Synthetic peptide
AEEEIRTTNPVATEQYGSVSTMNTQDGNQ

SEQ ID NO: 13024 - protein, 30 aa, Artificial Sequence
  Description of Artificial Sequence: Synthetic polypeptide
AEEEIRTTNPVATEQYGSVSTMNVQSVGNR

SEQ ID NO: 13025 - protein, 28 aa, Artificial Sequence
  Description of Artificial Sequence: Synthetic peptide
SENEIRCTNPVATECYGSVSENLQRGNR

SEQ ID NO: 13026 - protein, 30 aa, Artificial Sequence
  Description of Artificial Sequence: Synthetic polypeptide
DEDEIRTTNPVATEQYGEVSTNLQHDGNQR

SEQ ID NO: 13027 - protein, 29 aa, Artificial Sequence
  Description of Artificial Sequence: Synthetic peptide
SESEIRCTNPVATEQYGSVSCNLQDRGNR

SEQ ID NO: 13028 - protein, 28 aa, Artificial Sequence
  Description of Artificial Sequence: Synthetic peptide
AEEEIRTTNPVATEQYGSVSTMQQRGDI

SEQ ID NO: 13029 - protein, 30 aa, Artificial Sequence
  Description of Artificial Sequence: Synthetic polypeptide
DEDEIRTTNPVATEQYGEVSTNLQRDGDSR

SEQ ID NO: 13030 - protein, 28 aa, Artificial Sequence
  Description of Artificial Sequence: Synthetic peptide
SESEIRCTNPIATEQYGSVSENLQRGNR

SEQ ID NO: 13031 - protein, 30 aa, Artificial Sequence
  Description of Artificial Sequence: Synthetic polypeptide
DEEEIRTTNPVATEAWGSVSCNELSQRGNR

SEQ ID NO: 13032 - protein, 29 aa, Artificial Sequence
  Description of Artificial Sequence: Synthetic peptide
AEEEIRTTNPVATEQYGSVSTNAQQFGNQ

SEQ ID NO: 13033 - protein, 30 aa, Artificial Sequence
  Description of Artificial Sequence: Synthetic polypeptide
AEEEIRTTNPVATEQYGSVSTNAQQGNQRQ

SEQ ID NO: 13034 - protein, 29 aa, Artificial Sequence
  Description of Artificial Sequence: Synthetic peptide
DEDEIRTTNPVATEQYGMVSTNLQHGAND

SEQ ID NO: 13035 - protein, 30 aa, Artificial Sequence
  Description of Artificial Sequence: Synthetic polypeptide
AEEEIRTTNPVATEQYGSVSTNFGQIQGNR

SEQ ID NO: 13036 - protein, 30 aa, Artificial Sequence
  Description of Artificial Sequence: Synthetic polypeptide
AEEEIRTTNPVATEQYGSVSTNFGQPGGNR

SEQ ID NO: 13037 - protein, 29 aa, Artificial Sequence
  Description of Artificial Sequence: Synthetic peptide
DEDEIRTTNPVATEQYGMVSTNQQMEGNR

SEQ ID NO: 13038 - protein, 28 aa, Artificial Sequence
  Description of Artificial Sequence: Synthetic peptide
DEDEIRTTNPVATEQYGATSTNLQRGEG

SEQ ID NO: 13039 - protein, 29 aa, Artificial Sequence
  Description of Artificial Sequence: Synthetic peptide
DEDEIRTTNPVATEQYGMVSTNVQLDGNR

SEQ ID NO: 13040 - protein, 31 aa, Artificial Sequence
  Description of Artificial Sequence: Synthetic polypeptide
DEEEIRTTNPVATEQYGSVSLTNLQDGLGIR

SEQ ID NO: 13041 - protein, 30 aa, Artificial Sequence
  Description of Artificial Sequence: Synthetic polypeptide
AEEEIRTTNPVATEQYGSVSTNFEQQGNFR

SEQ ID NO: 13042 - protein, 30 aa, Artificial Sequence
  Description of Artificial Sequence: Synthetic polypeptide
AEEEIRTTNPVATEQYGSVSTNGLQDGNIG

SEQ ID NO: 13043 - protein, 29 aa, Artificial Sequence
  Description of Artificial Sequence: Synthetic peptide
DEDEIRTTNPVATEQYGNVSTNLGDGSNR

SEQ ID NO: 13044 - protein, 28 aa, Artificial Sequence
  Description of Artificial Sequence: Synthetic peptide
SEMEIRCTNPVATEQYGSVSENLMRGNR

SEQ ID NO: 13045 - protein, 29 aa, Artificial Sequence
  Description of Artificial Sequence: Synthetic peptide
DEDEIRTTNPVATEQYGNVSTNLQHNGNS

SEQ ID NO: 13046 - protein, 29 aa, Artificial Sequence
  Description of Artificial Sequence: Synthetic peptide
AEEEIRTTNPVATEQYGSVSTNGQNQGNF

SEQ ID NO: 13047 - protein, 29 aa, Artificial Sequence
  Description of Artificial Sequence: Synthetic peptide
AEEEIRTTNPVATEQYGSVSTNGQRPNVD

SEQ ID NO: 13048 - protein, 30 aa, Artificial Sequence
  Description of Artificial Sequence: Synthetic polypeptide
AEEEIRTTNPVATEQYGSVSSTNTQIGNER

SEQ ID NO: 13049 - protein, 30 aa, Artificial Sequence
  Description of Artificial Sequence: Synthetic polypeptide
DEEEIRTTNPVATEQYGSVSSTNLIGDGNP

SEQ ID NO: 13050 - protein, 30 aa, Artificial Sequence
  Description of Artificial Sequence: Synthetic polypeptide
AEEEIRTTNPVATEQYGSVSTNGLQNGGNT

SEQ ID NO: 13051 - protein, 29 aa, Artificial Sequence
  Description of Artificial Sequence: Synthetic peptide
DEEEIRTTNPVATDQYGVVSTNLQENGNI

SEQ ID NO: 13052 - protein, 30 aa, Artificial Sequence
  Description of Artificial Sequence: Synthetic polypeptide
DEEEIRTTNPVATEQYGSVSSTGLQIMGND

SEQ ID NO: 13053 - protein, 29 aa, Artificial Sequence
  Description of Artificial Sequence: Synthetic peptide
DEEEIRTTNPVATEQYGSVSSTGLQSSER

SEQ ID NO: 13054 - protein, 29 aa, Artificial Sequence
  Description of Artificial Sequence: Synthetic peptide
AEEEIRTTNPVATEQYGSVSTNAVDFGNR

SEQ ID NO: 13055 - protein, 30 aa, Artificial Sequence
  Description of Artificial Sequence: Synthetic polypeptide
AEEEIRTTNPVATEQYGSVSTNAVQTTGNR

SEQ ID NO: 13056 - protein, 31 aa, Artificial Sequence
  Description of Artificial Sequence: Synthetic polypeptide
DEEEIRTTNPVATEQYGSVSSTGNPLQDGNF

SEQ ID NO: 13057 - protein, 30 aa, Artificial Sequence
  Description of Artificial Sequence: Synthetic polypeptide
AEEEIRTTNPVATEQYGSVSTNDLQQGEQR

SEQ ID NO: 13058 - protein, 31 aa, Artificial Sequence
  Description of Artificial Sequence: Synthetic polypeptide
DEEEIRTTNPVATEQYGSVSSTGNLQAGNGN

SEQ ID NO: 13059 - protein, 29 aa, Artificial Sequence
  Description of Artificial Sequence: Synthetic peptide
AEEEIRTTNPVATEQYGSVSTNDLQQSNM

SEQ ID NO: 13060 - protein, 29 aa, Artificial Sequence
  Description of Artificial Sequence: Synthetic peptide
AEEEIRTTNPVATEQYGSVSTNDMQDGER

SEQ ID NO: 13061 - protein, 29 aa, Artificial Sequence
  Description of Artificial Sequence: Synthetic peptide
AEEEIRTTNPVATEQYGSVSTNETQQGER

SEQ ID NO: 13062 - protein, 30 aa, Artificial Sequence
  Description of Artificial Sequence: Synthetic polypeptide
AEEEIRTTNPVATEQYGSVSTNDQFGVNRD

SEQ ID NO: 13063 - protein, 28 aa, Artificial Sequence
  Description of Artificial Sequence: Synthetic peptide
AEEEIRTTNPVATEQYGSVSTNDQPTNL

SEQ ID NO: 13064 - protein, 29 aa, Artificial Sequence
  Description of Artificial Sequence: Synthetic peptide
DEDEIRTTNPVATEQYGAVNSTNLQRGDS

SEQ ID NO: 13065 - protein, 30 aa, Artificial Sequence
  Description of Artificial Sequence: Synthetic polypeptide
AEEEIRTTNPVATEQYGSVSTNELQFGNDM

SEQ ID NO: 13066 - protein, 30 aa, Artificial Sequence
  Description of Artificial Sequence: Synthetic polypeptide
AEEEIRTTNPVATEQYGSVSTNELQIGNTE

SEQ ID NO: 13067 - protein, 30 aa, Artificial Sequence
  Description of Artificial Sequence: Synthetic polypeptide
AEEEIRTTNPVATEQYGSVSTNELQLGGNQ

SEQ ID NO: 13068 - protein, 31 aa, Artificial Sequence
  Description of Artificial Sequence: Synthetic polypeptide
AEEEIRTTNPVATEQYGSVSSTTNLQDGNRE

SEQ ID NO: 13069 - protein, 30 aa, Artificial Sequence
  Description of Artificial Sequence: Synthetic polypeptide
AEEEIRTTNPVATEQYGSVSTNESQGDGNR

SEQ ID NO: 13070 - protein, 30 aa, Artificial Sequence
  Description of Artificial Sequence: Synthetic polypeptide
DEDEIRTTNPVATEQYGAVSTNLQGDGNDR

SEQ ID NO: 13071 - protein, 30 aa, Artificial Sequence
  Description of Artificial Sequence: Synthetic polypeptide
AEEEIRTTNPVATEQYGSVSTMDLQGTGNR

SEQ ID NO: 13072 - protein, 30 aa, Artificial Sequence
  Description of Artificial Sequence: Synthetic polypeptide
AEEEIRTTNPVATEQYGSVSTALQQIQGNR

SEQ ID NO: 13073 - protein, 29 aa, Artificial Sequence
  Description of Artificial Sequence: Synthetic peptide
AEEEIRTTNPVATEQYGSVSTALQTGTNG

SEQ ID NO: 13074 - protein, 32 aa, Artificial Sequence
  Description of Artificial Sequence: Synthetic polypeptide
DEEEIRTTNPVATCQYGSVSTNLFQRSGNNRN

SEQ ID NO: 13075 - protein, 28 aa, Artificial Sequence
  Description of Artificial Sequence: Synthetic peptide
DEDEIRTTNPVATEQYGCVSTWLQRQND

SEQ ID NO: 13076 - protein, 28 aa, Artificial Sequence
  Description of Artificial Sequence: Synthetic peptide
DEDEIRTTNPVATEQYGENSTNLQRGDQ

SEQ ID NO: 13077 - protein, 29 aa, Artificial Sequence
  Description of Artificial Sequence: Synthetic peptide
AEEEIRTTNPVATEQYGSVSTDLQPANNR

SEQ ID NO: 13078 - protein, 32 aa, Artificial Sequence
  Description of Artificial Sequence: Synthetic polypeptide
DEEEIRTTNPVATEQYGSVSLTNLQREGTIRN

SEQ ID NO: 13079 - protein, 29 aa, Artificial Sequence
  Description of Artificial Sequence: Synthetic peptide
AEEEIRTTNPVATEQYGSVSTDLQIDNQR

SEQ ID NO: 13080 - protein, 29 aa, Artificial Sequence
  Description of Artificial Sequence: Synthetic peptide
AEEEIRTTNPVATEQYGSVSTDLQALNIR

SEQ ID NO: 13081 - protein, 30 aa, Artificial Sequence
  Description of Artificial Sequence: Synthetic polypeptide
DEEEIRTTNPVATDQYGSVGSTNLQMAGNA

SEQ ID NO: 13082 - protein, 28 aa, Artificial Sequence
  Description of Artificial Sequence: Synthetic peptide
AEEEIRTTNPVATEQYGSVSTDLPTNNR

SEQ ID NO: 13083 - protein, 30 aa, Artificial Sequence
  Description of Artificial Sequence: Synthetic polypeptide
DEEEIRTTNPVATCQYGSVCSTNLQEGGNV

SEQ ID NO: 13084 - protein, 32 aa, Artificial Sequence
  Description of Artificial Sequence: Synthetic polypeptide
DEEEIRTTNPVATEQYGSVSLTNLQREGPMRD

SEQ ID NO: 13085 - protein, 29 aa, Artificial Sequence
  Description of Artificial Sequence: Synthetic peptide
AEEEIRTTNPVATEQYGSVSTENNQIGNE

SEQ ID NO: 13086 - protein, 30 aa, Artificial Sequence
  Description of Artificial Sequence: Synthetic polypeptide
DEDEIRTTNPVATEQYGCVSTNLQNGDNPR

SEQ ID NO: 13087 - protein, 31 aa, Artificial Sequence
  Description of Artificial Sequence: Synthetic polypeptide
DEEEIRTTNPVATEQYGSVSLTNLQRIGPQE

SEQ ID NO: 13088 - protein, 29 aa, Artificial Sequence
  Description of Artificial Sequence: Synthetic peptide
DEDEIRTTNPVATEQYGCVSTNLQEGEND

SEQ ID NO: 13089 - protein, 29 aa, Artificial Sequence
  Description of Artificial Sequence: Synthetic peptide
DEDEIRTTNPVATEQYGCVSTNLQDRDNG

SEQ ID NO: 13090 - protein, 29 aa, Artificial Sequence
  Description of Artificial Sequence: Synthetic peptide
AEEEIRTTNPVATEQYGSVSTDIQNQGNR

SEQ ID NO: 13091 - protein, 29 aa, Artificial Sequence
  Description of Artificial Sequence: Synthetic peptide
SENEIRTTNPVATEQYGSVSENLQQQGNR

SEQ ID NO: 13092 - protein, 31 aa, Artificial Sequence
  Description of Artificial Sequence: Synthetic polypeptide
DEEEIRTTNPVATEQYGSVSLTNLQRGELPM

SEQ ID NO: 13093 - protein, 31 aa, Artificial Sequence
  Description of Artificial Sequence: Synthetic polypeptide
DEEEIRTTNPVATEQYGSVSLTNLQRGELLN

SEQ ID NO: 13094 - protein, 29 aa, Artificial Sequence
  Description of Artificial Sequence: Synthetic peptide
AEEEIRTTNPVATEQYGSVSTDVQDGLNR

SEQ ID NO: 13095 - protein, 31 aa, Artificial Sequence
  Description of Artificial Sequence: Synthetic polypeptide
DEEEIRTTNPVATEQYGSVSSTMNLQNDGNG

SEQ ID NO: 13096 - protein, 31 aa, Artificial Sequence
  Description of Artificial Sequence: Synthetic polypeptide
DEEEIRTTNPVATEQYGSVSLTNLQRGEEMI

SEQ ID NO: 13097 - protein, 31 aa, Artificial Sequence
  Description of Artificial Sequence: Synthetic polypeptide
DEEEIRTTNPVATCQYGSVSTNLTRIGSNRI

SEQ ID NO: 13098 - protein, 31 aa, Artificial Sequence
  Description of Artificial Sequence: Synthetic polypeptide
DEEEIRTTNPVATCQYGSVSTNLTRFGSNRV

SEQ ID NO: 13099 - protein, 28 aa, Artificial Sequence
  Description of Artificial Sequence: Synthetic peptide
SEQEIRCTNPVATEQYGSVSENLMRGNR

SEQ ID NO: 13100 - protein, 29 aa, Artificial Sequence
  Description of Artificial Sequence: Synthetic peptide
AEEEIRTTNPVATEQYGSVSTELQTGSNS

SEQ ID NO: 13101 - protein, 30 aa, Artificial Sequence
  Description of Artificial Sequence: Synthetic polypeptide
DEEEIRTTNPVATDQYGSVESTNLQEGNVD

SEQ ID NO: 13102 - protein, 30 aa, Artificial Sequence
  Description of Artificial Sequence: Synthetic polypeptide
AEEEIRTTNPVATEQYGSVSTENLQFEGNY

SEQ ID NO: 13103 - protein, 29 aa, Artificial Sequence
  Description of Artificial Sequence: Synthetic peptide
DEDEIRTTNPVATEQYGDVSTNQQADGNR

SEQ ID NO: 13104 - protein, 30 aa, Artificial Sequence
  Description of Artificial Sequence: Synthetic polypeptide
AEEEIRTTNPVATEQYGSVSTDNLQQGAND

SEQ ID NO: 13105 - protein, 31 aa, Artificial Sequence
  Description of Artificial Sequence: Synthetic polypeptide
AEEEIRTTNPVATEQYGSVSTENLQRGNNSG

SEQ ID NO: 13106 - protein, 30 aa, Artificial Sequence
  Description of Artificial Sequence: Synthetic polypeptide
AEEEIRTTNPVATEQYGSVSTENLQSGDDR

SEQ ID NO: 13107 - protein, 30 aa, Artificial Sequence
  Description of Artificial Sequence: Synthetic polypeptide
AEEEIRTTNPVATEQYGSVSTDNLQISGNN

SEQ ID NO: 13108 - protein, 31 aa, Artificial Sequence
  Description of Artificial Sequence: Synthetic polypeptide
DEEEIRTTNPVATEQYGSVSLTNLQRGEIGD

SEQ ID NO: 13109 - protein, 31 aa, Artificial Sequence
  Description of Artificial Sequence: Synthetic polypeptide
AEEEIRTTNPVATEQYGSVSTDNLEQRGNNG

SEQ ID NO: 13110 - protein, 31 aa, Artificial Sequence
  Description of Artificial Sequence: Synthetic polypeptide
DEEEIRTTNPVATEQYGSVSLTNLQRFQERD

SEQ ID NO: 13111 - protein, 31 aa, Artificial Sequence
  Description of Artificial Sequence: Synthetic polypeptide
DEEEIRTTNPVATEQYGSVSSTNLIRGGNGQ

SEQ ID NO: 13112 - protein, 29 aa, Artificial Sequence
  Description of Artificial Sequence: Synthetic peptide
SENEIRTTNPVATEQYGSVSENLMQQGNR

SEQ ID NO: 13113 - protein, 28 aa, Artificial Sequence
  Description of Artificial Sequence: Synthetic peptide
AEEEIRTTNPVATEQYGSVSTGIQNENR

SEQ ID NO: 13114 - protein, 30 aa, Artificial Sequence
  Description of Artificial Sequence: Synthetic polypeptide
DEEEIRTTNPVATDQYGSVSTVNLQSGGNT

SEQ ID NO: 13115 - protein, 29 aa, Artificial Sequence
  Description of Artificial Sequence: Synthetic peptide
AEEEIRTTNPVATEQYGSVSTANLQSINS

SEQ ID NO: 13116 - protein, 30 aa, Artificial Sequence
  Description of Artificial Sequence: Synthetic polypeptide
AEEEIRTTNPVATEQYGSVSTLLQRGGNNN

SEQ ID NO: 13117 - protein, 30 aa, Artificial Sequence
  Description of Artificial Sequence: Synthetic polypeptide
AEEEIRTTNPVATEQYGSVSTLLQRGGNTF

SEQ ID NO: 13118 - protein, 29 aa, Artificial Sequence
  Description of Artificial Sequence: Synthetic peptide
AEEEIRTTNPVATEQYGSVSTANLQLINP

SEQ ID NO: 13119 - protein, 28 aa, Artificial Sequence
  Description of Artificial Sequence: Synthetic peptide
DEDEIRTTNPVATEQYGETSTNLQRGTF

SEQ ID NO: 13120 - protein, 30 aa, Artificial Sequence
  Description of Artificial Sequence: Synthetic polypeptide
AEEEIRTTNPVATEQYGSVSTLNEQDVGNR

SEQ ID NO: 13121 - protein, 29 aa, Artificial Sequence
  Description of Artificial Sequence: Synthetic peptide
AEEEIRTTNPVATEQYGSVSTLEQLPGNR

SEQ ID NO: 13122 - protein, 29 aa, Artificial Sequence
  Description of Artificial Sequence: Synthetic peptide
AEEEIRTTNPVATEQYGSVSTANLQEENS

SEQ ID NO: 13123 - protein, 30 aa, Artificial Sequence
  Description of Artificial Sequence: Synthetic polypeptide
AEEEIRTTNPVATEQYGSVSTLNLQGGTMR

SEQ ID NO: 13124 - protein, 30 aa, Artificial Sequence
  Description of Artificial Sequence: Synthetic polypeptide
AEEEIRTTNPVATEQYGSVSTANEQEGNRV

SEQ ID NO: 13125 - protein, 29 aa, Artificial Sequence
  Description of Artificial Sequence: Synthetic peptide
DEEEIRTTNPVATEQYGSVSSTLERGNLF

SEQ ID NO: 13126 - protein, 31 aa, Artificial Sequence
  Description of Artificial Sequence: Synthetic polypeptide
AEEEIRTTNPVATEQYGSVSTLNTLQLGTNR

SEQ ID NO: 13127 - protein, 30 aa, Artificial Sequence
  Description of Artificial Sequence: Synthetic polypeptide
AEEEIRTTNPVATEQYGSVSTLNVQAVGNR

SEQ ID NO: 13128 - protein, 30 aa, Artificial Sequence
  Description of Artificial Sequence: Synthetic polypeptide
AEEEIRTTNPVATEQYGSVSTLNVQNNGNR

SEQ ID NO: 13129 - protein, 30 aa, Artificial Sequence
  Description of Artificial Sequence: Synthetic polypeptide
DEEEIRTTNPVATEQYGSVSSTNGFQEGND

SEQ ID NO: 13130 - protein, 29 aa, Artificial Sequence
  Description of Artificial Sequence: Synthetic peptide
AEEEIRTTNPVATEQYGSVSTLNLQEENE

SEQ ID NO: 13131 - protein, 29 aa, Artificial Sequence
  Description of Artificial Sequence: Synthetic peptide
AEEEIRTTNPVATEQYGSVSTFLQIINNR

SEQ ID NO: 13132 - protein, 30 aa, Artificial Sequence
  Description of Artificial Sequence: Synthetic polypeptide
DEEEIRTTNPVATDQYGSVSTVNLQMEGNF

SEQ ID NO: 13133 - protein, 28 aa, Artificial Sequence
  Description of Artificial Sequence: Synthetic peptide
DEDEIRTTNPVATEQYGETSTNLQRGDS

SEQ ID NO: 13134 - protein, 28 aa, Artificial Sequence
  Description of Artificial Sequence: Synthetic peptide
AEEEIRTTNPVATEQYGSVSTGLQTSNS

SEQ ID NO: 13135 - protein, 30 aa, Artificial Sequence
  Description of Artificial Sequence: Synthetic polypeptide
AEEEIRTTNPVATEQYGSVSTGNLQQGTNS

SEQ ID NO: 13136 - protein, 29 aa, Artificial Sequence
  Description of Artificial Sequence: Synthetic peptide
AEEEIRTTNPVATEQYGSVSTGNLQQQNS

SEQ ID NO: 13137 - protein, 30 aa, Artificial Sequence
  Description of Artificial Sequence: Synthetic polypeptide
AEEEIRTTNPVATEQYGSVSTGNLQRGVDD

SEQ ID NO: 13138 - protein, 31 aa, Artificial Sequence
  Description of Artificial Sequence: Synthetic polypeptide
AEEEIRTTNPVATEQYGSVSTGNLTQIGENR

SEQ ID NO: 13139 - protein, 30 aa, Artificial Sequence
  Description of Artificial Sequence: Synthetic polypeptide
DEEEIRTTNPVATDQYGSVSTNLGQEAGNV

SEQ ID NO: 13140 - protein, 30 aa, Artificial Sequence
  Description of Artificial Sequence: Synthetic polypeptide
DEEEIRTTNPVATEQYGSVSLTNLQRISFE

SEQ ID NO: 13141 - protein, 30 aa, Artificial Sequence
  Description of Artificial Sequence: Synthetic polypeptide
AEEEIRTTNPVATEQYGSVSTINNLERGNN

SEQ ID NO: 13142 - protein, 30 aa, Artificial Sequence
  Description of Artificial Sequence: Synthetic polypeptide
AEEEIRTTNPVATEQYGSVSTGNNQRGNDF

SEQ ID NO: 13143 - protein, 29 aa, Artificial Sequence
  Description of Artificial Sequence: Synthetic peptide
AEEEIRTTNPVATEQYGSVSTIGLQDGNI

SEQ ID NO: 13144 - protein, 29 aa, Artificial Sequence
  Description of Artificial Sequence: Synthetic peptide
DEDEIRTTNPVATEQYGETSTNLQRGDER

SEQ ID NO: 13145 - protein, 29 aa, Artificial Sequence
  Description of Artificial Sequence: Synthetic peptide
AEEEIRTTNPVATEQYGSVSTILEQADNR

SEQ ID NO: 13146 - protein, 29 aa, Artificial Sequence
  Description of Artificial Sequence: Synthetic peptide
AEEEIRTTNPVATEQYGSVSTILQMVTNR

SEQ ID NO: 13147 - protein, 29 aa, Artificial Sequence
  Description of Artificial Sequence: Synthetic peptide
AEEEIRTTNPVATEQYGSVSTANNEGGNR

SEQ ID NO: 13148 - protein, 30 aa, Artificial Sequence
  Description of Artificial Sequence: Synthetic polypeptide
AEEEIRTTNPVATEQYGSVSTILVQNGVNR

SEQ ID NO: 13149 - protein, 28 aa, Artificial Sequence
  Description of Artificial Sequence: Synthetic peptide
SENEIRCTNPVATEQYGSVSENLMRGNR

SEQ ID NO: 13150 - protein, 28 aa, Artificial Sequence
  Description of Artificial Sequence: Synthetic peptide
AEEEIRTTNPVATEQYGSVSTGNQNPNR

SEQ ID NO: 13151 - protein, 30 aa, Artificial Sequence
  Description of Artificial Sequence: Synthetic polypeptide
AEEEIRTTNPVATEQYGSVSTNLQDDNGNF

SEQ ID NO: 13152 - protein, 30 aa, Artificial Sequence
  Description of Artificial Sequence: Synthetic polypeptide
DEDEIRTTNPVATEQYGNVSTNLQPEGDNR

SEQ ID NO: 13153 - protein, 28 aa, Artificial Sequence
  Description of Artificial Sequence: Synthetic peptide
AEEEIRTTNPVATEQYGSVSTNILNGNN

SEQ ID NO: 13154 - protein, 31 aa, Artificial Sequence
  Description of Artificial Sequence: Synthetic polypeptide
AEEEIRTTNPVATEQYGSVSSTNLQQGEENR

SEQ ID NO: 13155 - protein, 31 aa, Artificial Sequence
  Description of Artificial Sequence: Synthetic polypeptide
DEEEIRTTNPVATEQYGSVSSTNLQPGGNTM

SEQ ID NO: 13156 - protein, 28 aa, Artificial Sequence
  Description of Artificial Sequence: Synthetic peptide
SEGEIVTTNPVATEQYGIVSTNLQGGNR

SEQ ID NO: 13157 - protein, 31 aa, Artificial Sequence
  Description of Artificial Sequence: Synthetic polypeptide
DEEEIRTTNPVATEQYGSVSSTNLQPGQNAV

SEQ ID NO: 13158 - protein, 30 aa, Artificial Sequence
  Description of Artificial Sequence: Synthetic polypeptide
DEEEIRTTNPVATEQYGSVSSTNLQQGEME

SEQ ID NO: 13159 - protein, 30 aa, Artificial Sequence
  Description of Artificial Sequence: Synthetic polypeptide
DEEEIRTTNPVATEQYGSVSSTNLQQNGVP

SEQ ID NO: 13160 - protein, 28 aa, Artificial Sequence
  Description of Artificial Sequence: Synthetic peptide
SEGEIRCTNPIATEQYGSVSENLQRGNR

SEQ ID NO: 13161 - protein, 31 aa, Artificial Sequence
  Description of Artificial Sequence: Synthetic polypeptide
AEEEIRTTNPVATEQYGSVSSTNLQNIGNQR

SEQ ID NO: 13162 - protein, 31 aa, Artificial Sequence
  Description of Artificial Sequence: Synthetic polypeptide
DEEEIRTTNPVATEQYGSVSSTNLQSGGGNG

SEQ ID NO: 13163 - protein, 30 aa, Artificial Sequence
  Description of Artificial Sequence: Synthetic polypeptide
DEEEIRTTNPVATEQYGSVSSTNLQSNGMD

SEQ ID NO: 13164 - protein, 30 aa, Artificial Sequence
  Description of Artificial Sequence: Synthetic polypeptide
AEEEIRTTNPVATEQYGSVSTNLNNQAGNV

SEQ ID NO: 13165 - protein, 30 aa, Artificial Sequence
  Description of Artificial Sequence: Synthetic polypeptide
AEEEIRTTNPVATEQYGSVSSTNLQMGENM

SEQ ID NO: 13166 - protein, 30 aa, Artificial Sequence
  Description of Artificial Sequence: Synthetic polypeptide
DEEEIRTTNPVATEQYGSVSSTNLQVGMDE

SEQ ID NO: 13167 - protein, 30 aa, Artificial Sequence
  Description of Artificial Sequence: Synthetic polypeptide
DEEEIRTTNPVATEQYGSVSSTNLQVNNDG

SEQ ID NO: 13168 - protein, 30 aa, Artificial Sequence
  Description of Artificial Sequence: Synthetic polypeptide
DEEEIRTTNPVATEQYGSVSSTNLSTGNEI

SEQ ID NO: 13169 - protein, 31 aa, Artificial Sequence
  Description of Artificial Sequence: Synthetic polypeptide
DEEEIRTTNPVATEQYGSVSSSLQSRGSNDR

SEQ ID NO: 13170 - protein, 30 aa, Artificial Sequence
  Description of Artificial Sequence: Synthetic polypeptide
AEEEIRTTNPVATEQYGSVSTNLNEQTGNL

SEQ ID NO: 13171 - protein, 31 aa, Artificial Sequence
  Description of Artificial Sequence: Synthetic polypeptide
AEEEIRTTNPVATEQYGSVSSTNLQQQGNNR

SEQ ID NO: 13172 - protein, 29 aa, Artificial Sequence
  Description of Artificial Sequence: Synthetic peptide
AEEEIRTTNPVATEQYGSVSTNLNEAANR

SEQ ID NO: 13173 - protein, 30 aa, Artificial Sequence
  Description of Artificial Sequence: Synthetic polypeptide
DEEEIRTTNPVATEQYGSVSSTALQQGNED

SEQ ID NO: 13174 - protein, 30 aa, Artificial Sequence
  Description of Artificial Sequence: Synthetic polypeptide
AEEEIRTTNPVATEQYGSVSTNLLQQGNNW

SEQ ID NO: 13175 - protein, 31 aa, Artificial Sequence
  Description of Artificial Sequence: Synthetic polypeptide
DEEEIRTTNPVATEQYGSVSSTNLQNGNGQT

SEQ ID NO: 13176 - protein, 31 aa, Artificial Sequence
  Description of Artificial Sequence: Synthetic polypeptide
DEEEIRTTNPVATEQYGSVSSTNLQNGNVGG

SEQ ID NO: 13177 - protein, 30 aa, Artificial Sequence
  Description of Artificial Sequence: Synthetic polypeptide
AEEEIRTTNPVATEQYGSVSTNLLQSNGSR

SEQ ID NO: 13178 - protein, 31 aa, Artificial Sequence
  Description of Artificial Sequence: Synthetic polypeptide
DEEEIRTTNPVATEQYGSVSSTNLQNGNVTT

SEQ ID NO: 13179 - protein, 30 aa, Artificial Sequence
  Description of Artificial Sequence: Synthetic polypeptide
AEEEIRTTNPVATEQYGSVSTNLLTQMGNE

SEQ ID NO: 13180 - protein, 30 aa, Artificial Sequence
  Description of Artificial Sequence: Synthetic polypeptide
DEEEIRTTNPVATEQYGSVSSTNLTDGGNE

SEQ ID NO: 13181 - protein, 29 aa, Artificial Sequence
  Description of Artificial Sequence: Synthetic peptide
AEEEIRTTNPVATEQYGSVSTNLLTSGNN

SEQ ID NO: 13182 - protein, 30 aa, Artificial Sequence
  Description of Artificial Sequence: Synthetic polypeptide
AEEEIRTTNPVATEQYGSVSTNLMGDGNRT

SEQ ID NO: 13183 - protein, 31 aa, Artificial Sequence
  Description of Artificial Sequence: Synthetic polypeptide
AEEEIRTTNPVATEQYGSVSSTNLQRIGNLT

SEQ ID NO: 13184 - protein, 31 aa, Artificial Sequence
  Description of Artificial Sequence: Synthetic polypeptide
AEEEIRTTNPVATEQYGSVSTNLMQDSTGNR

SEQ ID NO: 13185 - protein, 30 aa, Artificial Sequence
  Description of Artificial Sequence: Synthetic polypeptide
AEEEIRTTNPVATEQYGSVSTNLMQLGNNN

SEQ ID NO: 13186 - protein, 30 aa, Artificial Sequence
  Description of Artificial Sequence: Synthetic polypeptide
AEEEIRTTNPVATEQYGSVSTNLMQQGNDT

SEQ ID NO: 13187 - protein, 29 aa, Artificial Sequence
  Description of Artificial Sequence: Synthetic peptide
AEEEIRTTNPVATEQYGSVSTNLNAAQNR

SEQ ID NO: 13188 - protein, 31 aa, Artificial Sequence
  Description of Artificial Sequence: Synthetic polypeptide
AEEEIRTTNPVATEQYGSVSSTNLQRGGNMN

SEQ ID NO: 13189 - protein, 31 aa, Artificial Sequence
  Description of Artificial Sequence: Synthetic polypeptide
AEEEIRTTNPVATEQYGSVSSTNLQRSTNRT

SEQ ID NO: 13190 - protein, 30 aa, Artificial Sequence
  Description of Artificial Sequence: Synthetic polypeptide
DEEEIRTTNPVATEQYGSVSSTNLTDGNED

SEQ ID NO: 13191 - protein, 30 aa, Artificial Sequence
  Description of Artificial Sequence: Synthetic polypeptide
DEEEIRTTNPVATEQYGSVSSTNLTIGDNM

SEQ ID NO: 13192 - protein, 30 aa, Artificial Sequence
  Description of Artificial Sequence: Synthetic polypeptide
DEEEIRTTNPVATEQYGSVSSTNLTNGGNG

SEQ ID NO: 13193 - protein, 30 aa, Artificial Sequence
  Description of Artificial Sequence: Synthetic polypeptide
AEEEIRTTNPVATEQYGSVSSTNLNQIGNS

SEQ ID NO: 13194 - protein, 31 aa, Artificial Sequence
  Description of Artificial Sequence: Synthetic polypeptide
AEEEIRTTNPVATEQYGSVSTNLNQQRGNTE

SEQ ID NO: 13195 - protein, 31 aa, Artificial Sequence
  Description of Artificial Sequence: Synthetic polypeptide
AEEEIRTTNPVATEQYGSVSTNLNQQYGTNR

SEQ ID NO: 13196 - protein, 30 aa, Artificial Sequence
  Description of Artificial Sequence: Synthetic polypeptide
AEEEIRTTNPVATEQYGSVSTNLNRGENSQ

SEQ ID NO: 13197 - protein, 30 aa, Artificial Sequence
  Description of Artificial Sequence: Synthetic polypeptide
DEDEIRTTNPVATEQYGSVCTNLTQDGGNR

SEQ ID NO: 13198 - protein, 30 aa, Artificial Sequence
  Description of Artificial Sequence: Synthetic polypeptide
AEEEIRTTNPVATEQYGSVSTNLNRGINNM

SEQ ID NO: 13199 - protein, 29 aa, Artificial Sequence
  Description of Artificial Sequence: Synthetic peptide
DEEEIRTTNPVATEQYGSVSSNLQSTEER

SEQ ID NO: 13200 - protein, 31 aa, Artificial Sequence
  Description of Artificial Sequence: Synthetic polypeptide
DEEEIRTTNPVATEQYGSVSSTNQIQTVGNR

SEQ ID NO: 13201 - protein, 30 aa, Artificial Sequence
  Description of Artificial Sequence: Synthetic polypeptide
AEEEIRTTNPVATEQYGSVSSTNLNQGGNW

SEQ ID NO: 13202 - protein, 31 aa, Artificial Sequence
  Description of Artificial Sequence: Synthetic polypeptide
AEEEIRTTNPVATEQYGSVSTNLPQDINGNR

SEQ ID NO: 13203 - protein, 30 aa, Artificial Sequence
  Description of Artificial Sequence: Synthetic polypeptide
AEEEIRTTNPVATEQYGSVSTNLPQNFGNN

SEQ ID NO: 13204 - protein, 29 aa, Artificial Sequence
  Description of Artificial Sequence: Synthetic peptide
AEEEIRTTNPVATEQYGSVSTNLQAGQAA

SEQ ID NO: 13205 - protein, 31 aa, Artificial Sequence
  Description of Artificial Sequence: Synthetic polypeptide
DEEEIRTTNPVATEQYGSVSSNLQRSGDTRQ

SEQ ID NO: 13206 - protein, 31 aa, Artificial Sequence
  Description of Artificial Sequence: Synthetic polypeptide
DEDEIRTTNPVATEQYGSVGSTNELQDGNQR

SEQ ID NO: 13207 - protein, 30 aa, Artificial Sequence
  Description of Artificial Sequence: Synthetic polypeptide
AEEEIRTTNPVATEQYGSVSTNLQALGERE

SEQ ID NO: 13208 - protein, 30 aa, Artificial Sequence
  Description of Artificial Sequence: Synthetic polypeptide
AEEEIRTTNPVATEQYGSVSTNLQALILNR

SEQ ID NO: 13209 - protein, 30 aa, Artificial Sequence
  Description of Artificial Sequence: Synthetic polypeptide
AEEEIRTTNPVATEQYGSVSTNLPDTQGNR

SEQ ID NO: 13210 - protein, 30 aa, Artificial Sequence
  Description of Artificial Sequence: Synthetic polypeptide
AEEEIRTTNPVATEQYGSVSTNLLQQGDNY

SEQ ID NO: 13211 - protein, 31 aa, Artificial Sequence
  Description of Artificial Sequence: Synthetic polypeptide
DEDEIRTTNPVATEQYGSVCSTNLQHGENHR

SEQ ID NO: 13212 - protein, 29 aa, Artificial Sequence
  Description of Artificial Sequence: Synthetic peptide
DEEEIRTTNPVATEQYGSVSSNNDRGADR

SEQ ID NO: 13213 - protein, 30 aa, Artificial Sequence
  Description of Artificial Sequence: Synthetic polypeptide
DEEEIRTTNPVATEQYGSVSSTNLTQGENA

SEQ ID NO: 13214 - protein, 31 aa, Artificial Sequence
  Description of Artificial Sequence: Synthetic polypeptide
DEEEIRTTNPVATEQYGSVSSTNLVQGGNQA

SEQ ID NO: 13215 - protein, 31 aa, Artificial Sequence
  Description of Artificial Sequence: Synthetic polypeptide
AEEEIRTTNPVATEQYGSVSSTNLQGEGNPR

SEQ ID NO: 13216 - protein, 30 aa, Artificial Sequence
  Description of Artificial Sequence: Synthetic polypeptide
AEEEIRTTNPVATEQYGSVSSTNLQFETNR

SEQ ID NO: 13217 - protein, 31 aa, Artificial Sequence
  Description of Artificial Sequence: Synthetic polypeptide
AEEEIRTTNPVATEQYGSVSTNLNQISGENR

SEQ ID NO: 13218 - protein, 29 aa, Artificial Sequence
  Description of Artificial Sequence: Synthetic peptide
DEEEIRTTNPVATEQYGSVSSNVERGSDR

SEQ ID NO: 13219 - protein, 31 aa, Artificial Sequence
  Description of Artificial Sequence: Synthetic polypeptide
AEEEIRTTNPVATEQYGSVSSTNLQEQGNPR

SEQ ID NO: 13220 - protein, 29 aa, Artificial Sequence
  Description of Artificial Sequence: Synthetic peptide
DEDEIRTTNPVATEQYGSVCSTDLKEGNR

SEQ ID NO: 13221 - protein, 32 aa, Artificial Sequence
  Description of Artificial Sequence: Synthetic polypeptide
DEEEIRTTNPVATEQYGSVSSNTVNNLQRGNQ

SEQ ID NO: 13222 - protein, 29 aa, Artificial Sequence
  Description of Artificial Sequence: Synthetic peptide
DEEEIRTTNPVATEQYGSVSSNTQFFGNQ

SEQ ID NO: 13223 - protein, 31 aa, Artificial Sequence
  Description of Artificial Sequence: Synthetic polypeptide
AEEEIRTTNPVATEQYGSVSSTNLQELGNAR

SEQ ID NO: 13224 - protein, 30 aa, Artificial Sequence
  Description of Artificial Sequence: Synthetic polypeptide
AEEEIRTTNPVATEQYGSVSSTNLQEIGNG

SEQ ID NO: 13225 - protein, 30 aa, Artificial Sequence
  Description of Artificial Sequence: Synthetic polypeptide
DEEEIRTTNPVATEQYGSVSSNPQRGNDQQ

SEQ ID NO: 13226 - protein, 31 aa, Artificial Sequence
  Description of Artificial Sequence: Synthetic polypeptide
DEEEIRTTNPVATEQYGSVSSTNNLQPGSNI

SEQ ID NO: 13227 - protein, 30 aa, Artificial Sequence
  Description of Artificial Sequence: Synthetic polypeptide
AEEEIRTTNPVATEQYGSVSSTNLNRGVNE

SEQ ID NO: 13228 - protein, 30 aa, Artificial Sequence
  Description of Artificial Sequence: Synthetic polypeptide
DEEEIRTTNPVATEQYGSVSSTNNQTGNAP

SEQ ID NO: 13229 - protein, 29 aa, Artificial Sequence
  Description of Artificial Sequence: Synthetic peptide
SEGEEIRTTNPVATEQWGTVSTNLQEGNR

SEQ ID NO: 13230 - protein, 30 aa, Artificial Sequence
  Description of Artificial Sequence: Synthetic polypeptide
AEEEIRTTNPVATEQYGSVSTNLLQNQGQR

SEQ ID NO: 13231 - protein, 30 aa, Artificial Sequence
  Description of Artificial Sequence: Synthetic polypeptide
AEEEIRTTNPVATEQYGSVSSTNLQVGNTI

SEQ ID NO: 13232 - protein, 30 aa, Artificial Sequence
  Description of Artificial Sequence: Synthetic polypeptide
AEEEIRTTNPVATEQYGSVSSTNLSQTGNY

SEQ ID NO: 13233 - protein, 28 aa, Artificial Sequence
  Description of Artificial Sequence: Synthetic peptide
DEDEIRTTNPVATEQYGSCSTNLQSGDD

SEQ ID NO: 13234 - protein, 30 aa, Artificial Sequence
  Description of Artificial Sequence: Synthetic polypeptide
AEEEIRTTNPVATEQYGSVSSTNNQQGNTR

SEQ ID NO: 13235 - protein, 30 aa, Artificial Sequence
  Description of Artificial Sequence: Synthetic polypeptide
SESEIRTTNPVATEQYGSVSTNLQDHGNDR

SEQ ID NO: 13236 - protein, 29 aa, Artificial Sequence
  Description of Artificial Sequence: Synthetic peptide
AEEEIRTTNPVATEQYGSVSTNLDNTGNE

SEQ ID NO: 13237 - protein, 30 aa, Artificial Sequence
  Description of Artificial Sequence: Synthetic polypeptide
DEEEIRTTNPVATEQYGSVSLTNPLQREQQ

SEQ ID NO: 13238 - protein, 30 aa, Artificial Sequence
  Description of Artificial Sequence: Synthetic polypeptide
AEEEIRTTNPVATEQYGSVSTNLDPGGNPR

SEQ ID NO: 13239 - protein, 31 aa, Artificial Sequence
  Description of Artificial Sequence: Synthetic polypeptide
AEEEIRTTNPVATEQYGSVSTNLDQDQDGNR

SEQ ID NO: 13240 - protein, 31 aa, Artificial Sequence
  Description of Artificial Sequence: Synthetic polypeptide
DEEEIRTTNPVATEQYGSVSLTNNQRGQNAE

SEQ ID NO: 13241 - protein, 30 aa, Artificial Sequence
  Description of Artificial Sequence: Synthetic polypeptide
AEEEIRTTNPVATEQYGSVSTNLDQGGNST

SEQ ID NO: 13242 - protein, 30 aa, Artificial Sequence
  Description of Artificial Sequence: Synthetic polypeptide
DEEEIRTTNPVATEQYGSVSSTNLQAGEDS

SEQ ID NO: 13243 - protein, 28 aa, Artificial Sequence
  Description of Artificial Sequence: Synthetic peptide
DEDEIRTTNPVATEQYGSTSTNLQHGSH

SEQ ID NO: 13244 - protein, 31 aa, Artificial Sequence
  Description of Artificial Sequence: Synthetic polypeptide
DEEEIRTTNPVATEQYGSVSSTNLQDGNATT

SEQ ID NO: 13245 - protein, 28 aa, Artificial Sequence
  Description of Artificial Sequence: Synthetic peptide
DEDEIRTTNPVATEQYGSTSTNLQSGDV

SEQ ID NO: 13246 - protein, 30 aa, Artificial Sequence
  Description of Artificial Sequence: Synthetic polypeptide
AEEEIRTTNPVATEQYGSVSTNLDQQGNQK

SEQ ID NO: 13247 - protein, 30 aa, Artificial Sequence
  Description of Artificial Sequence: Synthetic polypeptide
AEEEIRTTNPVATEQYGSVSTNLDQQGNSM

SEQ ID NO: 13248 - protein, 30 aa, Artificial Sequence
  Description of Artificial Sequence: Synthetic polypeptide
AEEEIRTTNPVATEQYGSVSTNLDQRGSQQ

SEQ ID NO: 13249 - protein, 30 aa, Artificial Sequence
  Description of Artificial Sequence: Synthetic polypeptide
AEEEIRTTNPVATEQYGSVSTNLDQNGNPG

SEQ ID NO: 13250 - protein, 31 aa, Artificial Sequence
  Description of Artificial Sequence: Synthetic polypeptide
DEEEIRTTNPVATEQYGSVSSTNLQFAGNEF

SEQ ID NO: 13251 - protein, 31 aa, Artificial Sequence
  Description of Artificial Sequence: Synthetic polypeptide
DEEEIRTTNPVATEQYGSVSSTNLNPREDNR

SEQ ID NO: 13252 - protein, 29 aa, Artificial Sequence
  Description of Artificial Sequence: Synthetic peptide
DEDEIRTTNPVATEQYGSCSTNDQREGER

SEQ ID NO: 13253 - protein, 30 aa, Artificial Sequence
  Description of Artificial Sequence: Synthetic polypeptide
AEEEIRTTNPVATEQYGSVSTNILQAGQNQ

SEQ ID NO: 13254 - protein, 29 aa, Artificial Sequence
  Description of Artificial Sequence: Synthetic peptide
AEEEIRTTNPVATEQYGSVSTNIQNDGNF

SEQ ID NO: 13255 - protein, 31 aa, Artificial Sequence
  Description of Artificial Sequence: Synthetic polypeptide
DEEEIRTTNPVATEQYGSVSLTNLTRLNDRD

SEQ ID NO: 13256 - protein, 30 aa, Artificial Sequence
  Description of Artificial Sequence: Synthetic polypeptide
AEEEIRTTNPVATEQYGSVSTNIQSGGGNR

SEQ ID NO: 13257 - protein, 29 aa, Artificial Sequence
  Description of Artificial Sequence: Synthetic peptide
AEEEIRTTNPVATEQYGSVSTNIQTGNLG

SEQ ID NO: 13258 - protein, 29 aa, Artificial Sequence
  Description of Artificial Sequence: Synthetic peptide
AEEEIRTTNPVATEQYGSVSTNLAQSNDR

SEQ ID NO: 13259 - protein, 29 aa, Artificial Sequence
  Description of Artificial Sequence: Synthetic peptide
AEEEIRTTNPVATEQYGSVSTNLATPGNE

SEQ ID NO: 13260 - protein, 30 aa, Artificial Sequence
  Description of Artificial Sequence: Synthetic polypeptide
AEEEIRTTNPVATEQYGSVSTNLDGGGNDR

SEQ ID NO: 13261 - protein, 30 aa, Artificial Sequence
  Description of Artificial Sequence: Synthetic polypeptide
AEEEIRTTNPVATEQYGSVSTNLDAGENQR

SEQ ID NO: 13262 - protein, 29 aa, Artificial Sequence
  Description of Artificial Sequence: Synthetic peptide
AEEEIRTTNPVATEQYGSVSTNLDEGGER

SEQ ID NO: 13263 - protein, 31 aa, Artificial Sequence
  Description of Artificial Sequence: Synthetic polypeptide
DEEEIRTTNPVATEQYGSVSLTNNGQRVNNR

SEQ ID NO: 13264 - protein, 29 aa, Artificial Sequence
  Description of Artificial Sequence: Synthetic peptide
AEEEIRTTNPVATEQYGSVSSTNQQMGNN

SEQ ID NO: 13265 - protein, 30 aa, Artificial Sequence
  Description of Artificial Sequence: Synthetic polypeptide
DEEEIRTTNPVATEQYGSVSSTNLNDGGND

SEQ ID NO: 13266 - protein, 29 aa, Artificial Sequence
  Description of Artificial Sequence: Synthetic peptide
DEEEIRTTNPVATEQYGSVSSTELTVGER

SEQ ID NO: 13267 - protein, 30 aa, Artificial Sequence
  Description of Artificial Sequence: Synthetic polypeptide
AEEEIRTTNPVATEQYGSVSSTNPLQFGND

SEQ ID NO: 13268 - protein, 29 aa, Artificial Sequence
  Description of Artificial Sequence: Synthetic peptide
AEEEIRTTNPVATEQYGSVSTNLDFIGNE

SEQ ID NO: 13269 - protein, 29 aa, Artificial Sequence
  Description of Artificial Sequence: Synthetic peptide
AEEEIRTTNPVATEQYGSVSTNLDEAVNR

SEQ ID NO: 13270 - protein, 30 aa, Artificial Sequence
  Description of Artificial Sequence: Synthetic polypeptide
AEEEIRTTNPVATEQYGSVSTNHQRGNNTE

SEQ ID NO: 13271 - protein, 29 aa, Artificial Sequence
  Description of Artificial Sequence: Synthetic peptide
AEEEIRTTNPVATEQYGSVSTNLDTVGNL

SEQ ID NO: 13272 - protein, 30 aa, Artificial Sequence
  Description of Artificial Sequence: Synthetic polypeptide
AEEEIRTTNPVATEQYGSVSTNLDYGSNNR

SEQ ID NO: 13273 - protein, 29 aa, Artificial Sequence
  Description of Artificial Sequence: Synthetic peptide
DEDEIRTTNPVATEQYGSVATNLTRVGND

SEQ ID NO: 13274 - protein, 31 aa, Artificial Sequence
  Description of Artificial Sequence: Synthetic polypeptide
DEEEIRTTNPVATEQYGSVSSTNLQIGMNTP

SEQ ID NO: 13275 - protein, 30 aa, Artificial Sequence
  Description of Artificial Sequence: Synthetic polypeptide
DEEEIRTTNPVATEQYGSVSSTNLQLNGDE

SEQ ID NO: 13276 - protein, 29 aa, Artificial Sequence
  Description of Artificial Sequence: Synthetic peptide
AEEEIRTTNPVATEQYGSVSTNLLGSGER

SEQ ID NO: 13277 - protein, 31 aa, Artificial Sequence
  Description of Artificial Sequence: Synthetic polypeptide
DEEEIRTTNPVATEQYGSVSSTNLQMDGNGT

SEQ ID NO: 13278 - protein, 30 aa, Artificial Sequence
  Description of Artificial Sequence: Synthetic polypeptide
AEEEIRTTNPVATEQYGSVSTNLLNLGNNR

SEQ ID NO: 13279 - protein, 30 aa, Artificial Sequence
  Description of Artificial Sequence: Synthetic polypeptide
AEEEIRTTNPVATEQYGSVSTNLLNQGNRN

SEQ ID NO: 13280 - protein, 29 aa, Artificial Sequence
  Description of Artificial Sequence: Synthetic peptide
DEDEIRTTNPVATEQYGSVATNLQRQGDH

SEQ ID NO: 13281 - protein, 30 aa, Artificial Sequence
  Description of Artificial Sequence: Synthetic polypeptide
DEEEIRTTNPVATEQYGSVSSTNLQMGEDA

SEQ ID NO: 13282 - protein, 30 aa, Artificial Sequence
  Description of Artificial Sequence: Synthetic polypeptide
AEEEIRTTNPVATEQYGSVSTNLLQAGNQG

SEQ ID NO: 13283 - protein, 31 aa, Artificial Sequence
  Description of Artificial Sequence: Synthetic polypeptide
DEEEIRTTNPVATEQYGSVSSTNLQMNGDRS

SEQ ID NO: 13284 - protein, 30 aa, Artificial Sequence
  Description of Artificial Sequence: Synthetic polypeptide
AEEEIRTTNPVATEQYGSVSSTNNDQDGNR

SEQ ID NO: 13285 - protein, 31 aa, Artificial Sequence
  Description of Artificial Sequence: Synthetic polypeptide
DEEEIRTTNPVATEQYGSVSSTNLQNGGNTT

SEQ ID NO: 13286 - protein, 30 aa, Artificial Sequence
  Description of Artificial Sequence: Synthetic polypeptide
AEEEIRTTNPVATEQYGSVSTNLLQIGNDN

SEQ ID NO: 13287 - protein, 30 aa, Artificial Sequence
  Description of Artificial Sequence: Synthetic polypeptide
AEEEIRTTNPVATEQYGSVSTNLLQNGNNN

SEQ ID NO: 13288 - protein, 30 aa, Artificial Sequence
  Description of Artificial Sequence: Synthetic polypeptide
AEEEIRTTNPVATEQYGSVSSTNLVAGNPR

SEQ ID NO: 13289 - protein, 30 aa, Artificial Sequence
  Description of Artificial Sequence: Synthetic polypeptide
DEEEIRTTNPVATEQYGSVSSTNLQMGEEA

SEQ ID NO: 13290 - protein, 30 aa, Artificial Sequence
  Description of Artificial Sequence: Synthetic polypeptide
AEEEIRTTNPVATEQYGSVSTNLDVQGQNR

SEQ ID NO: 13291 - protein, 29 aa, Artificial Sequence
  Description of Artificial Sequence: Synthetic peptide
DEDEIRTTNPVATEQYGSVATNLQRHGDQ

SEQ ID NO: 13292 - protein, 30 aa, Artificial Sequence
  Description of Artificial Sequence: Synthetic polypeptide
AEEEIRTTNPVATEQYGSVSTNLIQMDENR

SEQ ID NO: 13293 - protein, 28 aa, Artificial Sequence
  Description of Artificial Sequence: Synthetic peptide
AEEEIRTTNPVATEQYGSVSTNLEDDPR

SEQ ID NO: 13294 - protein, 29 aa, Artificial Sequence
  Description of Artificial Sequence: Synthetic peptide
DEDEIRTTNPVATEQYGSVAATDLQRGDR

SEQ ID NO: 13295 - protein, 30 aa, Artificial Sequence
  Description of Artificial Sequence: Synthetic polypeptide
AEEEIRTTNPVATEQYGSVSTNLENTGQNR

SEQ ID NO: 13296 - protein, 30 aa, Artificial Sequence
  Description of Artificial Sequence: Synthetic polypeptide
AEEEIRTTNPVATEQYGSVSTNLEQGGNSA

SEQ ID NO: 13297 - protein, 30 aa, Artificial Sequence
  Description of Artificial Sequence: Synthetic polypeptide
AEEEIRTTNPVATEQYGSVSTNLERGINQL

SEQ ID NO: 13298 - protein, 30 aa, Artificial Sequence
  Description of Artificial Sequence: Synthetic polypeptide
AEEEIRTTNPVATEQYGSVSTNLGDAGNRE

SEQ ID NO: 13299 - protein, 31 aa, Artificial Sequence
  Description of Artificial Sequence: Synthetic polypeptide
DEEEIRTTNPVATEQYGSVSSTNLQFAGNQT

SEQ ID NO: 13300 - protein, 29 aa, Artificial Sequence
  Description of Artificial Sequence: Synthetic peptide
AEEEIRTTNPVATEQYGSVSTNLIQNGTM

SEQ ID NO: 13301 - protein, 30 aa, Artificial Sequence
  Description of Artificial Sequence: Synthetic polypeptide
DEEEIRTTNPVATEAYGCTISTNELQRGNR

SEQ ID NO: 13302 - protein, 30 aa, Artificial Sequence
  Description of Artificial Sequence: Synthetic polypeptide
AEEEIRTTNPVATEQYGSVSTNLGQTFGNN

SEQ ID NO: 13303 - protein, 30 aa, Artificial Sequence
  Description of Artificial Sequence: Synthetic polypeptide
AEEEIRTTNPVATEQYGSVSTNLGQTTGNP

SEQ ID NO: 13304 - protein, 31 aa, Artificial Sequence
  Description of Artificial Sequence: Synthetic polypeptide
DEEEIRTTNPVATEQYGSVSSTNLQGGMNET

SEQ ID NO: 13305 - protein, 28 aa, Artificial Sequence
  Description of Artificial Sequence: Synthetic peptide
AEEEIRTTNPVATEQYGSVSTNLINENE

SEQ ID NO: 13306 - protein, 30 aa, Artificial Sequence
  Description of Artificial Sequence: Synthetic polypeptide
DEEEIRTTNPVATEAYGCVSCTNLSTRGNR

SEQ ID NO: 13307 - protein, 29 aa, Artificial Sequence
  Description of Artificial Sequence: Synthetic peptide
DEDEIRTTNPVATEQYGSVATNLQQGNDL

SEQ ID NO: 13308 - protein, 30 aa, Artificial Sequence
  Description of Artificial Sequence: Synthetic polypeptide
AEEEIRTTNPVATEQYGSVSTNLIQGIMNR

SEQ ID NO: 13309 - protein, 30 aa, Artificial Sequence
  Description of Artificial Sequence: Synthetic polypeptide
AEEEIRTTNPVATEQYGSVSTNLGQLPGNN

SEQ ID NO: 13310 - protein, 30 aa, Artificial Sequence
  Description of Artificial Sequence: Synthetic polypeptide
DEDEIRTTNPVATEQYGSVSTNLNRGNENQ

SEQ ID NO: 13311 - protein, 30 aa, Artificial Sequence
  Description of Artificial Sequence: Synthetic polypeptide
DEEEIRTTNPVATEQYGSVSSTVLQGGGNL

SEQ ID NO: 13312 - protein, 31 aa, Artificial Sequence
  Description of Artificial Sequence: Synthetic polypeptide
AEEEIRTTNPVATEQYGSVSATNLQPGSNQR

SEQ ID NO: 13313 - protein, 30 aa, Artificial Sequence
  Description of Artificial Sequence: Synthetic polypeptide
SEEEIRTTNPVATEQYGSVSTNLQRNANET

SEQ ID NO: 13314 - protein, 29 aa, Artificial Sequence
  Description of Artificial Sequence: Synthetic peptide
DEEEIRTTNPVATEQYGSVSSEALNRGNV

SEQ ID NO: 13315 - protein, 28 aa, Artificial Sequence
  Description of Artificial Sequence: Synthetic peptide
DEEEIRTTNPTATEQYGSVSWNIFRGND

SEQ ID NO: 13316 - protein, 30 aa, Artificial Sequence
  Description of Artificial Sequence: Synthetic polypeptide
SEEEIRTTNPVATEQYGSVSTNLQRGEDEE

SEQ ID NO: 13317 - protein, 28 aa, Artificial Sequence
  Description of Artificial Sequence: Synthetic peptide
SSEEIRTTNPVATLQYGSVSTWLQRGNI

SEQ ID NO: 13318 - protein, 30 aa, Artificial Sequence
  Description of Artificial Sequence: Synthetic polypeptide
SEEEIRTTNPVATEQYGSVSTNLQREANFY

SEQ ID NO: 13319 - protein, 31 aa, Artificial Sequence
  Description of Artificial Sequence: Synthetic polypeptide
SEEEIRTTNPVATEQYGSVSTNLQRDNGNEY

SEQ ID NO: 13320 - protein, 31 aa, Artificial Sequence
  Description of Artificial Sequence: Synthetic polypeptide
SEEEIRTTNPVATEQYGSVSTNLQQTGTNNR

SEQ ID NO: 13321 - protein, 30 aa, Artificial Sequence
  Description of Artificial Sequence: Synthetic polypeptide
SEEEIRTTNPVATEQYGSVSTNLQQIGMNN

SEQ ID NO: 13322 - protein, 30 aa, Artificial Sequence
  Description of Artificial Sequence: Synthetic polypeptide
DEEEIRTTNPTATEQYGSVSTNNQRDGNAM

SEQ ID NO: 13323 - protein, 30 aa, Artificial Sequence
  Description of Artificial Sequence: Synthetic polypeptide
SEEEIRTTNPVATEQYGSVSTNLQQGNPVA

SEQ ID NO: 13324 - protein, 30 aa, Artificial Sequence
  Description of Artificial Sequence: Synthetic polypeptide
SEEEIRTTNPVATEQYGSVSTNLQQGNESG

SEQ ID NO: 13325 - protein, 28 aa, Artificial Sequence
  Description of Artificial Sequence: Synthetic peptide
SSEEIRTTNPVATQQYGSVSTWLQRGNI

SEQ ID NO: 13326 - protein, 30 aa, Artificial Sequence
  Description of Artificial Sequence: Synthetic polypeptide
SEEEIRTTNPVATEQYGSVSTNLQQGNEIA

SEQ ID NO: 13327 - protein, 30 aa, Artificial Sequence
  Description of Artificial Sequence: Synthetic polypeptide
SEEEIRTTNPVATEQYGSVSTNLQNVGENV

SEQ ID NO: 13328 - protein, 30 aa, Artificial Sequence
  Description of Artificial Sequence: Synthetic polypeptide
SEEEIRTTNPVATEQYGSVSTNLQRNNNFK

SEQ ID NO: 13329 - protein, 28 aa, Artificial Sequence
  Description of Artificial Sequence: Synthetic peptide
DEEEIRTTNPTATEQYGSVSYNEFRGND

SEQ ID NO: 13330 - protein, 30 aa, Artificial Sequence
  Description of Artificial Sequence: Synthetic polypeptide
SEEEIRTTNPVATEQYGSVSTNLQRPANVY

SEQ ID NO: 13331 - protein, 30 aa, Artificial Sequence
  Description of Artificial Sequence: Synthetic polypeptide
AEEEIRTTNPVATEQYGSVSTSTLQRGNEI

SEQ ID NO: 13332 - protein, 29 aa, Artificial Sequence
  Description of Artificial Sequence: Synthetic peptide
DEEEIRTTNPVATEAYGSVSTNLSQHGEE

SEQ ID NO: 13333 - protein, 30 aa, Artificial Sequence
  Description of Artificial Sequence: Synthetic polypeptide
SEEEIRTTNPVATEQYGSVSTNNLQDEGNF

SEQ ID NO: 13334 - protein, 32 aa, Artificial Sequence
  Description of Artificial Sequence: Synthetic polypeptide
SEEEIRTTNPVATEQYGSVSTNNLNQRGGNYR

SEQ ID NO: 13335 - protein, 30 aa, Artificial Sequence
  Description of Artificial Sequence: Synthetic polypeptide
SEEEIRTTNPVATEQYGSVSTNNLNQGGGR

SEQ ID NO: 13336 - protein, 29 aa, Artificial Sequence
  Description of Artificial Sequence: Synthetic peptide
SEEEIRTTNPVATEQYGSVSTNMQNGNQL

SEQ ID NO: 13337 - protein, 30 aa, Artificial Sequence
  Description of Artificial Sequence: Synthetic polypeptide
SEEEIRTTNPVATEQYGSVSTNMQGGNNRN

SEQ ID NO: 13338 - protein, 30 aa, Artificial Sequence
  Description of Artificial Sequence: Synthetic polypeptide
SEEEIRTTNPVATEQYGSVSTNLTQAQGNI

SEQ ID NO: 13339 - protein, 31 aa, Artificial Sequence
  Description of Artificial Sequence: Synthetic polypeptide
DEEEIRTTNPTATEQYGSVSTNLQSNGGNMR

SEQ ID NO: 13340 - protein, 29 aa, Artificial Sequence
  Description of Artificial Sequence: Synthetic peptide
SEEEIRTTNPVATEQYGSVSTNLTEGTER

SEQ ID NO: 13341 - protein, 30 aa, Artificial Sequence
  Description of Artificial Sequence: Synthetic polypeptide
SEEEIRTTNPVATEQYGSVSTNLQVSNGNP

SEQ ID NO: 13342 - protein, 28 aa, Artificial Sequence
  Description of Artificial Sequence: Synthetic peptide
DEEEIRTTNPTATEQYGSVSYNMTRGND

SEQ ID NO: 13343 - protein, 29 aa, Artificial Sequence
  Description of Artificial Sequence: Synthetic peptide
AEEEIRTTNPVATEQYGSVSTSQQREGNG

SEQ ID NO: 13344 - protein, 30 aa, Artificial Sequence
  Description of Artificial Sequence: Synthetic polypeptide
AEEEIRTTNPVATEQYGSVSTSSLQTGNIR

SEQ ID NO: 13345 - protein, 30 aa, Artificial Sequence
  Description of Artificial Sequence: Synthetic polypeptide
SEEEIRTTNPVATEQYGSVSTNLQTEGVNQ

SEQ ID NO: 13346 - protein, 30 aa, Artificial Sequence
  Description of Artificial Sequence: Synthetic polypeptide
SEEEIRTTNPVATEQYGSVSTNLQRPQNEH

SEQ ID NO: 13347 - protein, 30 aa, Artificial Sequence
  Description of Artificial Sequence: Synthetic polypeptide
AEEEIRTTNPVATEQYGSVSTSTLQRGNAG

SEQ ID NO: 13348 - protein, 28 aa, Artificial Sequence
  Description of Artificial Sequence: Synthetic peptide
SEEEIRTTNPVATEQYGSVSTNLTDGDD

SEQ ID NO: 13349 - protein, 30 aa, Artificial Sequence
  Description of Artificial Sequence: Synthetic polypeptide
SEEEIRTTNPVATEQYGSVSTNLQNLGNFM

SEQ ID NO: 13350 - protein, 28 aa, Artificial Sequence
  Description of Artificial Sequence: Synthetic peptide
DEDEIRTTNPVATDQYGCVSTNLGRGNP

SEQ ID NO: 13351 - protein, 30 aa, Artificial Sequence
  Description of Artificial Sequence: Synthetic polypeptide
SEEEIRTTNPVATEQYGSVSTNLQMSQGNF

SEQ ID NO: 13352 - protein, 28 aa, Artificial Sequence
  Description of Artificial Sequence: Synthetic peptide
STEEIRTTNPVATAQYGSVSTALQRGNQ

SEQ ID NO: 13353 - protein, 30 aa, Artificial Sequence
  Description of Artificial Sequence: Synthetic polypeptide
SEEEIRTTNPVATEQYGSVSTNLEQPNGNA

SEQ ID NO: 13354 - protein, 30 aa, Artificial Sequence
  Description of Artificial Sequence: Synthetic polypeptide
SEEEIRTTNPVATEQYGSVSTNLEQMQGNG

SEQ ID NO: 13355 - protein, 31 aa, Artificial Sequence
  Description of Artificial Sequence: Synthetic polypeptide
SEEEIRTTNPVATEQYGSVSTNLDQRGSNEL

SEQ ID NO: 13356 - protein, 30 aa, Artificial Sequence
  Description of Artificial Sequence: Synthetic polypeptide
SEEEIRTTNPVATEQYGSVSTNLDQNGNQF

SEQ ID NO: 13357 - protein, 31 aa, Artificial Sequence
  Description of Artificial Sequence: Synthetic polypeptide
DEEEIRTTNPVATEQYGSVSLNALSQRGTNG

SEQ ID NO: 13358 - protein, 29 aa, Artificial Sequence
  Description of Artificial Sequence: Synthetic peptide
SEEEIRTTNPVATEQYGSVSTNLDEGIIR

SEQ ID NO: 13359 - protein, 29 aa, Artificial Sequence
  Description of Artificial Sequence: Synthetic peptide
SEEEIRTTNPVATEQYGSVSTNLIDGVER

SEQ ID NO: 13360 - protein, 29 aa, Artificial Sequence
  Description of Artificial Sequence: Synthetic peptide
SEEEIRTTNPVATEQYGSVSTNISNSGNR

SEQ ID NO: 13361 - protein, 29 aa, Artificial Sequence
  Description of Artificial Sequence: Synthetic peptide
SEEEIRTTNPVATEQYGSVSTNGQTGNQQ

SEQ ID NO: 13362 - protein, 30 aa, Artificial Sequence
  Description of Artificial Sequence: Synthetic polypeptide
DEDEIRTTNPVATEQYGSVSTTLQREGTNP

SEQ ID NO: 13363 - protein, 30 aa, Artificial Sequence
  Description of Artificial Sequence: Synthetic polypeptide
SEEEIRTTNPVATEQYGSVSTNGLQVDGNE

SEQ ID NO: 13364 - protein, 29 aa, Artificial Sequence
  Description of Artificial Sequence: Synthetic peptide
DEEEIRTTNPVATEQYGSVSTDDAWRGER

SEQ ID NO: 13365 - protein, 30 aa, Artificial Sequence
  Description of Artificial Sequence: Synthetic polypeptide
SEEEIRTTNPVATEQYGSVSTNGLEGGGNR

SEQ ID NO: 13366 - protein, 29 aa, Artificial Sequence
  Description of Artificial Sequence: Synthetic peptide
SEEEIRTTNPVATEQYGSVSTNEQVGNPD

SEQ ID NO: 13367 - protein, 29 aa, Artificial Sequence
  Description of Artificial Sequence: Synthetic peptide
SEEEIRTTNPVATEQYGSVSTNEQGFGNG

SEQ ID NO: 13368 - protein, 29 aa, Artificial Sequence
  Description of Artificial Sequence: Synthetic peptide
SEEEIRTTNPVATEQYGSVSTNIQGGNLS

SEQ ID NO: 13369 - protein, 30 aa, Artificial Sequence
  Description of Artificial Sequence: Synthetic polypeptide
SEEEIRTTNPVATEQYGSVSTNNLQGQDNR

SEQ ID NO: 13370 - protein, 30 aa, Artificial Sequence
  Description of Artificial Sequence: Synthetic polypeptide
SEEEIRTTNPVATEQYGSVSTNLLGGNQRG

SEQ ID NO: 13371 - protein, 30 aa, Artificial Sequence
  Description of Artificial Sequence: Synthetic polypeptide
SEEEIRTTNPVATEQYGSVSTNLNEPGVNR

SEQ ID NO: 13372 - protein, 30 aa, Artificial Sequence
  Description of Artificial Sequence: Synthetic polypeptide
SEEEIRTTNPVATEQYGSVSTNLQLDGNLL

SEQ ID NO: 13373 - protein, 30 aa, Artificial Sequence
  Description of Artificial Sequence: Synthetic polypeptide
SEEEIRTTNPVATEQYGSVSTNLQIMGNSE

SEQ ID NO: 13374 - protein, 30 aa, Artificial Sequence
  Description of Artificial Sequence: Synthetic polypeptide
SEEEIRTTNPVATEQYGSVSTNLQILGNLY

SEQ ID NO: 13375 - protein, 30 aa, Artificial Sequence
  Description of Artificial Sequence: Synthetic polypeptide
SEEEIRTTNPVATEQYGSVSTNLQIEGNLM

SEQ ID NO: 13376 - protein, 30 aa, Artificial Sequence
  Description of Artificial Sequence: Synthetic polypeptide
SEEEIRTTNPVATEQYGSVSTNLQHGNEQA

SEQ ID NO: 13377 - protein, 30 aa, Artificial Sequence
  Description of Artificial Sequence: Synthetic polypeptide
SEEEIRTTNPVATEQYGSVSTNLQGGVANM

SEQ ID NO: 13378 - protein, 29 aa, Artificial Sequence
  Description of Artificial Sequence: Synthetic peptide
SEEEIRTTNPVATEQYGSVSTNLQFGLVN

SEQ ID NO: 13379 - protein, 29 aa, Artificial Sequence
  Description of Artificial Sequence: Synthetic peptide
DEEEIRTTNPVATEQYGSVSMNDLQDGID

SEQ ID NO: 13380 - protein, 31 aa, Artificial Sequence
  Description of Artificial Sequence: Synthetic polypeptide
SEEEIRTTNPVATEQYGSVSTNLQFGGGNRG

SEQ ID NO: 13381 - protein, 30 aa, Artificial Sequence
  Description of Artificial Sequence: Synthetic polypeptide
SEEEIRTTNPVATEQYGSVSTNLQDQGNPQ

SEQ ID NO: 13382 - protein, 30 aa, Artificial Sequence
  Description of Artificial Sequence: Synthetic polypeptide
SEEEIRTTNPVATEQYGSVSTNLQDQGNIM

SEQ ID NO: 13383 - protein, 29 aa, Artificial Sequence
  Description of Artificial Sequence: Synthetic peptide
SEEEIRTTNPVATEQYGSVSTNLQDGLIP

SEQ ID NO: 13384 - protein, 29 aa, Artificial Sequence
  Description of Artificial Sequence: Synthetic peptide
SEEEIRTTNPVATEQYGSVSTNLQAGEQQ

SEQ ID NO: 13385 - protein, 31 aa, Artificial Sequence
  Description of Artificial Sequence: Synthetic polypeptide
SEEEIRTTNPVATEQYGSVSTNLNRNGNERT

SEQ ID NO: 13386 - protein, 28 aa, Artificial Sequence
  Description of Artificial Sequence: Synthetic peptide
SSEEIRTTNPVATWQYGSVSTDLQRGNE

SEQ ID NO: 13387 - protein, 30 aa, Artificial Sequence
  Description of Artificial Sequence: Synthetic polypeptide
DEEEIRTTNPVATEAYGSVSTNLVQQGGNA

SEQ ID NO: 13388 - protein, 30 aa, Artificial Sequence
  Description of Artificial Sequence: Synthetic polypeptide
SEEEIRTTNPVATEQYGSVSTNLQEYGNPT

SEQ ID NO: 13389 - protein, 30 aa, Artificial Sequence
  Description of Artificial Sequence: Synthetic polypeptide
SEEEIRTTNPVATEQYGSVSTNNLQNGENE

SEQ ID NO: 13390 - protein, 30 aa, Artificial Sequence
  Description of Artificial Sequence: Synthetic polypeptide
SEEEIRTTNPVATEQYGSVSTNNLQVDENR

SEQ ID NO: 13391 - protein, 30 aa, Artificial Sequence
  Description of Artificial Sequence: Synthetic polypeptide
SEEEIRTTNPVATEQYGSVSTNNNQRGNMS

SEQ ID NO: 13392 - protein, 29 aa, Artificial Sequence
  Description of Artificial Sequence: Synthetic peptide
DEEEIRTTNPVATEQYGSVSSGLQRGEQI

SEQ ID NO: 13393 - protein, 30 aa, Artificial Sequence
  Description of Artificial Sequence: Synthetic polypeptide
SEEEIRTTNPVATEQYGSVSYTNNQQAGNR

SEQ ID NO: 13394 - protein, 31 aa, Artificial Sequence
  Description of Artificial Sequence: Synthetic polypeptide
SEEEIRTTNPVATEQYGSVSVTNLQSGGNDR

SEQ ID NO: 13395 - protein, 31 aa, Artificial Sequence
  Description of Artificial Sequence: Synthetic polypeptide
SEEEIRTTNPVATEQYGSVSVTNLQQMGANR

SEQ ID NO: 13396 - protein, 30 aa, Artificial Sequence
  Description of Artificial Sequence: Synthetic polypeptide
DEEEIRTTNPVATEAYGSVSTNLQGGPNDM

SEQ ID NO: 13397 - protein, 30 aa, Artificial Sequence
  Description of Artificial Sequence: Synthetic polypeptide
DEEEIRTTNPVATEAYGSVSTNLQMDGNNT

SEQ ID NO: 13398 - protein, 30 aa, Artificial Sequence
  Description of Artificial Sequence: Synthetic polypeptide
DEEEIRTTNPVATEAYGSVSTNLQPGNNAQ

SEQ ID NO: 13399 - protein, 31 aa, Artificial Sequence
  Description of Artificial Sequence: Synthetic polypeptide
SEEEIRTTNPVATEQYGSVTSTTNLQSGNPR

SEQ ID NO: 13400 - protein, 30 aa, Artificial Sequence
  Description of Artificial Sequence: Synthetic polypeptide
SEEEIRTTNPVATEQYGSVSVTGLQIRGLR

SEQ ID NO: 13401 - protein, 29 aa, Artificial Sequence
  Description of Artificial Sequence: Synthetic peptide
SEEEIRTTNPVATEQYGSVSVNNQRGNGV

SEQ ID NO: 13402 - protein, 30 aa, Artificial Sequence
  Description of Artificial Sequence: Synthetic polypeptide
SEEEIRTTNPVATEQYGSVSVANLQFGNER

SEQ ID NO: 13403 - protein, 28 aa, Artificial Sequence
  Description of Artificial Sequence: Synthetic peptide
SSEEIRTTNPVATHQYGSVSTALQRGNV

SEQ ID NO: 13404 - protein, 30 aa, Artificial Sequence
  Description of Artificial Sequence: Synthetic polypeptide
SEEEIRTTNPVATEQYGSVSTYNLQDEGNE

SEQ ID NO: 13405 - protein, 31 aa, Artificial Sequence
  Description of Artificial Sequence: Synthetic polypeptide
SEEEIRTTNPVATEQYGSVSTVNLQRSGSND

SEQ ID NO: 13406 - protein, 30 aa, Artificial Sequence
  Description of Artificial Sequence: Synthetic polypeptide
SEEEIRTTNPVATEQYGSVSTVNEDQGGNR

SEQ ID NO: 13407 - protein, 29 aa, Artificial Sequence
  Description of Artificial Sequence: Synthetic peptide
SEEEIRTTNPVATEQYGSVSTVLQMQGNF

SEQ ID NO: 13408 - protein, 30 aa, Artificial Sequence
  Description of Artificial Sequence: Synthetic polypeptide
SEEEIRTTNPVATEQYGSVSVTDNLQEGNY

SEQ ID NO: 13409 - protein, 29 aa, Artificial Sequence
  Description of Artificial Sequence: Synthetic peptide
SEEEIRTTNPVATEQYGSVSTVLQDVGNF

SEQ ID NO: 13410 - protein, 31 aa, Artificial Sequence
  Description of Artificial Sequence: Synthetic polypeptide
SEEEIRTTNPVATEQYGSVTSTVNLQTGNNR

SEQ ID NO: 13411 - protein, 31 aa, Artificial Sequence
  Description of Artificial Sequence: Synthetic polypeptide
SEEEIRTTNPVATEQYGSVVSTNLQMGANNR

SEQ ID NO: 13412 - protein, 28 aa, Artificial Sequence
  Description of Artificial Sequence: Synthetic peptide
SEEEIRTTNPVATEQYGTVSTNDQGGNV

SEQ ID NO: 13413 - protein, 30 aa, Artificial Sequence
  Description of Artificial Sequence: Synthetic polypeptide
AEEEIRTTNPVATEQYGDVCSTNPPQRGNR

SEQ ID NO: 13414 - protein, 29 aa, Artificial Sequence
  Description of Artificial Sequence: Synthetic peptide
DEEEIRTTNPVATEQYGSVSSILVRGEDR

SEQ ID NO: 13415 - protein, 31 aa, Artificial Sequence
  Description of Artificial Sequence: Synthetic polypeptide
DEEEIRTTNPVATEAYGSVSTNELSQRVPNR

SEQ ID NO: 13416 - protein, 30 aa, Artificial Sequence
  Description of Artificial Sequence: Synthetic polypeptide
AEEEIRTTNPVATEQYGCVSTNLQMGENRD

SEQ ID NO: 13417 - protein, 32 aa, Artificial Sequence
  Description of Artificial Sequence: Synthetic polypeptide
AEEEIRTTNPVATEQYGSVSTSNLTQRGSNAR

SEQ ID NO: 13418 - protein, 30 aa, Artificial Sequence
  Description of Artificial Sequence: Synthetic polypeptide
AEEEIRTTNPVATEQYGCVSTNLQEGDNRL

SEQ ID NO: 13419 - protein, 28 aa, Artificial Sequence
  Description of Artificial Sequence: Synthetic peptide
SEEEIRTTNPVATEQYGSVVSNLQRGGN

SEQ ID NO: 13420 - protein, 30 aa, Artificial Sequence
  Description of Artificial Sequence: Synthetic polypeptide
AEEEIRTTNPVATEQYGCVSTNLQDRGNDN

SEQ ID NO: 13421 - protein, 29 aa, Artificial Sequence
  Description of Artificial Sequence: Synthetic peptide
SEEEIRTTNPVATEQYGSVYTTLQRVNDR

SEQ ID NO: 13422 - protein, 30 aa, Artificial Sequence
  Description of Artificial Sequence: Synthetic polypeptide
SEEEIRTTNPVATEQYGSVVTVNLQDGGNR

SEQ ID NO: 13423 - protein, 28 aa, Artificial Sequence
  Description of Artificial Sequence: Synthetic peptide
AEEEIRTTNPVATEQYGCVSTNDQGNNR

SEQ ID NO: 13424 - protein, 29 aa, Artificial Sequence
  Description of Artificial Sequence: Synthetic peptide
SEEEIRTTNPVATEQYGSVVTNSEQFGNR

SEQ ID NO: 13425 - protein, 29 aa, Artificial Sequence
  Description of Artificial Sequence: Synthetic peptide
SEEEIRTTNPVATEQYGSVVTNNGQDGNR

SEQ ID NO: 13426 - protein, 28 aa, Artificial Sequence
  Description of Artificial Sequence: Synthetic peptide
SEEEIRTTNPVATEQYGSVVTALQNGFR

SEQ ID NO: 13427 - protein, 30 aa, Artificial Sequence
  Description of Artificial Sequence: Synthetic polypeptide
SEEEIRTTNPVATEQYGSVVSTNNQQAGNR

SEQ ID NO: 13428 - protein, 30 aa, Artificial Sequence
  Description of Artificial Sequence: Synthetic polypeptide
AEEEIRTTNPVATEQYGCVSTNHQRGSDNR

SEQ ID NO: 13429 - protein, 29 aa, Artificial Sequence
  Description of Artificial Sequence: Synthetic peptide
SEEEIRTTNPVATEQYGSVSTNEQEGNIN

SEQ ID NO: 13430 - protein, 30 aa, Artificial Sequence
  Description of Artificial Sequence: Synthetic polypeptide
SEEEIRTTNPVATEQYGSVSTTVNEQEGNR

SEQ ID NO: 13431 - protein, 29 aa, Artificial Sequence
  Description of Artificial Sequence: Synthetic peptide
SEEEIRTTNPVATEQYGSVSTTNLSTGIR

SEQ ID NO: 13432 - protein, 31 aa, Artificial Sequence
  Description of Artificial Sequence: Synthetic polypeptide
DEEEIRTTNPVATEAYGSVSTNLQRPGGNGQ

SEQ ID NO: 13433 - protein, 29 aa, Artificial Sequence
  Description of Artificial Sequence: Synthetic peptide
SEEEIRTTNPVATEQYGSVSTNVVVQGNR

SEQ ID NO: 13434 - protein, 29 aa, Artificial Sequence
  Description of Artificial Sequence: Synthetic peptide
SEEEIRTTNPVATEQYGSVSTNVQNYGNT

SEQ ID NO: 13435 - protein, 29 aa, Artificial Sequence
  Description of Artificial Sequence: Synthetic peptide
SEEEIRTTNPVATEQYGSVSTNTVTAGNR

SEQ ID NO: 13436 - protein, 28 aa, Artificial Sequence
  Description of Artificial Sequence: Synthetic peptide
SSEEIRTTNPVATHQYGSVSTQLQRGNQ

SEQ ID NO: 13437 - protein, 29 aa, Artificial Sequence
  Description of Artificial Sequence: Synthetic peptide
DEDEIRTTNPVATEQYGSVSTSLQAGNTS

SEQ ID NO: 13438 - protein, 29 aa, Artificial Sequence
  Description of Artificial Sequence: Synthetic peptide
SEEEIRTTNPVATEQYGSVSTNTQDGGND

SEQ ID NO: 13439 - protein, 28 aa, Artificial Sequence
  Description of Artificial Sequence: Synthetic peptide
DEDEIRTTNPVATDQYGTVSTNLERGNS

SEQ ID NO: 13440 - protein, 31 aa, Artificial Sequence
  Description of Artificial Sequence: Synthetic polypeptide
DEEEIRTTNPVATEAYGSVSTNLSNRGTSNR

SEQ ID NO: 13441 - protein, 30 aa, Artificial Sequence
  Description of Artificial Sequence: Synthetic polypeptide
SEEEIRTTNPVATEQYGSVSTNSLQGGNQS

SEQ ID NO: 13442 - protein, 29 aa, Artificial Sequence
  Description of Artificial Sequence: Synthetic peptide
SEEEIRTTNPVATEQYGSVSTNQQQIGNV

SEQ ID NO: 13443 - protein, 30 aa, Artificial Sequence
  Description of Artificial Sequence: Synthetic polypeptide
SEEEIRTTNPVATEQYGSVSTNQQEGNERN

SEQ ID NO: 13444 - protein, 29 aa, Artificial Sequence
  Description of Artificial Sequence: Synthetic peptide
SEEEIRTTNPVATEQYGSVSTNQQEGNEQ

SEQ ID NO: 13445 - protein, 30 aa, Artificial Sequence
  Description of Artificial Sequence: Synthetic polypeptide
SEEEIRTTNPVATEQYGSVSTNPQDGNTRN

SEQ ID NO: 13446 - protein, 28 aa, Artificial Sequence
  Description of Artificial Sequence: Synthetic peptide
DEDEIRTTNPVATDQYGSVPTQLQRGNS

SEQ ID NO: 13447 - protein, 30 aa, Artificial Sequence
  Description of Artificial Sequence: Synthetic polypeptide
DEDEIRTTNPVATEQYGSVSTSLQRDGNNE

SEQ ID NO: 13448 - protein, 29 aa, Artificial Sequence
  Description of Artificial Sequence: Synthetic peptide
SEEEIRTTNPVATEQYGSVSTNTDNPGNR

SEQ ID NO: 13449 - protein, 30 aa, Artificial Sequence
  Description of Artificial Sequence: Synthetic polypeptide
SEEEIRTTNPVATEQYGSVSTTNNLQYGNM

SEQ ID NO: 13450 - protein, 30 aa, Artificial Sequence
  Description of Artificial Sequence: Synthetic polypeptide
DEEEIRTTNPVATEQYGSVSMLNLQRLNLG

SEQ ID NO: 13451 - protein, 30 aa, Artificial Sequence
  Description of Artificial Sequence: Synthetic polypeptide
SEEEIRTTNPVATEQYGSVSTPNLMMRGNV

SEQ ID NO: 13452 - protein, 30 aa, Artificial Sequence
  Description of Artificial Sequence: Synthetic polypeptide
SEEEIRTTNPVATEQYGSVSTTNLSQTGNT

SEQ ID NO: 13453 - protein, 31 aa, Artificial Sequence
  Description of Artificial Sequence: Synthetic polypeptide
SEEEIRTTNPVATEQYGSVSTTNLQRGENNT

SEQ ID NO: 13454 - protein, 31 aa, Artificial Sequence
  Description of Artificial Sequence: Synthetic polypeptide
SEEEIRTTNPVATEQYGSVSTTNLQNNGANR

SEQ ID NO: 13455 - protein, 31 aa, Artificial Sequence
  Description of Artificial Sequence: Synthetic polypeptide
SEEEIRTTNPVATEQYGSVSTTNLQGLGANR

SEQ ID NO: 13456 - protein, 31 aa, Artificial Sequence
  Description of Artificial Sequence: Synthetic polypeptide
SEEEIRTTNPVATEQYGSVSTTNLQDSGNRG

SEQ ID NO: 13457 - protein, 30 aa, Artificial Sequence
  Description of Artificial Sequence: Synthetic polypeptide
SEEEIRTTNPVATEQYGSVSTTINLQEGNP

SEQ ID NO: 13458 - protein, 30 aa, Artificial Sequence
  Description of Artificial Sequence: Synthetic polypeptide
SEEEIRTTNPVATEQYGSVSTSNSQNGSNR

SEQ ID NO: 13459 - protein, 31 aa, Artificial Sequence
  Description of Artificial Sequence: Synthetic polypeptide
DEEEIRTTNPVATEAYGSVSTNLQRGGNYGC

SEQ ID NO: 13460 - protein, 29 aa, Artificial Sequence
  Description of Artificial Sequence: Synthetic peptide
DEEEIRTTNPVATEAYGSVSTNLQQSVSR

SEQ ID NO: 13461 - protein, 32 aa, Artificial Sequence
  Description of Artificial Sequence: Synthetic polypeptide
SEEEIRTTNPVATEQYGSVSTSNLIQRGENDR

SEQ ID NO: 13462 - protein, 29 aa, Artificial Sequence
  Description of Artificial Sequence: Synthetic peptide
DEEEIRTTNPVATEQYGSVSMGTLQRNND

SEQ ID NO: 13463 - protein, 32 aa, Artificial Sequence
  Description of Artificial Sequence: Synthetic polypeptide
SEEEIRTTNPVATEQYGSVSTSNLDQRGENTR

SEQ ID NO: 13464 - protein, 31 aa, Artificial Sequence
  Description of Artificial Sequence: Synthetic polypeptide
DEEEIRTTNPVATEQYGCVCSTNNLQFGSNR

SEQ ID NO: 13465 - protein, 31 aa, Artificial Sequence
  Description of Artificial Sequence: Synthetic polypeptide
DEEEIRTTNPVATEAYGSVSTNLQRGDSNQS

SEQ ID NO: 13466 - protein, 28 aa, Artificial Sequence
  Description of Artificial Sequence: Synthetic peptide
SSEEIRTTNPVATHQYGSVSTHLQRGNQ

SEQ ID NO: 13467 - protein, 32 aa, Artificial Sequence
  Description of Artificial Sequence: Synthetic polypeptide
SEEEIRTTNPVATEQYGSVSTQNLSQRGENYR

SEQ ID NO: 13468 - protein, 31 aa, Artificial Sequence
  Description of Artificial Sequence: Synthetic polypeptide
SEEEIRTTNPVATEQYGSVSTSNLLQTGGNR

SEQ ID NO: 13469 - protein, 31 aa, Artificial Sequence
  Description of Artificial Sequence: Synthetic polypeptide
DEEEIRTTNPVATEAYGSVSTNALSQRGSNV

SEQ ID NO: 13470 - protein, 28 aa, Artificial Sequence
  Description of Artificial Sequence: Synthetic peptide
STEEIRTTNPVATNQYGSVSTSLQRGNE

SEQ ID NO: 13471 - protein, 30 aa, Artificial Sequence
  Description of Artificial Sequence: Synthetic polypeptide
SEEEIRTTNPVATEQYGSVSTNEQDRGDTR

SEQ ID NO: 13472 - protein, 29 aa, Artificial Sequence
  Description of Artificial Sequence: Synthetic peptide
AEEEIRTTNPVATEPYGSVNSTNLQSGNQ

SEQ ID NO: 13473 - protein, 29 aa, Artificial Sequence
  Description of Artificial Sequence: Synthetic peptide
AEEEIRTTNPVATENYGSVSTNLQSGNMT

SEQ ID NO: 13474 - protein, 28 aa, Artificial Sequence
  Description of Artificial Sequence: Synthetic peptide
AEEEIRTTNPVATEMYGSVSANLQDGNQ

SEQ ID NO: 13475 - protein, 28 aa, Artificial Sequence
  Description of Artificial Sequence: Synthetic peptide
AEEEIRTTNPVATELYGSVSTNLQYGSG

SEQ ID NO: 13476 - protein, 29 aa, Artificial Sequence
  Description of Artificial Sequence: Synthetic peptide
AEEEIRTTNPVATEIYGSVVTNLQNGNLR

SEQ ID NO: 13477 - protein, 30 aa, Artificial Sequence
  Description of Artificial Sequence: Synthetic polypeptide
AEEEIRTTNPVATEQYGSVSTTLVQLQGNR

SEQ ID NO: 13478 - protein, 29 aa, Artificial Sequence
  Description of Artificial Sequence: Synthetic peptide
DEEEIRTTNPVATEQYGSVSTDHDQEGER

SEQ ID NO: 13479 - protein, 31 aa, Artificial Sequence
  Description of Artificial Sequence: Synthetic polypeptide
DEEEIRTTNPVATEQYGSVSMNLQRGVLERN

SEQ ID NO: 13480 - protein, 30 aa, Artificial Sequence
  Description of Artificial Sequence: Synthetic polypeptide
AEEEIRTTNPVATEQYGSVSTTMNLLEGNR

SEQ ID NO: 13481 - protein, 30 aa, Artificial Sequence
  Description of Artificial Sequence: Synthetic polypeptide
AEEEIRTTNPVATEQYGSVSTTNADQVGNR

SEQ ID NO: 13482 - protein, 29 aa, Artificial Sequence
  Description of Artificial Sequence: Synthetic peptide
AEEEIRTTNPVATEIYGSVSTVLQRGNNL

SEQ ID NO: 13483 - protein, 30 aa, Artificial Sequence
  Description of Artificial Sequence: Synthetic polypeptide
SEEEIRTTNPVATEQYGSVNSTNLQLEGNF

SEQ ID NO: 13484 - protein, 31 aa, Artificial Sequence
  Description of Artificial Sequence: Synthetic polypeptide
DEEEIRTTNPVATEQYGSVSMNLQRNGNILD

SEQ ID NO: 13485 - protein, 30 aa, Artificial Sequence
  Description of Artificial Sequence: Synthetic polypeptide
DEEEIRTTNPVATEQYGSVSQTNPDQRGEN

SEQ ID NO: 13486 - protein, 29 aa, Artificial Sequence
  Description of Artificial Sequence: Synthetic peptide
DEEEIRTTNPVATEAYGSVTSTEEQNGNR

SEQ ID NO: 13487 - protein, 28 aa, Artificial Sequence
  Description of Artificial Sequence: Synthetic peptide
DEECIRCTNPVATEQYGSVSVNQQRGNL

SEQ ID NO: 13488 - protein, 30 aa, Artificial Sequence
  Description of Artificial Sequence: Synthetic polypeptide
AEEEIRTTNPVATEPYGSVSITNLQNGNNR

SEQ ID NO: 13489 - protein, 31 aa, Artificial Sequence
  Description of Artificial Sequence: Synthetic polypeptide
DEEEIRTTNPVATEQYGSVSTDGLQTEFGNR

SEQ ID NO: 13490 - protein, 30 aa, Artificial Sequence
  Description of Artificial Sequence: Synthetic polypeptide
AEEEIRTTNPVATEQYGSVSTTLQRVGNEL

SEQ ID NO: 13491 - protein, 29 aa, Artificial Sequence
  Description of Artificial Sequence: Synthetic peptide
AEEEIRTTNPVATEPYGSVVSTNEQNGNR

SEQ ID NO: 13492 - protein, 31 aa, Artificial Sequence
  Description of Artificial Sequence: Synthetic polypeptide
AEEEIRTTNPVATEPYGSVVSCTNMLQRGNR

SEQ ID NO: 13493 - protein, 29 aa, Artificial Sequence
  Description of Artificial Sequence: Synthetic peptide
AEEEIRTTNPVATEPYGSVSTVNLQNGNM

SEQ ID NO: 13494 - protein, 29 aa, Artificial Sequence
  Description of Artificial Sequence: Synthetic peptide
SEEEIRTTNPVATEQYGSVSATNLTRENG

SEQ ID NO: 13495 - protein, 29 aa, Artificial Sequence
  Description of Artificial Sequence: Synthetic peptide
AEEEIRTTNPVATEPYGSVSTVLQRGNDG

SEQ ID NO: 13496 - protein, 28 aa, Artificial Sequence
  Description of Artificial Sequence: Synthetic peptide
DEEEIRTTNPVATEQYGSVSTDDTVGNC

SEQ ID NO: 13497 - protein, 28 aa, Artificial Sequence
  Description of Artificial Sequence: Synthetic peptide
AEEEIRTTNPVATEPYGSVSTQLQRVNG

SEQ ID NO: 13498 - protein, 31 aa, Artificial Sequence
  Description of Artificial Sequence: Synthetic polypeptide
DEEEIRTTNPVATEQYGSVSQTNNQRGENLL

SEQ ID NO: 13499 - protein, 31 aa, Artificial Sequence
  Description of Artificial Sequence: Synthetic polypeptide
SEEEIRTTNPVATEQYGSVPSTNFSQRGNNR

SEQ ID NO: 13500 - protein, 28 aa, Artificial Sequence
  Description of Artificial Sequence: Synthetic peptide
AEEEIRTTNPVATEPYGSVSTNLQPING

SEQ ID NO: 13501 - protein, 29 aa, Artificial Sequence
  Description of Artificial Sequence: Synthetic peptide
DEEEIRTTNPVATEQYGSVSTDEASRGSR

SEQ ID NO: 13502 - protein, 30 aa, Artificial Sequence
  Description of Artificial Sequence: Synthetic polypeptide
AEEEIRTTNPVATEPYGSVSSTNLQAGNMR

SEQ ID NO: 13503 - protein, 28 aa, Artificial Sequence
  Description of Artificial Sequence: Synthetic peptide
DEEEIRTTNPVATEQYGSVSTDEQNGEF

SEQ ID NO: 13504 - protein, 28 aa, Artificial Sequence
  Description of Artificial Sequence: Synthetic peptide
DEECIRCTNPVATEQYGSVSSNQQRGNL

SEQ ID NO: 13505 - protein, 29 aa, Artificial Sequence
  Description of Artificial Sequence: Synthetic peptide
AEEEIRTTNPVATEPYGSVSSTNLQAGNG

SEQ ID NO: 13506 - protein, 30 aa, Artificial Sequence
  Description of Artificial Sequence: Synthetic polypeptide
AEEEIRTTNPVATEPYGSVSSQTNLQLGNR

SEQ ID NO: 13507 - protein, 30 aa, Artificial Sequence
  Description of Artificial Sequence: Synthetic polypeptide
AEEEIRTTNPVATEPYGSVSTNPLQGEGNR

SEQ ID NO: 13508 - protein, 30 aa, Artificial Sequence
  Description of Artificial Sequence: Synthetic polypeptide
DEEEIRTTNPVATEQYGSVSQTNLTRGVFT

SEQ ID NO: 13509 - protein, 28 aa, Artificial Sequence
  Description of Artificial Sequence: Synthetic peptide
AEEEIRTTNPVATEIYGSVSTNNQYGNI

SEQ ID NO: 13510 - protein, 29 aa, Artificial Sequence
  Description of Artificial Sequence: Synthetic peptide
AEEEIRTTNPVATEIYGSVSTNLQTGNDN

SEQ ID NO: 13511 - protein, 28 aa, Artificial Sequence
  Description of Artificial Sequence: Synthetic peptide
AEEEIRTTNPVATEGYGSVSTNLQRTEE

SEQ ID NO: 13512 - protein, 29 aa, Artificial Sequence
  Description of Artificial Sequence: Synthetic peptide
AEEEIRTTNPVATEGYGSVSTNLFGGNER

SEQ ID NO: 13513 - protein, 31 aa, Artificial Sequence
  Description of Artificial Sequence: Synthetic polypeptide
DEEEIRTTNPVATEQYGSVSQTNLQRNEGRD

SEQ ID NO: 13514 - protein, 31 aa, Artificial Sequence
  Description of Artificial Sequence: Synthetic polypeptide
DEEEIRTTNPVATEAYGSVVSANLQRGGNRQ

SEQ ID NO: 13515 - protein, 28 aa, Artificial Sequence
  Description of Artificial Sequence: Synthetic peptide
AEEEIRTTNPVATEGYGEESINLQRGNR

SEQ ID NO: 13516 - protein, 30 aa, Artificial Sequence
  Description of Artificial Sequence: Synthetic polypeptide
DEEEIRTTNPVATEQYGSVSTDILQRDTDR

SEQ ID NO: 13517 - protein, 30 aa, Artificial Sequence
  Description of Artificial Sequence: Synthetic polypeptide
DEEEIRTTNPVATEQYGSVSQTNLQQSNIL

SEQ ID NO: 13518 - protein, 29 aa, Artificial Sequence
  Description of Artificial Sequence: Synthetic peptide
AEEEIRTTNPVATEGYGSVSTNNQRGNDG

SEQ ID NO: 13519 - protein, 28 aa, Artificial Sequence
  Description of Artificial Sequence: Synthetic peptide
SEEEIRTTNPVATEQYGSVATTLQNGFR

SEQ ID NO: 13520 - protein, 29 aa, Artificial Sequence
  Description of Artificial Sequence: Synthetic peptide
SEEEIRTTNPVATEQYGSVATNQLELGNR

SEQ ID NO: 13521 - protein, 31 aa, Artificial Sequence
  Description of Artificial Sequence: Synthetic polypeptide
DEEEIRTTNPVATEAYGSVVSTNLSQNGGNR

SEQ ID NO: 13522 - protein, 29 aa, Artificial Sequence
  Description of Artificial Sequence: Synthetic peptide
SEEEIRTTNPVATEQYGSVATNLQSGDNN

SEQ ID NO: 13523 - protein, 31 aa, Artificial Sequence
  Description of Artificial Sequence: Synthetic polypeptide
DEEEIRTTNPVATEQYGSVSQTNLQQGNEES

SEQ ID NO: 13524 - protein, 31 aa, Artificial Sequence
  Description of Artificial Sequence: Synthetic polypeptide
DEEEIRTTNPVATEQYGSVSQTNLQQGMNNL

SEQ ID NO: 13525 - protein, 30 aa, Artificial Sequence
  Description of Artificial Sequence: Synthetic polypeptide
DEEEIRTTNPVATEQYGSVSMNLQRSENIS

SEQ ID NO: 13526 - protein, 30 aa, Artificial Sequence
  Description of Artificial Sequence: Synthetic polypeptide
DEEEIRTTNPSATEQYGSVIETNLQRGNHQ

SEQ ID NO: 13527 - protein, 29 aa, Artificial Sequence
  Description of Artificial Sequence: Synthetic peptide
SEEEIRTTNPVATEQYGSVATNVQRGDVR

SEQ ID NO: 13528 - protein, 30 aa, Artificial Sequence
  Description of Artificial Sequence: Synthetic polypeptide
AEEEIRTTNPVATEPYGSVVSTNLQQGGNR

SEQ ID NO: 13529 - protein, 30 aa, Artificial Sequence
  Description of Artificial Sequence: Synthetic polypeptide
DEEEIRTTNPVATEQYGSVSQTNLQSPENQ

SEQ ID NO: 13530 - protein, 29 aa, Artificial Sequence
  Description of Artificial Sequence: Synthetic peptide
AEEEIRTTNPVATEHYGSVSNTNLQRTNP

SEQ ID NO: 13531 - protein, 30 aa, Artificial Sequence
  Description of Artificial Sequence: Synthetic polypeptide
AEEEIRTTNPVATEIYGSVSTNLQREGVNE

SEQ ID NO: 13532 - protein, 30 aa, Artificial Sequence
  Description of Artificial Sequence: Synthetic polypeptide
SEEEIRTTNPVATEQYGSVISTNLQATTNR

SEQ ID NO: 13533 - protein, 29 aa, Artificial Sequence
  Description of Artificial Sequence: Synthetic peptide
AEEEIRTTNPVATEIYGSVSTNLQQGNGQ

SEQ ID NO: 13534 - protein, 30 aa, Artificial Sequence
  Description of Artificial Sequence: Synthetic polypeptide
SEEEIRTTNPVATEQYGSVGTNLQVGGNNR

SEQ ID NO: 13535 - protein, 30 aa, Artificial Sequence
  Description of Artificial Sequence: Synthetic polypeptide
AEEEIRTTNPVATEIYGSVSTNLEQQGGNR

SEQ ID NO: 13536 - protein, 28 aa, Artificial Sequence
  Description of Artificial Sequence: Synthetic peptide
SEEEIRTTNPVATEQYGSVETALQNGQR

SEQ ID NO: 13537 - protein, 28 aa, Artificial Sequence
  Description of Artificial Sequence: Synthetic peptide
SEEEIRTTNPVATEQYGSVETALQEGDR

SEQ ID NO: 13538 - protein, 30 aa, Artificial Sequence
  Description of Artificial Sequence: Synthetic polypeptide
DEEEIRTTNPVATEQYGSVSQTNLQTNENW

SEQ ID NO: 13539 - protein, 30 aa, Artificial Sequence
  Description of Artificial Sequence: Synthetic polypeptide
SEEEIRTTNPVATEQYGSVESTNLQTNGER

SEQ ID NO: 13540 - protein, 28 aa, Artificial Sequence
  Description of Artificial Sequence: Synthetic peptide
AEEEIRTTNPVATEIYGSTSTNLQFGNV

SEQ ID NO: 13541 - protein, 29 aa, Artificial Sequence
  Description of Artificial Sequence: Synthetic peptide
AEEEIRTTNPVATEHYGSVSTNLQVGNYT

SEQ ID NO: 13542 - protein, 28 aa, Artificial Sequence
  Description of Artificial Sequence: Synthetic peptide
AEEEIRTTNPVATEHYGSVSTNLQMQNV

SEQ ID NO: 13543 - protein, 30 aa, Artificial Sequence
  Description of Artificial Sequence: Synthetic polypeptide
AEEEIRTTNPVATEQYGSVSTTNDQIRGNN

SEQ ID NO: 13544 - protein, 29 aa, Artificial Sequence
  Description of Artificial Sequence: Synthetic peptide
SEEEIRTTNPVATEQYGSVESTNLQAGGT

SEQ ID NO: 13545 - protein, 30 aa, Artificial Sequence
  Description of Artificial Sequence: Synthetic polypeptide
AEEEIRTTNPVATEHYGSVSTNLQGNGNRT

SEQ ID NO: 13546 - protein, 28 aa, Artificial Sequence
  Description of Artificial Sequence: Synthetic peptide
AEEEIRTTNPVATEHYGSVSSNLTVGNR

SEQ ID NO: 13547 - protein, 29 aa, Artificial Sequence
  Description of Artificial Sequence: Synthetic peptide
SEEEIRTTNPVATEQYGSVESTNLQFGIA

SEQ ID NO: 13548 - protein, 29 aa, Artificial Sequence
  Description of Artificial Sequence: Synthetic peptide
AEEEIRTTNPVATEPYGSVVSTNLQTGNL

SEQ ID NO: 13549 - protein, 30 aa, Artificial Sequence
  Description of Artificial Sequence: Synthetic polypeptide
DEEEIRTTNPTATEQYGSVAATNLQRGNHA

SEQ ID NO: 13550 - protein, 30 aa, Artificial Sequence
  Description of Artificial Sequence: Synthetic polypeptide
DEEEIRTTNPVATEQYGSVSTDDQRTVNER

SEQ ID NO: 13551 - protein, 29 aa, Artificial Sequence
  Description of Artificial Sequence: Synthetic peptide
SEEEIRTTNPVATEQYGSVSTELQIVNNR

SEQ ID NO: 13552 - protein, 30 aa, Artificial Sequence
  Description of Artificial Sequence: Synthetic polypeptide
DEEEIRTTNPVATEQYGSVSMNDQRGENMD

SEQ ID NO: 13553 - protein, 29 aa, Artificial Sequence
  Description of Artificial Sequence: Synthetic peptide
SEEEIRTTNPVATEQYGSVSTDNPQRGSD

SEQ ID NO: 13554 - protein, 31 aa, Artificial Sequence
  Description of Artificial Sequence: Synthetic polypeptide
DEEEIRTTNPTATEQYGSVSTNLQEHGGNAR

SEQ ID NO: 13555 - protein, 29 aa, Artificial Sequence
  Description of Artificial Sequence: Synthetic peptide
TCEEIRTTNPVATEQYGVVSTNLQDGPNR

SEQ ID NO: 13556 - protein, 28 aa, Artificial Sequence
  Description of Artificial Sequence: Synthetic peptide
DEDEIRTTNPVATAQYGSVGTELQRGND

SEQ ID NO: 13557 - protein, 30 aa, Artificial Sequence
  Description of Artificial Sequence: Synthetic polypeptide
DEEEIRTTNPVATEAYGSVSTTNLSQKGNA

SEQ ID NO: 13558 - protein, 32 aa, Artificial Sequence
  Description of Artificial Sequence: Synthetic polypeptide
SEEEIRTTNPVATEQYGSVSTGNLDQRGGNYR

SEQ ID NO: 13559 - protein, 30 aa, Artificial Sequence
  Description of Artificial Sequence: Synthetic polypeptide
DEEEIRTTNPVATEQYGSVSMNLDQGGVER

SEQ ID NO: 13560 - protein, 31 aa, Artificial Sequence
  Description of Artificial Sequence: Synthetic polypeptide
SEEEIRTTNPVATEQYGSVSSTTNLQEGENR

SEQ ID NO: 13561 - protein, 30 aa, Artificial Sequence
  Description of Artificial Sequence: Synthetic polypeptide
SEEEIRTTNPVATEQYGSVSSTNNLQGGNP

SEQ ID NO: 13562 - protein, 29 aa, Artificial Sequence
  Description of Artificial Sequence: Synthetic peptide
SEEEIRTTNPVATEQYGSVSSTNLQYGGN

SEQ ID NO: 13563 - protein, 29 aa, Artificial Sequence
  Description of Artificial Sequence: Synthetic peptide
DEEEIRTTNPVATEQYGSVSTDDERNNQR

SEQ ID NO: 13564 - protein, 30 aa, Artificial Sequence
  Description of Artificial Sequence: Synthetic polypeptide
SEEEIRTTNPVATEQYGSVSSTENTQAGNR

SEQ ID NO: 13565 - protein, 30 aa, Artificial Sequence
  Description of Artificial Sequence: Synthetic polypeptide
DEEEIRTTNPVATEQYGSVSMNLDQNGDRM

SEQ ID NO: 13566 - protein, 29 aa, Artificial Sequence
  Description of Artificial Sequence: Synthetic peptide
SEEEIRTTNPVATEQYGSVSSNQDQLGNR

SEQ ID NO: 13567 - protein, 29 aa, Artificial Sequence
  Description of Artificial Sequence: Synthetic peptide
SEEEIRTTNPVATEQYGSVSSVNLQMGNG

SEQ ID NO: 13568 - protein, 29 aa, Artificial Sequence
  Description of Artificial Sequence: Synthetic peptide
SEEEIRTTNPVATEQYGSVSSNLQLDGNI

SEQ ID NO: 13569 - protein, 30 aa, Artificial Sequence
  Description of Artificial Sequence: Synthetic polypeptide
SEEEIRTTNPVATEQYGSVSTGNLQCRGDE

SEQ ID NO: 13570 - protein, 31 aa, Artificial Sequence
  Description of Artificial Sequence: Synthetic polypeptide
DEEEIRTTNPTATEQYGSVSTNLQEMGDNQR

SEQ ID NO: 13571 - protein, 29 aa, Artificial Sequence
  Description of Artificial Sequence: Synthetic peptide
SEEEIRTTNPVATEQYGSVSTNDQRGEDD

SEQ ID NO: 13572 - protein, 29 aa, Artificial Sequence
  Description of Artificial Sequence: Synthetic peptide
DEEEIRTTNPTATEQYGSVSTNLQMGDTQ

SEQ ID NO: 13573 - protein, 31 aa, Artificial Sequence
  Description of Artificial Sequence: Synthetic polypeptide
DEEEIRTTNPTATEQYGSVSTNLQMEGGNQR

SEQ ID NO: 13574 - protein, 30 aa, Artificial Sequence
  Description of Artificial Sequence: Synthetic polypeptide
SEEEIRTTNPVATEQYGSVSTNDDQFGNRS

SEQ ID NO: 13575 - protein, 30 aa, Artificial Sequence
  Description of Artificial Sequence: Synthetic polypeptide
AEEEIRTTNPVATEQYGSVSTTANLQSGNM

SEQ ID NO: 13576 - protein, 29 aa, Artificial Sequence
  Description of Artificial Sequence: Synthetic peptide
SEEEIRTTNPVATEQYGSVSTNAQDGNPI

SEQ ID NO: 13577 - protein, 30 aa, Artificial Sequence
  Description of Artificial Sequence: Synthetic polypeptide
SEEEIRTTNPVATEQYGSVSTMNNLQTGNV

SEQ ID NO: 13578 - protein, 29 aa, Artificial Sequence
  Description of Artificial Sequence: Synthetic peptide
DEEEIRTTNPVATEAYGSVSTSLSQGGNA

SEQ ID NO: 13579 - protein, 30 aa, Artificial Sequence
  Description of Artificial Sequence: Synthetic polypeptide
SEEEIRTTNPVATEQYGSVSTMNLTNGGNR

SEQ ID NO: 13580 - protein, 29 aa, Artificial Sequence
  Description of Artificial Sequence: Synthetic peptide
SEEEIRTTNPVATEQYGSVSTMLQDNGNE

SEQ ID NO: 13581 - protein, 32 aa, Artificial Sequence
  Description of Artificial Sequence: Synthetic polypeptide
SEEEIRTTNPVATEQYGSVSTLNLMQRGENDR

SEQ ID NO: 13582 - protein, 29 aa, Artificial Sequence
  Description of Artificial Sequence: Synthetic peptide
SEEEIRTTNPVATEQYGSVSTGSQNDGNR

SEQ ID NO: 13583 - protein, 29 aa, Artificial Sequence
  Description of Artificial Sequence: Synthetic peptide
SEEEIRTTNPVATEQYGSVSTGQQVQGNR

SEQ ID NO: 13584 - protein, 29 aa, Artificial Sequence
  Description of Artificial Sequence: Synthetic peptide
DEDEIRTTNPVATEQYGSVSTTNDGFGNR

SEQ ID NO: 13585 - protein, 31 aa, Artificial Sequence
  Description of Artificial Sequence: Synthetic polypeptide
DEEEIRTTNPTATEQYGSVSTNLQHQGGNDR

SEQ ID NO: 13586 - protein, 29 aa, Artificial Sequence
  Description of Artificial Sequence: Synthetic peptide
SVEEIRTTNPVATEQYGVVSTNLQDGNNR

SEQ ID NO: 13587 - protein, 29 aa, Artificial Sequence
  Description of Artificial Sequence: Synthetic peptide
SEEEIRTTNPVATEQYGSVSTMLQEVGNQ

SEQ ID NO: 13588 - protein, 28 aa, Artificial Sequence
  Description of Artificial Sequence: Synthetic peptide
STEEIRTTNPVATTQYGSVSTTLQRGND

SEQ ID NO: 13589 - protein, 28 aa, Artificial Sequence
  Description of Artificial Sequence: Synthetic peptide
DEECIRCTNPVATEQYGSVSANHQRGNL

SEQ ID NO: 13590 - protein, 31 aa, Artificial Sequence
  Description of Artificial Sequence: Synthetic polypeptide
DEEEIRTTNPVATEQYGSVSTDDLQGGNNIR

SEQ ID NO: 13591 - protein, 30 aa, Artificial Sequence
  Description of Artificial Sequence: Synthetic polypeptide
DEEEIRTTNPVATEQYGSVSRTNGEQRGKF

SEQ ID NO: 13592 - protein, 30 aa, Artificial Sequence
  Description of Artificial Sequence: Synthetic polypeptide
AEEEIRTTNPVATEQYGSVSTTLNLGQGNR

SEQ ID NO: 13593 - protein, 29 aa, Artificial Sequence
  Description of Artificial Sequence: Synthetic peptide
SEEEIRTTNPVATEQYGSVSENLMDHGNR

SEQ ID NO: 13594 - protein, 29 aa, Artificial Sequence
  Description of Artificial Sequence: Synthetic peptide
DEEEIRTTNPVATEQYGSVSTDDQDGNNE

SEQ ID NO: 13595 - protein, 29 aa, Artificial Sequence
  Description of Artificial Sequence: Synthetic peptide
DEEEIRTTNPVATEQYGSVSTDDQFGEQR

SEQ ID NO: 13596 - protein, 28 aa, Artificial Sequence
  Description of Artificial Sequence: Synthetic peptide
SEEEIRTTNPVATEQYGSVSENGNRGNV

SEQ ID NO: 13597 - protein, 29 aa, Artificial Sequence
  Description of Artificial Sequence: Synthetic peptide
DEEEIRTTNPVATEQYGSVSTDDQLGEMR

SEQ ID NO: 13598 - protein, 29 aa, Artificial Sequence
  Description of Artificial Sequence: Synthetic peptide
SEEEIRTTNPVATEQYGSVSENLQNVGNE

SEQ ID NO: 13599 - protein, 29 aa, Artificial Sequence
  Description of Artificial Sequence: Synthetic peptide
SEEEIRTTNPVATEQYGSVSENGMRGMNR

SEQ ID NO: 13600 - protein, 28 aa, Artificial Sequence
  Description of Artificial Sequence: Synthetic peptide
DEECIRCTNPVATEQYGSVSDNGQRGNV

SEQ ID NO: 13601 - protein, 30 aa, Artificial Sequence
  Description of Artificial Sequence: Synthetic polypeptide
AEEEIRTTNPVATEQYGSVSTTLPQNGENR

SEQ ID NO: 13602 - protein, 28 aa, Artificial Sequence
  Description of Artificial Sequence: Synthetic peptide
AEEEIRTTNPVATEQYGAVSTNLGIGNN

SEQ ID NO: 13603 - protein, 31 aa, Artificial Sequence
  Description of Artificial Sequence: Synthetic polypeptide
AEEEIRTTNPVATEQYGASVSTNLQNGGNRM

SEQ ID NO: 13604 - protein, 29 aa, Artificial Sequence
  Description of Artificial Sequence: Synthetic peptide
AEEEIRTTNPVATEQYGSVSTTLQANNSR

SEQ ID NO: 13605 - protein, 29 aa, Artificial Sequence
  Description of Artificial Sequence: Synthetic peptide
AEEEIRTTNPVATEQWGSVATNLQRGNSA

SEQ ID NO: 13606 - protein, 29 aa, Artificial Sequence
  Description of Artificial Sequence: Synthetic peptide
AEEEIRTTNPVATEQWGSVATNLQRGNET

SEQ ID NO: 13607 - protein, 30 aa, Artificial Sequence
  Description of Artificial Sequence: Synthetic polypeptide
DEEEIRTTNPVATEQYGSVSMNLQPRGEEY

SEQ ID NO: 13608 - protein, 28 aa, Artificial Sequence
  Description of Artificial Sequence: Synthetic peptide
DEEEIRTTNPTATEQYGSVSHNIFRGND

SEQ ID NO: 13609 - protein, 29 aa, Artificial Sequence
  Description of Artificial Sequence: Synthetic peptide
SEEEIRTTNPVATEQYGSVSENLVMRGND

SEQ ID NO: 13610 - protein, 31 aa, Artificial Sequence
  Description of Artificial Sequence: Synthetic polypeptide
DEEEIRTTNPVATEAYGSVSTVNLSGRGNRY

SEQ ID NO: 13611 - protein, 31 aa, Artificial Sequence
  Description of Artificial Sequence: Synthetic polypeptide
DEEEIRTTNPVATEQYGSVSTDDLQIGDNLR

SEQ ID NO: 13612 - protein, 30 aa, Artificial Sequence
  Description of Artificial Sequence: Synthetic polypeptide
DEEEIRTTNPVATEQYGSVSTDDLQRDVDR

SEQ ID NO: 13613 - protein, 31 aa, Artificial Sequence
  Description of Artificial Sequence: Synthetic polypeptide
SEEEIRTTNPVATEQYGSVSNTNLQLGGANR

SEQ ID NO: 13614 - protein, 30 aa, Artificial Sequence
  Description of Artificial Sequence: Synthetic polypeptide
SEEEIRTTNPVATEQYGSVSNTNLQGNGNL

SEQ ID NO: 13615 - protein, 31 aa, Artificial Sequence
  Description of Artificial Sequence: Synthetic polypeptide
DEEEIRTTNPVATEQYGSVSTDDLSRGNERN

SEQ ID NO: 13616 - protein, 29 aa, Artificial Sequence
  Description of Artificial Sequence: Synthetic peptide
SEEEIRTTNPVATEQYGSVSNNLQPGNQA

SEQ ID NO: 13617 - protein, 30 aa, Artificial Sequence
  Description of Artificial Sequence: Synthetic polypeptide
DEDEIRTTNPVATEQYGSVSTTNLQGGNGS

SEQ ID NO: 13618 - protein, 29 aa, Artificial Sequence
  Description of Artificial Sequence: Synthetic peptide
DEEEIRTTNPVATEQYGSVSSDLQFEDNR

SEQ ID NO: 13619 - protein, 29 aa, Artificial Sequence
  Description of Artificial Sequence: Synthetic peptide
SEEEIRTTNPVATEQYGSVSGNLQLGNVM

SEQ ID NO: 13620 - protein, 29 aa, Artificial Sequence
  Description of Artificial Sequence: Synthetic peptide
TEAEIRTTNPVATEQYGSVSCTNLQGGNK

SEQ ID NO: 13621 - protein, 31 aa, Artificial Sequence
  Description of Artificial Sequence: Synthetic polypeptide
SEEEIRTTNPVATEQYGSVSETNLQAGGGNR

SEQ ID NO: 13622 - protein, 30 aa, Artificial Sequence
  Description of Artificial Sequence: Synthetic polypeptide
SEEEIRTTNPVATEQYGSVSETNLNQTGNM

SEQ ID NO: 13623 - protein, 30 aa, Artificial Sequence
  Description of Artificial Sequence: Synthetic polypeptide
DEEEIRTTNPVATEQYGSVSMNLERGNTQN

SEQ ID NO: 13624 - protein, 29 aa, Artificial Sequence
  Description of Artificial Sequence: Synthetic peptide
DEEEIRTTNPVATEQYGSVSMNLNQRVVE

SEQ ID NO: 13625 - protein, 29 aa, Artificial Sequence
  Description of Artificial Sequence: Synthetic peptide
TEAEIRTTNPVATESYGSVSTNLSQRGNH

SEQ ID NO: 13626 - protein, 30 aa, Artificial Sequence
  Description of Artificial Sequence: Synthetic polypeptide
DEEEIRTTNPVATEAYGSVSTVLQRGNNFD

SEQ ID NO: 13627 - protein, 30 aa, Artificial Sequence
  Description of Artificial Sequence: Synthetic polypeptide
DEEEIRTTNPVATEQYGSVSMNLDRGGDNL

SEQ ID NO: 13628 - protein, 30 aa, Artificial Sequence
  Description of Artificial Sequence: Synthetic polypeptide
AEEEIRTTNPVATEQYGLVSTNLQRGSNAP

SEQ ID NO: 13629 - protein, 29 aa, Artificial Sequence
  Description of Artificial Sequence: Synthetic peptide
SEEEIRTTNPVATEQYGTVSTNLVEFGNR

SEQ ID NO: 13630 - protein, 29 aa, Artificial Sequence
  Description of Artificial Sequence: Synthetic peptide
AEEEIRTTNPVATEQYGNVSTNLQMGGNP

SEQ ID NO: 13631 - protein, 30 aa, Artificial Sequence
  Description of Artificial Sequence: Synthetic polypeptide
DEEEIRTTNPVATEQYGSVSTALQGDGNVI

SEQ ID NO: 13632 - protein, 29 aa, Artificial Sequence
  Description of Artificial Sequence: Synthetic peptide
DEEEIRTTNPVATEQYGSVSTALQHRTDQ

SEQ ID NO: 13633 - protein, 30 aa, Artificial Sequence
  Description of Artificial Sequence: Synthetic polypeptide
AEEEIRTTNPVATEQYGSVGTNLQEGGNIR

SEQ ID NO: 13634 - protein, 30 aa, Artificial Sequence
  Description of Artificial Sequence: Synthetic polypeptide
DEEEIRTTNPVATEQYGSVSMDNLEQRVND

SEQ ID NO: 13635 - protein, 30 aa, Artificial Sequence
  Description of Artificial Sequence: Synthetic polypeptide
DEEEIRTTNPVATEQYGSVSTALQIVGNIP

SEQ ID NO: 13636 - protein, 30 aa, Artificial Sequence
  Description of Artificial Sequence: Synthetic polypeptide
AEEEIRTTNPVATEQYGSVSTNNQNSGNRN

SEQ ID NO: 13637 - protein, 30 aa, Artificial Sequence
  Description of Artificial Sequence: Synthetic polypeptide
AEEEIRTTNPVATEQYGSVETNNLQDEGNR

SEQ ID NO: 13638 - protein, 30 aa, Artificial Sequence
  Description of Artificial Sequence: Synthetic polypeptide
AEEEIRTTNPVATEQYGSVETNLQTEGVNR

SEQ ID NO: 13639 - protein, 29 aa, Artificial Sequence
  Description of Artificial Sequence: Synthetic peptide
SEEEIRTTNPVAYEEYGSVSTNLQRGMNG

SEQ ID NO: 13640 - protein, 31 aa, Artificial Sequence
  Description of Artificial Sequence: Synthetic polypeptide
DEEEIRTTNPVATEQYGSVSTALQNRGSNQM

SEQ ID NO: 13641 - protein, 30 aa, Artificial Sequence
  Description of Artificial Sequence: Synthetic polypeptide
AEEEIRTTNPVATEQYGSVETNLQQTGNRE

SEQ ID NO: 13642 - protein, 30 aa, Artificial Sequence
  Description of Artificial Sequence: Synthetic polypeptide
AEEEIRTTNPVATEQYGSVETNLQQGGLNR

SEQ ID NO: 13643 - protein, 28 aa, Artificial Sequence
  Description of Artificial Sequence: Synthetic peptide
AEEEIRTTNPVATEQYGSVETILQVGND

SEQ ID NO: 13644 - protein, 29 aa, Artificial Sequence
  Description of Artificial Sequence: Synthetic peptide
AEEEIRTTNPVATEQYGSVESTNLQYGEA

SEQ ID NO: 13645 - protein, 30 aa, Artificial Sequence
  Description of Artificial Sequence: Synthetic polypeptide
AEEEIRTTNPVATEQYGSVESTNLQVGNDT

SEQ ID NO: 13646 - protein, 30 aa, Artificial Sequence
  Description of Artificial Sequence: Synthetic polypeptide
AEEEIRTTNPVATEQYGSVGTNLQGTAGNR

SEQ ID NO: 13647 - protein, 30 aa, Artificial Sequence
  Description of Artificial Sequence: Synthetic polypeptide
AEEEIRTTNPVATEQYGSVSTNNQLQGNRN

SEQ ID NO: 13648 - protein, 29 aa, Artificial Sequence
  Description of Artificial Sequence: Synthetic peptide
AEEEIRTTNPVATEQYGSVGTNLQGTDNR

SEQ ID NO: 13649 - protein, 30 aa, Artificial Sequence
  Description of Artificial Sequence: Synthetic polypeptide
DEEEIRTTNPVATEQYGSVSTALQFGNGSE

SEQ ID NO: 13650 - protein, 30 aa, Artificial Sequence
  Description of Artificial Sequence: Synthetic polypeptide
AEEEIRTTNPVATEQYGSVSTNNNQRGNSA

SEQ ID NO: 13651 - protein, 30 aa, Artificial Sequence
  Description of Artificial Sequence: Synthetic polypeptide
DEEEIRTTNPVATEQYGSVSTALQDGDNGV

SEQ ID NO: 13652 - protein, 30 aa, Artificial Sequence
  Description of Artificial Sequence: Synthetic polypeptide
AEEEIRTTNPVATEQYGSVNSTNLQAQGNP

SEQ ID NO: 13653 - protein, 29 aa, Artificial Sequence
  Description of Artificial Sequence: Synthetic peptide
AEEEIRTTNPVATEQYGSVSTNNNVGNFR

SEQ ID NO: 13654 - protein, 30 aa, Artificial Sequence
  Description of Artificial Sequence: Synthetic polypeptide
AEEEIRTTNPVATEQYGSVNSTNELQFGNG

SEQ ID NO: 13655 - protein, 30 aa, Artificial Sequence
  Description of Artificial Sequence: Synthetic polypeptide
AEEEIRTTNPVATEQYGSVNSTGLQDGNNR

SEQ ID NO: 13656 - protein, 30 aa, Artificial Sequence
  Description of Artificial Sequence: Synthetic polypeptide
AEEEIRTTNPVATEQYGSVNSTELQMGNER

SEQ ID NO: 13657 - protein, 29 aa, Artificial Sequence
  Description of Artificial Sequence: Synthetic peptide
AEEEIRTTNPVATEQYGSVSTNNQQTGNL

SEQ ID NO: 13658 - protein, 30 aa, Artificial Sequence
  Description of Artificial Sequence: Synthetic polypeptide
DEEEIRTTNPVATEQYGSVSTALQDGGNNN

SEQ ID NO: 13659 - protein, 30 aa, Artificial Sequence
  Description of Artificial Sequence: Synthetic polypeptide
AEEEIRTTNPVATEQYGSVSTNNQEGNLRN

SEQ ID NO: 13660 - protein, 30 aa, Artificial Sequence
  Description of Artificial Sequence: Synthetic polypeptide
DEEEIRTTNPVATEQYGSVSTALQDNGNEE

SEQ ID NO: 13661 - protein, 29 aa, Artificial Sequence
  Description of Artificial Sequence: Synthetic peptide
AEEEIRTTNPVATEQYGSVNATNLQAGNG

SEQ ID NO: 13662 - protein, 28 aa, Artificial Sequence
  Description of Artificial Sequence: Synthetic peptide
AEEEIRTTNPVATEQYGSVMTNLQPQND

SEQ ID NO: 13663 - protein, 28 aa, Artificial Sequence
  Description of Artificial Sequence: Synthetic peptide
AEEEIRTTNPVATEQYGSVMTEEQSGNR

SEQ ID NO: 13664 - protein, 30 aa, Artificial Sequence
  Description of Artificial Sequence: Synthetic polypeptide
DEEEIRTTNPVATEQYGSVSTALQERDNEN

SEQ ID NO: 13665 - protein, 30 aa, Artificial Sequence
  Description of Artificial Sequence: Synthetic polypeptide
DEEEIRTTNPVATEQYGSVSTALQERGSVG

SEQ ID NO: 13666 - protein, 29 aa, Artificial Sequence
  Description of Artificial Sequence: Synthetic peptide
AEEEIRTTNPVATEQYGSVSTNNQDEGNL

SEQ ID NO: 13667 - protein, 31 aa, Artificial Sequence
  Description of Artificial Sequence: Synthetic polypeptide
AEEEIRTTNPVATEQYGSVESTNLQREGEND

SEQ ID NO: 13668 - protein, 30 aa, Artificial Sequence
  Description of Artificial Sequence: Synthetic polypeptide
AEEEIRTTNPVATEQYGSVESTNLQLNGIR

SEQ ID NO: 13669 - protein, 29 aa, Artificial Sequence
  Description of Artificial Sequence: Synthetic peptide
AEEEIRTTNPVATEQYGSVESTNLQFGGN

SEQ ID NO: 13670 - protein, 30 aa, Artificial Sequence
  Description of Artificial Sequence: Synthetic polypeptide
AEEEIRTTNPVATEQYGSVSTNPLQVQANR

SEQ ID NO: 13671 - protein, 28 aa, Artificial Sequence
  Description of Artificial Sequence: Synthetic peptide
SEEEIRTTNPVATEYYGEVSTNLQRIER

SEQ ID NO: 13672 - protein, 28 aa, Artificial Sequence
  Description of Artificial Sequence: Synthetic peptide
SQEEIRTTNPVATEQWGAVSTNLQVGNR

SEQ ID NO: 13673 - protein, 29 aa, Artificial Sequence
  Description of Artificial Sequence: Synthetic peptide
SEEEIRTTNPVATETYGSVSTNLQVGNQM

SEQ ID NO: 13674 - protein, 31 aa, Artificial Sequence
  Description of Artificial Sequence: Synthetic polypeptide
DEEEIRTTNPVATEQYGSVSMDNLQRGSIIR

SEQ ID NO: 13675 - protein, 28 aa, Artificial Sequence
  Description of Artificial Sequence: Synthetic peptide
AEEEIRTTNPVATEQYGSVSTNPQNGTL

SEQ ID NO: 13676 - protein, 30 aa, Artificial Sequence
  Description of Artificial Sequence: Synthetic polypeptide
DEDEIRTTNPVATEQYGSVSTNLQGTGEMR

SEQ ID NO: 13677 - protein, 30 aa, Artificial Sequence
  Description of Artificial Sequence: Synthetic polypeptide
AEEEIRTTNPVATEQYGSVSTNPIQGGNQR

SEQ ID NO: 13678 - protein, 30 aa, Artificial Sequence
  Description of Artificial Sequence: Synthetic polypeptide
DEDEIRTTNPVATEQYGSVSTNLQHAGEDR

SEQ ID NO: 13679 - protein, 30 aa, Artificial Sequence
  Description of Artificial Sequence: Synthetic polypeptide
AEEEIRTTNPVATEQYGSVSTNQAQEEGNR

SEQ ID NO: 13680 - protein, 30 aa, Artificial Sequence
  Description of Artificial Sequence: Synthetic polypeptide
DEEEIRTTNPVATEQYGSVSTALQQQGIND

SEQ ID NO: 13681 - protein, 30 aa, Artificial Sequence
  Description of Artificial Sequence: Synthetic polypeptide
AEEEIRTTNPVATEQYGSVSTNQEQNGTNR

SEQ ID NO: 13682 - protein, 30 aa, Artificial Sequence
  Description of Artificial Sequence: Synthetic polypeptide
AEEEIRTTNPVATEQYGSVSTNQERGNQRD

SEQ ID NO: 13683 - protein, 29 aa, Artificial Sequence
  Description of Artificial Sequence: Synthetic peptide
DEDEIRTTNPVATEAYGSVSTNLQQGDRD

SEQ ID NO: 13684 - protein, 31 aa, Artificial Sequence
  Description of Artificial Sequence: Synthetic polypeptide
AEEEIRTTNPVATEQYGSVSTNQLEQNNGNR

SEQ ID NO: 13685 - protein, 30 aa, Artificial Sequence
  Description of Artificial Sequence: Synthetic polypeptide
DEDEIRTTNPVATEQYGSVSTNLQKDGNDG

SEQ ID NO: 13686 - protein, 30 aa, Artificial Sequence
  Description of Artificial Sequence: Synthetic polypeptide
DEDEIRTTNPVATEQYGSVSTNLQHNGNDE

SEQ ID NO: 13687 - protein, 30 aa, Artificial Sequence
  Description of Artificial Sequence: Synthetic polypeptide
AEEEIRTTNPVATEQYGSVSTNNNQREGNG

SEQ ID NO: 13688 - protein, 29 aa, Artificial Sequence
  Description of Artificial Sequence: Synthetic peptide
AEEEIRTTNPVATEQYGSVSTNPIQDGIR

SEQ ID NO: 13689 - protein, 29 aa, Artificial Sequence
  Description of Artificial Sequence: Synthetic peptide
DEEEIRTTNPVATEQYGSVSLNLQNNDSR

SEQ ID NO: 13690 - protein, 29 aa, Artificial Sequence
  Description of Artificial Sequence: Synthetic peptide
AEEEIRTTNPVATEQYGSVSTNNQRINVD

SEQ ID NO: 13691 - protein, 31 aa, Artificial Sequence
  Description of Artificial Sequence: Synthetic polypeptide
AEEEIRTTNPVATEQYGSVESTNLQAGGTNR

SEQ ID NO: 13692 - protein, 30 aa, Artificial Sequence
  Description of Artificial Sequence: Synthetic polypeptide
AEEEIRTTNPVATEQYGSVESTNLGAGNLR

SEQ ID NO: 13693 - protein, 29 aa, Artificial Sequence
  Description of Artificial Sequence: Synthetic peptide
SEEEIRTTNPVATEYYGSVSTNVQGDGNR

SEQ ID NO: 13694 - protein, 29 aa, Artificial Sequence
  Description of Artificial Sequence: Synthetic peptide
AEEEIRTTNPVATEQYGSVENNLQPSGNR

SEQ ID NO: 13695 - protein, 30 aa, Artificial Sequence
  Description of Artificial Sequence: Synthetic polypeptide
DEEEIRTTNPVATEQYGSVSTALQQFNNYR

SEQ ID NO: 13696 - protein, 29 aa, Artificial Sequence
  Description of Artificial Sequence: Synthetic peptide
AEEEIRTTNPVATEQYGSVDTNLQGQSNR

SEQ ID NO: 13697 - protein, 30 aa, Artificial Sequence
  Description of Artificial Sequence: Synthetic polypeptide
AEEEIRTTNPVATEQYGSVCSTNDNQNGNR

SEQ ID NO: 13698 - protein, 29 aa, Artificial Sequence
  Description of Artificial Sequence: Synthetic peptide
AEEEIRTTNPVATEQYGSVSTNNSDSGNR

SEQ ID NO: 13699 - protein, 29 aa, Artificial Sequence
  Description of Artificial Sequence: Synthetic peptide
AEEEIRTTNPVATEQYGSVSTNNSEGNDR

SEQ ID NO: 13700 - protein, 30 aa, Artificial Sequence
  Description of Artificial Sequence: Synthetic polypeptide
AEEEIRTTNPVATEQYGSVCTNLQRGNNIN

SEQ ID NO: 13701 - protein, 28 aa, Artificial Sequence
  Description of Artificial Sequence: Synthetic peptide
AEEEIRTTNPVATEQYGSVCTALQNGFR

SEQ ID NO: 13702 - protein, 30 aa, Artificial Sequence
  Description of Artificial Sequence: Synthetic polypeptide
AEEEIRTTNPVATEQYGSVCSTNLQQGEER

SEQ ID NO: 13703 - protein, 31 aa, Artificial Sequence
  Description of Artificial Sequence: Synthetic polypeptide
AEEEIRTTNPVATEQYGSVCSTNLQLTGVNR

SEQ ID NO: 13704 - protein, 31 aa, Artificial Sequence
  Description of Artificial Sequence: Synthetic polypeptide
DEEEIRTTNPVATEAYGSVSCANLSQRVGNR

SEQ ID NO: 13705 - protein, 29 aa, Artificial Sequence
  Description of Artificial Sequence: Synthetic peptide
AEEEIRTTNPVATEQYGSVSTNNTQFGDR

SEQ ID NO: 13706 - protein, 30 aa, Artificial Sequence
  Description of Artificial Sequence: Synthetic polypeptide
AEEEIRTTNPVATEQYGSVCTNLQRGNVAT

SEQ ID NO: 13707 - protein, 30 aa, Artificial Sequence
  Description of Artificial Sequence: Synthetic polypeptide
DEEEIRTTNPVATEQYGSVSTALQAQGENA

SEQ ID NO: 13708 - protein, 30 aa, Artificial Sequence
  Description of Artificial Sequence: Synthetic polypeptide
AEEEIRTTNPVATEQYGSVSTNNNQQRGNT

SEQ ID NO: 13709 - protein, 31 aa, Artificial Sequence
  Description of Artificial Sequence: Synthetic polypeptide
DEDEIRTTNPVATEQYGSVSTNLQGEGNDQR

SEQ ID NO: 13710 - protein, 31 aa, Artificial Sequence
  Description of Artificial Sequence: Synthetic polypeptide
DEEEIRTTNPVATEQYGSVSSTWLQQRSENR

SEQ ID NO: 13711 - protein, 30 aa, Artificial Sequence
  Description of Artificial Sequence: Synthetic polypeptide
AEEEIRTTNPVATEQYGSVSAENLQRGNNP

SEQ ID NO: 13712 - protein, 31 aa, Artificial Sequence
  Description of Artificial Sequence: Synthetic polypeptide
SEEEVRTTNPVATEQYGSVSTANLDQRTGNR

SEQ ID NO: 13713 - protein, 29 aa, Artificial Sequence
  Description of Artificial Sequence: Synthetic peptide
AEEEIRTTNPVATEQYGSVSAALQSGNNR

SEQ ID NO: 13714 - protein, 28 aa, Artificial Sequence
  Description of Artificial Sequence: Synthetic peptide
SEEEVRCTNPVATEQYGSVSETLQRGNR

SEQ ID NO: 13715 - protein, 28 aa, Artificial Sequence
  Description of Artificial Sequence: Synthetic peptide
SEEEVRCTNPVATEQYGSVSENLMRGNR

SEQ ID NO: 13716 - protein, 31 aa, Artificial Sequence
  Description of Artificial Sequence: Synthetic polypeptide
DEEEIRTTNPVATEQYGSVSSTYNYQRGEDR

SEQ ID NO: 13717 - protein, 30 aa, Artificial Sequence
  Description of Artificial Sequence: Synthetic polypeptide
DEDEIRTTNPVATEQYGSVSTNLQAQGNEG

SEQ ID NO: 13718 - protein, 30 aa, Artificial Sequence
  Description of Artificial Sequence: Synthetic polypeptide
AEEEIRTTNPVATEQYGSVQTNLQVLGGNR

SEQ ID NO: 13719 - protein, 31 aa, Artificial Sequence
  Description of Artificial Sequence: Synthetic polypeptide
DEEEIRTTNPVATEQYGSVSLNLQRTGNEFV

SEQ ID NO: 13720 - protein, 31 aa, Artificial Sequence
  Description of Artificial Sequence: Synthetic polypeptide
DEEEIRTTNPVATEQYGSVSLNLQRSLENRV

SEQ ID NO: 13721 - protein, 31 aa, Artificial Sequence
  Description of Artificial Sequence: Synthetic polypeptide
AEEEIRTTNPVATEQYGSVQSTNLQQGDNIR

SEQ ID NO: 13722 - protein, 31 aa, Artificial Sequence
  Description of Artificial Sequence: Synthetic polypeptide
AEEEIRTTNPVATEQYGSVQSTNLQNNGENR

SEQ ID NO: 13723 - protein, 30 aa, Artificial Sequence
  Description of Artificial Sequence: Synthetic polypeptide
AEEEIRTTNPVATEQYGSVQSTNLQNIGNG

SEQ ID NO: 13724 - protein, 29 aa, Artificial Sequence
  Description of Artificial Sequence: Synthetic peptide
SNEEIRTTNPVATEQYGVVSTNLQSGPNR

SEQ ID NO: 13725 - protein, 28 aa, Artificial Sequence
  Description of Artificial Sequence: Synthetic peptide
SNEEIRTTNPVATHQYGSVSTYLQRGNE

SEQ ID NO: 13726 - protein, 30 aa, Artificial Sequence
  Description of Artificial Sequence: Synthetic polypeptide
AEEEIRTTNPVATEQYGSVQTNLQPTQGNR

SEQ ID NO: 13727 - protein, 32 aa, Artificial Sequence
  Description of Artificial Sequence: Synthetic polypeptide
DEEEIRTTNPVATEAYGSVPSCTNELQRGNRT

SEQ ID NO: 13728 - protein, 31 aa, Artificial Sequence
  Description of Artificial Sequence: Synthetic polypeptide
DEEEIRTTNPVATEQYGSVSSTWLDQRSENR

SEQ ID NO: 13729 - protein, 30 aa, Artificial Sequence
  Description of Artificial Sequence: Synthetic polypeptide
DEEEIRTTNPVATEQYGSVSSTVLQIGNSD

SEQ ID NO: 13730 - protein, 30 aa, Artificial Sequence
  Description of Artificial Sequence: Synthetic polypeptide
DEDEIRTTNPVATEQYGSVSTNLPHEGENR

SEQ ID NO: 13731 - protein, 31 aa, Artificial Sequence
  Description of Artificial Sequence: Synthetic polypeptide
AEEEIRTTNPVATEQYGSVSTNNLQRGNISE

SEQ ID NO: 13732 - protein, 31 aa, Artificial Sequence
  Description of Artificial Sequence: Synthetic polypeptide
AEEEIRTTNPVATEQYGSVSATNLQIGENLR

SEQ ID NO: 13733 - protein, 31 aa, Artificial Sequence
  Description of Artificial Sequence: Synthetic polypeptide
AEEEIRTTNPVATEQYGSVSTNNLQRGNVDG

SEQ ID NO: 13734 - protein, 31 aa, Artificial Sequence
  Description of Artificial Sequence: Synthetic polypeptide
AEEEIRTTNPVATEQYGSVSTNNLQRGNVEV

SEQ ID NO: 13735 - protein, 31 aa, Artificial Sequence
  Description of Artificial Sequence: Synthetic polypeptide
AEEEIRTTNPVATEQYGSVSATNLQAGENNR

SEQ ID NO: 13736 - protein, 29 aa, Artificial Sequence
  Description of Artificial Sequence: Synthetic peptide
DEDEIRTTNPVATEGYGSVSTNLQGGNSL

SEQ ID NO: 13737 - protein, 30 aa, Artificial Sequence
  Description of Artificial Sequence: Synthetic polypeptide
AEEEIRTTNPVATEQYGSVSANLQLNGNRS

SEQ ID NO: 13738 - protein, 30 aa, Artificial Sequence
  Description of Artificial Sequence: Synthetic polypeptide
DEEEIRTTNPVATEQYGSVSLNLSQEGGTR

SEQ ID NO: 13739 - protein, 29 aa, Artificial Sequence
  Description of Artificial Sequence: Synthetic peptide
AEEEIRTTNPVATEQYGSVSATLQIGSNR

SEQ ID NO: 13740 - protein, 30 aa, Artificial Sequence
  Description of Artificial Sequence: Synthetic polypeptide
DEDEIRTTNPVATEQYGSVSTNLQADGEGR

SEQ ID NO: 13741 - protein, 28 aa, Artificial Sequence
  Description of Artificial Sequence: Synthetic peptide
DEDEIRTTNPVATEGYGSVSNNLQRGTW

SEQ ID NO: 13742 - protein, 30 aa, Artificial Sequence
  Description of Artificial Sequence: Synthetic polypeptide
DEDEIRTTNPVATEQYGSVSTNLQAGHNQQ

SEQ ID NO: 13743 - protein, 29 aa, Artificial Sequence
  Description of Artificial Sequence: Synthetic peptide
AEEEIRTTNPVATEQYGSVSANLQRGVGA

SEQ ID NO: 13744 - protein, 31 aa, Artificial Sequence
  Description of Artificial Sequence: Synthetic polypeptide
SEEEVRTTNPVATEQYGSVSTTNLDQRIGNR

SEQ ID NO: 13745 - protein, 29 aa, Artificial Sequence
  Description of Artificial Sequence: Synthetic peptide
AEEEIRTTNPVATEQYGSVSANLQRGELN

SEQ ID NO: 13746 - protein, 28 aa, Artificial Sequence
  Description of Artificial Sequence: Synthetic peptide
SEEGIRTTNPVATEQYGSVSTNLSMDNR

SEQ ID NO: 13747 - protein, 30 aa, Artificial Sequence
  Description of Artificial Sequence: Synthetic polypeptide
DEEEIRTTNPVATEAYGSVSCTGNLQPVNR

SEQ ID NO: 13748 - protein, 30 aa, Artificial Sequence
  Description of Artificial Sequence: Synthetic polypeptide
DEDEIRTTNPVATEQYGSVSTNLQDAGNHT

SEQ ID NO: 13749 - protein, 29 aa, Artificial Sequence
  Description of Artificial Sequence: Synthetic peptide
AEEEIRTTNPVATEQYGSVNVTNLQQFNR

SEQ ID NO: 13750 - protein, 29 aa, Artificial Sequence
  Description of Artificial Sequence: Synthetic peptide
AEEEIRTTNPVATEQYGSVNTNLQREVER

SEQ ID NO: 13751 - protein, 29 aa, Artificial Sequence
  Description of Artificial Sequence: Synthetic peptide
AEEEIRTTNPVATEQYGSVNTNLQQEGNN

SEQ ID NO: 13752 - protein, 30 aa, Artificial Sequence
  Description of Artificial Sequence: Synthetic polypeptide
AEEEIRTTNPVATEQYGSVNTNLQPEGQNR

SEQ ID NO: 13753 - protein, 31 aa, Artificial Sequence
  Description of Artificial Sequence: Synthetic polypeptide
DEEEIRTTNPVATEQYGSVSLNLQRGLENEM

SEQ ID NO: 13754 - protein, 30 aa, Artificial Sequence
  Description of Artificial Sequence: Synthetic polypeptide
AEEEIRTTNPVATEQYGSVNTNLQFEGNRE

SEQ ID NO: 13755 - protein, 30 aa, Artificial Sequence
  Description of Artificial Sequence: Synthetic polypeptide
DEDEIRTTNPVATECYGSVSTGNMQRGENR

SEQ ID NO: 13756 - protein, 29 aa, Artificial Sequence
  Description of Artificial Sequence: Synthetic peptide
DEEEIRTTNPVATEQYGSVSTAHQGGNQM

SEQ ID NO: 13757 - protein, 30 aa, Artificial Sequence
  Description of Artificial Sequence: Synthetic polypeptide
AEEEIRTTNPVATEQYGSVNTNLQYGGNAR

SEQ ID NO: 13758 - protein, 30 aa, Artificial Sequence
  Description of Artificial Sequence: Synthetic polypeptide
DEDEIRTTNPVATEQYGSVSTNLQGDNNRN

SEQ ID NO: 13759 - protein, 30 aa, Artificial Sequence
  Description of Artificial Sequence: Synthetic polypeptide
DEEEIRTTNPVATEQYGSVSTALELRGDRM

SEQ ID NO: 13760 - protein, 29 aa, Artificial Sequence
  Description of Artificial Sequence: Synthetic peptide
DEEEIRTTNPVATEQYGSVSTALERNSER

SEQ ID NO: 13761 - protein, 30 aa, Artificial Sequence
  Description of Artificial Sequence: Synthetic polypeptide
DEEEIRTTNPVATEQYGSVSTALHQSRNNE

SEQ ID NO: 13762 - protein, 30 aa, Artificial Sequence
  Description of Artificial Sequence: Synthetic polypeptide
DEEEIRTTNPVATEQYGSVSTALHRGEQRE

SEQ ID NO: 13763 - protein, 31 aa, Artificial Sequence
  Description of Artificial Sequence: Synthetic polypeptide
AEEEIRTTNPVATEQYGSVNSTNNNLQRGNV

SEQ ID NO: 13764 - protein, 30 aa, Artificial Sequence
  Description of Artificial Sequence: Synthetic polypeptide
AEEEIRTTNPVATEQYGSVNSTNLQVGNGG

SEQ ID NO: 13765 - protein, 31 aa, Artificial Sequence
  Description of Artificial Sequence: Synthetic polypeptide
AEEEIRTTNPVATEQYGSVNSTNLQRNGINT

SEQ ID NO: 13766 - protein, 32 aa, Artificial Sequence
  Description of Artificial Sequence: Synthetic polypeptide
DEEEIRTTNPVATEQYGSVSTALDQRSGNERN

SEQ ID NO: 13767 - protein, 30 aa, Artificial Sequence
  Description of Artificial Sequence: Synthetic polypeptide
DEDEIRTTNPVATEQYGSVSTNLQDAGNTE

SEQ ID NO: 13768 - protein, 29 aa, Artificial Sequence
  Description of Artificial Sequence: Synthetic peptide
AEEEIRTTNPVATEQYGSVNTNTQMGNER

SEQ ID NO: 13769 - protein, 31 aa, Artificial Sequence
  Description of Artificial Sequence: Synthetic polypeptide
DEDEIRTTNPVATEQYGSVSTNLQGDGDNAR

SEQ ID NO: 13770 - protein, 29 aa, Artificial Sequence
  Description of Artificial Sequence: Synthetic peptide
DEEEIRTTNPVATEQYGSVSLNLQRNEME

SEQ ID NO: 13771 - protein, 30 aa, Artificial Sequence
  Description of Artificial Sequence: Synthetic polypeptide
DEDEIRTTNPVATEQYGSVSTNLQDDGNHS

SEQ ID NO: 13772 - protein, 31 aa, Artificial Sequence
  Description of Artificial Sequence: Synthetic polypeptide
DEEEIRTTNPVATEQYGSVSSVNLQRGSEIR

SEQ ID NO: 13773 - protein, 28 aa, Artificial Sequence
  Description of Artificial Sequence: Synthetic peptide
DEEEIRTTNPVATEQYGSVSSWLQGGDV

SEQ ID NO: 13774 - protein, 29 aa, Artificial Sequence
  Description of Artificial Sequence: Synthetic peptide
AEEEIRTTNPVATEQYGSVNTTNLQAGNG

SEQ ID NO: 13775 - protein, 28 aa, Artificial Sequence
  Description of Artificial Sequence: Synthetic peptide
DEDEIRTTNPVATEFYGSVSTNDGRGNE

SEQ ID NO: 13776 - protein, 30 aa, Artificial Sequence
  Description of Artificial Sequence: Synthetic polypeptide
DEEEIRTTNPVATEQYGSVSTADDQGRGER

SEQ ID NO: 13777 - protein, 30 aa, Artificial Sequence
  Description of Artificial Sequence: Synthetic polypeptide
DEDEIRTTNPVATECYGSVSTNNQRDGGNR

SEQ ID NO: 13778 - protein, 30 aa, Artificial Sequence
  Description of Artificial Sequence: Synthetic polypeptide
DEDEIRTTNPVATEEYGSVSTNLQRGNGMD

SEQ ID NO: 13779 - protein, 30 aa, Artificial Sequence
  Description of Artificial Sequence: Synthetic polypeptide
DEDEIRTTNPVATEQYGSVSTNLQDHGNVQ

SEQ ID NO: 13780 - protein, 31 aa, Artificial Sequence
  Description of Artificial Sequence: Synthetic polypeptide
DEDEIRTTNPVATEQYGSVSTNLQDNGNNDR

SEQ ID NO: 13781 - protein, 30 aa, Artificial Sequence
  Description of Artificial Sequence: Synthetic polypeptide
DEDEIRTTNPVATEQYGSVSTNLQERGDTA

SEQ ID NO: 13782 - protein, 31 aa, Artificial Sequence
  Description of Artificial Sequence: Synthetic polypeptide
DEEEIRTTNPVATEQYGSVSTAELQQIGSNR

SEQ ID NO: 13783 - protein, 30 aa, Artificial Sequence
  Description of Artificial Sequence: Synthetic polypeptide
DEDEIRTTNPVATEQYGSVSTNLQFGGNQK

SEQ ID NO: 13784 - protein, 30 aa, Artificial Sequence
  Description of Artificial Sequence: Synthetic polypeptide
DEDEIRTTNPVATEQYGSVSTNLQGAGNMT

SEQ ID NO: 13785 - protein, 30 aa, Artificial Sequence
  Description of Artificial Sequence: Synthetic polypeptide
DEEEIRTTNPVATEQYGSVSTAELSQAGNT

SEQ ID NO: 13786 - protein, 29 aa, Artificial Sequence
  Description of Artificial Sequence: Synthetic peptide
DEDEIRTTNPVATEEYGSVSTNLQGGNVE

SEQ ID NO: 13787 - protein, 31 aa, Artificial Sequence
  Description of Artificial Sequence: Synthetic polypeptide
AEEEIRTTNPVATEQYGSVSTNQLQAGNQRT

SEQ ID NO: 13788 - protein, 30 aa, Artificial Sequence
  Description of Artificial Sequence: Synthetic polypeptide
AEEEIRTTNPVATEQYGSVSTNQLQNGNGG

SEQ ID NO: 13789 - protein, 31 aa, Artificial Sequence
  Description of Artificial Sequence: Synthetic polypeptide
AEEEIRTTNPVATEQYGSVSTNQLQQAQGNR

SEQ ID NO: 13790 - protein, 31 aa, Artificial Sequence
  Description of Artificial Sequence: Synthetic polypeptide
DEEEIRTTNPVATEAYGSVSCTNLSQRGNSA

SEQ ID NO: 13791 - protein, 30 aa, Artificial Sequence
  Description of Artificial Sequence: Synthetic polypeptide
AEEEIRTTNPVATEQYGSVSTPTLQSGNRE

SEQ ID NO: 13792 - protein, 29 aa, Artificial Sequence
  Description of Artificial Sequence: Synthetic peptide
AEEEIRTTNPVATEQYGSSSTNLNQQGNG

SEQ ID NO: 13793 - protein, 30 aa, Artificial Sequence
  Description of Artificial Sequence: Synthetic polypeptide
AEEEIRTTNPVATEQYGSVSTQLGQDGSNR

SEQ ID NO: 13794 - protein, 29 aa, Artificial Sequence
  Description of Artificial Sequence: Synthetic peptide
AEEEIRTTNPVATEQYGSISTNLQRNSNQ

SEQ ID NO: 13795 - protein, 30 aa, Artificial Sequence
  Description of Artificial Sequence: Synthetic polypeptide
AEEEIRTTNPVATEQYGSVSTQLGQIGTNR

SEQ ID NO: 13796 - protein, 29 aa, Artificial Sequence
  Description of Artificial Sequence: Synthetic peptide
AEEEIRTTNPVATEQYGSVSTQLGQQPNR

SEQ ID NO: 13797 - protein, 30 aa, Artificial Sequence
  Description of Artificial Sequence: Synthetic polypeptide
AEEEIRTTNPVATEQYGSVSTPNNQEGGNR

SEQ ID NO: 13798 - protein, 29 aa, Artificial Sequence
  Description of Artificial Sequence: Synthetic peptide
AEEEIRTTNPVATEQYGSISTNLQQGNQT

SEQ ID NO: 13799 - protein, 29 aa, Artificial Sequence
  Description of Artificial Sequence: Synthetic peptide
AEEEIRTTNPVATEQYGSVSTQLQEGANM

SEQ ID NO: 13800 - protein, 29 aa, Artificial Sequence
  Description of Artificial Sequence: Synthetic peptide
AEEEIRTTNPVATEQYGSVSTQLQISGNN

SEQ ID NO: 13801 - protein, 30 aa, Artificial Sequence
  Description of Artificial Sequence: Synthetic polypeptide
DEEEIRTTNPVATEQYGSVSTANLQFNNFG

SEQ ID NO: 13802 - protein, 29 aa, Artificial Sequence
  Description of Artificial Sequence: Synthetic peptide
AEEEIRTTNPVATEQYGSVSTQLQQSGNE

SEQ ID NO: 13803 - protein, 30 aa, Artificial Sequence
  Description of Artificial Sequence: Synthetic polypeptide
AEEEIRTTNPVATEQYGSVSTQLQRGGNQE

SEQ ID NO: 13804 - protein, 29 aa, Artificial Sequence
  Description of Artificial Sequence: Synthetic peptide
AEEEIRTTNPVATEQYGSVSTQLQRNNLS

SEQ ID NO: 13805 - protein, 29 aa, Artificial Sequence
  Description of Artificial Sequence: Synthetic peptide
AEEEIRTTNPVATEQYGSVSTQLQYGANA

SEQ ID NO: 13806 - protein, 30 aa, Artificial Sequence
  Description of Artificial Sequence: Synthetic polypeptide
AEEEIRTTNPVATEQYGSISTNLQNGENRL

SEQ ID NO: 13807 - protein, 30 aa, Artificial Sequence
  Description of Artificial Sequence: Synthetic polypeptide
AEEEIRTTNPVATEQYGSVSTQLTQAGSNR

SEQ ID NO: 13808 - protein, 28 aa, Artificial Sequence
  Description of Artificial Sequence: Synthetic peptide
AEEEIRTTNPVATEQYGSTSTDLQREER

SEQ ID NO: 13809 - protein, 29 aa, Artificial Sequence
  Description of Artificial Sequence: Synthetic peptide
AEEEIRTTNPVATEQYGSTSTHLQRQGDR

SEQ ID NO: 13810 - protein, 30 aa, Artificial Sequence
  Description of Artificial Sequence: Synthetic polypeptide
AEEEIRTTNPVATEQYGSVSTNTQEGNNRE

SEQ ID NO: 13811 - protein, 29 aa, Artificial Sequence
  Description of Artificial Sequence: Synthetic peptide
AEEEIRTTNPVATEQYGSVSTNTQNDGNE

SEQ ID NO: 13812 - protein, 31 aa, Artificial Sequence
  Description of Artificial Sequence: Synthetic polypeptide
DEDEIRTTNPVATEQYGSVSTNLQREGNDDA

SEQ ID NO: 13813 - protein, 31 aa, Artificial Sequence
  Description of Artificial Sequence: Synthetic polypeptide
DEEEIRTTNPVATEQYGSVSTANLQEIGNNE

SEQ ID NO: 13814 - protein, 31 aa, Artificial Sequence
  Description of Artificial Sequence: Synthetic polypeptide
DEDEIRTTNPVATEQYGSVSTNLQREGNNTP

SEQ ID NO: 13815 - protein, 30 aa, Artificial Sequence
  Description of Artificial Sequence: Synthetic polypeptide
AEEEIRTTNPVATEQYGSVSTNTQSGVNRS

SEQ ID NO: 13816 - protein, 31 aa, Artificial Sequence
  Description of Artificial Sequence: Synthetic polypeptide
DEDEIRTTNPVATEQYGSVSTNLQREGNSDD

SEQ ID NO: 13817 - protein, 30 aa, Artificial Sequence
  Description of Artificial Sequence: Synthetic polypeptide
AEEEIRTTNPVATEQYGSVSTPNLQGEGTR

SEQ ID NO: 13818 - protein, 29 aa, Artificial Sequence
  Description of Artificial Sequence: Synthetic peptide
AEEEIRTTNPVATEQYGSTSTNLQQGNSG

SEQ ID NO: 13819 - protein, 29 aa, Artificial Sequence
  Description of Artificial Sequence: Synthetic peptide
AEEEIRTTNPVATEQYGSTSTNLGVSGNR

SEQ ID NO: 13820 - protein, 30 aa, Artificial Sequence
  Description of Artificial Sequence: Synthetic polypeptide
DEDEIRTTNPVATEQYGSVSTNLQRGDSES

SEQ ID NO: 13821 - protein, 29 aa, Artificial Sequence
  Description of Artificial Sequence: Synthetic peptide
AEEEIRTTNPVATEQYGSVSTNYIDGGNR

SEQ ID NO: 13822 - protein, 29 aa, Artificial Sequence
  Description of Artificial Sequence: Synthetic peptide
AEEEIRTTNPVATEQYGSVSTPLQIENAR

SEQ ID NO: 13823 - protein, 29 aa, Artificial Sequence
  Description of Artificial Sequence: Synthetic peptide
AEEEIRTTNPVATEQYGSVSTPLQRENLV

SEQ ID NO: 13824 - protein, 30 aa, Artificial Sequence
  Description of Artificial Sequence: Synthetic polypeptide
AEEEIRTTNPVATEQYGSVSTPLQRGVNTA

SEQ ID NO: 13825 - protein, 28 aa, Artificial Sequence
  Description of Artificial Sequence: Synthetic peptide
AEEEIRTTNPVATEQYGSVSTPLSTTNR

SEQ ID NO: 13826 - protein, 31 aa, Artificial Sequence
  Description of Artificial Sequence: Synthetic polypeptide
DEEEIRTTNPVATEQYGSVSTANLQESGNDT

SEQ ID NO: 13827 - protein, 29 aa, Artificial Sequence
  Description of Artificial Sequence: Synthetic peptide
AEEEIRTTNPVATEQYGSVSTNTQDGGNT

SEQ ID NO: 13828 - protein, 31 aa, Artificial Sequence
  Description of Artificial Sequence: Synthetic polypeptide
DEEEIRTTNPVATEAYGSVSCTNQQRTVGNR

SEQ ID NO: 13829 - protein, 30 aa, Artificial Sequence
  Description of Artificial Sequence: Synthetic polypeptide
AEEEIRTTNPVATEQYGSVSTQNLEDGNRE

SEQ ID NO: 13830 - protein, 31 aa, Artificial Sequence
  Description of Artificial Sequence: Synthetic polypeptide
DEEEIRTTNPVATEQYGSVSTANLQVGTNAG

SEQ ID NO: 13831 - protein, 31 aa, Artificial Sequence
  Description of Artificial Sequence: Synthetic polypeptide
DEEEIRTTNPVATEQYGSVSLNLQERQGDER

SEQ ID NO: 13832 - protein, 29 aa, Artificial Sequence
  Description of Artificial Sequence: Synthetic peptide
DEEEIRTTNPVATEQYGSVSLNLEREEGR

SEQ ID NO: 13833 - protein, 30 aa, Artificial Sequence
  Description of Artificial Sequence: Synthetic polypeptide
AEEEIRTTNPVATEQYGSVSTSNEQRGNSD

SEQ ID NO: 13834 - protein, 30 aa, Artificial Sequence
  Description of Artificial Sequence: Synthetic polypeptide
DEDEIRTTNPVATEQYGSVSTNPQGGNYRE

SEQ ID NO: 13835 - protein, 28 aa, Artificial Sequence
  Description of Artificial Sequence: Synthetic peptide
SSEEIRTTNPVATDQYGSVSTELQRGNP

SEQ ID NO: 13836 - protein, 32 aa, Artificial Sequence
  Description of Artificial Sequence: Synthetic polypeptide
AEEEIRTTNPVATEQYGSVSTSNLEQRGENLR

SEQ ID NO: 13837 - protein, 31 aa, Artificial Sequence
  Description of Artificial Sequence: Synthetic polypeptide
DEEEIRTTNPVATEQYGCVCSTENLQNGSNR

SEQ ID NO: 13838 - protein, 30 aa, Artificial Sequence
  Description of Artificial Sequence: Synthetic polypeptide
DEEEIRTTNPVATEQYGSVSTANMQRTQDR

SEQ ID NO: 13839 - protein, 30 aa, Artificial Sequence
  Description of Artificial Sequence: Synthetic polypeptide
DEDEIRTTNPVATEQYGSVSTNSQKGPNDR

SEQ ID NO: 13840 - protein, 32 aa, Artificial Sequence
  Description of Artificial Sequence: Synthetic polypeptide
DEEEIRTTNPVATEQYGSVSTANSSQRGGNRI

SEQ ID NO: 13841 - protein, 30 aa, Artificial Sequence
  Description of Artificial Sequence: Synthetic polypeptide
DEDEIRTTNPVATEQYGSVSTNWQLGNNDR

SEQ ID NO: 13842 - protein, 30 aa, Artificial Sequence
  Description of Artificial Sequence: Synthetic polypeptide
DEDEIRTTNPVATEQYGSVSTPNLQDGSNL

SEQ ID NO: 13843 - protein, 28 aa, Artificial Sequence
  Description of Artificial Sequence: Synthetic peptide
SEEEIRTTNPVATEQYGTVSTNQQGGNV

SEQ ID NO: 13844 - protein, 29 aa, Artificial Sequence
  Description of Artificial Sequence: Synthetic peptide
AEEEIRTTNPVATEQYGNVSTTNLQLGIR

SEQ ID NO: 13845 - protein, 29 aa, Artificial Sequence
  Description of Artificial Sequence: Synthetic peptide
SEEEIRTTNPVATEQYGTVSTNLVERGND

SEQ ID NO: 13846 - protein, 30 aa, Artificial Sequence
  Description of Artificial Sequence: Synthetic polypeptide
AEEEIRTTNPVATEQYGSVSTSNLMQVGNT

SEQ ID NO: 13847 - protein, 31 aa, Artificial Sequence
  Description of Artificial Sequence: Synthetic polypeptide
AEEEIRTTNPVATEQYGSVSTQNELQEGNLR

SEQ ID NO: 13848 - protein, 31 aa, Artificial Sequence
  Description of Artificial Sequence: Synthetic polypeptide
DEEEIRTTNPVATEQYGCVCSTENLQRGQRS

SEQ ID NO: 13849 - protein, 30 aa, Artificial Sequence
  Description of Artificial Sequence: Synthetic polypeptide
AEEEIRTTNPVATEQYGSVSTSLQTGGNRE

SEQ ID NO: 13850 - protein, 31 aa, Artificial Sequence
  Description of Artificial Sequence: Synthetic polypeptide
DEEEIRTTNPVATEQYGSVSTANLQGMGNNP

SEQ ID NO: 13851 - protein, 29 aa, Artificial Sequence
  Description of Artificial Sequence: Synthetic peptide
AEEEIRTTNPVATEQYGSVSTQNLQEGVE

SEQ ID NO: 13852 - protein, 29 aa, Artificial Sequence
  Description of Artificial Sequence: Synthetic peptide
DEDEIRTTNPVATEQYGSVSTNLQRNTEP

SEQ ID NO: 13853 - protein, 32 aa, Artificial Sequence
  Description of Artificial Sequence: Synthetic polypeptide
DEEEIRTTNPVATEAYGSVSCTPNLPQRGNNR

SEQ ID NO: 13854 - protein, 29 aa, Artificial Sequence
  Description of Artificial Sequence: Synthetic peptide
AEEEIRTTNPVATEQYGSVSTQNLQSQNS

SEQ ID NO: 13855 - protein, 31 aa, Artificial Sequence
  Description of Artificial Sequence: Synthetic polypeptide
DEEEIRTTNPVATEQYGSVSTANLQNSGNDT

SEQ ID NO: 13856 - protein, 31 aa, Artificial Sequence
  Description of Artificial Sequence: Synthetic polypeptide
DEEEIRTTNPVATEQYGSVSTANLQNSGNEF

SEQ ID NO: 13857 - protein, 30 aa, Artificial Sequence
  Description of Artificial Sequence: Synthetic polypeptide
DEDEIRTTNPVATEQYGSVSTNNQEQGNRN

SEQ ID NO: 13858 - protein, 30 aa, Artificial Sequence
  Description of Artificial Sequence: Synthetic polypeptide
DEEEIRTTNPVATEQYGCVCSTNLQSGNDE

SEQ ID NO: 13859 - protein, 28 aa, Artificial Sequence
  Description of Artificial Sequence: Synthetic peptide
SSEEIRTTNPVATAQYGSVSTDLQRGNS

SEQ ID NO: 13860 - protein, 32 aa, Artificial Sequence
  Description of Artificial Sequence: Synthetic polypeptide
DEEEIRTTNPVATEQYGSVSTANLQRDGIERY

SEQ ID NO: 13861 - protein, 32 aa, Artificial Sequence
  Description of Artificial Sequence: Synthetic polypeptide
DEEEIRTTNPVATEQYGSVSTANLQRGGEENE

SEQ ID NO: 13862 - protein, 30 aa, Artificial Sequence
  Description of Artificial Sequence: Synthetic polypeptide
SEEEIRTTNPVATESYGSVSATNLHRGDNR

SEQ ID NO: 13863 - protein, 29 aa, Artificial Sequence
  Description of Artificial Sequence: Synthetic peptide
AEEEIRTTNPVATEQYGSVSTSGLQIVNR

SEQ ID NO: 13864 - protein, 30 aa, Artificial Sequence
  Description of Artificial Sequence: Synthetic polypeptide
DEEEIRTTNPVATEAYGSVSNNELSQQGNR

SEQ ID NO: 13865 - protein, 31 aa, Artificial Sequence
  Description of Artificial Sequence: Synthetic polypeptide
DEEEIRTTNPVATEQYGSVSTANLQTHANRN

SEQ ID NO: 13866 - protein, 32 aa, Artificial Sequence
  Description of Artificial Sequence: Synthetic polypeptide
DEDEIRTTNPVATEQYGSVSTNLSQERGGNRK

SEQ ID NO: 13867 - protein, 30 aa, Artificial Sequence
  Description of Artificial Sequence: Synthetic polypeptide
DEEEIRTTNPSATEQWGSVSTNLSQGGGNR

SEQ ID NO: 13868 - protein, 29 aa, Artificial Sequence
  Description of Artificial Sequence: Synthetic peptide
AEEEIRTTNPVATEQYGSVSTNTQAMGNG

SEQ ID NO: 13869 - protein, 30 aa, Artificial Sequence
  Description of Artificial Sequence: Synthetic polypeptide
AEEEIRTTNPVATEQYGSVAATNLQRGNNE

SEQ ID NO: 13870 - protein, 29 aa, Artificial Sequence
  Description of Artificial Sequence: Synthetic peptide
AEEEIRTTNPVATEQYGSVSTNQQRVNDE

SEQ ID NO: 13871 - protein, 32 aa, Artificial Sequence
  Description of Artificial Sequence: Synthetic polypeptide
DEEEIRTTNPVATEAYGSVSCTNLQRNGGNRG

SEQ ID NO: 13872 - protein, 30 aa, Artificial Sequence
  Description of Artificial Sequence: Synthetic polypeptide
DEEEIRTTNPVATEQYGSVSTANLAEAGNE

SEQ ID NO: 13873 - protein, 32 aa, Artificial Sequence
  Description of Artificial Sequence: Synthetic polypeptide
DEEEIRTTNPVATEAYGSVSCTNLQRTSGNRN

SEQ ID NO: 13874 - protein, 29 aa, Artificial Sequence
  Description of Artificial Sequence: Synthetic peptide
AEEEIRTTNPVATEQYGSVATNMQSGNTR

SEQ ID NO: 13875 - protein, 30 aa, Artificial Sequence
  Description of Artificial Sequence: Synthetic polypeptide
AEEEIRTTNPVATEQYGSVATNLQVTVGNR

SEQ ID NO: 13876 - protein, 31 aa, Artificial Sequence
  Description of Artificial Sequence: Synthetic polypeptide
AEEEIRTTNPVATEQYGSVATNLQRNGDNRS

SEQ ID NO: 13877 - protein, 29 aa, Artificial Sequence
  Description of Artificial Sequence: Synthetic peptide
AEEEIRTTNPVATEQYGSVSTNQQQQGIR

SEQ ID NO: 13878 - protein, 30 aa, Artificial Sequence
  Description of Artificial Sequence: Synthetic polypeptide
AEEEIRTTNPVATEQYGSVSTNQQYGNQRD

SEQ ID NO: 13879 - protein, 30 aa, Artificial Sequence
  Description of Artificial Sequence: Synthetic polypeptide
AEEEIRTTNPVATEQYGSVATNLQRGGNMQ

SEQ ID NO: 13880 - protein, 30 aa, Artificial Sequence
  Description of Artificial Sequence: Synthetic polypeptide
AEEEIRTTNPVATEQYGSVSTNSLQQGNSD

SEQ ID NO: 13881 - protein, 28 aa, Artificial Sequence
  Description of Artificial Sequence: Synthetic peptide
SEEEIRTTNPVATESYGSVSTNLQAGAF

SEQ ID NO: 13882 - protein, 30 aa, Artificial Sequence
  Description of Artificial Sequence: Synthetic polypeptide
DEEEIRTTNPVATEQYGCVCSTNLQHGNML

SEQ ID NO: 13883 - protein, 30 aa, Artificial Sequence
  Description of Artificial Sequence: Synthetic polypeptide
AEEEIRTTNPVATEQYGSVATNLQRGENNE

SEQ ID NO: 13884 - protein, 30 aa, Artificial Sequence
  Description of Artificial Sequence: Synthetic polypeptide
AEEEIRTTNPVATEQYGSVATNLQRGENGS

SEQ ID NO: 13885 - protein, 30 aa, Artificial Sequence
  Description of Artificial Sequence: Synthetic polypeptide
AEEEIRTTNPVATEQYGSVATNLQRGANND

SEQ ID NO: 13886 - protein, 30 aa, Artificial Sequence
  Description of Artificial Sequence: Synthetic polypeptide
AEEEIRTTNPVATEQYGSVATNLQRGGNNS

SEQ ID NO: 13887 - protein, 31 aa, Artificial Sequence
  Description of Artificial Sequence: Synthetic polypeptide
AEEEIRTTNPVATEQYGSVATNLQREGGNRS

SEQ ID NO: 13888 - protein, 31 aa, Artificial Sequence
  Description of Artificial Sequence: Synthetic polypeptide
DEEEIRTTNPVATEQYGSVSTANDQIGSNQR

SEQ ID NO: 13889 - protein, 30 aa, Artificial Sequence
  Description of Artificial Sequence: Synthetic polypeptide
AEEEIRTTNPVATEQYGSVSTNQQQGGNLR

SEQ ID NO: 13890 - protein, 30 aa, Artificial Sequence
  Description of Artificial Sequence: Synthetic polypeptide
AEEEIRTTNPVATEQYGSVSTNQLQQGDGR

SEQ ID NO: 13891 - protein, 30 aa, Artificial Sequence
  Description of Artificial Sequence: Synthetic polypeptide
AEEEIRTTNPVATEQYGSVSTNQLQQGNEQ

SEQ ID NO: 13892 - protein, 30 aa, Artificial Sequence
  Description of Artificial Sequence: Synthetic polypeptide
DEEEIRTTNPVATEQYGSVSTALQRGDTEN

SEQ ID NO: 13893 - protein, 30 aa, Artificial Sequence
  Description of Artificial Sequence: Synthetic polypeptide
DEEEIRTTNPVATEQYGSVSTALQRGFGES

SEQ ID NO: 13894 - protein, 30 aa, Artificial Sequence
  Description of Artificial Sequence: Synthetic polypeptide
DEEEIRTTNPVATEQYGSVSTALQRGPEDG

SEQ ID NO: 13895 - protein, 31 aa, Artificial Sequence
  Description of Artificial Sequence: Synthetic polypeptide
DEDEIRTTNPVATEQYGSVSTNLQKGPNDRG

SEQ ID NO: 13896 - protein, 31 aa, Artificial Sequence
  Description of Artificial Sequence: Synthetic polypeptide
DEDEIRTTNPVATEQYGSVSTNLQMGDNGDR

SEQ ID NO: 13897 - protein, 29 aa, Artificial Sequence
  Description of Artificial Sequence: Synthetic peptide
AEEEIRTTNPVATEQYGSVATTNLQYGNY

SEQ ID NO: 13898 - protein, 30 aa, Artificial Sequence
  Description of Artificial Sequence: Synthetic polypeptide
DEEEIRTTNPVATEQYGSVSTALQTQGFNN

SEQ ID NO: 13899 - protein, 28 aa, Artificial Sequence
  Description of Artificial Sequence: Synthetic peptide
AEEEIRTTNPVATEQYGSVSTNQQDGTS

SEQ ID NO: 13900 - protein, 30 aa, Artificial Sequence
  Description of Artificial Sequence: Synthetic polypeptide
DEEEIRTTNPVATEAYGSVSCTNALARGSR

SEQ ID NO: 13901 - protein, 30 aa, Artificial Sequence
  Description of Artificial Sequence: Synthetic polypeptide
AEEEIRTTNPVATEQYGSVSTNQQFGENRS

SEQ ID NO: 13902 - protein, 30 aa, Artificial Sequence
  Description of Artificial Sequence: Synthetic polypeptide
AEEEIRTTNPVATEQYGSVSTNQQMGNIRN

SEQ ID NO: 13903 - protein, 28 aa, Artificial Sequence
  Description of Artificial Sequence: Synthetic peptide
AEEEIRTTNPVATEQYGSVSTNQQNGTL

SEQ ID NO: 13904 - protein, 29 aa, Artificial Sequence
  Description of Artificial Sequence: Synthetic peptide
SEEEIRTTNPVATESYGSVSVNLQNEGNR

SEQ ID NO: 13905 - protein, 29 aa, Artificial Sequence
  Description of Artificial Sequence: Synthetic peptide
AEEEIRTTNPVATEQYGSVSTNQQNVGDR

SEQ ID NO: 13906 - protein, 29 aa, Artificial Sequence
  Description of Artificial Sequence: Synthetic peptide
DEDEIRTTNPVATEQYGSVSTNLQNDNQG

SEQ ID NO: 13907 - protein, 29 aa, Artificial Sequence
  Description of Artificial Sequence: Synthetic peptide
DEDEIRTTNPVATEQYGSVSTNLQRDSTQ

SEQ ID NO: 13908 - protein, 28 aa, Artificial Sequence
  Description of Artificial Sequence: Synthetic peptide
AEEEIRTTNPVATEQYGSVATNLQPQNS

SEQ ID NO: 13909 - protein, 30 aa, Artificial Sequence
  Description of Artificial Sequence: Synthetic polypeptide
AEEEIRTTNPVATEQYGSVATNLQPQGTNR

SEQ ID NO: 13910 - protein, 31 aa, Artificial Sequence
  Description of Artificial Sequence: Synthetic polypeptide
AEEEIRTTNPVATEQYGSVASTNLQRGGNLD

SEQ ID NO: 13911 - protein, 31 aa, Artificial Sequence
  Description of Artificial Sequence: Synthetic polypeptide
AEEEIRTTNPVATEQYGSVASTNLQQNGTNR

SEQ ID NO: 13912 - protein, 30 aa, Artificial Sequence
  Description of Artificial Sequence: Synthetic polypeptide
DEEEIRTTNPVATEQYGCVCSTNLQRSGEQ

SEQ ID NO: 13913 - protein, 31 aa, Artificial Sequence
  Description of Artificial Sequence: Synthetic polypeptide
AEEEIRTTNPVATEQYGSVASTNLQAGVNIR

SEQ ID NO: 13914 - protein, 30 aa, Artificial Sequence
  Description of Artificial Sequence: Synthetic polypeptide
AEEEIRTTNPVATEQYGSVASTNLNRTGNG

SEQ ID NO: 13915 - protein, 30 aa, Artificial Sequence
  Description of Artificial Sequence: Synthetic polypeptide
AEEEIRTTNPVATEQYGSVASTNLMEGGNR

SEQ ID NO: 13916 - protein, 30 aa, Artificial Sequence
  Description of Artificial Sequence: Synthetic polypeptide
AEEEIRTTNPVATEQYGSVASTNLEQGVNR

SEQ ID NO: 13917 - protein, 30 aa, Artificial Sequence
  Description of Artificial Sequence: Synthetic polypeptide
AEEEIRTTNPVATEQYGSVASTNNLQQGNF

SEQ ID NO: 13918 - protein, 30 aa, Artificial Sequence
  Description of Artificial Sequence: Synthetic polypeptide
AEEEIRTTNPVATEQYGSVASTNELQVQNR

SEQ ID NO: 13919 - protein, 31 aa, Artificial Sequence
  Description of Artificial Sequence: Synthetic polypeptide
DEEEIRTTNPVATEQYGSVSTANLQDGNTNA

SEQ ID NO: 13920 - protein, 29 aa, Artificial Sequence
  Description of Artificial Sequence: Synthetic peptide
AEEEIRTTNPVATEQYGSVAPNLQDAGNR

SEQ ID NO: 13921 - protein, 29 aa, Artificial Sequence
  Description of Artificial Sequence: Synthetic peptide
AEEEIRTTNPVATEQYGSVANNLQDTGNR

SEQ ID NO: 13922 - protein, 31 aa, Artificial Sequence
  Description of Artificial Sequence: Synthetic polypeptide
DEDEIRTTNPVATEQYGSVSTNLQRDGNSDP

SEQ ID NO: 13923 - protein, 32 aa, Artificial Sequence
  Description of Artificial Sequence: Synthetic polypeptide
DEEEIRTTNPVATEQYGSVSTANLQDRSGDER

SEQ ID NO: 13924 - protein, 32 aa, Artificial Sequence
  Description of Artificial Sequence: Synthetic polypeptide
DEEEIRTTNPVATEQYGSVSTANLQEIEGDNR

SEQ ID NO: 13925 - protein, 31 aa, Artificial Sequence
  Description of Artificial Sequence: Synthetic polypeptide
DEEEIRTTNPVATEQYGSVSTANLQEIGNDS

SEQ ID NO: 13926 - protein, 29 aa, Artificial Sequence
  Description of Artificial Sequence: Synthetic peptide
AEEEIRTTNPVATEQYGSVASTNDQMGNT

SEQ ID NO: 13927 - protein, 30 aa, Artificial Sequence
  Description of Artificial Sequence: Synthetic polypeptide
AEEEIRTTNPVATEQYGSVSTNSQTGSGNR

SEQ ID NO: 13928 - protein, 30 aa, Artificial Sequence
  Description of Artificial Sequence: Synthetic polypeptide
AEEEIRTTNPVATEQYGSVASTSNDQDGNR

SEQ ID NO: 13929 - protein, 31 aa, Artificial Sequence
  Description of Artificial Sequence: Synthetic polypeptide
DEEEIRTTNPVATEQYGSVSTANLIQEGNEL

SEQ ID NO: 13930 - protein, 29 aa, Artificial Sequence
  Description of Artificial Sequence: Synthetic peptide
AEEEIRTTNPVATEQYGSVATNLQDGDRM

SEQ ID NO: 13931 - protein, 30 aa, Artificial Sequence
  Description of Artificial Sequence: Synthetic polypeptide
DEDEIRTTNPVATEQYGSVSTNLQPQGNDG

SEQ ID NO: 13932 - protein, 29 aa, Artificial Sequence
  Description of Artificial Sequence: Synthetic peptide
AEEEIRTTNPVATEQYGSVATNLPGTGNR

SEQ ID NO: 13933 - protein, 32 aa, Artificial Sequence
  Description of Artificial Sequence: Synthetic polypeptide
DEEEIRTTNPVATEAYGSVSCTNLSGQRPGNR

SEQ ID NO: 13934 - protein, 30 aa, Artificial Sequence
  Description of Artificial Sequence: Synthetic polypeptide
DEEEIRTTNPVATEQYGSVSTANLDEGNEA

SEQ ID NO: 13935 - protein, 28 aa, Artificial Sequence
  Description of Artificial Sequence: Synthetic peptide
AEEEIRTTNPVATEQYGSVATILQTGND

SEQ ID NO: 13936 - protein, 29 aa, Artificial Sequence
  Description of Artificial Sequence: Synthetic peptide
AEEEIRTTNPVATEQYGSVSTNTDDSGNR

SEQ ID NO: 13937 - protein, 31 aa, Artificial Sequence
  Description of Artificial Sequence: Synthetic polypeptide
DEEEIRTTNPVATEQYGSVSTANLIQSGNGS

SEQ ID NO: 13938 - protein, 30 aa, Artificial Sequence
  Description of Artificial Sequence: Synthetic polypeptide
AEEEIRTTNPVATEQYGSVSTNTIQAGNFR

SEQ ID NO: 13939 - protein, 29 aa, Artificial Sequence
  Description of Artificial Sequence: Synthetic peptide
AEEEIRTTNPVATEQYGSVSTNTLAGANR

SEQ ID NO: 13940 - protein, 30 aa, Artificial Sequence
  Description of Artificial Sequence: Synthetic polypeptide
AEEEIRTTNPVATEQYGSVSTNTLGEGGNR

SEQ ID NO: 13941 - protein, 29 aa, Artificial Sequence
  Description of Artificial Sequence: Synthetic peptide
DEEEIRTTNPVATEQYGSVSTANLDRISD

SEQ ID NO: 13942 - protein, 29 aa, Artificial Sequence
  Description of Artificial Sequence: Synthetic peptide
DEDEIRTTNPVATEQYGSVSTNLQQGMSG

SEQ ID NO: 13943 - protein, 30 aa, Artificial Sequence
  Description of Artificial Sequence: Synthetic polypeptide
AEEEIRTTNPVATEQYGSVSTNTLLNGGNR

SEQ ID NO: 13944 - protein, 31 aa, Artificial Sequence
  Description of Artificial Sequence: Synthetic polypeptide
AEEEIRTTNPVATEQYGSVSTNTLLQITGNR

SEQ ID NO: 13945 - protein, 28 aa, Artificial Sequence
  Description of Artificial Sequence: Synthetic peptide
AEEEIRTTNPVATEQYGSVATALQEGGR

SEQ ID NO: 13946 - protein, 28 aa, Artificial Sequence
  Description of Artificial Sequence: Synthetic peptide
AEEEIRTTNPVATEQYGSVATALQTGFR

SEQ ID NO: 13947 - protein, 31 aa, Artificial Sequence
  Description of Artificial Sequence: Synthetic polypeptide
DEEEIRTTNPVATEQYGSVSINLQRFMNVRD

SEQ ID NO: 13948 - protein, 29 aa, Artificial Sequence
  Description of Artificial Sequence: Synthetic peptide
AEEEIRTTNPVATEQYGSVSTDQQAGDNR

SEQ ID NO: 13949 - protein, 29 aa, Artificial Sequence
  Description of Artificial Sequence: Synthetic peptide
DEEEIRTTNPVATEQYGSVSPEDLQGGNH

SEQ ID NO: 13950 - protein, 30 aa, Artificial Sequence
  Description of Artificial Sequence: Synthetic polypeptide
DEEEIRTTNPVATEQYGSVSNTNLQFLLNG

SEQ ID NO: 13951 - protein, 29 aa, Artificial Sequence
  Description of Artificial Sequence: Synthetic peptide
DEEEIRTTNPVATEFYGDVSTNLQQNGNG

SEQ ID NO: 13952 - protein, 31 aa, Artificial Sequence
  Description of Artificial Sequence: Synthetic polypeptide
AEEEIRTTNPVATEQYGSVSVTNLQRGENQN

SEQ ID NO: 13953 - protein, 30 aa, Artificial Sequence
  Description of Artificial Sequence: Synthetic polypeptide
DEEEIRTTNPVATEQYGSVSNTNDQSGTND

SEQ ID NO: 13954 - protein, 30 aa, Artificial Sequence
  Description of Artificial Sequence: Synthetic polypeptide
DEEEIRTTNPVATEQYGSVSPDMQRGNERQ

SEQ ID NO: 13955 - protein, 30 aa, Artificial Sequence
  Description of Artificial Sequence: Synthetic polypeptide
DEEEIRTTNPCATEQYGSVSTYLQRDSNRD

SEQ ID NO: 13956 - protein, 28 aa, Artificial Sequence
  Description of Artificial Sequence: Synthetic peptide
DEEEIRTTNPVATEQYGDVSEDLQVGNM

SEQ ID NO: 13957 - protein, 31 aa, Artificial Sequence
  Description of Artificial Sequence: Synthetic polypeptide
AEEEIRTTNPVATEQYGSVSVTNLIQTPGNR

SEQ ID NO: 13958 - protein, 31 aa, Artificial Sequence
  Description of Artificial Sequence: Synthetic polypeptide
AEEEIRTTNPVATEQYGSVSVTNLQRGNGND

SEQ ID NO: 13959 - protein, 29 aa, Artificial Sequence
  Description of Artificial Sequence: Synthetic peptide
DEEEIRTTNPVATEQYGCVSTNLEDEGNT

SEQ ID NO: 13960 - protein, 30 aa, Artificial Sequence
  Description of Artificial Sequence: Synthetic polypeptide
AEEEIRTTNPVATEQYGSVSVTNLINTGNR

SEQ ID NO: 13961 - protein, 28 aa, Artificial Sequence
  Description of Artificial Sequence: Synthetic peptide
DEEEIRTTNPVATELYGSVSTNEEFGNY

SEQ ID NO: 13962 - protein, 30 aa, Artificial Sequence
  Description of Artificial Sequence: Synthetic polypeptide
DEEEIRTTNPVATEQYGCVSTNLQIGDNGF

SEQ ID NO: 13963 - protein, 30 aa, Artificial Sequence
  Description of Artificial Sequence: Synthetic polypeptide
DEEEIRTTNPVATEQYGSVSTNALDDIGNI

SEQ ID NO: 13964 - protein, 30 aa, Artificial Sequence
  Description of Artificial Sequence: Synthetic polypeptide
DEEEIRTTNPVATEQYGCVSWLNLNRGMNR

SEQ ID NO: 13965 - protein, 30 aa, Artificial Sequence
  Description of Artificial Sequence: Synthetic polypeptide
QEEEIRTTNPVATEQYGSVSTNLQRNANTY

SEQ ID NO: 13966 - protein, 31 aa, Artificial Sequence
  Description of Artificial Sequence: Synthetic polypeptide
DEEEIRTTNPVATEQYGSVSGTNLQTQGQNS

SEQ ID NO: 13967 - protein, 29 aa, Artificial Sequence
  Description of Artificial Sequence: Synthetic peptide
YENEIRTTNPVATEMYGSVSFTNLQTGNR

SEQ ID NO: 13968 - protein, 31 aa, Artificial Sequence
  Description of Artificial Sequence: Synthetic polypeptide
DEEEIRTTNPVATEPYGSVVSTNISQRGNRF

SEQ ID NO: 13969 - protein, 30 aa, Artificial Sequence
  Description of Artificial Sequence: Synthetic polypeptide
DEEEIRTTNPCATEQYGSVATNLQNRAGNM

SEQ ID NO: 13970 - protein, 30 aa, Artificial Sequence
  Description of Artificial Sequence: Synthetic polypeptide
YENEIRTTNPVATEMYGSVSTNTLDQRGNR

SEQ ID NO: 13971 - protein, 30 aa, Artificial Sequence
  Description of Artificial Sequence: Synthetic polypeptide
QEEEIRTTNPVATEQYGSVSTNLQRNDNFY

SEQ ID NO: 13972 - protein, 29 aa, Artificial Sequence
  Description of Artificial Sequence: Synthetic peptide
DEEEIRTTNPVATEQYGSVSNTNPQMEND

SEQ ID NO: 13973 - protein, 29 aa, Artificial Sequence
  Description of Artificial Sequence: Synthetic peptide
DEEEIRTTNPVATEQYGSVSPDNLQILNV

SEQ ID NO: 13974 - protein, 29 aa, Artificial Sequence
  Description of Artificial Sequence: Synthetic peptide
QEQEIRTTNPVATEQYGSVSTNLQRGDMI

SEQ ID NO: 13975 - protein, 30 aa, Artificial Sequence
  Description of Artificial Sequence: Synthetic polypeptide
DEEEIRTTNPVATEQYGSVSPDLQRGNQIP

SEQ ID NO: 13976 - protein, 28 aa, Artificial Sequence
  Description of Artificial Sequence: Synthetic peptide
QEEGIRTTNPVATEQYGSVSTNLFMDNR

SEQ ID NO: 13977 - protein, 30 aa, Artificial Sequence
  Description of Artificial Sequence: Synthetic polypeptide
QEEEIRTTNPVATEQYGSVSTNLQQGPNNS

SEQ ID NO: 13978 - protein, 30 aa, Artificial Sequence
  Description of Artificial Sequence: Synthetic polypeptide
DEEEIRTTNPVATEQYGSVSNTDLQRVNSS

SEQ ID NO: 13979 - protein, 29 aa, Artificial Sequence
  Description of Artificial Sequence: Synthetic peptide
DEEEIRTTNPVATEQYGCVSTNLEHSGNV

SEQ ID NO: 13980 - protein, 30 aa, Artificial Sequence
  Description of Artificial Sequence: Synthetic polypeptide
DEEEIRTTNPVATENYGSVSTNLQNMGENG

SEQ ID NO: 13981 - protein, 30 aa, Artificial Sequence
  Description of Artificial Sequence: Synthetic polypeptide
DEEEIRTTNPVATEQYGSVSNTNEQVGNYF

SEQ ID NO: 13982 - protein, 30 aa, Artificial Sequence
  Description of Artificial Sequence: Synthetic polypeptide
DEEEIRTTNPVATEQYGSVSTMNTQGLGER

SEQ ID NO: 13983 - protein, 28 aa, Artificial Sequence
  Description of Artificial Sequence: Synthetic peptide
DEEEIRTTNPCATEQYGSVCTNLERGDS

SEQ ID NO: 13984 - protein, 31 aa, Artificial Sequence
  Description of Artificial Sequence: Synthetic polypeptide
DEEEIRTTNPVATEQYGSVSGTNLQNEGNTD

SEQ ID NO: 13985 - protein, 29 aa, Artificial Sequence
  Description of Artificial Sequence: Synthetic peptide
AEEEIRTTNPVATEQYGSVSVNLQVGSNQ

SEQ ID NO: 13986 - protein, 30 aa, Artificial Sequence
  Description of Artificial Sequence: Synthetic polypeptide
DEEEIRTTNPVATEQYGSVSNTNEQVGNFE

SEQ ID NO: 13987 - protein, 31 aa, Artificial Sequence
  Description of Artificial Sequence: Synthetic polypeptide
QEEEVRTTNPVATEQYGSVSTLNLDQRIGNR

SEQ ID NO: 13988 - protein, 32 aa, Artificial Sequence
  Description of Artificial Sequence: Synthetic polypeptide
DEEEIRTTNPVATEQYGSVSPPNDLQRGNTRF

SEQ ID NO: 13989 - protein, 31 aa, Artificial Sequence
  Description of Artificial Sequence: Synthetic polypeptide
DEEEIRTTNPVATEQYGSVSTMLQRIGNNGL

SEQ ID NO: 13990 - protein, 30 aa, Artificial Sequence
  Description of Artificial Sequence: Synthetic polypeptide
DEEEIRTTNPVATEQYGSVSPPLQRSGNNE

SEQ ID NO: 13991 - protein, 28 aa, Artificial Sequence
  Description of Artificial Sequence: Synthetic peptide
SAEEIRTTNPVATHQYGSVSTSLQRGND

SEQ ID NO: 13992 - protein, 29 aa, Artificial Sequence
  Description of Artificial Sequence: Synthetic peptide
DEEEIRTTNPVATEMYGTVSTNLQNGGNQ

SEQ ID NO: 13993 - protein, 30 aa, Artificial Sequence
  Description of Artificial Sequence: Synthetic polypeptide
QEEEIRTTNPVATEQYGSVSTNLQMDGNAI

SEQ ID NO: 13994 - protein, 30 aa, Artificial Sequence
  Description of Artificial Sequence: Synthetic polypeptide
DEEEIRTTNPVATEQYGCVSTNLQMGDNPH

SEQ ID NO: 13995 - protein, 30 aa, Artificial Sequence
  Description of Artificial Sequence: Synthetic polypeptide
QEEEIRTTNPVATEQYGSVSTNLQPGDNED

SEQ ID NO: 13996 - protein, 29 aa, Artificial Sequence
  Description of Artificial Sequence: Synthetic peptide
YEEEIRTTNPVGTEQYGSLSTNLQRMGER

SEQ ID NO: 13997 - protein, 30 aa, Artificial Sequence
  Description of Artificial Sequence: Synthetic polypeptide
YENEIRTTNPVATECYGSVSTNLDQRGSNR

SEQ ID NO: 13998 - protein, 30 aa, Artificial Sequence
  Description of Artificial Sequence: Synthetic polypeptide
WEEEIRTTNPVATEIYGSVSTNLQRGQNDC

SEQ ID NO: 13999 - protein, 31 aa, Artificial Sequence
  Description of Artificial Sequence: Synthetic polypeptide
DEEEIRTTNPVATEQYGCVSTPNLEQRGNQY

SEQ ID NO: 14000 - protein, 29 aa, Artificial Sequence
  Description of Artificial Sequence: Synthetic peptide
DEEEIRTTNPVATEFYGDVSTDLQRGMNN

SEQ ID NO: 14001 - protein, 31 aa, Artificial Sequence
  Description of Artificial Sequence: Synthetic polypeptide
DEEEIRTTNPVATEQYGSVSPMTLLQRGDRD

SEQ ID NO: 14002 - protein, 28 aa, Artificial Sequence
  Description of Artificial Sequence: Synthetic peptide
AEEEIRTTNPVATEQYGSVSVNLTAGLR

SEQ ID NO: 14003 - protein, 30 aa, Artificial Sequence
  Description of Artificial Sequence: Synthetic polypeptide
DEEEIRTTNPVATEQYGSVSIENLQEIGER

SEQ ID NO: 14004 - protein, 32 aa, Artificial Sequence
  Description of Artificial Sequence: Synthetic polypeptide
DEEEIRTTNPVATEQYGSVSTNDLQFRSGNQG

SEQ ID NO: 14005 - protein, 30 aa, Artificial Sequence
  Description of Artificial Sequence: Synthetic polypeptide
QEEEIRTTNPVATEQYGSVSTNLQLFGNGN

SEQ ID NO: 14006 - protein, 30 aa, Artificial Sequence
  Description of Artificial Sequence: Synthetic polypeptide
DEEEIRTTNPCATEQYGSVIATNLQRGNMA

SEQ ID NO: 14007 - protein, 29 aa, Artificial Sequence
  Description of Artificial Sequence: Synthetic peptide
YENEIRTTNPVATEQYGMVSTNLQQRGNT

SEQ ID NO: 14008 - protein, 30 aa, Artificial Sequence
  Description of Artificial Sequence: Synthetic polypeptide
QEEEIRTTNPVATEQYGSVSTNLQRNNNFG

SEQ ID NO: 14009 - protein, 30 aa, Artificial Sequence
  Description of Artificial Sequence: Synthetic polypeptide
DEEEIRTTNPVATEQYGCVSTNLQGAGTGR

SEQ ID NO: 14010 - protein, 30 aa, Artificial Sequence
  Description of Artificial Sequence: Synthetic polypeptide
DEEEIRTTNPVATEQYGCVSWNLQRGGDER

SEQ ID NO: 14011 - protein, 30 aa, Artificial Sequence
  Description of Artificial Sequence: Synthetic polypeptide
DEEEIRTTNPVATEQYGSVSNTNQQGVGNE

SEQ ID NO: 14012 - protein, 30 aa, Artificial Sequence
  Description of Artificial Sequence: Synthetic polypeptide
DEEEIRTTNPVATEQYGSVSTMLFQQGTNI

SEQ ID NO: 14013 - protein, 30 aa, Artificial Sequence
  Description of Artificial Sequence: Synthetic polypeptide
DEEEIRTTNPVATEQYGSVSPNDLQRGLEN

SEQ ID NO: 14014 - protein, 29 aa, Artificial Sequence
  Description of Artificial Sequence: Synthetic peptide
DEEEIRTTNPVATEQYGDASTDLQHQGNR

SEQ ID NO: 14015 - protein, 29 aa, Artificial Sequence
  Description of Artificial Sequence: Synthetic peptide
DEEEIRTTNPVATEIWGSVSTNLQDGNDN

SEQ ID NO: 14016 - protein, 30 aa, Artificial Sequence
  Description of Artificial Sequence: Synthetic polypeptide
YEEHIRTTNPVATEQYGSVSTNLQGRGMDR

SEQ ID NO: 14017 - protein, 29 aa, Artificial Sequence
  Description of Artificial Sequence: Synthetic peptide
DEEEIRTTNPCATEQYGSVCTNLNRGNPM

SEQ ID NO: 14018 - protein, 32 aa, Artificial Sequence
  Description of Artificial Sequence: Synthetic polypeptide
DEEEIRTTNPVATEQYGSVSTMNPQERGSNRQ

SEQ ID NO: 14019 - protein, 32 aa, Artificial Sequence
  Description of Artificial Sequence: Synthetic polypeptide
QEEEIRTTNPVATEQYGSVSTSNLQDRGDNYR

SEQ ID NO: 14020 - protein, 29 aa, Artificial Sequence
  Description of Artificial Sequence: Synthetic peptide
DEEEIRTTNPVATEGYGWVSTNLQSGGNQ

SEQ ID NO: 14021 - protein, 30 aa, Artificial Sequence
  Description of Artificial Sequence: Synthetic polypeptide
DEEEIRTTNPVATEQYGSVSPNPQRGNEQT

SEQ ID NO: 14022 - protein, 30 aa, Artificial Sequence
  Description of Artificial Sequence: Synthetic polypeptide
DEEEIRTTNPVATEQYGSVSTMLQPNGNES

SEQ ID NO: 14023 - protein, 30 aa, Artificial Sequence
  Description of Artificial Sequence: Synthetic polypeptide
DEEEIRTTNPVATEQYGSVSTMNLETEGNE

SEQ ID NO: 14024 - protein, 30 aa, Artificial Sequence
  Description of Artificial Sequence: Synthetic polypeptide
YENEIRTTNPVATEQYGSVSATNLYQRDNR

SEQ ID NO: 14025 - protein, 29 aa, Artificial Sequence
  Description of Artificial Sequence: Synthetic peptide
DEEEIRTTNPVATEQYGSVSPNNVDRGNT

SEQ ID NO: 14026 - protein, 29 aa, Artificial Sequence
  Description of Artificial Sequence: Synthetic peptide
YEEEIQTTNCVATEQYGSVSTNLQRGNDS

SEQ ID NO: 14027 - protein, 30 aa, Artificial Sequence
  Description of Artificial Sequence: Synthetic polypeptide
DEEEIRTTNPVATEQYGSVSTMNHGRGNEQ

SEQ ID NO: 14028 - protein, 31 aa, Artificial Sequence
  Description of Artificial Sequence: Synthetic polypeptide
QEEEISTTNPVATEQYGSVSTNLIQRSGTNR

SEQ ID NO: 14029 - protein, 32 aa, Artificial Sequence
  Description of Artificial Sequence: Synthetic polypeptide
DEEEIRTTNPVATEQYGSVSNTELHQRGSNRY

SEQ ID NO: 14030 - protein, 29 aa, Artificial Sequence
  Description of Artificial Sequence: Synthetic peptide
DEEEIRTTNPVATEQYGSVSPNLQNPEIR

SEQ ID NO: 14031 - protein, 32 aa, Artificial Sequence
  Description of Artificial Sequence: Synthetic polypeptide
DEEEIRTTNPVATEQYGSVSTMNGLQTRGNEN

SEQ ID NO: 14032 - protein, 28 aa, Artificial Sequence
  Description of Artificial Sequence: Synthetic peptide
QSEEIRTTNPVATDQYGSVSTWLQRGNF

SEQ ID NO: 14033 - protein, 31 aa, Artificial Sequence
  Description of Artificial Sequence: Synthetic polypeptide
DEEEIRTTNPVATEQYGCVSTNLQERNDNRV

SEQ ID NO: 14034 - protein, 31 aa, Artificial Sequence
  Description of Artificial Sequence: Synthetic polypeptide
DEECIRTTNPVATEQYGSVCSTNEFQRIGNR

SEQ ID NO: 14035 - protein, 29 aa, Artificial Sequence
  Description of Artificial Sequence: Synthetic peptide
QEEEIVTTNPVATEQYGSVSAMNLQRGND

SEQ ID NO: 14036 - protein, 28 aa, Artificial Sequence
  Description of Artificial Sequence: Synthetic peptide
YEEEISTTNPVATEQYGEVSTNLQRINE

SEQ ID NO: 14037 - protein, 30 aa, Artificial Sequence
  Description of Artificial Sequence: Synthetic polypeptide
YEEEILTTNPVATEQYGSVSTNLQLRGHER

SEQ ID NO: 14038 - protein, 30 aa, Artificial Sequence
  Description of Artificial Sequence: Synthetic polypeptide
DEEEIRTTNPCATEQYGSVATNLQDRPGNH

SEQ ID NO: 14039 - protein, 31 aa, Artificial Sequence
  Description of Artificial Sequence: Synthetic polypeptide
DEEEIRTTNPVATEQYGSVSPDNWLQEGNER

SEQ ID NO: 14040 - protein, 28 aa, Artificial Sequence
  Description of Artificial Sequence: Synthetic peptide
QEREIRTTNPVATEQYGSVWTNLQNGSR

SEQ ID NO: 14041 - protein, 30 aa, Artificial Sequence
  Description of Artificial Sequence: Synthetic polypeptide
DEEEIRTTNPVATEQYGCVSTNLDRADNRN

SEQ ID NO: 14042 - protein, 31 aa, Artificial Sequence
  Description of Artificial Sequence: Synthetic polypeptide
YEEGIRTTNPVATEQYGSVSTMNLLQRGNRD

SEQ ID NO: 14043 - protein, 31 aa, Artificial Sequence
  Description of Artificial Sequence: Synthetic polypeptide
DEEEIRTTNPVATEQYGSVSNTTDQQRGNER

SEQ ID NO: 14044 - protein, 32 aa, Artificial Sequence
  Description of Artificial Sequence: Synthetic polypeptide
QEEEIRTTNPVATEQYGSVSTPNLGQRGENER

SEQ ID NO: 14045 - protein, 30 aa, Artificial Sequence
  Description of Artificial Sequence: Synthetic polypeptide
QEEEIRTTNPVATEQYGSVSTPNLQDGNVS

SEQ ID NO: 14046 - protein, 31 aa, Artificial Sequence
  Description of Artificial Sequence: Synthetic polypeptide
DEEEIRTTNPVATEQYGSVSNTNLLQAGNGN

SEQ ID NO: 14047 - protein, 28 aa, Artificial Sequence
  Description of Artificial Sequence: Synthetic peptide
SAEEIRTTNPVATTQYGSVSTALQRGNM

SEQ ID NO: 14048 - protein, 29 aa, Artificial Sequence
  Description of Artificial Sequence: Synthetic peptide
DEEEIRTTNPVATEQYGSVSPENLQIGDD

SEQ ID NO: 14049 - protein, 28 aa, Artificial Sequence
  Description of Artificial Sequence: Synthetic peptide
YEEGIRTTNPVATEQYGSVSTNLSPENR

SEQ ID NO: 14050 - protein, 29 aa, Artificial Sequence
  Description of Artificial Sequence: Synthetic peptide
DEEEIRTTNPVATEQYGSVSPHLQRGDDN

SEQ ID NO: 14051 - protein, 29 aa, Artificial Sequence
  Description of Artificial Sequence: Synthetic peptide
DEECIRTTNPVATEQYGVVSTNLQGMGNM

SEQ ID NO: 14052 - protein, 31 aa, Artificial Sequence
  Description of Artificial Sequence: Synthetic polypeptide
DEEEIRTTNPVATEQYGCVSTNLQGTGENER

SEQ ID NO: 14053 - protein, 30 aa, Artificial Sequence
  Description of Artificial Sequence: Synthetic polypeptide
DEEEIRTTNPVATEQYGSVSNTNLQNGDFE

SEQ ID NO: 14054 - protein, 29 aa, Artificial Sequence
  Description of Artificial Sequence: Synthetic peptide
YEEGIRTTNPVATEQYGSVSTNQQMAGNR

SEQ ID NO: 14055 - protein, 30 aa, Artificial Sequence
  Description of Artificial Sequence: Synthetic polypeptide
DEEEIRTTNPVATEQYGSVSNTTVERGNNR

SEQ ID NO: 14056 - protein, 29 aa, Artificial Sequence
  Description of Artificial Sequence: Synthetic peptide
DEEEIRTTNPVATEQFGVSVSTTLLRGNN

SEQ ID NO: 14057 - protein, 29 aa, Artificial Sequence
  Description of Artificial Sequence: Synthetic peptide
DEEEIRTTNPVATEQYGSVSPNVDRGSIR

SEQ ID NO: 14058 - protein, 30 aa, Artificial Sequence
  Description of Artificial Sequence: Synthetic polypeptide
YEEEILTTNPVATEQYGSVSITNLQRGTER

SEQ ID NO: 14059 - protein, 29 aa, Artificial Sequence
  Description of Artificial Sequence: Synthetic peptide
YEEHIRTTNPVATEQYGSVISTNLEHGNR

SEQ ID NO: 14060 - protein, 30 aa, Artificial Sequence
  Description of Artificial Sequence: Synthetic polypeptide
QEEEIVTTNPVATEQYGSVVSTNLQVGNRS

SEQ ID NO: 14061 - protein, 28 aa, Artificial Sequence
  Description of Artificial Sequence: Synthetic peptide
DEDEIRTTNPVAYEQYGSVSTNQQDGSR

SEQ ID NO: 14062 - protein, 29 aa, Artificial Sequence
  Description of Artificial Sequence: Synthetic peptide
DEEEIRTTNPVATEQYGSVSTNDDQDGDA

SEQ ID NO: 14063 - protein, 31 aa, Artificial Sequence
  Description of Artificial Sequence: Synthetic polypeptide
DEEEIRTTNPVATEQYGSVSTMNGLQNEGND

SEQ ID NO: 14064 - protein, 31 aa, Artificial Sequence
  Description of Artificial Sequence: Synthetic polypeptide
DEEEIRTTNPVATEQYGSVSGTNLQGGNLQE

SEQ ID NO: 14065 - protein, 30 aa, Artificial Sequence
  Description of Artificial Sequence: Synthetic polypeptide
DEEEIRTTNPVATEQYGSVSNTTLQRMNVD

SEQ ID NO: 14066 - protein, 28 aa, Artificial Sequence
  Description of Artificial Sequence: Synthetic peptide
WEEEIRCTNPIATEQYGSVSENLMRGNR

SEQ ID NO: 14067 - protein, 32 aa, Artificial Sequence
  Description of Artificial Sequence: Synthetic polypeptide
DEEEIRTTNPVATEQYGSVSGTNNLQRGNLGD

SEQ ID NO: 14068 - protein, 29 aa, Artificial Sequence
  Description of Artificial Sequence: Synthetic peptide
DEEEIRTTNPCATEQYGSVSTVLQHGNQV

SEQ ID NO: 14069 - protein, 32 aa, Artificial Sequence
  Description of Artificial Sequence: Synthetic polypeptide
DEEEIRTTNPVATEQYGSVSPIFNLQRGNNRN

SEQ ID NO: 14070 - protein, 31 aa, Artificial Sequence
  Description of Artificial Sequence: Synthetic polypeptide
DEEEIRTTNPVATEQYGSVSNTNLQQGGNNE

SEQ ID NO: 14071 - protein, 29 aa, Artificial Sequence
  Description of Artificial Sequence: Synthetic peptide
DEEEIRTTNPVATEGYGSVSTNLQRDTDE

SEQ ID NO: 14072 - protein, 31 aa, Artificial Sequence
  Description of Artificial Sequence: Synthetic polypeptide
DEEEIRTTNPVATEQYGSVSGTNLQMAGNEF

SEQ ID NO: 14073 - protein, 28 aa, Artificial Sequence
  Description of Artificial Sequence: Synthetic peptide
REEEIRTTNPVATEQYGSVATGLQNGWR

SEQ ID NO: 14074 - protein, 29 aa, Artificial Sequence
  Description of Artificial Sequence: Synthetic peptide
DEEEIRTTNPCATEQYGSVSTVLQNGNDA

SEQ ID NO: 14075 - protein, 30 aa, Artificial Sequence
  Description of Artificial Sequence: Synthetic polypeptide
DEEEIRTTNPVATEQYGSVSTMLQEVGGNV

SEQ ID NO: 14076 - protein, 32 aa, Artificial Sequence
  Description of Artificial Sequence: Synthetic polypeptide
DEEEIRTTNPVATEQYGSVSTNDLQMMGNERT

SEQ ID NO: 14077 - protein, 28 aa, Artificial Sequence
  Description of Artificial Sequence: Synthetic peptide
YESEIRTTNPVTTEQYGSVSTNIQRGNG

SEQ ID NO: 14078 - protein, 30 aa, Artificial Sequence
  Description of Artificial Sequence: Synthetic polypeptide
DEEEIRTTNPVATEQYGSVSTMNLNIEGNA

SEQ ID NO: 14079 - protein, 29 aa, Artificial Sequence
  Description of Artificial Sequence: Synthetic peptide
DEEEIRTTNPVATEQYGSVSPELQRGTDI

SEQ ID NO: 14080 - protein, 32 aa, Artificial Sequence
  Description of Artificial Sequence: Synthetic polypeptide
DEEEIRTTNPVATEQYGSVSPANLQRGEGNRM

SEQ ID NO: 14081 - protein, 29 aa, Artificial Sequence
  Description of Artificial Sequence: Synthetic peptide
DEEEIRTTNPCATEQYGSVSTVLQQGNEN

SEQ ID NO: 14082 - protein, 31 aa, Artificial Sequence
  Description of Artificial Sequence: Synthetic polypeptide
AEEEIRTTNPVATEQYGSVSVTNLQQLGGNR

SEQ ID NO: 14083 - protein, 29 aa, Artificial Sequence
  Description of Artificial Sequence: Synthetic peptide
YEEEIRTTNPVATEGYGSVSTNLQARVNF

SEQ ID NO: 14084 - protein, 30 aa, Artificial Sequence
  Description of Artificial Sequence: Synthetic polypeptide
DEEEIRTTNPCATEQYGSVIATNLQRGNVS

SEQ ID NO: 14085 - protein, 28 aa, Artificial Sequence
  Description of Artificial Sequence: Synthetic peptide
VEEGIRTTNPVATEQYGSVSTNLEELNR

SEQ ID NO: 14086 - protein, 29 aa, Artificial Sequence
  Description of Artificial Sequence: Synthetic peptide
DEEEIRTTNPVATEQYGSVSIMNLDEGNE

SEQ ID NO: 14087 - protein, 28 aa, Artificial Sequence
  Description of Artificial Sequence: Synthetic peptide
REEEIRTTNPVATEQYGSVATALQPGSR

SEQ ID NO: 14088 - protein, 29 aa, Artificial Sequence
  Description of Artificial Sequence: Synthetic peptide
DEEEIRTTNPVATEGYGSVSTNLQNFGIE

SEQ ID NO: 14089 - protein, 30 aa, Artificial Sequence
  Description of Artificial Sequence: Synthetic polypeptide
DEEEIRTTNPCATEQYGSVIATNLQRGNSA

SEQ ID NO: 14090 - protein, 29 aa, Artificial Sequence
  Description of Artificial Sequence: Synthetic peptide
AEEEIRTTNPVATEQYGSVSVTATQGGNR

SEQ ID NO: 14091 - protein, 29 aa, Artificial Sequence
  Description of Artificial Sequence: Synthetic peptide
DEEEIRTTNPCATEQYGSVVTNLDRGNPA

SEQ ID NO: 14092 - protein, 31 aa, Artificial Sequence
  Description of Artificial Sequence: Synthetic polypeptide
DEEEIRTTNPVATEQYGCVTSTNLQFFGNRQ

SEQ ID NO: 14093 - protein, 30 aa, Artificial Sequence
  Description of Artificial Sequence: Synthetic polypeptide
DEEEIRTTNPVATEGYGSVSTNLQRSMSER

SEQ ID NO: 14094 - protein, 29 aa, Artificial Sequence
  Description of Artificial Sequence: Synthetic peptide
DEEEIRTTNPVATEFYGSVSTNLEGNGNP

SEQ ID NO: 14095 - protein, 29 aa, Artificial Sequence
  Description of Artificial Sequence: Synthetic peptide
DEEEIRTTNPCATEQYGSVSTVLQDGNSM

SEQ ID NO: 14096 - protein, 30 aa, Artificial Sequence
  Description of Artificial Sequence: Synthetic polypeptide
DEEEIRTTNPVATEQYGSVSNTYLQGIGNQ

SEQ ID NO: 14097 - protein, 28 aa, Artificial Sequence
  Description of Artificial Sequence: Synthetic peptide
AEEEIRTTNPVATEQYGSVSVNLLQGQR

SEQ ID NO: 14098 - protein, 32 aa, Artificial Sequence
  Description of Artificial Sequence: Synthetic polypeptide
DEEEIRTTNPVATEQYGCVSTNLLQRSGNNRD

SEQ ID NO: 14099 - protein, 31 aa, Artificial Sequence
  Description of Artificial Sequence: Synthetic polypeptide
DEEEIRTTNPCATEQYGSVSTTNLSQRVQNR

SEQ ID NO: 14100 - protein, 29 aa, Artificial Sequence
  Description of Artificial Sequence: Synthetic peptide
DEEEIRTTNPVATEQYGSVSPPPLIRGNL

SEQ ID NO: 14101 - protein, 30 aa, Artificial Sequence
  Description of Artificial Sequence: Synthetic polypeptide
DEEEIRTTNPVATEGYGSVSTPNLQFEGNF

SEQ ID NO: 14102 - protein, 28 aa, Artificial Sequence
  Description of Artificial Sequence: Synthetic peptide
REEEIRTTNPVATEQYGSVCTALQGGFR

SEQ ID NO: 14103 - protein, 30 aa, Artificial Sequence
  Description of Artificial Sequence: Synthetic polypeptide
DEEEIRTTNPVATEQYGSVSTMNLDEGNEN

SEQ ID NO: 14104 - protein, 30 aa, Artificial Sequence
  Description of Artificial Sequence: Synthetic polypeptide
DEEEIRTTNPVATEQYGSVSTMLQNVEGNI

SEQ ID NO: 14105 - protein, 30 aa, Artificial Sequence
  Description of Artificial Sequence: Synthetic polypeptide
DEEEIRTTNPVATEQYGSVSNTNLMYNNRF

SEQ ID NO: 14106 - protein, 29 aa, Artificial Sequence
  Description of Artificial Sequence: Synthetic peptide
AEEEIRTTNPVATEQYGSVSVNLQFGQNL

SEQ ID NO: 14107 - protein, 31 aa, Artificial Sequence
  Description of Artificial Sequence: Synthetic polypeptide
DEEEIRTTNPVATEHYGSVCSTNDLQRGNQS

SEQ ID NO: 14108 - protein, 29 aa, Artificial Sequence
  Description of Artificial Sequence: Synthetic peptide
DEEEIRTTNPVATEQYGCVSTNTQFGQRA

SEQ ID NO: 14109 - protein, 30 aa, Artificial Sequence
  Description of Artificial Sequence: Synthetic polypeptide
AEEEIRTTNPVATEQYGSVSVNLQNDNGNR

SEQ ID NO: 14110 - protein, 31 aa, Artificial Sequence
  Description of Artificial Sequence: Synthetic polypeptide
DEEEIRTTNPVATEGYGSVNSTNLQRGENEF

SEQ ID NO: 14111 - protein, 30 aa, Artificial Sequence
  Description of Artificial Sequence: Synthetic polypeptide
DEEEIRTTNPVATEQYGSVSNTYVPRGINR

SEQ ID NO: 14112 - protein, 30 aa, Artificial Sequence
  Description of Artificial Sequence: Synthetic polypeptide
YEEEIRTTNPVATEGYGSVSTHNEEQRGNR

SEQ ID NO: 14113 - protein, 30 aa, Artificial Sequence
  Description of Artificial Sequence: Synthetic polypeptide
DEEEIRTTNPVATEQYGSVSTNAQNGNQDQ

SEQ ID NO: 14114 - protein, 29 aa, Artificial Sequence
  Description of Artificial Sequence: Synthetic peptide
AEEEIRTTNPVATEQYGSVSVNLQGGFNF

SEQ ID NO: 14115 - protein, 32 aa, Artificial Sequence
  Description of Artificial Sequence: Synthetic polypeptide
DEEEIRTTNPVATEHYGISTVSCTNLQRGNNR

SEQ ID NO: 14116 - protein, 30 aa, Artificial Sequence
  Description of Artificial Sequence: Synthetic polypeptide
DEEEIRTTNPVATEQYGCVSTNLQNGDNDA

SEQ ID NO: 14117 - protein, 29 aa, Artificial Sequence
  Description of Artificial Sequence: Synthetic peptide
AEEEIRTTNPVATEQYGSVSVNLQMGGNM

SEQ ID NO: 14118 - protein, 30 aa, Artificial Sequence
  Description of Artificial Sequence: Synthetic polypeptide
YEEEISTTNPVATEAYGSVVSTMNLQRGNR

SEQ ID NO: 14119 - protein, 30 aa, Artificial Sequence
  Description of Artificial Sequence: Synthetic polypeptide
DEEEIRTTNPVATEGYGSVSTNLQTGSDRS

SEQ ID NO: 14120 - protein, 31 aa, Artificial Sequence
  Description of Artificial Sequence: Synthetic polypeptide
AEEEIRTTNPVATEQYGSVSVTNLLQNEGNR

SEQ ID NO: 14121 - protein, 31 aa, Artificial Sequence
  Description of Artificial Sequence: Synthetic polypeptide
DEEEIRTTNPVATEQYGSVSTMNGIQPRGNI

SEQ ID NO: 14122 - protein, 29 aa, Artificial Sequence
  Description of Artificial Sequence: Synthetic peptide
SEEEIATTNPVATEQYGSVCSTNSQRGER

SEQ ID NO: 14123 - protein, 30 aa, Artificial Sequence
  Description of Artificial Sequence: Synthetic polypeptide
QEENIRTTNPVATEQYGSVSTNLQRGNLPV

SEQ ID NO: 14124 - protein, 29 aa, Artificial Sequence
  Description of Artificial Sequence: Synthetic peptide
AEEEIRTTNPVATEQYGSVSVTNPADGNR

SEQ ID NO: 14125 - protein, 30 aa, Artificial Sequence
  Description of Artificial Sequence: Synthetic polypeptide
YEEEIRTTNPVATEHYGSVSTSNLQRGNGT

SEQ ID NO: 14126 - protein, 29 aa, Artificial Sequence
  Description of Artificial Sequence: Synthetic peptide
DEEEIRTTNPCATEQYGSVCTNLDRGNEH

SEQ ID NO: 14127 - protein, 29 aa, Artificial Sequence
  Description of Artificial Sequence: Synthetic peptide
DEEEIRTTNPVATEQYGCVSTNLMNGGDR

SEQ ID NO: 14128 - protein, 30 aa, Artificial Sequence
  Description of Artificial Sequence: Synthetic polypeptide
DEEEIRTTNPVATEQYGCVSTQNLQGGNNP

SEQ ID NO: 14129 - protein, 28 aa, Artificial Sequence
  Description of Artificial Sequence: Synthetic peptide
REEEIRCTNPIATEQYGSVSENLMRGNR

SEQ ID NO: 14130 - protein, 29 aa, Artificial Sequence
  Description of Artificial Sequence: Synthetic peptide
AEEEIRTTNPVATEQYGSVSVNLQNYGNT

SEQ ID NO: 14131 - protein, 30 aa, Artificial Sequence
  Description of Artificial Sequence: Synthetic polypeptide
DEEEIRTTNPVATEQYGSVSPDPLQIRGNL

SEQ ID NO: 14132 - protein, 29 aa, Artificial Sequence
  Description of Artificial Sequence: Synthetic peptide
DEEEIRTTNPCATEQYGSVCTNLDRGNPD

SEQ ID NO: 14133 - protein, 30 aa, Artificial Sequence
  Description of Artificial Sequence: Synthetic polypeptide
DEEEIRTTNPVATEQYGSVSTNDLQGSTIR

SEQ ID NO: 14134 - protein, 29 aa, Artificial Sequence
  Description of Artificial Sequence: Synthetic peptide
DEEEIRTTNPVATEQYGSVSPAQQRGENI

SEQ ID NO: 14135 - protein, 31 aa, Artificial Sequence
  Description of Artificial Sequence: Synthetic polypeptide
DEEEIRTTNPVATENYGSVSTTNPLQTNGNR

SEQ ID NO: 14136 - protein, 29 aa, Artificial Sequence
  Description of Artificial Sequence: Synthetic peptide
DEEEIRTTNPVATEGYGSVSTNLQLEGDD

SEQ ID NO: 14137 - protein, 30 aa, Artificial Sequence
  Description of Artificial Sequence: Synthetic polypeptide
DEEEIRTTNPVATEQYGSVSNTNGGQRGEF

SEQ ID NO: 14138 - protein, 30 aa, Artificial Sequence
  Description of Artificial Sequence: Synthetic polypeptide
DEEEIRTTNPVATEGYGSVNFTNLIRGQNR

SEQ ID NO: 14139 - protein, 31 aa, Artificial Sequence
  Description of Artificial Sequence: Synthetic polypeptide
DEEEIRTTNPVATEQYGSVSGTNLQTSGGNM

SEQ ID NO: 14140 - protein, 31 aa, Artificial Sequence
  Description of Artificial Sequence: Synthetic polypeptide
DEEEIRTTNPVATEQYGSVSNTNLIRGENVE

SEQ ID NO: 14141 - protein, 30 aa, Artificial Sequence
  Description of Artificial Sequence: Synthetic polypeptide
DEEEIRTTNPCATEQYGSVCTNLEQERGNP

SEQ ID NO: 14142 - protein, 29 aa, Artificial Sequence
  Description of Artificial Sequence: Synthetic peptide
DEEEIRTTNPCATEQYGSVATNLQQEGNQ

SEQ ID NO: 14143 - protein, 30 aa, Artificial Sequence
  Description of Artificial Sequence: Synthetic polypeptide
DEEEIRTTNPVATEQYGSVSNTTLQRSTER

SEQ ID NO: 14144 - protein, 30 aa, Artificial Sequence
  Description of Artificial Sequence: Synthetic polypeptide
AEEEIRTTNPVATEQYGSVSVNLQRGSNAA

SEQ ID NO: 14145 - protein, 29 aa, Artificial Sequence
  Description of Artificial Sequence: Synthetic peptide
AEEEIRTTNPVATEQYGSVSVTNPYNGNR

SEQ ID NO: 14146 - protein, 30 aa, Artificial Sequence
  Description of Artificial Sequence: Synthetic polypeptide
DEEEIRTTNPVATEGYGSVSTNLQIGNEAI

SEQ ID NO: 14147 - protein, 29 aa, Artificial Sequence
  Description of Artificial Sequence: Synthetic peptide
AEEEIRTTNPVATEQYGSVSVNLQRGVIQ

SEQ ID NO: 14148 - protein, 30 aa, Artificial Sequence
  Description of Artificial Sequence: Synthetic polypeptide
DEEEIRTTNPVATEQYGSVSTMNLIETGNS

SEQ ID NO: 14149 - protein, 29 aa, Artificial Sequence
  Description of Artificial Sequence: Synthetic peptide
DEEEIRTTNPVATEQYGSVSIEVLQDGPR

SEQ ID NO: 14150 - protein, 29 aa, Artificial Sequence
  Description of Artificial Sequence: Synthetic peptide
AEEEIRTTNPVATEQYGSVSVNLQSGSNC

SEQ ID NO: 14151 - protein, 28 aa, Artificial Sequence
  Description of Artificial Sequence: Synthetic peptide
REEEIRATNPVASEQYGSVSNNDQRGNR

SEQ ID NO: 14152 - protein, 29 aa, Artificial Sequence
  Description of Artificial Sequence: Synthetic peptide
DEEEIRTTNPVATEQYGSVSNTNGQLENH

SEQ ID NO: 14153 - protein, 30 aa, Artificial Sequence
  Description of Artificial Sequence: Synthetic polypeptide
DEEEIRTTNPVATEGYGSVSTNLQMEGGNA

SEQ ID NO: 14154 - protein, 31 aa, Artificial Sequence
  Description of Artificial Sequence: Synthetic polypeptide
DEEEIRTTNPVATEQYGSVSNTNLIRGENIS

SEQ ID NO: 14155 - protein, 30 aa, Artificial Sequence
  Description of Artificial Sequence: Synthetic polypeptide
QEPEIRTTNPVATEQYGSVPSTNLQRVENR

SEQ ID NO: 14156 - protein, 31 aa, Artificial Sequence
  Description of Artificial Sequence: Synthetic polypeptide
DEEEIRTTNPVATEQYGSVSTMNLIQSGNLN

SEQ ID NO: 14157 - protein, 29 aa, Artificial Sequence
  Description of Artificial Sequence: Synthetic peptide
YEEEIRTTNPVGTEQYGSVSTNLQGTPNR

SEQ ID NO: 14158 - protein, 31 aa, Artificial Sequence
  Description of Artificial Sequence: Synthetic polypeptide
AEEEIRTTNPVATEQYGSVSVTNLQQNGANR

SEQ ID NO: 14159 - protein, 31 aa, Artificial Sequence
  Description of Artificial Sequence: Synthetic polypeptide
DEDEISTTNPVATEQYGSVSTENLQRFGSNR

SEQ ID NO: 14160 - protein, 30 aa, Artificial Sequence
  Description of Artificial Sequence: Synthetic polypeptide
QENEIRTTNPVATEQYGSVSTMNLQPRGNA

SEQ ID NO: 14161 - protein, 29 aa, Artificial Sequence
  Description of Artificial Sequence: Synthetic peptide
YEEEIRTTNPVATEIYGSVGSTNLQRVNV

SEQ ID NO: 14162 - protein, 29 aa, Artificial Sequence
  Description of Artificial Sequence: Synthetic peptide
QENEIRTTNPVATESYGSVSTNLDRSGNR

SEQ ID NO: 14163 - protein, 32 aa, Artificial Sequence
  Description of Artificial Sequence: Synthetic polypeptide
DEEEIRTTNPVATEQYGSVSNTNDMQRGNQRD

SEQ ID NO: 14164 - protein, 29 aa, Artificial Sequence
  Description of Artificial Sequence: Synthetic peptide
VENEIRTTNPVATDQYGSVSTNDLQNGNR

SEQ ID NO: 14165 - protein, 30 aa, Artificial Sequence
  Description of Artificial Sequence: Synthetic polypeptide
DEEEIRTTNPCATEQYGSVAVTNLQRGNNA

SEQ ID NO: 14166 - protein, 31 aa, Artificial Sequence
  Description of Artificial Sequence: Synthetic polypeptide
AEEEIRTTNPVATEQYGSVSVTNLLQDTGNR

SEQ ID NO: 14167 - protein, 29 aa, Artificial Sequence
  Description of Artificial Sequence: Synthetic peptide
VQEEIRTTNPVATEQYGVVSTNLQDGPNR

SEQ ID NO: 14168 - protein, 30 aa, Artificial Sequence
  Description of Artificial Sequence: Synthetic polypeptide
DEEEIRTTNPVATEHYGSVNCNLSQRGGNR

SEQ ID NO: 14169 - protein, 29 aa, Artificial Sequence
  Description of Artificial Sequence: Synthetic peptide
DEEEIRTTNPVATEQYGCVSTNLLSGNFM

SEQ ID NO: 14170 - protein, 30 aa, Artificial Sequence
  Description of Artificial Sequence: Synthetic polypeptide
DEEEIRTTNPVATEQYGSVSTMLQRNFNEG

SEQ ID NO: 14171 - protein, 31 aa, Artificial Sequence
  Description of Artificial Sequence: Synthetic polypeptide
DEEEIRTTNPVATEQYGSVSTMNLIQNGNNT

SEQ ID NO: 14172 - protein, 30 aa, Artificial Sequence
  Description of Artificial Sequence: Synthetic polypeptide
DEEEIRTTNPVATEQYGSVSPPNLQRVGVA

SEQ ID NO: 14173 - protein, 31 aa, Artificial Sequence
  Description of Artificial Sequence: Synthetic polypeptide
DEEEIRTTNPVATEQYGSVSTNDHQERDNIR

SEQ ID NO: 14174 - protein, 32 aa, Artificial Sequence
  Description of Artificial Sequence: Synthetic polypeptide
DEEEIRTTNPVATEHYGSVPSCTNELQRGNRV

SEQ ID NO: 14175 - protein, 29 aa, Artificial Sequence
  Description of Artificial Sequence: Synthetic peptide
YEEEIRTTNPVATEIYGSVVETNLQEGNR

SEQ ID NO: 14176 - protein, 31 aa, Artificial Sequence
  Description of Artificial Sequence: Synthetic polypeptide
DEEEIRTTNPVATEQYGSVSNTNLQQAGNGE

SEQ ID NO: 14177 - protein, 30 aa, Artificial Sequence
  Description of Artificial Sequence: Synthetic polypeptide
YEEEIRTTNPVATELYGSVSTNQIQRGNLR

SEQ ID NO: 14178 - protein, 29 aa, Artificial Sequence
  Description of Artificial Sequence: Synthetic peptide
VTEEIRTTNPVATEQYGVVSTNLQPGPNR

SEQ ID NO: 14179 - protein, 31 aa, Artificial Sequence
  Description of Artificial Sequence: Synthetic polypeptide
DEEEIRTTNPVATEQYGSVSPPNLEQNGNER

SEQ ID NO: 14180 - protein, 31 aa, Artificial Sequence
  Description of Artificial Sequence: Synthetic polypeptide
DEEEIRTTNPVATEQYGSVSNTTLQRVNPER

SEQ ID NO: 14181 - protein, 30 aa, Artificial Sequence
  Description of Artificial Sequence: Synthetic polypeptide
DEEEIRTTNPVATEQYGSVSTMQLGQEGNI

SEQ ID NO: 14182 - protein, 31 aa, Artificial Sequence
  Description of Artificial Sequence: Synthetic polypeptide
DEEEIRTTNPVATEQYGSVSNTTLSQRSTNR

SEQ ID NO: 14183 - protein, 31 aa, Artificial Sequence
  Description of Artificial Sequence: Synthetic polypeptide
DEEEIRTTNPVATEQYGCVSTINLQFFGQNR

SEQ ID NO: 14184 - protein, 30 aa, Artificial Sequence
  Description of Artificial Sequence: Synthetic polypeptide
DEEEIRTTNPVATEQYGSVSNTQNLDIGND

SEQ ID NO: 14185 - protein, 30 aa, Artificial Sequence
  Description of Artificial Sequence: Synthetic polypeptide
DEEEIRTTNPVATEQYGSVSPNDQRGPNQV

SEQ ID NO: 14186 - protein, 30 aa, Artificial Sequence
  Description of Artificial Sequence: Synthetic polypeptide
YEEQIRTTNPVATEQYGSVSITNLQRGLRP

SEQ ID NO: 14187 - protein, 30 aa, Artificial Sequence
  Description of Artificial Sequence: Synthetic polypeptide
DEEEIRTTNPVATEHYGSVSTNLQNGGNSN

SEQ ID NO: 14188 - protein, 29 aa, Artificial Sequence
  Description of Artificial Sequence: Synthetic peptide
DEEEIRTTNPVATEQYGSVSPNNINRGNP

SEQ ID NO: 14189 - protein, 28 aa, Artificial Sequence
  Description of Artificial Sequence: Synthetic peptide
YEEEIRCTNPIATEQYGSVSENLMRGNR

SEQ ID NO: 14190 - protein, 28 aa, Artificial Sequence
  Description of Artificial Sequence: Synthetic peptide
DEEEIRTTNPCATEQYGSVSVNIVRGNE

SEQ ID NO: 14191 - protein, 29 aa, Artificial Sequence
  Description of Artificial Sequence: Synthetic peptide
DEEEIRTTNPVATEQYGDVGSTNLQMGES

SEQ ID NO: 14192 - protein, 30 aa, Artificial Sequence
  Description of Artificial Sequence: Synthetic polypeptide
DEEEIRTTNPVATEQYGSVSNTELQPGNDS

SEQ ID NO: 14193 - protein, 31 aa, Artificial Sequence
  Description of Artificial Sequence: Synthetic polypeptide
DEEEIRTTNPVATEQYGSVSGTNLQGSGFNI

SEQ ID NO: 14194 - protein, 30 aa, Artificial Sequence
  Description of Artificial Sequence: Synthetic polypeptide
QEVEIRTTNPVATEQYGSVSTNLQNGNDRP

SEQ ID NO: 14195 - protein, 31 aa, Artificial Sequence
  Description of Artificial Sequence: Synthetic polypeptide
DEEEIRTTNPVATEQYGSVSNTTLQRMNQER

SEQ ID NO: 14196 - protein, 30 aa, Artificial Sequence
  Description of Artificial Sequence: Synthetic polypeptide
DEEEIRTTNPVATEQYGSVSPNLNNRGDDR

SEQ ID NO: 14197 - protein, 30 aa, Artificial Sequence
  Description of Artificial Sequence: Synthetic polypeptide
DEEEIRTTNPVATEQYGSVSNTVELQQGDR

SEQ ID NO: 14198 - protein, 29 aa, Artificial Sequence
  Description of Artificial Sequence: Synthetic peptide
DEDEIRTTNPVAYEQYGSVSTNGQDGENR

SEQ ID NO: 14199 - protein, 31 aa, Artificial Sequence
  Description of Artificial Sequence: Synthetic polypeptide
DEEEIRTTNPVATEQYGSVSNTTLQRMNLRD

SEQ ID NO: 14200 - protein, 28 aa, Artificial Sequence
  Description of Artificial Sequence: Synthetic peptide
DEEEIRTTNPVATEQYGSVSTNDDSGEN

SEQ ID NO: 14201 - protein, 29 aa, Artificial Sequence
  Description of Artificial Sequence: Synthetic peptide
QEEEIRTVNPVATEQYGSVSTVLQHAGNR

SEQ ID NO: 14202 - protein, 30 aa, Artificial Sequence
  Description of Artificial Sequence: Synthetic polypeptide
DEEEIRTTNPVATEMYGSVSTNLQMVGNGE

SEQ ID NO: 14203 - protein, 28 aa, Artificial Sequence
  Description of Artificial Sequence: Synthetic peptide
DEEEIRTTNPCATEQYGSVSYNNFRGND

SEQ ID NO: 14204 - protein, 29 aa, Artificial Sequence
  Description of Artificial Sequence: Synthetic peptide
YEAEIATTNPVATEQYGSVSTNIDQRGNR

SEQ ID NO: 14205 - protein, 28 aa, Artificial Sequence
  Description of Artificial Sequence: Synthetic peptide
QEEEIRTTNPVTPEQYGSVSTNLERGNG

SEQ ID NO: 14206 - protein, 31 aa, Artificial Sequence
  Description of Artificial Sequence: Synthetic polypeptide
YEPEIRTTNPVATEQYGSVSTNLQQRNGNER

SEQ ID NO: 14207 - protein, 31 aa, Artificial Sequence
  Description of Artificial Sequence: Synthetic polypeptide
YEEQIRTTNPVATEQYGSVVSTMNLQRGNRT

SEQ ID NO: 14208 - protein, 30 aa, Artificial Sequence
  Description of Artificial Sequence: Synthetic polypeptide
DEEEIRTTNPVATEQYGSVSTNDEDRGNDM

SEQ ID NO: 14209 - protein, 29 aa, Artificial Sequence
  Description of Artificial Sequence: Synthetic peptide
YEAEIKTTNPVATEQYGSVVTNLTQRGNR

SEQ ID NO: 14210 - protein, 31 aa, Artificial Sequence
  Description of Artificial Sequence: Synthetic polypeptide
YEAEIRTTNPVATEQYGSIVSTNNLQPRGNR

SEQ ID NO: 14211 - protein, 28 aa, Artificial Sequence
  Description of Artificial Sequence: Synthetic peptide
DEDEIRTTNPVAYEQYGSVSTNHQDGER

SEQ ID NO: 14212 - protein, 31 aa, Artificial Sequence
  Description of Artificial Sequence: Synthetic polypeptide
DEEEIRTTNPVATEQYGSVSNTNLQIGIQRQ

SEQ ID NO: 14213 - protein, 30 aa, Artificial Sequence
  Description of Artificial Sequence: Synthetic polypeptide
DEEEIRTTNPVATEQYGCVSTNLQEESGNA

SEQ ID NO: 14214 - protein, 28 aa, Artificial Sequence
  Description of Artificial Sequence: Synthetic peptide
SDEEIRTTNPVATGQYGSVSTSLQRGNF

SEQ ID NO: 14215 - protein, 29 aa, Artificial Sequence
  Description of Artificial Sequence: Synthetic peptide
DEEEIRTTNPVATEQYGSVSNTNLQISSQ

SEQ ID NO: 14216 - protein, 30 aa, Artificial Sequence
  Description of Artificial Sequence: Synthetic polypeptide
DEEEIRTTNPVATEMYGSVATNLQREGNTM

SEQ ID NO: 14217 - protein, 31 aa, Artificial Sequence
  Description of Artificial Sequence: Synthetic polypeptide
DEEEIRTTNPVATEPYGSVATNLQRGGNNRM

SEQ ID NO: 14218 - protein, 28 aa, Artificial Sequence
  Description of Artificial Sequence: Synthetic peptide
YENEIRTTNPVATEQYGSVSTNLQVHGN

SEQ ID NO: 14219 - protein, 29 aa, Artificial Sequence
  Description of Artificial Sequence: Synthetic peptide
YENEIRTTNPVATEQYGSVSTQLQNGSNR

SEQ ID NO: 14220 - protein, 30 aa, Artificial Sequence
  Description of Artificial Sequence: Synthetic polypeptide
DEEEIRTTNPVATEQYGSVSTNDLHDRGQH

SEQ ID NO: 14221 - protein, 30 aa, Artificial Sequence
  Description of Artificial Sequence: Synthetic polypeptide
DEEEIRTTNPVATEQYGSVSPNLDQRMDRG

SEQ ID NO: 14222 - protein, 31 aa, Artificial Sequence
  Description of Artificial Sequence: Synthetic polypeptide
DEEEIRTTNPVATEQYGSVSTNDDQYNGENR

SEQ ID NO: 14223 - protein, 30 aa, Artificial Sequence
  Description of Artificial Sequence: Synthetic polypeptide
DEEEIRTTNPVATEQYGSVSTNDDRGENHT

SEQ ID NO: 14224 - protein, 29 aa, Artificial Sequence
  Description of Artificial Sequence: Synthetic peptide
DEDEIRTTNPVAYEQYGSVSTNLQSGDAR

SEQ ID NO: 14225 - protein, 30 aa, Artificial Sequence
  Description of Artificial Sequence: Synthetic polypeptide
YDEEIRTTNPVATEQYGSVYTENLGQRGNR

SEQ ID NO: 14226 - protein, 31 aa, Artificial Sequence
  Description of Artificial Sequence: Synthetic polypeptide
DEEEIRTTNPVATEQYGSVSNTNLLRGENFE

SEQ ID NO: 14227 - protein, 31 aa, Artificial Sequence
  Description of Artificial Sequence: Synthetic polypeptide
DEEEIRTTNPVATEQYGSVSNTNLQGIGNAS

SEQ ID NO: 14228 - protein, 30 aa, Artificial Sequence
  Description of Artificial Sequence: Synthetic polypeptide
DEEEIRTTNPVATEQYGSVSTMLQQGNGPV

SEQ ID NO: 14229 - protein, 29 aa, Artificial Sequence
  Description of Artificial Sequence: Synthetic peptide
YEEEIRTTNPVATLQYGSVSTNQYQVGNR

SEQ ID NO: 14230 - protein, 30 aa, Artificial Sequence
  Description of Artificial Sequence: Synthetic polypeptide
DEEEIRTTNPVATEQYGSVSPNLGRGQIRT

SEQ ID NO: 14231 - protein, 29 aa, Artificial Sequence
  Description of Artificial Sequence: Synthetic peptide
YDEEIRTTNPVATESYGSVSTNLQRGNGD

SEQ ID NO: 14232 - protein, 31 aa, Artificial Sequence
  Description of Artificial Sequence: Synthetic polypeptide
DEEEIRTTNPVATEQYGSVSTNAASQRENNR

SEQ ID NO: 14233 - protein, 30 aa, Artificial Sequence
  Description of Artificial Sequence: Synthetic polypeptide
DEDEIRTTNPVAYEQYGSVSTNLQRGENDK

SEQ ID NO: 14234 - protein, 32 aa, Artificial Sequence
  Description of Artificial Sequence: Synthetic polypeptide
YEEEIRTTNPVATEQYGSVSTWNLHQRGENIR

SEQ ID NO: 14235 - protein, 30 aa, Artificial Sequence
  Description of Artificial Sequence: Synthetic polypeptide
DEDEIRTTNPVAYEQYGSVSTNLQRGDNGM

SEQ ID NO: 14236 - protein, 29 aa, Artificial Sequence
  Description of Artificial Sequence: Synthetic peptide
DEEEIRTTNPVATEQYGSVSTMYQRINNG

SEQ ID NO: 14237 - protein, 29 aa, Artificial Sequence
  Description of Artificial Sequence: Synthetic peptide
QEEEIRTTNPVAYEQYGSVSTNLQHGNNP

SEQ ID NO: 14238 - protein, 31 aa, Artificial Sequence
  Description of Artificial Sequence: Synthetic polypeptide
DEEEIRTTNPVATEQYGSVSGTNLQGDGENA

SEQ ID NO: 14239 - protein, 29 aa, Artificial Sequence
  Description of Artificial Sequence: Synthetic peptide
DEEEIRTTNPVATEQYGSVSTNDHQDGDD

SEQ ID NO: 14240 - protein, 29 aa, Artificial Sequence
  Description of Artificial Sequence: Synthetic peptide
QEEEIRTTNPVCTEQYGSVSTPLQRGFNQ

SEQ ID NO: 14241 - protein, 31 aa, Artificial Sequence
  Description of Artificial Sequence: Synthetic polypeptide
YEEQIRTTNPVATEQYGESVSTNLQRGSNDR

SEQ ID NO: 14242 - protein, 30 aa, Artificial Sequence
  Description of Artificial Sequence: Synthetic polypeptide
DEEEIRTTNPVATEQYGSVSIDLQRSGTDR

SEQ ID NO: 14243 - protein, 30 aa, Artificial Sequence
  Description of Artificial Sequence: Synthetic polypeptide
YEEEIRTTNPVATHQYGSVSVTNLQRGNGD

SEQ ID NO: 14244 - protein, 28 aa, Artificial Sequence
  Description of Artificial Sequence: Synthetic peptide
SEEEIATTNPTATEQYGSVSTNLQHGDR

SEQ ID NO: 14245 - protein, 31 aa, Artificial Sequence
  Description of Artificial Sequence: Synthetic polypeptide
DEEEIRTTNPVATEQYGSVSTMNQLQNSGNV

SEQ ID NO: 14246 - protein, 28 aa, Artificial Sequence
  Description of Artificial Sequence: Synthetic peptide
SEEEIATTNPIATEQYGDVSENLQRGNR

SEQ ID NO: 14247 - protein, 30 aa, Artificial Sequence
  Description of Artificial Sequence: Synthetic polypeptide
DEEEIRTTNPVATEQYGSVSPFLQRGVNVP

SEQ ID NO: 14248 - protein, 30 aa, Artificial Sequence
  Description of Artificial Sequence: Synthetic polypeptide
YEESIRTTNPVATEQYGTSVSTNLQRSGNV

SEQ ID NO: 14249 - protein, 28 aa, Artificial Sequence
  Description of Artificial Sequence: Synthetic peptide
DEEEIRTTNPCATEQYGSVATNLDRGSN

SEQ ID NO: 14250 - protein, 30 aa, Artificial Sequence
  Description of Artificial Sequence: Synthetic polypeptide
DEEEIRTTNPVATEQYGSVSPEYLQRGVRS

SEQ ID NO: 14251 - protein, 29 aa, Artificial Sequence
  Description of Artificial Sequence: Synthetic peptide
YEEEIRTTNPVATEWYGSASTANLERGNR

SEQ ID NO: 14252 - protein, 32 aa, Artificial Sequence
  Description of Artificial Sequence: Synthetic polypeptide
DEEEIRTTNPVATEHYGSVVSATNLSQRTGNR

SEQ ID NO: 14253 - protein, 30 aa, Artificial Sequence
  Description of Artificial Sequence: Synthetic polypeptide
DEEEIRTTNPVATEPYGSVCCTNLPRGGNR

SEQ ID NO: 14254 - protein, 30 aa, Artificial Sequence
  Description of Artificial Sequence: Synthetic polypeptide
DEEEIRTTNPVATEQYGSVSPNLQEGSNVI

SEQ ID NO: 14255 - protein, 31 aa, Artificial Sequence
  Description of Artificial Sequence: Synthetic polypeptide
DEEEIRTTNPVATEQYGSVSNTNLQIGAERQ

SEQ ID NO: 14256 - protein, 29 aa, Artificial Sequence
  Description of Artificial Sequence: Synthetic peptide
YEEEIRTTNPVATEVYGSVSTNLDRGEVR

SEQ ID NO: 14257 - protein, 28 aa, Artificial Sequence
  Description of Artificial Sequence: Synthetic peptide
DEEEIRTTNPVATEQYGCVSTPHQQGNV

SEQ ID NO: 14258 - protein, 29 aa, Artificial Sequence
  Description of Artificial Sequence: Synthetic peptide
YEEEIRTTNPVATETYGSVSTTLQRPGND

SEQ ID NO: 14259 - protein, 30 aa, Artificial Sequence
  Description of Artificial Sequence: Synthetic polypeptide
DEEEIRTTNPVATEQYGSVSTNDGLDEGNT

SEQ ID NO: 14260 - protein, 30 aa, Artificial Sequence
  Description of Artificial Sequence: Synthetic polypeptide
DEEEIRTTNPVATEMYGSVSTNALSQPGNL

SEQ ID NO: 14261 - protein, 32 aa, Artificial Sequence
  Description of Artificial Sequence: Synthetic polypeptide
DEEEIRTTNPVATEQYGSVSTNDLEQRGNNQA

SEQ ID NO: 14262 - protein, 29 aa, Artificial Sequence
  Description of Artificial Sequence: Synthetic peptide
DEEEIRTTNPVATEMYGSVSTNLERGEDL

SEQ ID NO: 14263 - protein, 32 aa, Artificial Sequence
  Description of Artificial Sequence: Synthetic polypeptide
DEEEIRTTNPVATEQYGSVSHTNDLQRGVNDG

SEQ ID NO: 14264 - protein, 30 aa, Artificial Sequence
  Description of Artificial Sequence: Synthetic polypeptide
DEEEIRTTNPVATEMYGSVSTNEQGGNDRM

SEQ ID NO: 14265 - protein, 29 aa, Artificial Sequence
  Description of Artificial Sequence: Synthetic peptide
YEEEIRTTNPVATETYGSVSTNLQRGDTS

SEQ ID NO: 14266 - protein, 29 aa, Artificial Sequence
  Description of Artificial Sequence: Synthetic peptide
DEEEIRTTNPVATEQFGTSVSTYLDRGNP

SEQ ID NO: 14267 - protein, 30 aa, Artificial Sequence
  Description of Artificial Sequence: Synthetic polypeptide
DEEEIRTTNPVATEQYGCVSTNISDRGNNR

SEQ ID NO: 14268 - protein, 30 aa, Artificial Sequence
  Description of Artificial Sequence: Synthetic polypeptide
DEEEIRTTNPVATEQYGCVSTNLQDGDNNG

SEQ ID NO: 14269 - protein, 30 aa, Artificial Sequence
  Description of Artificial Sequence: Synthetic polypeptide
DEEEIRTTNPVATEQYGSVSTNDFQEGGNP

SEQ ID NO: 14270 - protein, 31 aa, Artificial Sequence
  Description of Artificial Sequence: Synthetic polypeptide
DEEEIRTTNPVATEQYGSVSTNDLENDGNQR

SEQ ID NO: 14271 - protein, 29 aa, Artificial Sequence
  Description of Artificial Sequence: Synthetic peptide
DEEEIRTTNPVATEMYGSVSTNLQDGDDQ

SEQ ID NO: 14272 - protein, 28 aa, Artificial Sequence
  Description of Artificial Sequence: Synthetic peptide
YEEEIRCTNPVATEQYGVVSENLQSGNR

SEQ ID NO: 14273 - protein, 30 aa, Artificial Sequence
  Description of Artificial Sequence: Synthetic polypeptide
DEEEIRTTNPVATEQYGSVSTMWDLQRENV

SEQ ID NO: 14274 - protein, 30 aa, Artificial Sequence
  Description of Artificial Sequence: Synthetic polypeptide
DEEEIRTTNPVATEQYGCVSTNLQANGENH

SEQ ID NO: 14275 - protein, 29 aa, Artificial Sequence
  Description of Artificial Sequence: Synthetic peptide
DEEEIRTTNPVATEMYGSVSTNLQDGPDS

SEQ ID NO: 14276 - protein, 30 aa, Artificial Sequence
  Description of Artificial Sequence: Synthetic polypeptide
YEEEIRTTNPVATEYYGSVSTSNLQKGNRG

SEQ ID NO: 14277 - protein, 30 aa, Artificial Sequence
  Description of Artificial Sequence: Synthetic polypeptide
DEEEIRTTNPVATEMYGSVSTNLQDGNNVV

SEQ ID NO: 14278 - protein, 31 aa, Artificial Sequence
  Description of Artificial Sequence: Synthetic polypeptide
YEDEIRTTNPVATEQYGSDVSTGNLQRGNSR

SEQ ID NO: 14279 - protein, 30 aa, Artificial Sequence
  Description of Artificial Sequence: Synthetic polypeptide
YEEEIRTTNPVATEYYGSVASTNLQRGNDV

SEQ ID NO: 14280 - protein, 31 aa, Artificial Sequence
  Description of Artificial Sequence: Synthetic polypeptide
DEEEIRTTNPVATEQYGSVSTNDLEVGVNVR

SEQ ID NO: 14281 - protein, 29 aa, Artificial Sequence
  Description of Artificial Sequence: Synthetic peptide
YEPEIRTTNPVATEQYGSVSTNLPQRGLQ

SEQ ID NO: 14282 - protein, 30 aa, Artificial Sequence
  Description of Artificial Sequence: Synthetic polypeptide
YEERIRTTNPVATEQYGSVSTNQQERGDNR

SEQ ID NO: 14283 - protein, 30 aa, Artificial Sequence
  Description of Artificial Sequence: Synthetic polypeptide
YEPEIRTTNPVATEQYGSVSTGLLQRGNVR

SEQ ID NO: 14284 - protein, 28 aa, Artificial Sequence
  Description of Artificial Sequence: Synthetic peptide
YEEEIRTTNPVATEWYGTVSTNLQYGIR

SEQ ID NO: 14285 - protein, 29 aa, Artificial Sequence
  Description of Artificial Sequence: Synthetic peptide
DEEEIRTTNPVATEQYGSVSTMLLQRQDE

SEQ ID NO: 14286 - protein, 29 aa, Artificial Sequence
  Description of Artificial Sequence: Synthetic peptide
YEEEIRTTNPVATHQYGSVSTMNLQKGNN

SEQ ID NO: 14287 - protein, 29 aa, Artificial Sequence
  Description of Artificial Sequence: Synthetic peptide
YEEEIRTTNPVATEWYGSVSTNGQDGNRE

SEQ ID NO: 14288 - protein, 29 aa, Artificial Sequence
  Description of Artificial Sequence: Synthetic peptide
YENEIRTTNPVATTQYGSVSTNVLQGGNR

SEQ ID NO: 14289 - protein, 30 aa, Artificial Sequence
  Description of Artificial Sequence: Synthetic polypeptide
DEEEIRTTNPVATEQYGSVSNTMGDRGNQR

SEQ ID NO: 14290 - protein, 31 aa, Artificial Sequence
  Description of Artificial Sequence: Synthetic polypeptide
QETEIRTTNPVATEQYGSVSTNLQQRAGNDR

SEQ ID NO: 14291 - protein, 31 aa, Artificial Sequence
  Description of Artificial Sequence: Synthetic polypeptide
DEEEIRTTNPVATEQYGSVSNTTLQRLNEGR

SEQ ID NO: 14292 - protein, 28 aa, Artificial Sequence
  Description of Artificial Sequence: Synthetic peptide
YEEEIRTTNPVATEQYGVVSDNLQAGNA

SEQ ID NO: 14293 - protein, 30 aa, Artificial Sequence
  Description of Artificial Sequence: Synthetic polypeptide
DEEEIRTTNPVATEMYGSVSTNLQDGNDGQ

SEQ ID NO: 14294 - protein, 29 aa, Artificial Sequence
  Description of Artificial Sequence: Synthetic peptide
DEEEIRTTNPVATEQYGSVSTNDEQGGMI

SEQ ID NO: 14295 - protein, 28 aa, Artificial Sequence
  Description of Artificial Sequence: Synthetic peptide
YEEEIRCTNPSATEQYGSVSENLMRGNR

SEQ ID NO: 14296 - protein, 31 aa, Artificial Sequence
  Description of Artificial Sequence: Synthetic polypeptide
DEEEIRTTNPVATEQYGSVSTNDLESNGNGR

SEQ ID NO: 14297 - protein, 29 aa, Artificial Sequence
  Description of Artificial Sequence: Synthetic peptide
DEEEIRTTNPCATEQYGSVATNLARGNDA

SEQ ID NO: 14298 - protein, 29 aa, Artificial Sequence
  Description of Artificial Sequence: Synthetic peptide
YEDEIRTTNPVATEQYGSVSEPNLQRGNT

SEQ ID NO: 14299 - protein, 28 aa, Artificial Sequence
  Description of Artificial Sequence: Synthetic peptide
QEEKIRTTNPVATEPYGSVSTNDQRGER

SEQ ID NO: 14300 - protein, 32 aa, Artificial Sequence
  Description of Artificial Sequence: Synthetic polypeptide
DEEEIRTTNPVATEQYGSVSPGFNLQRGNERN

SEQ ID NO: 14301 - protein, 29 aa, Artificial Sequence
  Description of Artificial Sequence: Synthetic peptide
DEEEIRTTNPVATEQYGSVSPNLQIPDVR

SEQ ID NO: 14302 - protein, 30 aa, Artificial Sequence
  Description of Artificial Sequence: Synthetic polypeptide
DEEEIRTTNPVATEGYGSVSTMNLQFTGNN

SEQ ID NO: 14303 - protein, 31 aa, Artificial Sequence
  Description of Artificial Sequence: Synthetic polypeptide
QEEEIRTTNPVAYEQYGSMVSDTNLNQRGNR

SEQ ID NO: 14304 - protein, 30 aa, Artificial Sequence
  Description of Artificial Sequence: Synthetic polypeptide
DEEEIRTTNPVATEQYGSVSPDNLQRTNQE

SEQ ID NO: 14305 - protein, 30 aa, Artificial Sequence
  Description of Artificial Sequence: Synthetic polypeptide
DEEEIRTTNPVATEQYGSVSNTNLNGNGNN

SEQ ID NO: 14306 - protein, 32 aa, Artificial Sequence
  Description of Artificial Sequence: Synthetic polypeptide
DEEEIRTTNPVATEPYGWSVSTANLQDRIGNR

SEQ ID NO: 14307 - protein, 30 aa, Artificial Sequence
  Description of Artificial Sequence: Synthetic polypeptide
DEEEIRTTNPVATEQYGCVSTNLNRGSNGQ

SEQ ID NO: 14308 - protein, 32 aa, Artificial Sequence
  Description of Artificial Sequence: Synthetic polypeptide
WEEEIRTTNPVATEQYGSVSTSNLEQRGENMR

SEQ ID NO: 14309 - protein, 32 aa, Artificial Sequence
  Description of Artificial Sequence: Synthetic polypeptide
WEEEIRTTNPVATEQYGSVSTSNLNQRGENGR

SEQ ID NO: 14310 - protein, 31 aa, Artificial Sequence
  Description of Artificial Sequence: Synthetic polypeptide
DEEEIRTTNPVATEQYGSVSNTNTQPGNEMR

SEQ ID NO: 14311 - protein, 30 aa, Artificial Sequence
  Description of Artificial Sequence: Synthetic polypeptide
DEEEIRTTNPVATEQYGCVSWPNLARGGNR

SEQ ID NO: 14312 - protein, 30 aa, Artificial Sequence
  Description of Artificial Sequence: Synthetic polypeptide
DEEEIRTTNPVATEMYGSVSTNLQQGNDPV

SEQ ID NO: 14313 - protein, 32 aa, Artificial Sequence
  Description of Artificial Sequence: Synthetic polypeptide
QEEEIRTTNPVATEQYGSVSTVNLEQRGENYR

SEQ ID NO: 14314 - protein, 31 aa, Artificial Sequence
  Description of Artificial Sequence: Synthetic polypeptide
DEEEIRTTNPVATEQYGSVSTNDLDQRGMED

SEQ ID NO: 14315 - protein, 30 aa, Artificial Sequence
  Description of Artificial Sequence: Synthetic polypeptide
DEEEIRTTNPVATEQYGSVSPDNLQRLNNG

SEQ ID NO: 14316 - protein, 32 aa, Artificial Sequence
  Description of Artificial Sequence: Synthetic polypeptide
WEEEIRTTNPVATEQYGSVSTSNLTQRGENER

SEQ ID NO: 14317 - protein, 30 aa, Artificial Sequence
  Description of Artificial Sequence: Synthetic polypeptide
DEEEIRTTNPVATEQYGCVSTNLNRGSNNQ

SEQ ID NO: 14318 - protein, 29 aa, Artificial Sequence
  Description of Artificial Sequence: Synthetic peptide
DEEEIRTTNPVATEQFGTSVSTQLMRGNS

SEQ ID NO: 14319 - protein, 32 aa, Artificial Sequence
  Description of Artificial Sequence: Synthetic polypeptide
WEEEIRTTNPVATEQYGSVSTYNLEQRGENER

SEQ ID NO: 14320 - protein, 28 aa, Artificial Sequence
  Description of Artificial Sequence: Synthetic peptide
QEEGIRTTNPVATEQYGSVSTNLIGENR

SEQ ID NO: 14321 - protein, 30 aa, Artificial Sequence
  Description of Artificial Sequence: Synthetic polypeptide
QEEEIRTTNPVATEQYGSVTSTNLQGGNNI

SEQ ID NO: 14322 - protein, 30 aa, Artificial Sequence
  Description of Artificial Sequence: Synthetic polypeptide
DEEEIRTTNPVATEMYGSVSTNLQNGGNNE

SEQ ID NO: 14323 - protein, 32 aa, Artificial Sequence
  Description of Artificial Sequence: Synthetic polypeptide
DEEEIRTTNPVATEQYGSVSTNDLQDRSGNAQ

SEQ ID NO: 14324 - protein, 30 aa, Artificial Sequence
  Description of Artificial Sequence: Synthetic polypeptide
YEQEIRTTNPVATEQYGTVSTTNLQRGNRD

SEQ ID NO: 14325 - protein, 30 aa, Artificial Sequence
  Description of Artificial Sequence: Synthetic polypeptide
DEEEIRTTNPVATEQYGSVSPNGLQRGIIP

SEQ ID NO: 14326 - protein, 30 aa, Artificial Sequence
  Description of Artificial Sequence: Synthetic polypeptide
DEEEIRTTNPVATEHYGSVSTNLQDAGNVN

SEQ ID NO: 14327 - protein, 28 aa, Artificial Sequence
  Description of Artificial Sequence: Synthetic peptide
YEEKIRTTNPVATEWYGSVSTNAQRGER

SEQ ID NO: 14328 - protein, 29 aa, Artificial Sequence
  Description of Artificial Sequence: Synthetic peptide
YEELIRTTNPVATEQYGSVSDPNLQGGNR

SEQ ID NO: 14329 - protein, 32 aa, Artificial Sequence
  Description of Artificial Sequence: Synthetic polypeptide
WEEEIRTTNPVATEQYGSVSTSNLDQRGENDR

SEQ ID NO: 14330 - protein, 30 aa, Artificial Sequence
  Description of Artificial Sequence: Synthetic polypeptide
AEEEIRTTNPVATEQYGSVSVTNLFQNGNP

SEQ ID NO: 14331 - protein, 31 aa, Artificial Sequence
  Description of Artificial Sequence: Synthetic polypeptide
DEEEIRTTNPVATEQYGSVSNTNTNQRGSER

SEQ ID NO: 14332 - protein, 30 aa, Artificial Sequence
  Description of Artificial Sequence: Synthetic polypeptide
DEEEIRTTNPVATEQYGSVSGTNNQVGNPV

SEQ ID NO: 14333 - protein, 30 aa, Artificial Sequence
  Description of Artificial Sequence: Synthetic polypeptide
YEEDIRTTNPVATEQYGSVVTNLQRPGNDR

SEQ ID NO: 14334 - protein, 28 aa, Artificial Sequence
  Description of Artificial Sequence: Synthetic peptide
YERGIRTTNPVATEGYGSVSTNLQRGNQ

SEQ ID NO: 14335 - protein, 28 aa, Artificial Sequence
  Description of Artificial Sequence: Synthetic peptide
YEEEIRTTNPVATEQYGSVATHLQNGFR

SEQ ID NO: 14336 - protein, 30 aa, Artificial Sequence
  Description of Artificial Sequence: Synthetic polypeptide
YEEEIQTTNPVATEQYGSVSFTNLQNDGNR

SEQ ID NO: 14337 - protein, 30 aa, Artificial Sequence
  Description of Artificial Sequence: Synthetic polypeptide
DEEEIRTTNPVATEQYGCVSTNDQNRGNEM

SEQ ID NO: 14338 - protein, 30 aa, Artificial Sequence
  Description of Artificial Sequence: Synthetic polypeptide
DEEEIRTTNPVATEQYGCVSTNLDHGMNDR

SEQ ID NO: 14339 - protein, 29 aa, Artificial Sequence
  Description of Artificial Sequence: Synthetic peptide
YEEEIRTTNPVAYEQYGSVSLTNLIRNNR

SEQ ID NO: 14340 - protein, 30 aa, Artificial Sequence
  Description of Artificial Sequence: Synthetic polypeptide
YEEEIRTTNPVAWEQYGSVSTTNLQRGNDL

SEQ ID NO: 14341 - protein, 32 aa, Artificial Sequence
  Description of Artificial Sequence: Synthetic polypeptide
QEEEIRTTNPVATEQYGSVSTSNLTQRGENIR

SEQ ID NO: 14342 - protein, 29 aa, Artificial Sequence
  Description of Artificial Sequence: Synthetic peptide
AEEEIRTTNPVATEQYGSVSVQNLQIQNR

SEQ ID NO: 14343 - protein, 30 aa, Artificial Sequence
  Description of Artificial Sequence: Synthetic polypeptide
DEEEIRTTNPVATEQYGCVSYTNLQSGTRM

SEQ ID NO: 14344 - protein, 31 aa, Artificial Sequence
  Description of Artificial Sequence: Synthetic polypeptide
DEEEIRTTNPVATEQYGCVSTNLQERGPERM

SEQ ID NO: 14345 - protein, 29 aa, Artificial Sequence
  Description of Artificial Sequence: Synthetic peptide
DEEEIRTTNPVATEQYGSVSPNNLQLIHR

SEQ ID NO: 14346 - protein, 32 aa, Artificial Sequence
  Description of Artificial Sequence: Synthetic polypeptide
WEEEIRTTNPVATEQYGSVSTGNLAQRGENER

SEQ ID NO: 14347 - protein, 30 aa, Artificial Sequence
  Description of Artificial Sequence: Synthetic polypeptide
DEEEIRTTNPVATEQYGCVSTNLDERGDRI

SEQ ID NO: 14348 - protein, 30 aa, Artificial Sequence
  Description of Artificial Sequence: Synthetic polypeptide
YEEEIRTTNPVAVEQYGSVSTNNLQRGNTD

SEQ ID NO: 14349 - protein, 31 aa, Artificial Sequence
  Description of Artificial Sequence: Synthetic polypeptide
DEEEIRTTNPVATEQYGCVSTNLQERGEARM

SEQ ID NO: 14350 - protein, 29 aa, Artificial Sequence
  Description of Artificial Sequence: Synthetic peptide
YEEIIGTTNPVATEQYGSVYSTNLQNGNR

SEQ ID NO: 14351 - protein, 29 aa, Artificial Sequence
  Description of Artificial Sequence: Synthetic peptide
YEEEIRTTNPVATVQYGSVSTNQQGRGVR

SEQ ID NO: 14352 - protein, 29 aa, Artificial Sequence
  Description of Artificial Sequence: Synthetic peptide
YEREIRTTNPVATEQYGSVVTNLARGNDR

SEQ ID NO: 14353 - protein, 30 aa, Artificial Sequence
  Description of Artificial Sequence: Synthetic polypeptide
DEEEIRTTNPVATEQYGDVSDTNLQSGNGG

SEQ ID NO: 14354 - protein, 29 aa, Artificial Sequence
  Description of Artificial Sequence: Synthetic peptide
YEREIRTTNPVATEQYGSVSETNLQHVNR

SEQ ID NO: 14355 - protein, 31 aa, Artificial Sequence
  Description of Artificial Sequence: Synthetic polypeptide
DEEEIRTTNPVATEQYGCVSTNLQERGDERL

SEQ ID NO: 14356 - protein, 31 aa, Artificial Sequence
  Description of Artificial Sequence: Synthetic polypeptide
DEEEIRTTNPVATEQYGSVSTMNLEQGGNDE

SEQ ID NO: 14357 - protein, 32 aa, Artificial Sequence
  Description of Artificial Sequence: Synthetic polypeptide
WEEEIRTTNPVATEQYGSVSTPNLGQRGENIR

SEQ ID NO: 14358 - protein, 30 aa, Artificial Sequence
  Description of Artificial Sequence: Synthetic polypeptide
DEEEIRTTNPVATEQYGSVSNTLLQRQVER

SEQ ID NO: 14359 - protein, 32 aa, Artificial Sequence
  Description of Artificial Sequence: Synthetic polypeptide
WEEEIRTTNPVATEQYGSVSTPNLDQRGENFR

SEQ ID NO: 14360 - protein, 29 aa, Artificial Sequence
  Description of Artificial Sequence: Synthetic peptide
DEEEIRTTNPVATEQYGSVSTMLINNGNT

SEQ ID NO: 14361 - protein, 30 aa, Artificial Sequence
  Description of Artificial Sequence: Synthetic polypeptide
YEELIRTTNPVATEQYGSVSDTNNLQRGER

SEQ ID NO: 14362 - protein, 32 aa, Artificial Sequence
  Description of Artificial Sequence: Synthetic polypeptide
DEEEIRTTNPVATEQYGSVSNTSDLQRGNNDR

SEQ ID NO: 14363 - protein, 30 aa, Artificial Sequence
  Description of Artificial Sequence: Synthetic polypeptide
YEEEIRTTNPVATTQYGSVSFTNLQRGNGS

SEQ ID NO: 14364 - protein, 29 aa, Artificial Sequence
  Description of Artificial Sequence: Synthetic peptide
DEEEIRTTNPVATEQFGTSVSTWLDRGNS

SEQ ID NO: 14365 - protein, 30 aa, Artificial Sequence
  Description of Artificial Sequence: Synthetic polypeptide
DEEEIRTTNPVATEQYGSVSGTNNQIGNPQ

SEQ ID NO: 14366 - protein, 30 aa, Artificial Sequence
  Description of Artificial Sequence: Synthetic polypeptide
DEEEIRTTNPVATEHYGSVSTNLQGNEGNA

SEQ ID NO: 14367 - protein, 30 aa, Artificial Sequence
  Description of Artificial Sequence: Synthetic polypeptide
DEEEIRTTNPVATEHYGSVSTNLQHDGNNV

SEQ ID NO: 14368 - protein, 30 aa, Artificial Sequence
  Description of Artificial Sequence: Synthetic polypeptide
DEEEIRTTNPVATEQYGCVSTNLARGQNQT

SEQ ID NO: 14369 - protein, 31 aa, Artificial Sequence
  Description of Artificial Sequence: Synthetic polypeptide
DEEEIRTTNPVATEPYGSTVSTNLQRGGSLR

SEQ ID NO: 14370 - protein, 30 aa, Artificial Sequence
  Description of Artificial Sequence: Synthetic polypeptide
DEEEIRTTNPVATEQYGCVSTNLQAGDNDD

SEQ ID NO: 14371 - protein, 30 aa, Artificial Sequence
  Description of Artificial Sequence: Synthetic polypeptide
YEEEIRTTNPVATTQYGEVSTNLQRFGNAR

SEQ ID NO: 14372 - protein, 31 aa, Artificial Sequence
  Description of Artificial Sequence: Synthetic polypeptide
DEEEIRTTNPVATEQYGSVSIDLQVRGSNDR

SEQ ID NO: 14373 - protein, 29 aa, Artificial Sequence
  Description of Artificial Sequence: Synthetic peptide
DEEEIRTTNPVATEQYGSVSPGLQRGVQF

SEQ ID NO: 14374 - protein, 29 aa, Artificial Sequence
  Description of Artificial Sequence: Synthetic peptide
YEEEIRTTNPVATTQYGAVSTNNLQHGNR

SEQ ID NO: 14375 - protein, 30 aa, Artificial Sequence
  Description of Artificial Sequence: Synthetic polypeptide
YEEPIRTTNPVATEQYGSVMTNLQRQGNDR

SEQ ID NO: 14376 - protein, 30 aa, Artificial Sequence
  Description of Artificial Sequence: Synthetic polypeptide
DEEEIRTTNPVATEHYGSVSTNLQKDGNNG

SEQ ID NO: 14377 - protein, 29 aa, Artificial Sequence
  Description of Artificial Sequence: Synthetic peptide
QEVEIRTTNPVATEQYGSVSWNNLQRGNT

SEQ ID NO: 14378 - protein, 29 aa, Artificial Sequence
  Description of Artificial Sequence: Synthetic peptide
YENEIRTTNPVATEQYGSVSTNLQRNVER

SEQ ID NO: 14379 - protein, 30 aa, Artificial Sequence
  Description of Artificial Sequence: Synthetic polypeptide
DEEEIRTTNPVATEHYGSVSTNLQNDGNNH

SEQ ID NO: 14380 - protein, 28 aa, Artificial Sequence
  Description of Artificial Sequence: Synthetic peptide
YEEEIRCTNPIATEQYGSVSENLCRGNR

SEQ ID NO: 14381 - protein, 29 aa, Artificial Sequence
  Description of Artificial Sequence: Synthetic peptide
DEEEIRTTNPVATEQYGCVSTPLIGSGNR

SEQ ID NO: 14382 - protein, 30 aa, Artificial Sequence
  Description of Artificial Sequence: Synthetic polypeptide
QEEEIRTTNPVATEWYGSVSWTDLQRGMNR

SEQ ID NO: 14383 - protein, 29 aa, Artificial Sequence
  Description of Artificial Sequence: Synthetic peptide
YEEEIRTTNPVATRHYGSVSTNLERGNRY

SEQ ID NO: 14384 - protein, 30 aa, Artificial Sequence
  Description of Artificial Sequence: Synthetic polypeptide
QEEEISTTNPVATEQYGSVNCDTNLQRGNR

SEQ ID NO: 14385 - protein, 30 aa, Artificial Sequence
  Description of Artificial Sequence: Synthetic polypeptide
DEEEIRTTNPVATEMYGSVATNLQDRGNDE

SEQ ID NO: 14386 - protein, 28 aa, Artificial Sequence
  Description of Artificial Sequence: Synthetic peptide
DEDEIRTTNPVAYEQYGSVSTNMQHGER

SEQ ID NO: 14387 - protein, 30 aa, Artificial Sequence
  Description of Artificial Sequence: Synthetic polypeptide
YEEEIRTTNPVATMQYGSVSMTNLQRFGER

SEQ ID NO: 14388 - protein, 30 aa, Artificial Sequence
  Description of Artificial Sequence: Synthetic polypeptide
YEQEIRTTNPVATEQYGSVSETNLDQVGNR

SEQ ID NO: 14389 - protein, 28 aa, Artificial Sequence
  Description of Artificial Sequence: Synthetic peptide
DEEEIRTTNPVATEQYGCVYTNLQNGDD

SEQ ID NO: 14390 - protein, 30 aa, Artificial Sequence
  Description of Artificial Sequence: Synthetic polypeptide
DEEEIRTTNPVATEPYGTVSVTNLSQRGDR

SEQ ID NO: 14391 - protein, 30 aa, Artificial Sequence
  Description of Artificial Sequence: Synthetic polypeptide
DEEEIRTTNPCATEQYGSVITTNLQRGNEP

SEQ ID NO: 14392 - protein, 30 aa, Artificial Sequence
  Description of Artificial Sequence: Synthetic polypeptide
DEEEIRTTNPVATEQYGSVSPNGLQRGLVS

SEQ ID NO: 14393 - protein, 30 aa, Artificial Sequence
  Description of Artificial Sequence: Synthetic polypeptide
DEEEIRTTNPVATEQYGCVSTNELGRENRN

SEQ ID NO: 14394 - protein, 29 aa, Artificial Sequence
  Description of Artificial Sequence: Synthetic peptide
YENEIRTTNPVATEQYGSVSQNDLQNGNR

SEQ ID NO: 14395 - protein, 31 aa, Artificial Sequence
  Description of Artificial Sequence: Synthetic polypeptide
DEEEIRTTNPVATEQYGCVSTNELQRGDMRL

SEQ ID NO: 14396 - protein, 30 aa, Artificial Sequence
  Description of Artificial Sequence: Synthetic polypeptide
DEEEIRTTNPVATEQYGCVSWTTLNRGMNR

SEQ ID NO: 14397 - protein, 30 aa, Artificial Sequence
  Description of Artificial Sequence: Synthetic polypeptide
YEENIRTTNPVATEMYGSVSTSNLQRGNNR

SEQ ID NO: 14398 - protein, 31 aa, Artificial Sequence
  Description of Artificial Sequence: Synthetic polypeptide
DEEEIRTTNPCATEQYGSVIYSTNLQRGNDD

SEQ ID NO: 14399 - protein, 30 aa, Artificial Sequence
  Description of Artificial Sequence: Synthetic polypeptide
DEEEIRTTNPVATEQYGCVSTNLQEGDNDL

SEQ ID NO: 14400 - protein, 29 aa, Artificial Sequence
  Description of Artificial Sequence: Synthetic peptide
DEEEIRTTNPVATEQYGCVSTNFLERGEQ

SEQ ID NO: 14401 - protein, 28 aa, Artificial Sequence
  Description of Artificial Sequence: Synthetic peptide
DEDEIRTTNPVAYEQYGSVSSNLQNGNQ

SEQ ID NO: 14402 - protein, 31 aa, Artificial Sequence
  Description of Artificial Sequence: Synthetic polypeptide
DEEEIRTTNPVATEQYGSVSGTNLQFNTGND

SEQ ID NO: 14403 - protein, 33 aa, Artificial Sequence
  Description of Artificial Sequence: Synthetic polypeptide
DEEEIRTTNPVATEQYGSVSTNDLNQRMGNNRD

SEQ ID NO: 14404 - protein, 28 aa, Artificial Sequence
  Description of Artificial Sequence: Synthetic peptide
YEQEIRTTNPVATEQYGSVSTNVERGNF

SEQ ID NO: 14405 - protein, 30 aa, Artificial Sequence
  Description of Artificial Sequence: Synthetic polypeptide
AEEEIRTTNPVATEQYGSVSVTNLDQPGNP

SEQ ID NO: 14406 - protein, 28 aa, Artificial Sequence
  Description of Artificial Sequence: Synthetic peptide
QEEEIRTTNPVATEQYGSVYTALQNGFR

SEQ ID NO: 14407 - protein, 29 aa, Artificial Sequence
  Description of Artificial Sequence: Synthetic peptide
DEEEIRTTNPVATEQYGCVSTNMQHGNMP

SEQ ID NO: 14408 - protein, 29 aa, Artificial Sequence
  Description of Artificial Sequence: Synthetic peptide
DEEEIRTTNPVATEQYGSVSTMLGRSFNM

SEQ ID NO: 14409 - protein, 29 aa, Artificial Sequence
  Description of Artificial Sequence: Synthetic peptide
DEEEIRTTNPVATEQFGTSVSTYLMRGNM

SEQ ID NO: 14410 - protein, 29 aa, Artificial Sequence
  Description of Artificial Sequence: Synthetic peptide
YEQEIRTTNPVATEQYGSVSTNLQRGDHT

SEQ ID NO: 14411 - protein, 29 aa, Artificial Sequence
  Description of Artificial Sequence: Synthetic peptide
DEEEIRTTNPVATEPYGTVSEDLQMRGNR

SEQ ID NO: 14412 - protein, 29 aa, Artificial Sequence
  Description of Artificial Sequence: Synthetic peptide
QEEEIRTTNPVATEQYGTVISTDLQRENR

SEQ ID NO: 14413 - protein, 30 aa, Artificial Sequence
  Description of Artificial Sequence: Synthetic polypeptide
YEENIRTTNPVATEQYGSVPSTGNLQRQNR

SEQ ID NO: 14414 - protein, 28 aa, Artificial Sequence
  Description of Artificial Sequence: Synthetic peptide
QEVEIRTTNPVSTEQYGDVSENLQRGNR

SEQ ID NO: 14415 - protein, 30 aa, Artificial Sequence
  Description of Artificial Sequence: Synthetic polypeptide
YEENIRTTNPVATEQYGSVSTNLQRQGNND

SEQ ID NO: 14416 - protein, 29 aa, Artificial Sequence
  Description of Artificial Sequence: Synthetic peptide
DEEEIRTTNPVATEQYGSVSTMLIFNGNE

SEQ ID NO: 14417 - protein, 30 aa, Artificial Sequence
  Description of Artificial Sequence: Synthetic polypeptide
SEEEIATTNPVATEQYGESVATNLQRGNRA

SEQ ID NO: 14418 - protein, 30 aa, Artificial Sequence
  Description of Artificial Sequence: Synthetic polypeptide
DEEEIRTTNPVATEQYGSVSTMLQQGNGEL

SEQ ID NO: 14419 - protein, 29 aa, Artificial Sequence
  Description of Artificial Sequence: Synthetic peptide
DEEEIRTTNPVATEQYGSVSPELQRGDDG

SEQ ID NO: 14420 - protein, 29 aa, Artificial Sequence
  Description of Artificial Sequence: Synthetic peptide
YEEEIRTTNPVATESYGSVGSTNLQRNNY

SEQ ID NO: 14421 - protein, 29 aa, Artificial Sequence
  Description of Artificial Sequence: Synthetic peptide
DEEEIRTTNPVATEQYGSVSPANLERGEV

SEQ ID NO: 14422 - protein, 31 aa, Artificial Sequence
  Description of Artificial Sequence: Synthetic polypeptide
DEEEIRTTNPVATEQYGSVSPINLQRGLMRE

SEQ ID NO: 14423 - protein, 30 aa, Artificial Sequence
  Description of Artificial Sequence: Synthetic polypeptide
DEEEIRTTNPVATEQYGCVSTNLIHGDNDR

SEQ ID NO: 14424 - protein, 29 aa, Artificial Sequence
  Description of Artificial Sequence: Synthetic peptide
DEEEIRTTNPVATEQYGSVSPINLQQQNV

SEQ ID NO: 14425 - protein, 31 aa, Artificial Sequence
  Description of Artificial Sequence: Synthetic polypeptide
DEEEIRTTNPVATEQYGSVSNTGLQRSNENR

SEQ ID NO: 14426 - protein, 30 aa, Artificial Sequence
  Description of Artificial Sequence: Synthetic polypeptide
DEEEIRTTNPVATEQYGSVSINLGVRGELR

SEQ ID NO: 14427 - protein, 30 aa, Artificial Sequence
  Description of Artificial Sequence: Synthetic polypeptide
DEEEIRTTNPVATEQYGCVSTNLQSTGENV

SEQ ID NO: 14428 - protein, 30 aa, Artificial Sequence
  Description of Artificial Sequence: Synthetic polypeptide
DEEEIRTTNPCATEQYGSVSTDNGDQHGNR

SEQ ID NO: 14429 - protein, 30 aa, Artificial Sequence
  Description of Artificial Sequence: Synthetic polypeptide
YEGEIRTTNPVATEQYGAVSTNLYQRNGNR

SEQ ID NO: 14430 - protein, 29 aa, Artificial Sequence
  Description of Artificial Sequence: Synthetic peptide
YEEEISTCNPVATEQYGSVSTNVLQNGNR

SEQ ID NO: 14431 - protein, 30 aa, Artificial Sequence
  Description of Artificial Sequence: Synthetic polypeptide
DEEEIRTTNPVATEQYGSVSTMLQHVGNGP

SEQ ID NO: 14432 - protein, 30 aa, Artificial Sequence
  Description of Artificial Sequence: Synthetic polypeptide
AEEEIRTTNPVATEQYGSVSVTNLQAIGNA

SEQ ID NO: 14433 - protein, 30 aa, Artificial Sequence
  Description of Artificial Sequence: Synthetic polypeptide
YEHEIRTTNPVATEQYGSVPSYTNLVRGNR

SEQ ID NO: 14434 - protein, 30 aa, Artificial Sequence
  Description of Artificial Sequence: Synthetic polypeptide
VEEEIRTTNPVATEQYGTVSCTNLQSGGNR

SEQ ID NO: 14435 - protein, 30 aa, Artificial Sequence
  Description of Artificial Sequence: Synthetic polypeptide
YPEEIRTTNPVATEQYGSVSTNLQQYMGNR

SEQ ID NO: 14436 - protein, 30 aa, Artificial Sequence
  Description of Artificial Sequence: Synthetic polypeptide
DEEEIRTTNPVATEQYGSVSINLDRGGDNL

SEQ ID NO: 14437 - protein, 29 aa, Artificial Sequence
  Description of Artificial Sequence: Synthetic peptide
YEEEIRTTNPVACEQYGSVSTNLEARGNI

SEQ ID NO: 14438 - protein, 30 aa, Artificial Sequence
  Description of Artificial Sequence: Synthetic polypeptide
DEEEIRTTNPVATEQYGDVSTMDLQQRGNV

SEQ ID NO: 14439 - protein, 30 aa, Artificial Sequence
  Description of Artificial Sequence: Synthetic polypeptide
DEEEIRTTNPVATEQYGDVSTLNLQEFGNP

SEQ ID NO: 14440 - protein, 30 aa, Artificial Sequence
  Description of Artificial Sequence: Synthetic polypeptide
DEEEIRTTNPVATEQYGSVSPALLQRLGNE

SEQ ID NO: 14441 - protein, 31 aa, Artificial Sequence
  Description of Artificial Sequence: Synthetic polypeptide
DEEEIRTTNPVATEQYGSVSTMNLQFGEIRD

SEQ ID NO: 14442 - protein, 32 aa, Artificial Sequence
  Description of Artificial Sequence: Synthetic polypeptide
DEEEIRTTNPVATEQYGSVSNTNLQRFGLNID

SEQ ID NO: 14443 - protein, 30 aa, Artificial Sequence
  Description of Artificial Sequence: Synthetic polypeptide
DEEEIRTTNPVATEQYGSVSTMNDIQTGND

SEQ ID NO: 14444 - protein, 32 aa, Artificial Sequence
  Description of Artificial Sequence: Synthetic polypeptide
DEEEIRTTNPVATEQYGSVSNTTNLQRGGGND

SEQ ID NO: 14445 - protein, 30 aa, Artificial Sequence
  Description of Artificial Sequence: Synthetic polypeptide
DEEEIRTTNPVATEPYGSVSTNELQEGGNQ

SEQ ID NO: 14446 - protein, 30 aa, Artificial Sequence
  Description of Artificial Sequence: Synthetic polypeptide
DEEEIRTTNPVATEPYGSVSTNLNQDGNQE

SEQ ID NO: 14447 - protein, 30 aa, Artificial Sequence
  Description of Artificial Sequence: Synthetic polypeptide
DEEEIRTTNPVATEQYGCVSTNLQTREPNF

SEQ ID NO: 14448 - protein, 29 aa, Artificial Sequence
  Description of Artificial Sequence: Synthetic peptide
YQEEIRSTNPVATEQYGSDVSTNQQRGNR

SEQ ID NO: 14449 - protein, 30 aa, Artificial Sequence
  Description of Artificial Sequence: Synthetic polypeptide
DEEEIRTTNPVATEFYGTVSTNLQRGNNPN

SEQ ID NO: 14450 - protein, 29 aa, Artificial Sequence
  Description of Artificial Sequence: Synthetic peptide
DEEEIRTTNPCATEQYGSVSTALQDGNEH

SEQ ID NO: 14451 - protein, 29 aa, Artificial Sequence
  Description of Artificial Sequence: Synthetic peptide
DEEEIRTTNPVATEQYGSVSPSNLQNAND

SEQ ID NO: 14452 - protein, 30 aa, Artificial Sequence
  Description of Artificial Sequence: Synthetic polypeptide
DEEEIRTTNPVATEQYGSVSTMNLQGDNTD

SEQ ID NO: 14453 - protein, 31 aa, Artificial Sequence
  Description of Artificial Sequence: Synthetic polypeptide
DEEEIRTTNPVATEQYGSVSTMNLQGDGQNQ

SEQ ID NO: 14454 - protein, 29 aa, Artificial Sequence
  Description of Artificial Sequence: Synthetic peptide
DEEEIRTTNPVATEQYGSVSNTNLQTTAQ

SEQ ID NO: 14455 - protein, 30 aa, Artificial Sequence
  Description of Artificial Sequence: Synthetic polypeptide
DEEEIRTTNPVATEQYGSVSTNALVDINIR

SEQ ID NO: 14456 - protein, 29 aa, Artificial Sequence
  Description of Artificial Sequence: Synthetic peptide
YQEEIRTTNPVATEQYGSVYTNLQRFGNT

SEQ ID NO: 14457 - protein, 29 aa, Artificial Sequence
  Description of Artificial Sequence: Synthetic peptide
DEEEIRTTNPVATEQFGQSVSTSLHRGNS

SEQ ID NO: 14458 - protein, 30 aa, Artificial Sequence
  Description of Artificial Sequence: Synthetic polypeptide
DEEEIRTTNPVATEQYGCVSTNLQTTGNST

SEQ ID NO: 14459 - protein, 31 aa, Artificial Sequence
  Description of Artificial Sequence: Synthetic polypeptide
DEEEIRTTNPVATEIYGSVSTNLQNGSNPRA

SEQ ID NO: 14460 - protein, 31 aa, Artificial Sequence
  Description of Artificial Sequence: Synthetic polypeptide
DEEEIRTTNPVATEQYGSVSPEELLQRGNFR

SEQ ID NO: 14461 - protein, 30 aa, Artificial Sequence
  Description of Artificial Sequence: Synthetic polypeptide
DEEEIRTTNPVATEQYGSVSINLQDEGGND

SEQ ID NO: 14462 - protein, 30 aa, Artificial Sequence
  Description of Artificial Sequence: Synthetic polypeptide
DEEEIRTTNPVATEQYGSVSTNDNQEGTNS

SEQ ID NO: 14463 - protein, 31 aa, Artificial Sequence
  Description of Artificial Sequence: Synthetic polypeptide
DEEEIRTTNPVATEQYGSVSNTNLQVRIDGR

SEQ ID NO: 14464 - protein, 29 aa, Artificial Sequence
  Description of Artificial Sequence: Synthetic peptide
YQEEIRTTNPVATEQYGSVYTNLQREGND

SEQ ID NO: 14465 - protein, 31 aa, Artificial Sequence
  Description of Artificial Sequence: Synthetic polypeptide
YQEEIRTTNPVATEQYGSVCSTNLQGRPGNR

SEQ ID NO: 14466 - protein, 30 aa, Artificial Sequence
  Description of Artificial Sequence: Synthetic polypeptide
DEEEIRTTNPVATEQYGCVSTNPLQHGNEG

SEQ ID NO: 14467 - protein, 28 aa, Artificial Sequence
  Description of Artificial Sequence: Synthetic peptide
DEECIRTTNPVATEQYGCVSTNMQHGNM

SEQ ID NO: 14468 - protein, 29 aa, Artificial Sequence
  Description of Artificial Sequence: Synthetic peptide
DEEEIRTTNPVATEQYGSVSPANIERGNI

SEQ ID NO: 14469 - protein, 31 aa, Artificial Sequence
  Description of Artificial Sequence: Synthetic polypeptide
DEEEIRTTNPVATEQYGSVSTMNLQFGSQRS

SEQ ID NO: 14470 - protein, 28 aa, Artificial Sequence
  Description of Artificial Sequence: Synthetic peptide
YQEEIRTTNPVATEQWGRVSTNLQEGNR

SEQ ID NO: 14471 - protein, 30 aa, Artificial Sequence
  Description of Artificial Sequence: Synthetic polypeptide
DEEEIRTTNPVATEPYGSVSNTNLTFGGNR

SEQ ID NO: 14472 - protein, 30 aa, Artificial Sequence
  Description of Artificial Sequence: Synthetic polypeptide
DEEEIRTTNPVATEPYGSVSSTNLQNGNNA

SEQ ID NO: 14473 - protein, 30 aa, Artificial Sequence
  Description of Artificial Sequence: Synthetic polypeptide
DEEEIRTTNPVATEIYGSVSTNLQPGSDRI

SEQ ID NO: 14474 - protein, 30 aa, Artificial Sequence
  Description of Artificial Sequence: Synthetic polypeptide
DEEEIRTTNPVATEQYGCVSTNPLQNGNTS

SEQ ID NO: 14475 - protein, 31 aa, Artificial Sequence
  Description of Artificial Sequence: Synthetic polypeptide
DEEEIRTTNPVATEQYGCVSTNLQTRNENRN

SEQ ID NO: 14476 - protein, 32 aa, Artificial Sequence
  Description of Artificial Sequence: Synthetic polypeptide
DEEEIRTTNPVATEQYGSVSTMNETSQRGGNR

SEQ ID NO: 14477 - protein, 30 aa, Artificial Sequence
  Description of Artificial Sequence: Synthetic polypeptide
DEEEIRTTNPVATEPYGSVSFTNLTAGGNR

SEQ ID NO: 14478 - protein, 32 aa, Artificial Sequence
  Description of Artificial Sequence: Synthetic polypeptide
DEEEIRTTNPVATEEYGSVSCTNLQRPGNNRM

SEQ ID NO: 14479 - protein, 30 aa, Artificial Sequence
  Description of Artificial Sequence: Synthetic polypeptide
DEEEIRTTNPVATEQYGCVSTNLQSGPNDS

SEQ ID NO: 14480 - protein, 29 aa, Artificial Sequence
  Description of Artificial Sequence: Synthetic peptide
DEEEIRTTNPVATEQYGSVSNTNLQAISG

SEQ ID NO: 14481 - protein, 30 aa, Artificial Sequence
  Description of Artificial Sequence: Synthetic polypeptide
DEEEIRTTNPVATEPYGSVSTNLSQQGNEE

SEQ ID NO: 14482 - protein, 30 aa, Artificial Sequence
  Description of Artificial Sequence: Synthetic polypeptide
YEEEIRTTNPVATCQYGSVPSTNLERGNHR

SEQ ID NO: 14483 - protein, 30 aa, Artificial Sequence
  Description of Artificial Sequence: Synthetic polypeptide
DEEEIRTTNPCATEQYGSVSTNLERGDNLI

SEQ ID NO: 14484 - protein, 30 aa, Artificial Sequence
  Description of Artificial Sequence: Synthetic polypeptide
DEEEIRTTNPVATEQYGSVSPNLQQGGVER

SEQ ID NO: 14485 - protein, 30 aa, Artificial Sequence
  Description of Artificial Sequence: Synthetic polypeptide
YNEEIRTTNPVATEQYGSVSTSNLERIGNR

SEQ ID NO: 14486 - protein, 29 aa, Artificial Sequence
  Description of Artificial Sequence: Synthetic peptide
YEEEITTTNPVATEQYGSVSTNLDRVGER

SEQ ID NO: 14487 - protein, 31 aa, Artificial Sequence
  Description of Artificial Sequence: Synthetic polypeptide
DEEEIRTTNPVATEQYGSVSTNDNLDRGNEM

SEQ ID NO: 14488 - protein, 29 aa, Artificial Sequence
  Description of Artificial Sequence: Synthetic peptide
DEEEIRTTNPCATEQYGSVSTNLLRQSNQ

SEQ ID NO: 14489 - protein, 30 aa, Artificial Sequence
  Description of Artificial Sequence: Synthetic polypeptide
DEEEIRTTNPVATEQYGSVSPNLQQENVER

SEQ ID NO: 14490 - protein, 28 aa, Artificial Sequence
  Description of Artificial Sequence: Synthetic peptide
VEEEIRTTNPVSSEQYGSVATNLQRGNQ

SEQ ID NO: 14491 - protein, 31 aa, Artificial Sequence
  Description of Artificial Sequence: Synthetic polypeptide
DEEEIRTTNPVATEQYGSVSINLDQRGPPFR

SEQ ID NO: 14492 - protein, 29 aa, Artificial Sequence
  Description of Artificial Sequence: Synthetic peptide
DEEEIRTTNPVATEQYGSVSNTNIQSENT

SEQ ID NO: 14493 - protein, 31 aa, Artificial Sequence
  Description of Artificial Sequence: Synthetic polypeptide
DEEEIRTTNPVATEQYGSVSNTSNLQDGGNS

SEQ ID NO: 14494 - protein, 29 aa, Artificial Sequence
  Description of Artificial Sequence: Synthetic peptide
DEEEIRTTNPVATEEYGSVSSNLQNSGDR

SEQ ID NO: 14495 - protein, 29 aa, Artificial Sequence
  Description of Artificial Sequence: Synthetic peptide
DEEEIRTTNPVATEPYGSVSTNLSQTGLP

SEQ ID NO: 14496 - protein, 32 aa, Artificial Sequence
  Description of Artificial Sequence: Synthetic polypeptide
DEEEIRTTNPVATEPYGSVSTNMLSQRGTNRM

SEQ ID NO: 14497 - protein, 30 aa, Artificial Sequence
  Description of Artificial Sequence: Synthetic polypeptide
DEEEIRTTNPCATEQYGSVSTNLQAGEEHR

SEQ ID NO: 14498 - protein, 29 aa, Artificial Sequence
  Description of Artificial Sequence: Synthetic peptide
DEEEIRTTNPVATEQFGTSVSTALLRGNF

SEQ ID NO: 14499 - protein, 31 aa, Artificial Sequence
  Description of Artificial Sequence: Synthetic polypeptide
DEEEIRTTNPVATEQYGSVSTMNLQSEGNNP

SEQ ID NO: 14500 - protein, 31 aa, Artificial Sequence
  Description of Artificial Sequence: Synthetic polypeptide
DEEEIRTTNPVATEQYGSVSPLLQRSGENRE

SEQ ID NO: 14501 - protein, 29 aa, Artificial Sequence
  Description of Artificial Sequence: Synthetic peptide
YEEEISTTNPVATEQYGSVSTNIDNRGNR

SEQ ID NO: 14502 - protein, 31 aa, Artificial Sequence
  Description of Artificial Sequence: Synthetic polypeptide
DEEEIRTTNPVATEQYGCVSTNLQPREENRM

SEQ ID NO: 14503 - protein, 29 aa, Artificial Sequence
  Description of Artificial Sequence: Synthetic peptide
DEEEIRTTNPCATEQYGSVSTNLQAPNTN

SEQ ID NO: 14504 - protein, 28 aa, Artificial Sequence
  Description of Artificial Sequence: Synthetic peptide
YEEEIRTTNPVATCQYGSVSTTLERGNH

SEQ ID NO: 14505 - protein, 29 aa, Artificial Sequence
  Description of Artificial Sequence: Synthetic peptide
DEEEIRTTNPCATEQYGSVSTNLQDPNNH

SEQ ID NO: 14506 - protein, 30 aa, Artificial Sequence
  Description of Artificial Sequence: Synthetic polypeptide
YEEEIRTVNPVATECYGSVSTGNLQRQGNR

SEQ ID NO: 14507 - protein, 31 aa, Artificial Sequence
  Description of Artificial Sequence: Synthetic polypeptide
DEEEIRTTNPVATEQYGSVSNTNLQGTSGNV

SEQ ID NO: 14508 - protein, 30 aa, Artificial Sequence
  Description of Artificial Sequence: Synthetic polypeptide
DEEEIRTTNPVATEQYGCVSTNLTIIGNRS

SEQ ID NO: 14509 - protein, 32 aa, Artificial Sequence
  Description of Artificial Sequence: Synthetic polypeptide
DEEEIRTTNPVATEQYGSVSPNLQRPGTNMRI

SEQ ID NO: 14510 - protein, 30 aa, Artificial Sequence
  Description of Artificial Sequence: Synthetic polypeptide
DEEEIRTTNPCATEQYGSVSTNLDTDGNRS

SEQ ID NO: 14511 - protein, 30 aa, Artificial Sequence
  Description of Artificial Sequence: Synthetic polypeptide
DEEEIRTTNPVATEQYGSVSPALLQRGQRD

SEQ ID NO: 14512 - protein, 31 aa, Artificial Sequence
  Description of Artificial Sequence: Synthetic polypeptide
DEEEIRTTNPVATEPYGSVSTNLQEPGGNNR

SEQ ID NO: 14513 - protein, 30 aa, Artificial Sequence
  Description of Artificial Sequence: Synthetic polypeptide
AEEEIRTTNPVATEQYGSVSVTNLQAGSND

SEQ ID NO: 14514 - protein, 30 aa, Artificial Sequence
  Description of Artificial Sequence: Synthetic polypeptide
DEEEIRTTNPVATEQYGSVSNTNLMFQNRP

SEQ ID NO: 14515 - protein, 30 aa, Artificial Sequence
  Description of Artificial Sequence: Synthetic polypeptide
DEEEIRTTNPVATEPYGSVSTNLQQEGNGN

SEQ ID NO: 14516 - protein, 30 aa, Artificial Sequence
  Description of Artificial Sequence: Synthetic polypeptide
DEEEIRTTNPVATEPYGSVSTNLQQTGNTS

SEQ ID NO: 14517 - protein, 31 aa, Artificial Sequence
  Description of Artificial Sequence: Synthetic polypeptide
DEEEIRTTNPVATEQYGSVSTMNLQRGEVLT

SEQ ID NO: 14518 - protein, 30 aa, Artificial Sequence
  Description of Artificial Sequence: Synthetic polypeptide
DEEEIRTTNPVATEQYGCVSTNQQDAGANR

SEQ ID NO: 14519 - protein, 29 aa, Artificial Sequence
  Description of Artificial Sequence: Synthetic peptide
DEEEIRTTNPCATEQYGSVSTELQQGNEL

SEQ ID NO: 14520 - protein, 28 aa, Artificial Sequence
  Description of Artificial Sequence: Synthetic peptide
YEEEIRTVNPVATEQYGEVSTTLQHGNR

SEQ ID NO: 14521 - protein, 31 aa, Artificial Sequence
  Description of Artificial Sequence: Synthetic polypeptide
DEEEIRTTNPVATEQYGSVSTMNLQRGVYSD

SEQ ID NO: 14522 - protein, 28 aa, Artificial Sequence
  Description of Artificial Sequence: Synthetic peptide
DEECIRTTNPVATEQYGCVSTNIQFGNS

SEQ ID NO: 14523 - protein, 29 aa, Artificial Sequence
  Description of Artificial Sequence: Synthetic peptide
DEEEIRTTNPVATEPYGSVSTNLSQGGGE

SEQ ID NO: 14524 - protein, 30 aa, Artificial Sequence
  Description of Artificial Sequence: Synthetic polypeptide
DEEEIRTTNPVATEQYGCVSTNLQRGDPIQ

SEQ ID NO: 14525 - protein, 30 aa, Artificial Sequence
  Description of Artificial Sequence: Synthetic polypeptide
YNEEIRTTNPVATEQYGTVSTNDLQRGSNR

SEQ ID NO: 14526 - protein, 30 aa, Artificial Sequence
  Description of Artificial Sequence: Synthetic polypeptide
DEEEIRTTNPVATEQYGSVSNTNHQRFLNI

SEQ ID NO: 14527 - protein, 30 aa, Artificial Sequence
  Description of Artificial Sequence: Synthetic polypeptide
DEEEIRTTNPVATEQYGCVSTNQQHDGENR

SEQ ID NO: 14528 - protein, 30 aa, Artificial Sequence
  Description of Artificial Sequence: Synthetic polypeptide
DEEEIRTTNPCATEQYGSVSTNDQRGPNEM

SEQ ID NO: 14529 - protein, 28 aa, Artificial Sequence
  Description of Artificial Sequence: Synthetic peptide
QEGEIRCTNPCATEQYGSVSENLQRGNR

SEQ ID NO: 14530 - protein, 29 aa, Artificial Sequence
  Description of Artificial Sequence: Synthetic peptide
DEEEIRTTNPCATEQYGSVSTNGQPHGNA

SEQ ID NO: 14531 - protein, 31 aa, Artificial Sequence
  Description of Artificial Sequence: Synthetic polypeptide
DEEEIRTTNPVATEEYGSVSMTNNQRGSNIR

SEQ ID NO: 14532 - protein, 29 aa, Artificial Sequence
  Description of Artificial Sequence: Synthetic peptide
AEEEIRTTNPVATEQYGSVSTVTQLNGNR

SEQ ID NO: 14533 - protein, 30 aa, Artificial Sequence
  Description of Artificial Sequence: Synthetic polypeptide
DEEEIRTTNPCATEQYGTVSTNLQRGSNDM

SEQ ID NO: 14534 - protein, 32 aa, Artificial Sequence
  Description of Artificial Sequence: Synthetic polypeptide
DEEEIRTTNPVATEPYGSVSTNLSQERGNTRD

SEQ ID NO: 14535 - protein, 29 aa, Artificial Sequence
  Description of Artificial Sequence: Synthetic peptide
DEEEIRTTNPVATEQYGSVSNTNHQSMND

SEQ ID NO: 14536 - protein, 30 aa, Artificial Sequence
  Description of Artificial Sequence: Synthetic polypeptide
DEEEIRTTNPVATEQYGCVSTYLQRGNTTS

SEQ ID NO: 14537 - protein, 29 aa, Artificial Sequence
  Description of Artificial Sequence: Synthetic peptide
DEEEIRTTNPCATEQYGSVSTNDQRGPLA

SEQ ID NO: 14538 - protein, 31 aa, Artificial Sequence
  Description of Artificial Sequence: Synthetic polypeptide
DEEEIRTTNPVATEIYGSVSTNLQNGSNFRE

SEQ ID NO: 14539 - protein, 31 aa, Artificial Sequence
  Description of Artificial Sequence: Synthetic polypeptide
DEEEIRTTNPVATEQYGSVSGTNLQEIGANI

SEQ ID NO: 14540 - protein, 30 aa, Artificial Sequence
  Description of Artificial Sequence: Synthetic polypeptide
DEEEIRTTNPVATEQYGSVSTMLQIEGNPQ

SEQ ID NO: 14541 - protein, 30 aa, Artificial Sequence
  Description of Artificial Sequence: Synthetic polypeptide
DEEEIRTTNPVATEPYGSVCYTNLTREGNR

SEQ ID NO: 14542 - protein, 29 aa, Artificial Sequence
  Description of Artificial Sequence: Synthetic peptide
YTEEIRTTNPVATEQYGQTVSTNLQGGNR

SEQ ID NO: 14543 - protein, 29 aa, Artificial Sequence
  Description of Artificial Sequence: Synthetic peptide
YEEEIRTVNPVATLQYGSVSTNNLQRGNC

SEQ ID NO: 14544 - protein, 29 aa, Artificial Sequence
  Description of Artificial Sequence: Synthetic peptide
YEEEIRTVNPVATEQYGSVSTNVERAGNR

SEQ ID NO: 14545 - protein, 30 aa, Artificial Sequence
  Description of Artificial Sequence: Synthetic polypeptide
DEEEIRTTNPVATEQYGSVSTMNLQNTGPV

SEQ ID NO: 14546 - protein, 28 aa, Artificial Sequence
  Description of Artificial Sequence: Synthetic peptide
SEDEIRTTNPVATEQYGSVATNLQSGSR

SEQ ID NO: 14547 - protein, 31 aa, Artificial Sequence
  Description of Artificial Sequence: Synthetic polypeptide
DEEEIRTTNPVATEQYGSVSGTNLQPGMNTM

SEQ ID NO: 14548 - protein, 31 aa, Artificial Sequence
  Description of Artificial Sequence: Synthetic polypeptide
DEEEIRTTNPVATEGYGSVSMTNHQRGSNTR

SEQ ID NO: 14549 - protein, 30 aa, Artificial Sequence
  Description of Artificial Sequence: Synthetic polypeptide
DEEEIRTTNPVATEQYGSVSTMNDQNGNST

SEQ ID NO: 14550 - protein, 31 aa, Artificial Sequence
  Description of Artificial Sequence: Synthetic polypeptide
DEEEIRTTNPVATEQYGSVSINLQREGNELS

SEQ ID NO: 14551 - protein, 29 aa, Artificial Sequence
  Description of Artificial Sequence: Synthetic peptide
DEEEIRTTNPVATEQYGCVSTVNTQNGNA

SEQ ID NO: 14552 - protein, 29 aa, Artificial Sequence
  Description of Artificial Sequence: Synthetic peptide
AEEEIRTTNPVATEQYGSVSVTSGQDGNR

SEQ ID NO: 14553 - protein, 31 aa, Artificial Sequence
  Description of Artificial Sequence: Synthetic polypeptide
DEEEIRTTNPVATEQYGCVSTVNLQERFGNI

SEQ ID NO: 14554 - protein, 30 aa, Artificial Sequence
  Description of Artificial Sequence: Synthetic polypeptide
DEEEIRTTNPVATEQYGDVSTNLPQIGNQE

SEQ ID NO: 14555 - protein, 30 aa, Artificial Sequence
  Description of Artificial Sequence: Synthetic polypeptide
DEEEIRTTNPVATEQYGSVSTNDQAVDNTR

SEQ ID NO: 14556 - protein, 30 aa, Artificial Sequence
  Description of Artificial Sequence: Synthetic polypeptide
SEDEIRTTNPVATEQYGSVSTENLERGGNR

SEQ ID NO: 14557 - protein, 30 aa, Artificial Sequence
  Description of Artificial Sequence: Synthetic polypeptide
DEEEIRTTNPVATEHYGSTVSTNMLGRGNT

SEQ ID NO: 14558 - protein, 30 aa, Artificial Sequence
  Description of Artificial Sequence: Synthetic polypeptide
DEEEIRTTNPCAYEQYGSVSTNLQRTNSRE

SEQ ID NO: 14559 - protein, 29 aa, Artificial Sequence
  Description of Artificial Sequence: Synthetic peptide
DEEEIRTTNPVATEQFGQSVSTYLARGNS

SEQ ID NO: 14560 - protein, 31 aa, Artificial Sequence
  Description of Artificial Sequence: Synthetic polypeptide
AEEEIRTTNPVATEQYGSVSVTNLQNDNGNR

SEQ ID NO: 14561 - protein, 30 aa, Artificial Sequence
  Description of Artificial Sequence: Synthetic polypeptide
DEEEIRTTNPVATEPYGSVCVTNLTRHGNR

SEQ ID NO: 14562 - protein, 30 aa, Artificial Sequence
  Description of Artificial Sequence: Synthetic polypeptide
DEEEIRTTNPVATEPYGSVCVTNLTRGGNR

SEQ ID NO: 14563 - protein, 30 aa, Artificial Sequence
  Description of Artificial Sequence: Synthetic polypeptide
DEEEIRTTNPVATEQYGSVSTMNLQNTGQN

SEQ ID NO: 14564 - protein, 30 aa, Artificial Sequence
  Description of Artificial Sequence: Synthetic polypeptide
DEEEIRTTNPCAYEQYGSVSTNLQRANDRY

SEQ ID NO: 14565 - protein, 30 aa, Artificial Sequence
  Description of Artificial Sequence: Synthetic polypeptide
DEEEIRTTNPVATEQYGSVSPANDLQRVDR

SEQ ID NO: 14566 - protein, 30 aa, Artificial Sequence
  Description of Artificial Sequence: Synthetic polypeptide
YSEEIRTTNPVATEQYGTSVSTNLQRVNGR

SEQ ID NO: 14567 - protein, 30 aa, Artificial Sequence
  Description of Artificial Sequence: Synthetic polypeptide
DEECIRTTNPVATEQYGSVSTNLARGSDRS

SEQ ID NO: 14568 - protein, 28 aa, Artificial Sequence
  Description of Artificial Sequence: Synthetic peptide
AEDEIRTTNPVATEQYGSVCTNLQIGDR

SEQ ID NO: 14569 - protein, 28 aa, Artificial Sequence
  Description of Artificial Sequence: Synthetic peptide
SEDEIRTTNPVATEQYGEVSTNLQMGNN

SEQ ID NO: 14570 - protein, 31 aa, Artificial Sequence
  Description of Artificial Sequence: Synthetic polypeptide
DEEEIRTTNPVATEQYGSVSINLQREGNPLD

SEQ ID NO: 14571 - protein, 30 aa, Artificial Sequence
  Description of Artificial Sequence: Synthetic polypeptide
YEGEIRTTNPVATEQYGSVSTNLSQLHGNR

SEQ ID NO: 14572 - protein, 31 aa, Artificial Sequence
  Description of Artificial Sequence: Synthetic polypeptide
DEEEIRTTNPVATEQYGSVSTMNLQLGETRE

SEQ ID NO: 14573 - protein, 31 aa, Artificial Sequence
  Description of Artificial Sequence: Synthetic polypeptide
DEEEIRTTNPVATEQFGSVSTNLQHGGSNRE

SEQ ID NO: 14574 - protein, 30 aa, Artificial Sequence
  Description of Artificial Sequence: Synthetic polypeptide
DEEEIRTTNPVATEQYGSVSTMNLQLIGGT

SEQ ID NO: 14575 - protein, 29 aa, Artificial Sequence
  Description of Artificial Sequence: Synthetic peptide
DEEEIRTTNPVATEQYGDVSTNLQDGSEN

SEQ ID NO: 14576 - protein, 29 aa, Artificial Sequence
  Description of Artificial Sequence: Synthetic peptide
YEGEIRTTNPVATEQYGSVSTNLQQRGLV

SEQ ID NO: 14577 - protein, 30 aa, Artificial Sequence
  Description of Artificial Sequence: Synthetic polypeptide
DEEEIRTTNPVATEFYGSVISTNLQGTGNE

SEQ ID NO: 14578 - protein, 31 aa, Artificial Sequence
  Description of Artificial Sequence: Synthetic polypeptide
DEEEIRTTNPVATEQYGSVSNTNLQAEGNPN

SEQ ID NO: 14579 - protein, 30 aa, Artificial Sequence
  Description of Artificial Sequence: Synthetic polypeptide
DEEEIRTTNPVATEPYGSVNTNLSQAGNQR

SEQ ID NO: 14580 - protein, 30 aa, Artificial Sequence
  Description of Artificial Sequence: Synthetic polypeptide
DEEEIRTTNPVATEPYGSVGETNLTRGGNR

SEQ ID NO: 14581 - protein, 28 aa, Artificial Sequence
  Description of Artificial Sequence: Synthetic peptide
SEDEIRTTNPVATEQYGCVSTNLQHGNH

SEQ ID NO: 14582 - protein, 30 aa, Artificial Sequence
  Description of Artificial Sequence: Synthetic polypeptide
DEEEIRTTNPVATEQYGSVSNTPWLQRDNF

SEQ ID NO: 14583 - protein, 30 aa, Artificial Sequence
  Description of Artificial Sequence: Synthetic polypeptide
YTEEIRTTNPVATEQYGSVMSTNQDQRGNR

SEQ ID NO: 14584 - protein, 28 aa, Artificial Sequence
  Description of Artificial Sequence: Synthetic peptide
VEEEIRTTNPVATEQYGSVSTTLGLGNQ

SEQ ID NO: 14585 - protein, 30 aa, Artificial Sequence
  Description of Artificial Sequence: Synthetic polypeptide
YTEEIRTTNPVATEQYGSVTSTNQDQRGNR

SEQ ID NO: 14586 - protein, 30 aa, Artificial Sequence
  Description of Artificial Sequence: Synthetic polypeptide
DEEEIRTTNPVATEQYGCVSTNLTRGSNVF

SEQ ID NO: 14587 - protein, 31 aa, Artificial Sequence
  Description of Artificial Sequence: Synthetic polypeptide
DEEEIRTTNPVATEQYGSVSTMNLQIGINTM

SEQ ID NO: 14588 - protein, 30 aa, Artificial Sequence
  Description of Artificial Sequence: Synthetic polypeptide
DEEEIRTTNPVATEQYGSVSTMQDLQRSND

SEQ ID NO: 14589 - protein, 30 aa, Artificial Sequence
  Description of Artificial Sequence: Synthetic polypeptide
DEEEIRTTNPVATEQYGSVSINLQREGPDF

SEQ ID NO: 14590 - protein, 31 aa, Artificial Sequence
  Description of Artificial Sequence: Synthetic polypeptide
DEEEIRTTNPVATEQYGSVSINLQREGNTGG

SEQ ID NO: 14591 - protein, 31 aa, Artificial Sequence
  Description of Artificial Sequence: Synthetic polypeptide
DEEEIRTTNPVATEQYGSVSNTGLQRLQENR

SEQ ID NO: 14592 - protein, 30 aa, Artificial Sequence
  Description of Artificial Sequence: Synthetic polypeptide
DEEEIRTTNPCATEQYGSVCPTNLQRGNID

SEQ ID NO: 14593 - protein, 32 aa, Artificial Sequence
  Description of Artificial Sequence: Synthetic polypeptide
DEEEIRTTNPVATEQYGSVSTNALSQLQGNNR

SEQ ID NO: 14594 - protein, 33 aa, Artificial Sequence
  Description of Artificial Sequence: Synthetic polypeptide
DEEEIRTTNPVATEQYGSVSTNALSQRNGLNRW

SEQ ID NO: 14595 - protein, 31 aa, Artificial Sequence
  Description of Artificial Sequence: Synthetic polypeptide
DEEEIRTTNPVATEQYGSVSINLQREGNPSQ

SEQ ID NO: 14596 - protein, 31 aa, Artificial Sequence
  Description of Artificial Sequence: Synthetic polypeptide
DEEEIRTTNPVATEQYGSVSTMNLDQEGGNT

SEQ ID NO: 14597 - protein, 30 aa, Artificial Sequence
  Description of Artificial Sequence: Synthetic polypeptide
DEEEIRTTNPVATEQYGSVSTMNLQMVGGV

SEQ ID NO: 14598 - protein, 29 aa, Artificial Sequence
  Description of Artificial Sequence: Synthetic peptide
DEECIRTTNPVATEQYGIVSTNLQNDGNA

SEQ ID NO: 14599 - protein, 30 aa, Artificial Sequence
  Description of Artificial Sequence: Synthetic polypeptide
DEEEIRTTNPVATEPYGSVCTTNLTRGENR

SEQ ID NO: 14600 - protein, 29 aa, Artificial Sequence
  Description of Artificial Sequence: Synthetic peptide
VEEEIRTTNPVATEQYGSVSTTLQRPVLR

SEQ ID NO: 14601 - protein, 30 aa, Artificial Sequence
  Description of Artificial Sequence: Synthetic polypeptide
DEEEIRTTNPVATEQYGCVSTNLGEFGNRS

SEQ ID NO: 14602 - protein, 30 aa, Artificial Sequence
  Description of Artificial Sequence: Synthetic polypeptide
YSEEIRTTNPVATEQYGISVSTNLDQGGNR

SEQ ID NO: 14603 - protein, 31 aa, Artificial Sequence
  Description of Artificial Sequence: Synthetic polypeptide
AEEEIRTTNPVATEQYGSVSVTNVLQRGNGV

SEQ ID NO: 14604 - protein, 30 aa, Artificial Sequence
  Description of Artificial Sequence: Synthetic polypeptide
YEGEIRTTNPVATEQYGSVSPTNTQRGNTR

SEQ ID NO: 14605 - protein, 30 aa, Artificial Sequence
  Description of Artificial Sequence: Synthetic polypeptide
SEEEICTTNPVATEMYGSVSTNLQDRGNHR

SEQ ID NO: 14606 - protein, 30 aa, Artificial Sequence
  Description of Artificial Sequence: Synthetic polypeptide
DEEEIRTTNPVATEPYGSVCNTNLIRGGNR

SEQ ID NO: 14607 - protein, 30 aa, Artificial Sequence
  Description of Artificial Sequence: Synthetic polypeptide
DEEEIRTTNPVATEQYGSVSPALQRPGDNE

SEQ ID NO: 14608 - protein, 30 aa, Artificial Sequence
  Description of Artificial Sequence: Synthetic polypeptide
YEEEIRTVNPVATEQYGSVSTNLWERGSNR

SEQ ID NO: 14609 - protein, 31 aa, Artificial Sequence
  Description of Artificial Sequence: Synthetic polypeptide
DEEEIRTTNPVATEQYGSVSPLENLQRGDRQ

SEQ ID NO: 14610 - protein, 30 aa, Artificial Sequence
  Description of Artificial Sequence: Synthetic polypeptide
DEEEIRTTNPVATEQYGSVSINLQDIGNNE

SEQ ID NO: 14611 - protein, 28 aa, Artificial Sequence
  Description of Artificial Sequence: Synthetic peptide
VEEEIRTTNPVATEQYGSVSVNDQRPNE

SEQ ID NO: 14612 - protein, 29 aa, Artificial Sequence
  Description of Artificial Sequence: Synthetic peptide
YEEEIRTVNPVATEQYGSVSTNLGQRNNS

SEQ ID NO: 14613 - protein, 30 aa, Artificial Sequence
  Description of Artificial Sequence: Synthetic polypeptide
DEEEIRTTNPVATEQYGSVSINLQIGNEDD

SEQ ID NO: 14614 - protein, 28 aa, Artificial Sequence
  Description of Artificial Sequence: Synthetic peptide
DEEEIRTTNPCATEQYGSVSQNINRGND

SEQ ID NO: 14615 - protein, 30 aa, Artificial Sequence
  Description of Artificial Sequence: Synthetic polypeptide
DEEEIRTTNPCATEQYGSVSCNLQRGDNEI

SEQ ID NO: 14616 - protein, 31 aa, Artificial Sequence
  Description of Artificial Sequence: Synthetic polypeptide
DEEEIRTTNPVATEQYGSVSGTNLQEEGGNT

SEQ ID NO: 14617 - protein, 31 aa, Artificial Sequence
  Description of Artificial Sequence: Synthetic polypeptide
DEEEIRTTNPVATEPYGSVSCTNLDRVGNNR

SEQ ID NO: 14618 - protein, 28 aa, Artificial Sequence
  Description of Artificial Sequence: Synthetic peptide
SEEAIRTTNPVATEQYGSVSTNLSMDNR

SEQ ID NO: 14619 - protein, 31 aa, Artificial Sequence
  Description of Artificial Sequence: Synthetic polypeptide
DEEEIRTTNPVATEPYGSVSCTNLMRGDNNR

SEQ ID NO: 14620 - protein, 29 aa, Artificial Sequence
  Description of Artificial Sequence: Synthetic peptide
DEEEIRTTNPVATEQYGCVSTNLTMGNDD

SEQ ID NO: 14621 - protein, 29 aa, Artificial Sequence
  Description of Artificial Sequence: Synthetic peptide
DEEEIRTTNPVATEQYGDVSTNGQQGENI

SEQ ID NO: 14622 - protein, 32 aa, Artificial Sequence
  Description of Artificial Sequence: Synthetic polypeptide
DEEEIRTTNPVATEQYGSVSNTNLQRSGNTAP

SEQ ID NO: 14623 - protein, 29 aa, Artificial Sequence
  Description of Artificial Sequence: Synthetic peptide
DEEEIRTTNPVATEQYGCVSTNNQYGIRA

SEQ ID NO: 14624 - protein, 30 aa, Artificial Sequence
  Description of Artificial Sequence: Synthetic polypeptide
DEEEIRTTNPVATEPYGSVCLTNLGRGGNR

SEQ ID NO: 14625 - protein, 30 aa, Artificial Sequence
  Description of Artificial Sequence: Synthetic polypeptide
DEEEIRTTNPVATEQYGSVSINLQDGTNES

SEQ ID NO: 14626 - protein, 32 aa, Artificial Sequence
  Description of Artificial Sequence: Synthetic polypeptide
DEEEIRTTNPVATEQYGSVSTMNLQRDGVERY

SEQ ID NO: 14627 - protein, 29 aa, Artificial Sequence
  Description of Artificial Sequence: Synthetic peptide
DEEEIRTTNPVATEQYGSVSTNDPQLGDE

SEQ ID NO: 14628 - protein, 30 aa, Artificial Sequence
  Description of Artificial Sequence: Synthetic polypeptide
VEEEIRTTNPVATEQYGSVSTTLQRFGNVV

SEQ ID NO: 14629 - protein, 30 aa, Artificial Sequence
  Description of Artificial Sequence: Synthetic polypeptide
DEEEIRTTNPVATEIYGSVSTNALSQAGNQ

SEQ ID NO: 14630 - protein, 32 aa, Artificial Sequence
  Description of Artificial Sequence: Synthetic polypeptide
DEEEIRTTNPVATEQYGSVSPNLQRIGANNRN

SEQ ID NO: 14631 - protein, 30 aa, Artificial Sequence
  Description of Artificial Sequence: Synthetic polypeptide
DEEEIRTTNPVATEPYGSVCTTNLEREGNR

SEQ ID NO: 14632 - protein, 28 aa, Artificial Sequence
  Description of Artificial Sequence: Synthetic peptide
DEECIRTTNPVATEQYGSVSTHEDRGNT

SEQ ID NO: 14633 - protein, 31 aa, Artificial Sequence
  Description of Artificial Sequence: Synthetic polypeptide
DEEEIRTTNPVATEPYGSVPSATNLSQSGNR

SEQ ID NO: 14634 - protein, 32 aa, Artificial Sequence
  Description of Artificial Sequence: Synthetic polypeptide
DEEEIRTTNPVATEPYGSVPSCTNELDQRGNR

SEQ ID NO: 14635 - protein, 29 aa, Artificial Sequence
  Description of Artificial Sequence: Synthetic peptide
YSEEIRTTNPVATEQYGSVSSTNLVGGNR

SEQ ID NO: 14636 - protein, 30 aa, Artificial Sequence
  Description of Artificial Sequence: Synthetic polypeptide
DEECIRTTNPVATEQYGSVSTGNIQRGSNH

SEQ ID NO: 14637 - protein, 28 aa, Artificial Sequence
  Description of Artificial Sequence: Synthetic peptide
YEEELGTTNPVATEQYGSVSTNLQTGNC

SEQ ID NO: 14638 - protein, 28 aa, Artificial Sequence
  Description of Artificial Sequence: Synthetic peptide
DEEEIRTTNPCATEQYGSVSINEDRGND

SEQ ID NO: 14639 - protein, 30 aa, Artificial Sequence
  Description of Artificial Sequence: Synthetic polypeptide
AEDEIRTTNPVATEQYGSVSTNLQRGNGDE

SEQ ID NO: 14640 - protein, 28 aa, Artificial Sequence
  Description of Artificial Sequence: Synthetic peptide
DEECIRTTNPVATEQYGCVSTNSQYGNQ

SEQ ID NO: 14641 - protein, 30 aa, Artificial Sequence
  Description of Artificial Sequence: Synthetic polypeptide
DEEEIRTTNPVATEPYGSVQFTNLTRDGNR

SEQ ID NO: 14642 - protein, 31 aa, Artificial Sequence
  Description of Artificial Sequence: Synthetic polypeptide
DEEEIRTTNPVATEQYGSVSTNDQARDNQRL

SEQ ID NO: 14643 - protein, 31 aa, Artificial Sequence
  Description of Artificial Sequence: Synthetic polypeptide
DEEEIRTTNPVATEQYGSVSTMGLQRGDQDR

SEQ ID NO: 14644 - protein, 32 aa, Artificial Sequence
  Description of Artificial Sequence: Synthetic polypeptide
DEEEIRTTNPVATEQYGSVSNTNLQRMGMNAD

SEQ ID NO: 14645 - protein, 30 aa, Artificial Sequence
  Description of Artificial Sequence: Synthetic polypeptide
DEEEIRTTNPVATEQYGSVSINLQPGDNEF

SEQ ID NO: 14646 - protein, 30 aa, Artificial Sequence
  Description of Artificial Sequence: Synthetic polypeptide
DEEEIRTTNPVATEQYGSVSTMNLQGGFQN

SEQ ID NO: 14647 - protein, 31 aa, Artificial Sequence
  Description of Artificial Sequence: Synthetic polypeptide
DEECIRTTNPVATEQYGSVSTGNELSQTGNR

SEQ ID NO: 14648 - protein, 30 aa, Artificial Sequence
  Description of Artificial Sequence: Synthetic polypeptide
DEEEIRTTNPCATEQYGSVSGNLQRGDNNS

SEQ ID NO: 14649 - protein, 30 aa, Artificial Sequence
  Description of Artificial Sequence: Synthetic polypeptide
DEEEIRTTNPVATEQYGSVSTNDQALVNGR

SEQ ID NO: 14650 - protein, 29 aa, Artificial Sequence
  Description of Artificial Sequence: Synthetic peptide
YEEELRTTNPVATEQYGSVSTNLQRDNCN

SEQ ID NO: 14651 - protein, 32 aa, Artificial Sequence
  Description of Artificial Sequence: Synthetic polypeptide
DEEEIRTTNPVATEQYGSVSPSNNLQRGENRM

SEQ ID NO: 14652 - protein, 32 aa, Artificial Sequence
  Description of Artificial Sequence: Synthetic polypeptide
DEEEIRTTNPVATEQYGCVVSTNLQRDGTNER

SEQ ID NO: 14653 - protein, 28 aa, Artificial Sequence
  Description of Artificial Sequence: Synthetic peptide
YSEEIRTTNPVATEQYGSVDTDLQRGER

SEQ ID NO: 14654 - protein, 29 aa, Artificial Sequence
  Description of Artificial Sequence: Synthetic peptide
DEEEIRTTNPVATEQYGCVSTNLTQGNEM

SEQ ID NO: 14655 - protein, 30 aa, Artificial Sequence
  Description of Artificial Sequence: Synthetic polypeptide
YEGEIRTTNPVATEQYGSVSTNLPQRGNLQ

SEQ ID NO: 14656 - protein, 29 aa, Artificial Sequence
  Description of Artificial Sequence: Synthetic peptide
YEEELRTTNPVATEQYGSVSTNLQRSNQP

SEQ ID NO: 14657 - protein, 30 aa, Artificial Sequence
  Description of Artificial Sequence: Synthetic polypeptide
DEEEIRTTNPVATEQYGCVSTNLGRGEDRA

SEQ ID NO: 14658 - protein, 31 aa, Artificial Sequence
  Description of Artificial Sequence: Synthetic polypeptide
DEEEIRTTNPVATEQYGSVSNTNLARDNIRQ

SEQ ID NO: 14659 - protein, 31 aa, Artificial Sequence
  Description of Artificial Sequence: Synthetic polypeptide
DEEEIRTTNPVATEQYGDVSTINLQRGNNII

SEQ ID NO: 14660 - protein, 30 aa, Artificial Sequence
  Description of Artificial Sequence: Synthetic polypeptide
DEEEIRTTNPVATEQYGSVSINLDQGMNRD

SEQ ID NO: 14661 - protein, 29 aa, Artificial Sequence
  Description of Artificial Sequence: Synthetic peptide
AEEEIRTTNPVATEQYGSVSTYTQSGGNR

SEQ ID NO: 14662 - protein, 28 aa, Artificial Sequence
  Description of Artificial Sequence: Synthetic peptide
DEDEIYTTNPVATEQYGSVSTNLDYGNT

SEQ ID NO: 14663 - protein, 30 aa, Artificial Sequence
  Description of Artificial Sequence: Synthetic polypeptide
DEEEIRTTNPVATEQYGCVSTNLQNGDNTM

SEQ ID NO: 14664 - protein, 31 aa, Artificial Sequence
  Description of Artificial Sequence: Synthetic polypeptide
DEEEIRTTNPVATEGYGSVNSTNLQRGNEEI

SEQ ID NO: 14665 - protein, 30 aa, Artificial Sequence
  Description of Artificial Sequence: Synthetic polypeptide
DEEEIRTTNPVATEQYGSVSTNAQGMGDTR

SEQ ID NO: 14666 - protein, 28 aa, Artificial Sequence
  Description of Artificial Sequence: Synthetic peptide
DEECIRTTNPVATEQYGCVSTNGQFGNL

SEQ ID NO: 14667 - protein, 30 aa, Artificial Sequence
  Description of Artificial Sequence: Synthetic polypeptide
DEEEIRTTNPCATEQYGSVSTNLQRGGMDN

SEQ ID NO: 14668 - protein, 32 aa, Artificial Sequence
  Description of Artificial Sequence: Synthetic polypeptide
QEEEIRTTNPVATEQYGSVSTANLSQRVGNYR

SEQ ID NO: 14669 - protein, 28 aa, Artificial Sequence
  Description of Artificial Sequence: Synthetic peptide
SEEEIACTNPVATEQYGSVSENIQRGNR

SEQ ID NO: 14670 - protein, 30 aa, Artificial Sequence
  Description of Artificial Sequence: Synthetic polypeptide
DEEEIRTTNPCATEQYGSVSTNLQRGGSEN

SEQ ID NO: 14671 - protein, 30 aa, Artificial Sequence
  Description of Artificial Sequence: Synthetic polypeptide
DEEEIRTTNPVATEPYGCVSTNFSQRGNYR

SEQ ID NO: 14672 - protein, 29 aa, Artificial Sequence
  Description of Artificial Sequence: Synthetic peptide
YEEEIRTTNPVATECYGSVSTNGQKGNRT

SEQ ID NO: 14673 - protein, 31 aa, Artificial Sequence
  Description of Artificial Sequence: Synthetic polypeptide
DEEEIRTTNPVATEQYGSVSGVNLDQRGNQI

SEQ ID NO: 14674 - protein, 30 aa, Artificial Sequence
  Description of Artificial Sequence: Synthetic polypeptide
DEEEIRTTNPCATEQYGSVSTNLQRSGMDD

SEQ ID NO: 14675 - protein, 28 aa, Artificial Sequence
  Description of Artificial Sequence: Synthetic peptide
REEEIRTTNPVCSEQWGSVSTNLERGNR

SEQ ID NO: 14676 - protein, 29 aa, Artificial Sequence
  Description of Artificial Sequence: Synthetic peptide
YETEIRTTNPVATEQYGSVSTVNLQRGSQ

SEQ ID NO: 14677 - protein, 28 aa, Artificial Sequence
  Description of Artificial Sequence: Synthetic peptide
REEEIRTTNPVATVQYGSVSTNQQYGTR

SEQ ID NO: 14678 - protein, 33 aa, Artificial Sequence
  Description of Artificial Sequence: Synthetic polypeptide
DEEEIRTTNPVATEQYGSVSTNDLDQLRGENER

SEQ ID NO: 14679 - protein, 32 aa, Artificial Sequence
  Description of Artificial Sequence: Synthetic polypeptide
DEEEIRTTNPVATEQYGSVSTNALQPSGNERD

SEQ ID NO: 14680 - protein, 29 aa, Artificial Sequence
  Description of Artificial Sequence: Synthetic peptide
QEEEIRTTNPVATEQYGSVSTDLQDNGND

SEQ ID NO: 14681 - protein, 30 aa, Artificial Sequence
  Description of Artificial Sequence: Synthetic polypeptide
DEEEIRTTNPVATEGYGSVESNTNLQQGNF

SEQ ID NO: 14682 - protein, 31 aa, Artificial Sequence
  Description of Artificial Sequence: Synthetic polypeptide
DEEEIRTTNPVATEQYGSVSTMNLVQQEGNQ

SEQ ID NO: 14683 - protein, 31 aa, Artificial Sequence
  Description of Artificial Sequence: Synthetic polypeptide
DEEEIRTTNPVATEQYGSVSTMNLQAPGNQD

SEQ ID NO: 14684 - protein, 29 aa, Artificial Sequence
  Description of Artificial Sequence: Synthetic peptide
YEEEIRTTNPVATEGYGSTSTNLQRGNQY

SEQ ID NO: 14685 - protein, 28 aa, Artificial Sequence
  Description of Artificial Sequence: Synthetic peptide
DEECIRTTNPVATEQYGCVSTNGQFGND

SEQ ID NO: 14686 - protein, 30 aa, Artificial Sequence
  Description of Artificial Sequence: Synthetic polypeptide
DEEEIRTTNPVATEPYGSVTFTNLTRSGNR

SEQ ID NO: 14687 - protein, 29 aa, Artificial Sequence
  Description of Artificial Sequence: Synthetic peptide
AEEEIRTTNPVATEQYGSVSTYNQFEGNR

SEQ ID NO: 14688 - protein, 31 aa, Artificial Sequence
  Description of Artificial Sequence: Synthetic polypeptide
DEEEIRTTNPCATEQYGSVSTNLQREQNSRD

SEQ ID NO: 14689 - protein, 29 aa, Artificial Sequence
  Description of Artificial Sequence: Synthetic peptide
DEEEIRTTNPCATEQYGSVSTNLQRDQPS

SEQ ID NO: 14690 - protein, 28 aa, Artificial Sequence
  Description of Artificial Sequence: Synthetic peptide
YEYEIRTTNPVATEQYGCVDTNQQRGNR

SEQ ID NO: 14691 - protein, 30 aa, Artificial Sequence
  Description of Artificial Sequence: Synthetic polypeptide
YEKEIRTTNPVATEQYGSVSTNLEQGHGNR

SEQ ID NO: 14692 - protein, 29 aa, Artificial Sequence
  Description of Artificial Sequence: Synthetic peptide
DEEEIRTTNPVATEEYGSVSTYLQRGEDS

SEQ ID NO: 14693 - protein, 31 aa, Artificial Sequence
  Description of Artificial Sequence: Synthetic polypeptide
DEEEIRTTNPVATEQYGSVSTMNLTQLGSNF

SEQ ID NO: 14694 - protein, 32 aa, Artificial Sequence
  Description of Artificial Sequence: Synthetic polypeptide
DEEEIRTTNPVATEQYGSVSNTPNLLQRGENS

SEQ ID NO: 14695 - protein, 31 aa, Artificial Sequence
  Description of Artificial Sequence: Synthetic polypeptide
DEEEIRTTNPVATEPYGSVSVTNLSQPGNER

SEQ ID NO: 14696 - protein, 30 aa, Artificial Sequence
  Description of Artificial Sequence: Synthetic polypeptide
DEEEIRTTNPCATEQYGSVSTNLQREGHDN

SEQ ID NO: 14697 - protein, 30 aa, Artificial Sequence
  Description of Artificial Sequence: Synthetic polypeptide
YELEIRTTNPVATEQYGSVSCTNLQRDNRE

SEQ ID NO: 14698 - protein, 30 aa, Artificial Sequence
  Description of Artificial Sequence: Synthetic polypeptide
AEEEIRTTNPVATEQYGSVSTYNLQAGGNN

SEQ ID NO: 14699 - protein, 31 aa, Artificial Sequence
  Description of Artificial Sequence: Synthetic polypeptide
DEEEIRTTNPCATEQYGSVSTNLQRELNERN

SEQ ID NO: 14700 - protein, 30 aa, Artificial Sequence
  Description of Artificial Sequence: Synthetic polypeptide
DEEEIRTTNPVATEQYGSVSTNALQQDNNI

SEQ ID NO: 14701 - protein, 31 aa, Artificial Sequence
  Description of Artificial Sequence: Synthetic polypeptide
VEEEVRTTNPVATEQYGSVSTDNLDQRIGNR

SEQ ID NO: 14702 - protein, 29 aa, Artificial Sequence
  Description of Artificial Sequence: Synthetic peptide
YEVEIRTTNPVATEGYGSVSTPLQRGNTR

SEQ ID NO: 14703 - protein, 30 aa, Artificial Sequence
  Description of Artificial Sequence: Synthetic polypeptide
AEEEIRTTNPVATEQYGSVSTYNLQEMGNY

SEQ ID NO: 14704 - protein, 30 aa, Artificial Sequence
  Description of Artificial Sequence: Synthetic polypeptide
AEEEIRTTNPVATEQYGSVSTYNLQLGGDR

SEQ ID NO: 14705 - protein, 30 aa, Artificial Sequence
  Description of Artificial Sequence: Synthetic polypeptide
DEEEIRTTNPVATEQYGSVSNTFLQGGNIS

SEQ ID NO: 14706 - protein, 30 aa, Artificial Sequence
  Description of Artificial Sequence: Synthetic polypeptide
DEEEIRTTNPCATEQYGSVYATNLQRGNQA

SEQ ID NO: 14707 - protein, 29 aa, Artificial Sequence
  Description of Artificial Sequence: Synthetic peptide
YEEEIRTTNPVATDQYGSVSTQQQRGTNR

SEQ ID NO: 14708 - protein, 30 aa, Artificial Sequence
  Description of Artificial Sequence: Synthetic polypeptide
DEEEIRTTNPVATEQYGCVSTNLIHGDNQR

SEQ ID NO: 14709 - protein, 30 aa, Artificial Sequence
  Description of Artificial Sequence: Synthetic polypeptide
DEEEIRTTNPVATEQYGCVSTNLQNGFNPI

SEQ ID NO: 14710 - protein, 31 aa, Artificial Sequence
  Description of Artificial Sequence: Synthetic polypeptide
VEEEVRTTNPVATEQYGSVSTMNLDQRDGNR

SEQ ID NO: 14711 - protein, 29 aa, Artificial Sequence
  Description of Artificial Sequence: Synthetic peptide
YEMEIRTTNPVATEQYGSVSTNLTREGNC

SEQ ID NO: 14712 - protein, 30 aa, Artificial Sequence
  Description of Artificial Sequence: Synthetic polypeptide
DEEEIRTTNPVATEQYGDVSTDNLQVFGND

SEQ ID NO: 14713 - protein, 30 aa, Artificial Sequence
  Description of Artificial Sequence: Synthetic polypeptide
AEEEIRTTNPVATEQYGSVSTYNLQQEGNG

SEQ ID NO: 14714 - protein, 29 aa, Artificial Sequence
  Description of Artificial Sequence: Synthetic peptide
DEEEIRTTNPCATEQYGSVSTNLQRTEED

SEQ ID NO: 14715 - protein, 32 aa, Artificial Sequence
  Description of Artificial Sequence: Synthetic polypeptide
DEEEIRTTNPVATEQYGSVSNTSNGLQRGENE

SEQ ID NO: 14716 - protein, 30 aa, Artificial Sequence
  Description of Artificial Sequence: Synthetic polypeptide
REEEIRTTNPVATEYYGSVASTNLQRGNGE

SEQ ID NO: 14717 - protein, 31 aa, Artificial Sequence
  Description of Artificial Sequence: Synthetic polypeptide
DEEEIRTTNPVATEQYGSVSGTSNLQDGGNS

SEQ ID NO: 14718 - protein, 29 aa, Artificial Sequence
  Description of Artificial Sequence: Synthetic peptide
SEEEIATTNPVATEQYGSVSENLQNGNHR

SEQ ID NO: 14719 - protein, 28 aa, Artificial Sequence
  Description of Artificial Sequence: Synthetic peptide
DEECIRTTNPVATEQYGSVSTYLQGGED

SEQ ID NO: 14720 - protein, 30 aa, Artificial Sequence
  Description of Artificial Sequence: Synthetic polypeptide
DEEEIRTTNPVATEPYGSVVATNLTQGGNR

SEQ ID NO: 14721 - protein, 30 aa, Artificial Sequence
  Description of Artificial Sequence: Synthetic polypeptide
YEEEIRTTNPYATEQYGSVSTGNLQRGNDQ

SEQ ID NO: 14722 - protein, 28 aa, Artificial Sequence
  Description of Artificial Sequence: Synthetic peptide
SEEEIATTNPVATEQYGSVSENLMRGNL

SEQ ID NO: 14723 - protein, 30 aa, Artificial Sequence
  Description of Artificial Sequence: Synthetic polypeptide
DEEEIRTTNPVATEFYGSVSTNLVQGGGNN

SEQ ID NO: 14724 - protein, 31 aa, Artificial Sequence
  Description of Artificial Sequence: Synthetic polypeptide
DEEEIRTTNPVATEQYGSVSTNDLQNGQNDS

SEQ ID NO: 14725 - protein, 29 aa, Artificial Sequence
  Description of Artificial Sequence: Synthetic peptide
AEEEIRTTNPVATEQYGSVSVNGDQYGNR

SEQ ID NO: 14726 - protein, 29 aa, Artificial Sequence
  Description of Artificial Sequence: Synthetic peptide
REEEIRTTNPVATEQYGSVSEILQIAGNR

SEQ ID NO: 14727 - protein, 30 aa, Artificial Sequence
  Description of Artificial Sequence: Synthetic polypeptide
DEEEIRTTNPVATEFYGSVSTNLQVGNFDI

SEQ ID NO: 14728 - protein, 32 aa, Artificial Sequence
  Description of Artificial Sequence: Synthetic polypeptide
DEEEIRTTNPVATEQYGSVSTMNLNQRGSERA

SEQ ID NO: 14729 - protein, 29 aa, Artificial Sequence
  Description of Artificial Sequence: Synthetic peptide
YEEVIGTTNPVATEQYGSVISTNLQVGNR

SEQ ID NO: 14730 - protein, 30 aa, Artificial Sequence
  Description of Artificial Sequence: Synthetic polypeptide
YEETIRTTNPVATEQYGAVSTNLQNRGNRM

SEQ ID NO: 14731 - protein, 28 aa, Artificial Sequence
  Description of Artificial Sequence: Synthetic peptide
REEEIRTTNPVATEQYGSVQTVLQNGFR

SEQ ID NO: 14732 - protein, 29 aa, Artificial Sequence
  Description of Artificial Sequence: Synthetic peptide
YEEEISTTNPVATEQYGSVSTVLPRGNRM

SEQ ID NO: 14733 - protein, 30 aa, Artificial Sequence
  Description of Artificial Sequence: Synthetic polypeptide
DEEEIRTTNPVATEQYGSVSHNLQDGNNEH

SEQ ID NO: 14734 - protein, 30 aa, Artificial Sequence
  Description of Artificial Sequence: Synthetic polypeptide
DEEEIRTTNPVATEFYGSVSTNLQTSGNNE

SEQ ID NO: 14735 - protein, 30 aa, Artificial Sequence
  Description of Artificial Sequence: Synthetic polypeptide
DEEEIRTTNPVATEQYGCVSTNLQNGDNHD

SEQ ID NO: 14736 - protein, 30 aa, Artificial Sequence
  Description of Artificial Sequence: Synthetic polypeptide
DEEEIRTTNPCATEQYGSVSTTNLQQGNFA

SEQ ID NO: 14737 - protein, 29 aa, Artificial Sequence
  Description of Artificial Sequence: Synthetic peptide
DEEEIRTTNPVATEQYGSVSPPPLPRGNL

SEQ ID NO: 14738 - protein, 28 aa, Artificial Sequence
  Description of Artificial Sequence: Synthetic peptide
REEEIRTTNPVATEQYGSVQTALQHGFR

SEQ ID NO: 14739 - protein, 30 aa, Artificial Sequence
  Description of Artificial Sequence: Synthetic polypeptide
DEEEIRTTNPVATEQYGSVSTMLQFNGNTV

SEQ ID NO: 14740 - protein, 30 aa, Artificial Sequence
  Description of Artificial Sequence: Synthetic polypeptide
DEEEIRTTNPCATEQYGSVWATNLQRGNFC

SEQ ID NO: 14741 - protein, 29 aa, Artificial Sequence
  Description of Artificial Sequence: Synthetic peptide
DEEEIRTTNPVATEQFGTSVSTHLTRGNS

SEQ ID NO: 14742 - protein, 28 aa, Artificial Sequence
  Description of Artificial Sequence: Synthetic peptide
AEEEIRTTNPVATEQYGSVSVNGNGGNR

SEQ ID NO: 14743 - protein, 28 aa, Artificial Sequence
  Description of Artificial Sequence: Synthetic peptide
SEEEIACTNPIATEQYGSVSENLQRGNR

SEQ ID NO: 14744 - protein, 32 aa, Artificial Sequence
  Description of Artificial Sequence: Synthetic polypeptide
DEEEIRTTNPVATEQYGSVSTMNLPQLRGDNF

SEQ ID NO: 14745 - protein, 29 aa, Artificial Sequence
  Description of Artificial Sequence: Synthetic peptide
DEEEIRTTNPVATEQYGCVSTIDQRDGNS

SEQ ID NO: 14746 - protein, 31 aa, Artificial Sequence
  Description of Artificial Sequence: Synthetic polypeptide
DEEEIRTTNPVATEQYGSVSPPTNLERGDRQ

SEQ ID NO: 14747 - protein, 30 aa, Artificial Sequence
  Description of Artificial Sequence: Synthetic polypeptide
DEEEIRTTNPVATEGYGSVSTYNLQEGNIE

SEQ ID NO: 14748 - protein, 30 aa, Artificial Sequence
  Description of Artificial Sequence: Synthetic polypeptide
DEECIRTTNPVATEQYGSVSTNLSDNVGNR

SEQ ID NO: 14749 - protein, 30 aa, Artificial Sequence
  Description of Artificial Sequence: Synthetic polypeptide
DEEEIRTTNPVATEQYGSVSTNDLQNSGFE

SEQ ID NO: 14750 - protein, 31 aa, Artificial Sequence
  Description of Artificial Sequence: Synthetic polypeptide
DEEEIRTTNPVATEQYGSVSPNLQRNGNEFD

SEQ ID NO: 14751 - protein, 30 aa, Artificial Sequence
  Description of Artificial Sequence: Synthetic polypeptide
DEEEIRTTNPCATEQYGSVSTNLQSPENRN

SEQ ID NO: 14752 - protein, 30 aa, Artificial Sequence
  Description of Artificial Sequence: Synthetic polypeptide
DEEEIRTTNPVATEQYGSVSNTFALQRQND

SEQ ID NO: 14753 - protein, 31 aa, Artificial Sequence
  Description of Artificial Sequence: Synthetic polypeptide
DEEEIRTTNPVATEGYGSVSTTNDLQRGSNF

SEQ ID NO: 14754 - protein, 31 aa, Artificial Sequence
  Description of Artificial Sequence: Synthetic polypeptide
DEEEIRTTNPVATEPYGCTVSTNLSQRGNRG

SEQ ID NO: 14755 - protein, 32 aa, Artificial Sequence
  Description of Artificial Sequence: Synthetic polypeptide
DEEEIRTTNPVATEQYGSVSNTPNGLQRGENG

SEQ ID NO: 14756 - protein, 30 aa, Artificial Sequence
  Description of Artificial Sequence: Synthetic polypeptide
DEEEIRTTNPVATEQYGSVSTNDLQNRMVL

SEQ ID NO: 14757 - protein, 28 aa, Artificial Sequence
  Description of Artificial Sequence: Synthetic peptide
REEEIRTTNPVATEQYGSVYTALQNGVR

SEQ ID NO: 14758 - protein, 28 aa, Artificial Sequence
  Description of Artificial Sequence: Synthetic peptide
SEEEIACTNPVATEQYGSVSENLMRGNR

SEQ ID NO: 14759 - protein, 30 aa, Artificial Sequence
  Description of Artificial Sequence: Synthetic polypeptide
AEEEIRTTNPVATEQYGSVSVENLQRGNGY

SEQ ID NO: 14760 - protein, 32 aa, Artificial Sequence
  Description of Artificial Sequence: Synthetic polypeptide
DEEEIRTTNPVATEQYGSVSNTGNLQGGSNRF

SEQ ID NO: 14761 - protein, 30 aa, Artificial Sequence
  Description of Artificial Sequence: Synthetic polypeptide
DEEEIRTTNPVATEQYGCVSTNLQNGDNPF

SEQ ID NO: 14762 - protein, 28 aa, Artificial Sequence
  Description of Artificial Sequence: Synthetic peptide
DEEEIRTTNPVATEQYGSVSPILQTGVF

SEQ ID NO: 14763 - protein, 30 aa, Artificial Sequence
  Description of Artificial Sequence: Synthetic polypeptide
DEEEIRTTNPVATEQYGSVSTNAQNGNDQD

SEQ ID NO: 14764 - protein, 30 aa, Artificial Sequence
  Description of Artificial Sequence: Synthetic polypeptide
QEEEIRTTNPVATEQYGSVSTNELQRGGDV

SEQ ID NO: 14765 - protein, 30 aa, Artificial Sequence
  Description of Artificial Sequence: Synthetic polypeptide
SEEEIACTNPVATEQYGSVSTNLPQRGNDR

SEQ ID NO: 14766 - protein, 29 aa, Artificial Sequence
  Description of Artificial Sequence: Synthetic peptide
SEEEIATTNPVATEQYGSVSTNLQDGPNH

SEQ ID NO: 14767 - protein, 30 aa, Artificial Sequence
  Description of Artificial Sequence: Synthetic polypeptide
DEEEIRTTNPCATEQYGSVSTNLQVGITER

SEQ ID NO: 14768 - protein, 28 aa, Artificial Sequence
  Description of Artificial Sequence: Synthetic peptide
REEEIRTTNPVATEQYGSVWTALQNGTR

SEQ ID NO: 14769 - protein, 30 aa, Artificial Sequence
  Description of Artificial Sequence: Synthetic polypeptide
DEEEIRTTNPVATEQYGSVSTNDLQNGSTD

SEQ ID NO: 14770 - protein, 30 aa, Artificial Sequence
  Description of Artificial Sequence: Synthetic polypeptide
DEECIRTTNPVATEQYGSVSTNLVRGSVRN

SEQ ID NO: 14771 - protein, 30 aa, Artificial Sequence
  Description of Artificial Sequence: Synthetic polypeptide
DEEEIRTTNPCATEQYGSVSTNLQSGDERH

SEQ ID NO: 14772 - protein, 29 aa, Artificial Sequence
  Description of Artificial Sequence: Synthetic peptide
DEEEIRTTNPVATEQYGSVSPMLTRGNET

SEQ ID NO: 14773 - protein, 29 aa, Artificial Sequence
  Description of Artificial Sequence: Synthetic peptide
DEEEIRTTNPVATEQYGSVSPMNLQRNLQ

SEQ ID NO: 14774 - protein, 30 aa, Artificial Sequence
  Description of Artificial Sequence: Synthetic polypeptide
DEEEIRTTNPCATEQYGSVSTNLQPGAEDR

SEQ ID NO: 14775 - protein, 28 aa, Artificial Sequence
  Description of Artificial Sequence: Synthetic peptide
YEEEIRTTNPVATDGYGSCSTNLQGGNR

SEQ ID NO: 14776 - protein, 31 aa, Artificial Sequence
  Description of Artificial Sequence: Synthetic polypeptide
DEEEIRTTNPVATEQYGSVSNTNLQGTFGNA

SEQ ID NO: 14777 - protein, 30 aa, Artificial Sequence
  Description of Artificial Sequence: Synthetic polypeptide
DEEEIRTTNPVATEQYGSVSINDLQREQNS

SEQ ID NO: 14778 - protein, 30 aa, Artificial Sequence
  Description of Artificial Sequence: Synthetic polypeptide
DEEEIRTTNPVATEQYGSVSTMLQGIGNTD

SEQ ID NO: 14779 - protein, 30 aa, Artificial Sequence
  Description of Artificial Sequence: Synthetic polypeptide
DEEEIRTTNPVATEQYGCVSTENPQRGNIE

SEQ ID NO: 14780 - protein, 31 aa, Artificial Sequence
  Description of Artificial Sequence: Synthetic polypeptide
DEEEIRTTNPVATEQYGSVSTMNLQVGLEIR

SEQ ID NO: 14781 - protein, 29 aa, Artificial Sequence
  Description of Artificial Sequence: Synthetic peptide
DEEEIRTTNPVATEIYGTVSTNDQRGDRG

SEQ ID NO: 14782 - protein, 30 aa, Artificial Sequence
  Description of Artificial Sequence: Synthetic polypeptide
QEEEIRTTNPVATEQYGSVSSTNLDEFGNR

SEQ ID NO: 14783 - protein, 29 aa, Artificial Sequence
  Description of Artificial Sequence: Synthetic peptide
DEEEIRTTNPVATEQYGSVSNTNLQATSQ

SEQ ID NO: 14784 - protein, 30 aa, Artificial Sequence
  Description of Artificial Sequence: Synthetic polypeptide
YEKEIRTTNPVATEQYGSVSTNDQQRQGNR

SEQ ID NO: 14785 - protein, 30 aa, Artificial Sequence
  Description of Artificial Sequence: Synthetic polypeptide
DEEEIRTTNPVATEQYGSVSTMNLQDEPNV

SEQ ID NO: 14786 - protein, 30 aa, Artificial Sequence
  Description of Artificial Sequence: Synthetic polypeptide
DEEEIRTTNPCATEQYGSVYVTNLQRGNGN

SEQ ID NO: 14787 - protein, 30 aa, Artificial Sequence
  Description of Artificial Sequence: Synthetic polypeptide
AEEEIRTTNPVATEQYGSVSVTNLQNNGNQ

SEQ ID NO: 14788 - protein, 30 aa, Artificial Sequence
  Description of Artificial Sequence: Synthetic polypeptide
YEYEIRTTNPVATEQYGSVSTNLQNGVNRP

SEQ ID NO: 14789 - protein, 29 aa, Artificial Sequence
  Description of Artificial Sequence: Synthetic peptide
DEEEIRTTNPCATEQYGSVSTNLQLNNDV

SEQ ID NO: 14790 - protein, 31 aa, Artificial Sequence
  Description of Artificial Sequence: Synthetic polypeptide
DEEEIRTTNPVATEQYGDVSTDNLQRGNNPI

SEQ ID NO: 14791 - protein, 30 aa, Artificial Sequence
  Description of Artificial Sequence: Synthetic polypeptide
DEEEIRTTNPVATEQYGSVSTNAMQGDGNI

SEQ ID NO: 14792 - protein, 31 aa, Artificial Sequence
  Description of Artificial Sequence: Synthetic polypeptide
DEEEIRTTNPVATEQYGSVSTNDMQRGQNEG

SEQ ID NO: 14793 - protein, 32 aa, Artificial Sequence
  Description of Artificial Sequence: Synthetic polypeptide
DEEEIRTTNPVATEQYGSVSTMNLSQGGSNRA

SEQ ID NO: 14794 - protein, 31 aa, Artificial Sequence
  Description of Artificial Sequence: Synthetic polypeptide
DEEEIRTTNPVATEQYGCVSVTNLLQGGSNR

SEQ ID NO: 14795 - protein, 29 aa, Artificial Sequence
  Description of Artificial Sequence: Synthetic peptide
DEEEIRTTNPVATEQYGCVSTNNQFGVRL

SEQ ID NO: 14796 - protein, 28 aa, Artificial Sequence
  Description of Artificial Sequence: Synthetic peptide
DEEEIRTTNPVATEQYGSVSINDQRSDH

SEQ ID NO: 14797 - protein, 31 aa, Artificial Sequence
  Description of Artificial Sequence: Synthetic polypeptide
DEEEIRTTNPVATEQYGSVSINELSQRGTNI

SEQ ID NO: 14798 - protein, 30 aa, Artificial Sequence
  Description of Artificial Sequence: Synthetic polypeptide
DEEEIRTTNPVATEQYGSVSNTDDQRGELR

SEQ ID NO: 14799 - protein, 30 aa, Artificial Sequence
  Description of Artificial Sequence: Synthetic polypeptide
DEEEIRTTNPVATEQYGSVSTNDLVQNGEH

SEQ ID NO: 14800 - protein, 30 aa, Artificial Sequence
  Description of Artificial Sequence: Synthetic polypeptide
YEEEITTTNPVATEQYGSVNVDTNLQRGNR

SEQ ID NO: 14801 - protein, 30 aa, Artificial Sequence
  Description of Artificial Sequence: Synthetic polypeptide
DEEEIRTTNPVATEQYGSVSPQFNLQRQNL

SEQ ID NO: 14802 - protein, 29 aa, Artificial Sequence
  Description of Artificial Sequence: Synthetic peptide
REKEIRTTNPVATEQYGSVSTNLQRNTDR

SEQ ID NO: 14803 - protein, 30 aa, Artificial Sequence
  Description of Artificial Sequence: Synthetic polypeptide
DEEEIRTTNPVATEQYGCVSTNLQPGQNDF

SEQ ID NO: 14804 - protein, 30 aa, Artificial Sequence
  Description of Artificial Sequence: Synthetic polypeptide
DEEEIRTTNPVATEQYGSVSNTNLTNNNRP

SEQ ID NO: 14805 - protein, 30 aa, Artificial Sequence
  Description of Artificial Sequence: Synthetic polypeptide
DEEEIRTTNPVATEQYGSVSTMNDGQDGNT

SEQ ID NO: 14806 - protein, 29 aa, Artificial Sequence
  Description of Artificial Sequence: Synthetic peptide
YEHEIRTTNPVGTEQYGSVSTNLQGIGNR

SEQ ID NO: 14807 - protein, 29 aa, Artificial Sequence
  Description of Artificial Sequence: Synthetic peptide
YEYEIRTTNPVATEQYGSVSENLEQRGER

SEQ ID NO: 14808 - protein, 30 aa, Artificial Sequence
  Description of Artificial Sequence: Synthetic polypeptide
DEECIRTTNPVATEQYGSVSTNLQHQGDDR

SEQ ID NO: 14809 - protein, 30 aa, Artificial Sequence
  Description of Artificial Sequence: Synthetic polypeptide
YEYEIRTTNPVATEQYGSVSDTNLDQVGNR

SEQ ID NO: 14810 - protein, 33 aa, Artificial Sequence
  Description of Artificial Sequence: Synthetic polypeptide
DEEEIRTTNPVATEQYGSVSTNDLSQGRGENER

SEQ ID NO: 14811 - protein, 30 aa, Artificial Sequence
  Description of Artificial Sequence: Synthetic polypeptide
YEEEIRTTNPVATDQYGSVSTNLQRGGEVR

SEQ ID NO: 14812 - protein, 31 aa, Artificial Sequence
  Description of Artificial Sequence: Synthetic polypeptide
AEEEIRTTNPVATEQYGSVSVTNLQNNGVNR

SEQ ID NO: 14813 - protein, 29 aa, Artificial Sequence
  Description of Artificial Sequence: Synthetic peptide
DEEEIRTTNPCATEQYGSVSTNLQRDAAA

SEQ ID NO: 14814 - protein, 29 aa, Artificial Sequence
  Description of Artificial Sequence: Synthetic peptide
DEEEIRTTNPVATEQFGTSVSTELLRGNY

SEQ ID NO: 14815 - protein, 29 aa, Artificial Sequence
  Description of Artificial Sequence: Synthetic peptide
YEEEVRTTNPVATESYGSVSTNLQDGVNR

SEQ ID NO: 14816 - protein, 31 aa, Artificial Sequence
  Description of Artificial Sequence: Synthetic polypeptide
DEEEIRTTNPVATEQYGSVSHFNLQRGNLQL

SEQ ID NO: 14817 - protein, 30 aa, Artificial Sequence
  Description of Artificial Sequence: Synthetic polypeptide
DEEEIRTTNPVATEQYGSVSNTNLEDGGIR

SEQ ID NO: 14818 - protein, 28 aa, Artificial Sequence
  Description of Artificial Sequence: Synthetic peptide
REEEIRTTNPVCTEPYGSVSTNLQYGNM

SEQ ID NO: 14819 - protein, 30 aa, Artificial Sequence
  Description of Artificial Sequence: Synthetic polypeptide
DEEEIRTTNPCATEQYGSVSTNLQGGPERA

SEQ ID NO: 14820 - protein, 32 aa, Artificial Sequence
  Description of Artificial Sequence: Synthetic polypeptide
DEEEIRTTNPVATEQYGSVSTMNLQEGENDRP

SEQ ID NO: 14821 - protein, 29 aa, Artificial Sequence
  Description of Artificial Sequence: Synthetic peptide
YEHEIRTTNPVATEQYGSVSTNLQIVGNG

SEQ ID NO: 14822 - protein, 31 aa, Artificial Sequence
  Description of Artificial Sequence: Synthetic polypeptide
AEEEIRTTNPVATEQYGSVSVTNLQPSGVNR

SEQ ID NO: 14823 - protein, 30 aa, Artificial Sequence
  Description of Artificial Sequence: Synthetic polypeptide
DEEEIRTTNPCATEQYGSVSTNLQNQGNIG

SEQ ID NO: 14824 - protein, 30 aa, Artificial Sequence
  Description of Artificial Sequence: Synthetic polypeptide
DEEEIRTTNPVATEQYGSVSNTNLDFNNRI

SEQ ID NO: 14825 - protein, 29 aa, Artificial Sequence
  Description of Artificial Sequence: Synthetic peptide
DEEEIRTTNPVATEQFGTSVSTDLLRGNA

SEQ ID NO: 14826 - protein, 29 aa, Artificial Sequence
  Description of Artificial Sequence: Synthetic peptide
DEEEIRTTNPCATEQYGSVSTNLQHDNMV

SEQ ID NO: 14827 - protein, 29 aa, Artificial Sequence
  Description of Artificial Sequence: Synthetic peptide
DEEEIRTTNPCATEQYGSVSTNLQMPNPV

SEQ ID NO: 14828 - protein, 31 aa, Artificial Sequence
  Description of Artificial Sequence: Synthetic polypeptide
DEEEIRTTNPVATEQYGSVSTMNLQDGNANQ

SEQ ID NO: 14829 - protein, 30 aa, Artificial Sequence
  Description of Artificial Sequence: Synthetic polypeptide
DEEEIRTTNPCATEQYGSVYTTNLQRGNSV

SEQ ID NO: 14830 - protein, 31 aa, Artificial Sequence
  Description of Artificial Sequence: Synthetic polypeptide
DEEEIRTTNPVATEQYGSVSTMNLTQGGNIG

SEQ ID NO: 14831 - protein, 28 aa, Artificial Sequence
  Description of Artificial Sequence: Synthetic peptide
DEEEIRTTNPVATEQYGSVSPMLQTGPF

SEQ ID NO: 14832 - protein, 30 aa, Artificial Sequence
  Description of Artificial Sequence: Synthetic polypeptide
DEEEIRTTNPCATEQYGSVSTNLQNVGNGV

SEQ ID NO: 14833 - protein, 31 aa, Artificial Sequence
  Description of Artificial Sequence: Synthetic polypeptide
DEEEIRTTNPVATEQYGSVSNTGLEQRSNNR

SEQ ID NO: 14834 - protein, 28 aa, Artificial Sequence
  Description of Artificial Sequence: Synthetic peptide
DEECIRTTNPVATEQYGCVSTNGQTGNP

SEQ ID NO: 14835 - protein, 30 aa, Artificial Sequence
  Description of Artificial Sequence: Synthetic polypeptide
DEEEIRTTNPVATEPYGSVSTTNLTRGGNT

SEQ ID NO: 14836 - protein, 29 aa, Artificial Sequence
  Description of Artificial Sequence: Synthetic peptide
QEEGIRTTNPVATEQYGSVSTNGQSGENR

SEQ ID NO: 14837 - protein, 30 aa, Artificial Sequence
  Description of Artificial Sequence: Synthetic polypeptide
DEEEIRTTNPVATEPYGSVCFTNLVRAGNR

SEQ ID NO: 14838 - protein, 31 aa, Artificial Sequence
  Description of Artificial Sequence: Synthetic polypeptide
DEEEIRTTNPVATEQYGSVSTMNLSQSGNDT

SEQ ID NO: 14839 - protein, 30 aa, Artificial Sequence
  Description of Artificial Sequence: Synthetic polypeptide
DEHEIRTTNPVATEIYGSVSTNLDQGGENM

SEQ ID NO: 14840 - protein, 31 aa, Artificial Sequence
  Description of Artificial Sequence: Synthetic polypeptide
DEEEIRTTNPVATEQYGSVSNTTNAERGEDR

SEQ ID NO: 14841 - protein, 29 aa, Artificial Sequence
  Description of Artificial Sequence: Synthetic peptide
AEEEIRTTNPVATEQYGSVATTNQQAGNT

SEQ ID NO: 14842 - protein, 29 aa, Artificial Sequence
  Description of Artificial Sequence: Synthetic peptide
SQEEIRTTNPVATEQWGKVSTNLQEGGNR

SEQ ID NO: 14843 - protein, 29 aa, Artificial Sequence
  Description of Artificial Sequence: Synthetic peptide
DEAEIKTTNPVATEQYGSVSPTNLMYGNT

SEQ ID NO: 14844 - protein, 29 aa, Artificial Sequence
  Description of Artificial Sequence: Synthetic peptide
SQEEIRTTNPVATEQWGKVSTNLQESGNR

SEQ ID NO: 14845 - protein, 32 aa, Artificial Sequence
  Description of Artificial Sequence: Synthetic polypeptide
DEEEIRTTNPVATEQYGSVYSTNDPQRGENQF

SEQ ID NO: 14846 - protein, 28 aa, Artificial Sequence
  Description of Artificial Sequence: Synthetic peptide
AEEEIRTTNPVATEQYGSVATALQGGFG

SEQ ID NO: 14847 - protein, 30 aa, Artificial Sequence
  Description of Artificial Sequence: Synthetic polypeptide
DEEEIATTNPVATEQYGSVSTNGGNTGNNR

SEQ ID NO: 14848 - protein, 29 aa, Artificial Sequence
  Description of Artificial Sequence: Synthetic peptide
DEHEIRTTNPVATEQWGSISTNTQRTGSR

SEQ ID NO: 14849 - protein, 31 aa, Artificial Sequence
  Description of Artificial Sequence: Synthetic polypeptide
DEEEIRTTNPVATEQYGSVYSTNDIQDSGNQ

SEQ ID NO: 14850 - protein, 31 aa, Artificial Sequence
  Description of Artificial Sequence: Synthetic polypeptide
DEEEIATTNPVATEQYGSVSTNGQRNGENDG

SEQ ID NO: 14851 - protein, 31 aa, Artificial Sequence
  Description of Artificial Sequence: Synthetic polypeptide
DEEEIRTTNPVATEQYGVVSSTNLQNNGMNM

SEQ ID NO: 14852 - protein, 30 aa, Artificial Sequence
  Description of Artificial Sequence: Synthetic polypeptide
DEHEIRTTNPVATEQYGSISTNDEQREGLR

SEQ ID NO: 14853 - protein, 30 aa, Artificial Sequence
  Description of Artificial Sequence: Synthetic polypeptide
AEEEIRTTNPVATEQYGSVATALQNGNFER

SEQ ID NO: 14854 - protein, 28 aa, Artificial Sequence
  Description of Artificial Sequence: Synthetic peptide
SQEEIRTTNPVATEQWGTVSTNLQNGNQ

SEQ ID NO: 14855 - protein, 30 aa, Artificial Sequence
  Description of Artificial Sequence: Synthetic polypeptide
AEEEIRTTNPVATEQYGSVATNLQNGGNQS

SEQ ID NO: 14856 - protein, 28 aa, Artificial Sequence
  Description of Artificial Sequence: Synthetic peptide
DDEAIRTTNPVATEQYGAVSTNHQRPNM

SEQ ID NO: 14857 - protein, 29 aa, Artificial Sequence
  Description of Artificial Sequence: Synthetic peptide
DEAEIATTNPVATEQYGSVCTNLQQDGND

SEQ ID NO: 14858 - protein, 31 aa, Artificial Sequence
  Description of Artificial Sequence: Synthetic polypeptide
DEAEIRTTNPVATEQYGSVSTNLQPGQDNDS

SEQ ID NO: 14859 - protein, 30 aa, Artificial Sequence
  Description of Artificial Sequence: Synthetic polypeptide
DEHEIRTTNPVATEQYGEVSTNLQHQGNEP

SEQ ID NO: 14860 - protein, 30 aa, Artificial Sequence
  Description of Artificial Sequence: Synthetic polypeptide
DEEEIATTNPVATEQYGSVSTGNGLRGNAD

SEQ ID NO: 14861 - protein, 30 aa, Artificial Sequence
  Description of Artificial Sequence: Synthetic polypeptide
DEHEIRTTNPVATEQYGAVSTNLQGGDGNP

SEQ ID NO: 14862 - protein, 29 aa, Artificial Sequence
  Description of Artificial Sequence: Synthetic peptide
DEAEIATTNPVATEQYGSVCSTNLMYGNQ

SEQ ID NO: 14863 - protein, 28 aa, Artificial Sequence
  Description of Artificial Sequence: Synthetic peptide
DEEEIRTTNPVATEIYGSVSEDVIDGNR

SEQ ID NO: 14864 - protein, 31 aa, Artificial Sequence
  Description of Artificial Sequence: Synthetic polypeptide
DEEEIRTTNPVATEQYGVVSTENLQAGSNAN

SEQ ID NO: 14865 - protein, 31 aa, Artificial Sequence
  Description of Artificial Sequence: Synthetic polypeptide
DEAEIRTTNPVATEQYGSVSTNLQQGTGNAN

SEQ ID NO: 14866 - protein, 30 aa, Artificial Sequence
  Description of Artificial Sequence: Synthetic polypeptide
DEEEIATTNPVATEQYGSVSTGNDMTNGNR

SEQ ID NO: 14867 - protein, 29 aa, Artificial Sequence
  Description of Artificial Sequence: Synthetic peptide
AEEEIRTTNPVATEQYGSVATALQGGDFR

SEQ ID NO: 14868 - protein, 29 aa, Artificial Sequence
  Description of Artificial Sequence: Synthetic peptide
DEEEIATTNPVATEQYGSVSTNADQGNNN

SEQ ID NO: 14869 - protein, 29 aa, Artificial Sequence
  Description of Artificial Sequence: Synthetic peptide
DEHEIRTTNPVATEQYGSISTNGQREELR

SEQ ID NO: 14870 - protein, 32 aa, Artificial Sequence
  Description of Artificial Sequence: Synthetic polypeptide
DEEEIRTTNPVATEQYGSVNSTNDDQRDGNEN

SEQ ID NO: 14871 - protein, 31 aa, Artificial Sequence
  Description of Artificial Sequence: Synthetic polypeptide
DEEEIRTTNPVATEQYGSVSNTTLQGMNGER

SEQ ID NO: 14872 - protein, 30 aa, Artificial Sequence
  Description of Artificial Sequence: Synthetic polypeptide
YEEEISTTNPVATEQYGSVTSTNINFRGNR

SEQ ID NO: 14873 - protein, 31 aa, Artificial Sequence
  Description of Artificial Sequence: Synthetic polypeptide
DEEEIRTTNPVATEQYGVVSTENLQGSGNNP

SEQ ID NO: 14874 - protein, 31 aa, Artificial Sequence
  Description of Artificial Sequence: Synthetic polypeptide
DEAEIRTTNPVATEQYGSVSTNLQQAEGNSG

SEQ ID NO: 14875 - protein, 30 aa, Artificial Sequence
  Description of Artificial Sequence: Synthetic polypeptide
DEHEIRTTNPVATEQYGEVSTNLNQDTNDR

SEQ ID NO: 14876 - protein, 30 aa, Artificial Sequence
  Description of Artificial Sequence: Synthetic polypeptide
DEHEIRTTNPVATEPYGSVSTNLQIGGGNI

SEQ ID NO: 14877 - protein, 30 aa, Artificial Sequence
  Description of Artificial Sequence: Synthetic polypeptide
DEHEIRTTNPVATEQYGSISTNGQQREGGR

SEQ ID NO: 14878 - protein, 30 aa, Artificial Sequence
  Description of Artificial Sequence: Synthetic polypeptide
DEHEIRTTNPVATEQYGEVSTNLQDGNDME

SEQ ID NO: 14879 - protein, 30 aa, Artificial Sequence
  Description of Artificial Sequence: Synthetic polypeptide
YEEEISTTNPVATEQYGSVSTNNLQKGARI

SEQ ID NO: 14880 - protein, 30 aa, Artificial Sequence
  Description of Artificial Sequence: Synthetic polypeptide
YEEEISTTNPVATEQYGSVSTVLERGNPRL

SEQ ID NO: 14881 - protein, 30 aa, Artificial Sequence
  Description of Artificial Sequence: Synthetic polypeptide
DEEEIRTTNPVATEQYGVVSTELQRFTERA

SEQ ID NO: 14882 - protein, 30 aa, Artificial Sequence
  Description of Artificial Sequence: Synthetic polypeptide
DEHEIRTTNPVATEPYGSVSTNAQRDGDNP

SEQ ID NO: 14883 - protein, 29 aa, Artificial Sequence
  Description of Artificial Sequence: Synthetic peptide
DEEEIRTTNPVATEIYGCVGTELQRTQNR

SEQ ID NO: 14884 - protein, 29 aa, Artificial Sequence
  Description of Artificial Sequence: Synthetic peptide
DEHEIRTTNPVATEIYGSVSNGNLQRGDW

SEQ ID NO: 14885 - protein, 30 aa, Artificial Sequence
  Description of Artificial Sequence: Synthetic polypeptide
DEHEIRTTNPVATEPYGSVSTNLQEGGMNG

SEQ ID NO: 14886 - protein, 31 aa, Artificial Sequence
  Description of Artificial Sequence: Synthetic polypeptide
DEDEIRTTNPVATEQYGSVSTNLQNGQNDTN

SEQ ID NO: 14887 - protein, 30 aa, Artificial Sequence
  Description of Artificial Sequence: Synthetic polypeptide
DEHEIRTTNPVATEQYGEVSTNLQGNGDLR

SEQ ID NO: 14888 - protein, 33 aa, Artificial Sequence
  Description of Artificial Sequence: Synthetic polypeptide
DEEEIRTTNPVATEHYGSVVSTNLSQRGGNNRL

SEQ ID NO: 14889 - protein, 29 aa, Artificial Sequence
  Description of Artificial Sequence: Synthetic peptide
DEEEIATTNPVATEQYGSVSTNGDFGNNQ

SEQ ID NO: 14890 - protein, 31 aa, Artificial Sequence
  Description of Artificial Sequence: Synthetic polypeptide
DEEEIRTTNPVATEQYGSVSCTNEGSQRGED

SEQ ID NO: 14891 - protein, 30 aa, Artificial Sequence
  Description of Artificial Sequence: Synthetic polypeptide
DEEEIRTTNPVATEQYGVVSTGNLIGGNTQ

SEQ ID NO: 14892 - protein, 30 aa, Artificial Sequence
  Description of Artificial Sequence: Synthetic polypeptide
DEEEIATTNPVATEQYGSVSTNGQAGQGPR

SEQ ID NO: 14893 - protein, 30 aa, Artificial Sequence
  Description of Artificial Sequence: Synthetic polypeptide
DEHEIRTTNPVATEQYGCVSTNLQMGGNGS

SEQ ID NO: 14894 - protein, 30 aa, Artificial Sequence
  Description of Artificial Sequence: Synthetic polypeptide
DEHEIRTTNPVATEQYGNVSTNLQGEGDSR

SEQ ID NO: 14895 - protein, 30 aa, Artificial Sequence
  Description of Artificial Sequence: Synthetic polypeptide
DEHEIRTTNPVATENYGSVSTNLQQMGDNS

SEQ ID NO: 14896 - protein, 29 aa, Artificial Sequence
  Description of Artificial Sequence: Synthetic peptide
SQEEIRTTNPVATEQWGTVSTMNLQPGNR

SEQ ID NO: 14897 - protein, 31 aa, Artificial Sequence
  Description of Artificial Sequence: Synthetic polypeptide
DEDEIRTTNPVATEQYGSVSTNLQPQGENDD

SEQ ID NO: 14898 - protein, 31 aa, Artificial Sequence
  Description of Artificial Sequence: Synthetic polypeptide
DEEEIATTNPVATEQYGSVSTGNLQGDGNNV

SEQ ID NO: 14899 - protein, 31 aa, Artificial Sequence
  Description of Artificial Sequence: Synthetic polypeptide
DEHEIRTTNPVATEQYGCVSTNLQHDGTNNR

SEQ ID NO: 14900 - protein, 29 aa, Artificial Sequence
  Description of Artificial Sequence: Synthetic peptide
DEHEIRTTNPVATEQWGEVSTNLQGGNDM

SEQ ID NO: 14901 - protein, 30 aa, Artificial Sequence
  Description of Artificial Sequence: Synthetic polypeptide
DEHEIRTTNPVATEQYGCVSTNLQGGTNEG

SEQ ID NO: 14902 - protein, 30 aa, Artificial Sequence
  Description of Artificial Sequence: Synthetic polypeptide
YEEEISTTNPVATEQYGSVSTNIEHRGNRA

SEQ ID NO: 14903 - protein, 30 aa, Artificial Sequence
  Description of Artificial Sequence: Synthetic polypeptide
AEEEIRTTNPVATEQYGSVATNTQGVGNSR

SEQ ID NO: 14904 - protein, 30 aa, Artificial Sequence
  Description of Artificial Sequence: Synthetic polypeptide
DEEEIRTTNPVATEQYGSVCSTNLEHGPDQ

SEQ ID NO: 14905 - protein, 28 aa, Artificial Sequence
  Description of Artificial Sequence: Synthetic peptide
DDEAIRTTNPVATEQYGEVSTNGQRPNL

SEQ ID NO: 14906 - protein, 31 aa, Artificial Sequence
  Description of Artificial Sequence: Synthetic polypeptide
DEHEIRTTNPVATEQYGDVSTNLQRDGNNDS

SEQ ID NO: 14907 - protein, 32 aa, Artificial Sequence
  Description of Artificial Sequence: Synthetic polypeptide
DEAEIRTTNPVATEQYGSVSTNLQREGDNDEP

SEQ ID NO: 14908 - protein, 33 aa, Artificial Sequence
  Description of Artificial Sequence: Synthetic polypeptide
DEHEIRTTNPVATEQYGISTVSTNALSQRTGNR

SEQ ID NO: 14909 - protein, 32 aa, Artificial Sequence
  Description of Artificial Sequence: Synthetic polypeptide
DEDEIRTTNPVATEQYGSVSTNLQNGGQNDAR

SEQ ID NO: 14910 - protein, 30 aa, Artificial Sequence
  Description of Artificial Sequence: Synthetic polypeptide
YEEEISTTNPVATEQYGSVSTNENHRSGNR

SEQ ID NO: 14911 - protein, 31 aa, Artificial Sequence
  Description of Artificial Sequence: Synthetic polypeptide
DEHEIRTTNPVATEQYGCVSTNLQNGQNEDR

SEQ ID NO: 14912 - protein, 28 aa, Artificial Sequence
  Description of Artificial Sequence: Synthetic peptide
AEEEIRTTNPVATEQYGSVATNDQNGTQ

SEQ ID NO: 14913 - protein, 32 aa, Artificial Sequence
  Description of Artificial Sequence: Synthetic polypeptide
YEEEISTTNPVATEQYGSVVPSYTNLQGRGNR

SEQ ID NO: 14914 - protein, 30 aa, Artificial Sequence
  Description of Artificial Sequence: Synthetic polypeptide
DEAEIRTTNPVATEQYGSVSTNLQQGMDGD

SEQ ID NO: 14915 - protein, 31 aa, Artificial Sequence
  Description of Artificial Sequence: Synthetic polypeptide
DEHEIRTTNPVATEQYGCVSTNLQRDGGNLN

SEQ ID NO: 14916 - protein, 31 aa, Artificial Sequence
  Description of Artificial Sequence: Synthetic polypeptide
DEHEIRTTNPVATEQYGCVSTNLQRDGENDE

SEQ ID NO: 14917 - protein, 30 aa, Artificial Sequence
  Description of Artificial Sequence: Synthetic polypeptide
DEDEIRTTNPVATEQYGSVSTNLQPQGDDA

SEQ ID NO: 14918 - protein, 29 aa, Artificial Sequence
  Description of Artificial Sequence: Synthetic peptide
SQEEIRTTNPVATEQWGTVSTGNLQIGNR

SEQ ID NO: 14919 - protein, 30 aa, Artificial Sequence
  Description of Artificial Sequence: Synthetic polypeptide
DEDEIRTTNPVATEQYGSVSTNLQNGDVDG

SEQ ID NO: 14920 - protein, 32 aa, Artificial Sequence
  Description of Artificial Sequence: Synthetic polypeptide
DEEEIRTTNPVATEQYGVVSTGNLQFFGSNRE

SEQ ID NO: 14921 - protein, 31 aa, Artificial Sequence
  Description of Artificial Sequence: Synthetic polypeptide
DEHEIRTTNPVATEQYGCVSTNLQRDGDNQP

SEQ ID NO: 14922 - protein, 32 aa, Artificial Sequence
  Description of Artificial Sequence: Synthetic polypeptide
DEEEIRTTNPVATEAYGSVSCTNAHSQRGNYR

SEQ ID NO: 14923 - protein, 30 aa, Artificial Sequence
  Description of Artificial Sequence: Synthetic polypeptide
DEEEIATTNPVATEQYGSVSTNGQAGDMQR

SEQ ID NO: 14924 - protein, 31 aa, Artificial Sequence
  Description of Artificial Sequence: Synthetic polypeptide
DEEEIRTTNPVATEQYGVVSTDNLQENGNGV

SEQ ID NO: 14925 - protein, 31 aa, Artificial Sequence
  Description of Artificial Sequence: Synthetic polypeptide
DEEEIRTTNPVATEQYGVVSTFNLQPGNFGV

SEQ ID NO: 14926 - protein, 30 aa, Artificial Sequence
  Description of Artificial Sequence: Synthetic polypeptide
DEEEIRTTNPVATEQYGVVSTDNGQNGNGD

SEQ ID NO: 14927 - protein, 30 aa, Artificial Sequence
  Description of Artificial Sequence: Synthetic polypeptide
DEAEIRTTNPVATEQYGSVSTNLQYGGDED

SEQ ID NO: 14928 - protein, 29 aa, Artificial Sequence
  Description of Artificial Sequence: Synthetic peptide
DEHEIRTTNPVATEPYGEVSTNLQGGNAG

SEQ ID NO: 14929 - protein, 32 aa, Artificial Sequence
  Description of Artificial Sequence: Synthetic polypeptide
YEEEISTTNPVATEQYGSVSTMNLTQRSGANR

SEQ ID NO: 14930 - protein, 31 aa, Artificial Sequence
  Description of Artificial Sequence: Synthetic polypeptide
DEDEIRTTNPVATEQYGSVSTNLQPQGGNMG

SEQ ID NO: 14931 - protein, 31 aa, Artificial Sequence
  Description of Artificial Sequence: Synthetic polypeptide
DEDEIRTTNPVATEQYGSVSTNLQNTGEDQR

SEQ ID NO: 14932 - protein, 31 aa, Artificial Sequence
  Description of Artificial Sequence: Synthetic polypeptide
YEEEISTTNPVATEQYGSVVSTTNLIGRGNR

SEQ ID NO: 14933 - protein, 31 aa, Artificial Sequence
  Description of Artificial Sequence: Synthetic polypeptide
DEDEIRTTNPVATEQYGSVSTNLQNGPNDNQ

SEQ ID NO: 14934 - protein, 30 aa, Artificial Sequence
  Description of Artificial Sequence: Synthetic polypeptide
AEEEIRTTNPVATEQYGSVATTNLQQGNNP

SEQ ID NO: 14935 - protein, 29 aa, Artificial Sequence
  Description of Artificial Sequence: Synthetic peptide
DEHEIRTTNPVATEQYGSHSTNTQREGLI

SEQ ID NO: 14936 - protein, 31 aa, Artificial Sequence
  Description of Artificial Sequence: Synthetic polypeptide
DEEEIATTNPVATEQYGSVSTNGLGDDDGNR

SEQ ID NO: 14937 - protein, 31 aa, Artificial Sequence
  Description of Artificial Sequence: Synthetic polypeptide
DEEEIRTTNPVATEQYGSVNSTMGLQEGNIG

SEQ ID NO: 14938 - protein, 28 aa, Artificial Sequence
  Description of Artificial Sequence: Synthetic peptide
DEEEIRTTNPVATEIYGLSSTNEQRTNF

SEQ ID NO: 14939 - protein, 30 aa, Artificial Sequence
  Description of Artificial Sequence: Synthetic polypeptide
DEHEIRTTNPVATEQYGSCSTNTQGEGDNR

SEQ ID NO: 14940 - protein, 32 aa, Artificial Sequence
  Description of Artificial Sequence: Synthetic polypeptide
DEHEIRTTNPVATEQYGEVSTNLQRGDGQNNR

SEQ ID NO: 14941 - protein, 31 aa, Artificial Sequence
  Description of Artificial Sequence: Synthetic polypeptide
DEEEIRTTNPVATEHYGYSISTNHLEQRGER

SEQ ID NO: 14942 - protein, 30 aa, Artificial Sequence
  Description of Artificial Sequence: Synthetic polypeptide
YEEEISTTNPVATEQYGSVSSTNINPRGNR

SEQ ID NO: 14943 - protein, 31 aa, Artificial Sequence
  Description of Artificial Sequence: Synthetic polypeptide
DEDEIRTTNPVATEQYGSVSTNLQQNNGNAE

SEQ ID NO: 14944 - protein, 28 aa, Artificial Sequence
  Description of Artificial Sequence: Synthetic peptide
AEEEIRTTNPVATEQYGSVATALQNLFR

SEQ ID NO: 14945 - protein, 28 aa, Artificial Sequence
  Description of Artificial Sequence: Synthetic peptide
AEEEIRTTNPVATEQYGSVATDLQNGFL

SEQ ID NO: 14946 - protein, 30 aa, Artificial Sequence
  Description of Artificial Sequence: Synthetic polypeptide
AEEEIRTTNPVATEQYGSVATALQNGVNRE

SEQ ID NO: 14947 - protein, 32 aa, Artificial Sequence
  Description of Artificial Sequence: Synthetic polypeptide
DEAEIRTTNPVATEQYGSVSTNLQQGQGDMNR

SEQ ID NO: 14948 - protein, 29 aa, Artificial Sequence
  Description of Artificial Sequence: Synthetic peptide
AEEEIRTTNPVATEQYGSVATALQSNGVR

SEQ ID NO: 14949 - protein, 29 aa, Artificial Sequence
  Description of Artificial Sequence: Synthetic peptide
AEEEIRTTNPVATEQYGSVATALQNGQDR

SEQ ID NO: 14950 - protein, 29 aa, Artificial Sequence
  Description of Artificial Sequence: Synthetic peptide
YEEEISTTNPVATEQYGSVSTNINHRGTR

SEQ ID NO: 14951 - protein, 30 aa, Artificial Sequence
  Description of Artificial Sequence: Synthetic polypeptide
AEEEIRTTNPVATEQYGSVATTNLQDGNQE

SEQ ID NO: 14952 - protein, 31 aa, Artificial Sequence
  Description of Artificial Sequence: Synthetic polypeptide
DEHEIRTTNPVATEQYGNVSTNLQMDGNNSR

SEQ ID NO: 14953 - protein, 30 aa, Artificial Sequence
  Description of Artificial Sequence: Synthetic polypeptide
DEHEIRTTNPVATEQYGCVSTNLQGGNDMK

SEQ ID NO: 14954 - protein, 31 aa, Artificial Sequence
  Description of Artificial Sequence: Synthetic polypeptide
DEEEIRTTNPVATEHYGYSISTNELQRGERL

SEQ ID NO: 14955 - protein, 30 aa, Artificial Sequence
  Description of Artificial Sequence: Synthetic polypeptide
DEHEIRTTNPVATEQYGCVSTNLQGAGNGL

SEQ ID NO: 14956 - protein, 32 aa, Artificial Sequence
  Description of Artificial Sequence: Synthetic polypeptide
DEEEIRTTNPVATEAYGSVSCTGNLSQAGNNR

SEQ ID NO: 14957 - protein, 31 aa, Artificial Sequence
  Description of Artificial Sequence: Synthetic polypeptide
DEAEIRTTNPVATEQYGSVSTNLQQNGDENE

SEQ ID NO: 14958 - protein, 29 aa, Artificial Sequence
  Description of Artificial Sequence: Synthetic peptide
SQEEIRTTNPVATEQWGTVSTNLQAMGNR

SEQ ID NO: 14959 - protein, 31 aa, Artificial Sequence
  Description of Artificial Sequence: Synthetic polypeptide
DEHEIRTTNPVATEQYGEVSTNLNGQEGDNR

SEQ ID NO: 14960 - protein, 29 aa, Artificial Sequence
  Description of Artificial Sequence: Synthetic peptide
SQEEIRTTNPVATEQWGTVSTNLQNSGNR

SEQ ID NO: 14961 - protein, 28 aa, Artificial Sequence
  Description of Artificial Sequence: Synthetic peptide
SQEEIRTTNPVATEQWGTVSTNLENGNR

SEQ ID NO: 14962 - protein, 31 aa, Artificial Sequence
  Description of Artificial Sequence: Synthetic polypeptide
DEHEIRTTNPVATENYGSVSTNLQGDGGNTR

SEQ ID NO: 14963 - protein, 30 aa, Artificial Sequence
  Description of Artificial Sequence: Synthetic polypeptide
DEEEIRTTNPVATEQYGVVSTAPQYFGSNR

SEQ ID NO: 14964 - protein, 32 aa, Artificial Sequence
  Description of Artificial Sequence: Synthetic polypeptide
DEEEIRTTNPVATEQYGSVNSTMNLQEEGNNQ

SEQ ID NO: 14965 - protein, 30 aa, Artificial Sequence
  Description of Artificial Sequence: Synthetic polypeptide
DEEEIATTNPVATEQYGSVSTNGNQQGNHQ

SEQ ID NO: 14966 - protein, 31 aa, Artificial Sequence
  Description of Artificial Sequence: Synthetic polypeptide
DEHEIRTTNPVATEQYGEVSTNLGGQEGGNR

SEQ ID NO: 14967 - protein, 28 aa, Artificial Sequence
  Description of Artificial Sequence: Synthetic peptide
SQEEIRTTNPVATEQWGNVSTNLQHGNA

SEQ ID NO: 14968 - protein, 32 aa, Artificial Sequence
  Description of Artificial Sequence: Synthetic polypeptide
YEEEISTTNPVATEQYGSVVSQTNLQGRGNGR

SEQ ID NO: 14969 - protein, 30 aa, Artificial Sequence
  Description of Artificial Sequence: Synthetic polypeptide
DEEEIRTTNPVATEQYGVVSTELQQRPSNL

SEQ ID NO: 14970 - protein, 31 aa, Artificial Sequence
  Description of Artificial Sequence: Synthetic polypeptide
DEEEIRTTNPVATEQYGSVVATNMLQQPGNE

SEQ ID NO: 14971 - protein, 29 aa, Artificial Sequence
  Description of Artificial Sequence: Synthetic peptide
SQEEIRTTNPVATEQWGHVSTNLQEGGNR

SEQ ID NO: 14972 - protein, 30 aa, Artificial Sequence
  Description of Artificial Sequence: Synthetic polypeptide
DEHEIRTTNPVATEQYGSVSTNLNGGMNGA

SEQ ID NO: 14973 - protein, 30 aa, Artificial Sequence
  Description of Artificial Sequence: Synthetic polypeptide
DEAEIRTTNPVATEQYGSVSTVNLGGQGNQ

SEQ ID NO: 14974 - protein, 31 aa, Artificial Sequence
  Description of Artificial Sequence: Synthetic polypeptide
DEEEIATTNPVATEQYGSVSTNLQAGGDGNP

SEQ ID NO: 14975 - protein, 28 aa, Artificial Sequence
  Description of Artificial Sequence: Synthetic peptide
DEAEIATTNPVATEQYGSVSTNMQPGDV

SEQ ID NO: 14976 - protein, 31 aa, Artificial Sequence
  Description of Artificial Sequence: Synthetic polypeptide
DEEEIATTNPVATEQYGSVSTNLQADGNTEE

SEQ ID NO: 14977 - protein, 30 aa, Artificial Sequence
  Description of Artificial Sequence: Synthetic polypeptide
DEAEIATTNPVATEQYGSVSTNLQVGNDDA

SEQ ID NO: 14978 - protein, 29 aa, Artificial Sequence
  Description of Artificial Sequence: Synthetic peptide
DEHEIRTTNPVATEQYGSVSTNLNDGMGQ

SEQ ID NO: 14979 - protein, 30 aa, Artificial Sequence
  Description of Artificial Sequence: Synthetic polypeptide
DEHEIRTTNPVATEQYGSVSTNLNDGENEQ

SEQ ID NO: 14980 - protein, 31 aa, Artificial Sequence
  Description of Artificial Sequence: Synthetic polypeptide
DEEEIRTTNPVATEAYGSVPSTDLSQHGGNR

SEQ ID NO: 14981 - protein, 30 aa, Artificial Sequence
  Description of Artificial Sequence: Synthetic polypeptide
DEHEIRTTNPVATEQYGSVSTNLNDEGNGQ

SEQ ID NO: 14982 - protein, 30 aa, Artificial Sequence
  Description of Artificial Sequence: Synthetic polypeptide
DEHEIRTTNPVATEQYGSVSTNLNADGNTQ

SEQ ID NO: 14983 - protein, 31 aa, Artificial Sequence
  Description of Artificial Sequence: Synthetic polypeptide
YEEEITTTNPVATEQYGSVFSTNPLERGNFR

SEQ ID NO: 14984 - protein, 29 aa, Artificial Sequence
  Description of Artificial Sequence: Synthetic peptide
DEAEIATTNPVATEQYGSVSTNLQVGEPV

SEQ ID NO: 14985 - protein, 30 aa, Artificial Sequence
  Description of Artificial Sequence: Synthetic polypeptide
YEEEITTTNPVATEQYGMVSTNNLQKGNRQ

SEQ ID NO: 14986 - protein, 29 aa, Artificial Sequence
  Description of Artificial Sequence: Synthetic peptide
DEAEIATTNPVATEQYGSVSTNLQVGDSE

SEQ ID NO: 14987 - protein, 29 aa, Artificial Sequence
  Description of Artificial Sequence: Synthetic peptide
DEAEIATTNPVATEQYGSVSTNLQVGDDI

SEQ ID NO: 14988 - protein, 30 aa, Artificial Sequence
  Description of Artificial Sequence: Synthetic polypeptide
YEEEITTTNPVATEPYGSVMSTNLERGNNR

SEQ ID NO: 14989 - protein, 30 aa, Artificial Sequence
  Description of Artificial Sequence: Synthetic polypeptide
DEAEIATTNPVATEQYGSVSTNLQRQDNDP

SEQ ID NO: 14990 - protein, 30 aa, Artificial Sequence
  Description of Artificial Sequence: Synthetic polypeptide
DEHEIRTTNPVATEQYGSVSTNLNAGDNGQ

SEQ ID NO: 14991 - protein, 31 aa, Artificial Sequence
  Description of Artificial Sequence: Synthetic polypeptide
DEHEIRTTNPVATEQYGSVSTNLGHGDDGNR

SEQ ID NO: 14992 - protein, 30 aa, Artificial Sequence
  Description of Artificial Sequence: Synthetic polypeptide
DEDEIRTTNPVATEQYGSVSTNLQDHGGEQ

SEQ ID NO: 14993 - protein, 31 aa, Artificial Sequence
  Description of Artificial Sequence: Synthetic polypeptide
DEHEIRTTNPVATEQYGSVSTNLNGMEGNAR

SEQ ID NO: 14994 - protein, 31 aa, Artificial Sequence
  Description of Artificial Sequence: Synthetic polypeptide
DEHEIRTTNPVATEQYGSVSTNLQDGDGGSR

SEQ ID NO: 14995 - protein, 31 aa, Artificial Sequence
  Description of Artificial Sequence: Synthetic polypeptide
DEEEIRTTNPVATEQYGSVYTMNLMQRMGEE

SEQ ID NO: 14996 - protein, 29 aa, Artificial Sequence
  Description of Artificial Sequence: Synthetic peptide
DEAEIATTNPVATEQYGSVSTPLQRENIE

SEQ ID NO: 14997 - protein, 30 aa, Artificial Sequence
  Description of Artificial Sequence: Synthetic polypeptide
AEEEIRTTNPVATEQYGSVNTTNLQTGGNE

SEQ ID NO: 14998 - protein, 31 aa, Artificial Sequence
  Description of Artificial Sequence: Synthetic polypeptide
YEEEITTTNPVATEQYGSVNSTNNLQKGNRI

SEQ ID NO: 14999 - protein, 31 aa, Artificial Sequence
  Description of Artificial Sequence: Synthetic polypeptide
DEHEIRTTNPVATEQYGSVSTNLQANGDNNM

SEQ ID NO: 15000 - protein, 30 aa, Artificial Sequence
  Description of Artificial Sequence: Synthetic polypeptide
DEHEIRTTNPVATEQYGSVSTNLQAGGVPP

SEQ ID NO: 15001 - protein, 31 aa, Artificial Sequence
  Description of Artificial Sequence: Synthetic polypeptide
DEHEIRTTNPVATEQYGSVSTNLQAGGDNQP

SEQ ID NO: 15002 - protein, 31 aa, Artificial Sequence
  Description of Artificial Sequence: Synthetic polypeptide
YEEEITTTNPVATEQYGSVMSTNLERGDNFR

SEQ ID NO: 15003 - protein, 32 aa, Artificial Sequence
  Description of Artificial Sequence: Synthetic polypeptide
DEHEIRTTNPVATEQYGSVSTNLQADGNNGMR

SEQ ID NO: 15004 - protein, 31 aa, Artificial Sequence
  Description of Artificial Sequence: Synthetic polypeptide
DEDEIRTTNPVATEQYGSVSTNLQDGDGNVI

SEQ ID NO: 15005 - protein, 31 aa, Artificial Sequence
  Description of Artificial Sequence: Synthetic polypeptide
DEHEIRTTNPVATEQYGSVSTNLNQNGDQRG

SEQ ID NO: 15006 - protein, 32 aa, Artificial Sequence
  Description of Artificial Sequence: Synthetic polypeptide
DEHEIRTTNPVATEQYGSVSTNLNQGGPNDRN

SEQ ID NO: 15007 - protein, 31 aa, Artificial Sequence
  Description of Artificial Sequence: Synthetic polypeptide
DEEEIRTTNPVATEQYGSVSCTNGGQREGSS

SEQ ID NO: 15008 - protein, 30 aa, Artificial Sequence
  Description of Artificial Sequence: Synthetic polypeptide
DEAEIRTTNPVATEQYGSVSTVNSHQDGNM

SEQ ID NO: 15009 - protein, 31 aa, Artificial Sequence
  Description of Artificial Sequence: Synthetic polypeptide
DEDEIRTTNPVATEQYGSVSTNLQDGTNGDA

SEQ ID NO: 15010 - protein, 30 aa, Artificial Sequence
  Description of Artificial Sequence: Synthetic polypeptide
DEEEIRTTNPVATEQYGSVNSTNDNRFGEQ

SEQ ID NO: 15011 - protein, 31 aa, Artificial Sequence
  Description of Artificial Sequence: Synthetic polypeptide
DEAEIRTTNPVATEQYGSVSTVNLQGVGNEE

SEQ ID NO: 15012 - protein, 30 aa, Artificial Sequence
  Description of Artificial Sequence: Synthetic polypeptide
AEEEIRTTNPVATEQYGSVNTTNLQAGGNN

SEQ ID NO: 15013 - protein, 32 aa, Artificial Sequence
  Description of Artificial Sequence: Synthetic polypeptide
AEEEIRTTNPVATEQYGSVNTVNLVQRGENYR

SEQ ID NO: 15014 - protein, 30 aa, Artificial Sequence
  Description of Artificial Sequence: Synthetic polypeptide
DEHEIRTTNPVATEQYGSVSTNLGGAGNGQ

SEQ ID NO: 15015 - protein, 32 aa, Artificial Sequence
  Description of Artificial Sequence: Synthetic polypeptide
DEEEIRTTNPVATEQYGSVSNTNLPQNGNNSE

SEQ ID NO: 15016 - protein, 31 aa, Artificial Sequence
  Description of Artificial Sequence: Synthetic polypeptide
DEHEIRTTNPVATEQYGSVSTNEGGQTNGNR

SEQ ID NO: 15017 - protein, 32 aa, Artificial Sequence
  Description of Artificial Sequence: Synthetic polypeptide
DEEEIRTTNPVATEAYGSVPSVTNLSQHGGNR

SEQ ID NO: 15018 - protein, 32 aa, Artificial Sequence
  Description of Artificial Sequence: Synthetic polypeptide
AEEEIRTTNPVATEQYGSVNTGNLDQRGENPR

SEQ ID NO: 15019 - protein, 30 aa, Artificial Sequence
  Description of Artificial Sequence: Synthetic polypeptide
DEHEIRTTNPVATEQYGSVSTNEDHNGGNR

SEQ ID NO: 15020 - protein, 31 aa, Artificial Sequence
  Description of Artificial Sequence: Synthetic polypeptide
DEDEIRTTNPVATEQYGSVSTNLQGDHGDER

SEQ ID NO: 15021 - protein, 29 aa, Artificial Sequence
  Description of Artificial Sequence: Synthetic peptide
DEHEIRTTNPVATEQYGSVSTNDGQGNEP

SEQ ID NO: 15022 - protein, 31 aa, Artificial Sequence
  Description of Artificial Sequence: Synthetic polypeptide
DEHEIRTTNPVATEQYGSVSTNAQRDGDNTQ

SEQ ID NO: 15023 - protein, 32 aa, Artificial Sequence
  Description of Artificial Sequence: Synthetic polypeptide
DEAEIATTNPVATEQYGSVSTNLQRAEEGNRS

SEQ ID NO: 15024 - protein, 29 aa, Artificial Sequence
  Description of Artificial Sequence: Synthetic peptide
DEHEIRTTNPVATEQYGSVSTNENHGNGQ

SEQ ID NO: 15025 - protein, 31 aa, Artificial Sequence
  Description of Artificial Sequence: Synthetic polypeptide
DEHEIRTTNPVATEQYGSVSTNAQRDGDNDP

SEQ ID NO: 15026 - protein, 32 aa, Artificial Sequence
  Description of Artificial Sequence: Synthetic polypeptide
AEEEIRTTNPVATEQYGSVNTENLMQRGSNYR

SEQ ID NO: 15027 - protein, 31 aa, Artificial Sequence
  Description of Artificial Sequence: Synthetic polypeptide
DEHEIRTTNPVATEQYGSVSTNAQHDEGNER

SEQ ID NO: 15028 - protein, 32 aa, Artificial Sequence
  Description of Artificial Sequence: Synthetic polypeptide
AEEEIRTTNPVATEQYGSVNTDNLPQRGENGR

SEQ ID NO: 15029 - protein, 30 aa, Artificial Sequence
  Description of Artificial Sequence: Synthetic polypeptide
DEHEIRTTNPVATEQYGSVSTNAQGDGNEP

SEQ ID NO: 15030 - protein, 30 aa, Artificial Sequence
  Description of Artificial Sequence: Synthetic polypeptide
DEHEIRTTNPVATEQYGSVSTNAQGDGDNL

SEQ ID NO: 15031 - protein, 30 aa, Artificial Sequence
  Description of Artificial Sequence: Synthetic polypeptide
AEEEIRTTNPVATEQYGSVNSTNQQQIGNV

SEQ ID NO: 15032 - protein, 30 aa, Artificial Sequence
  Description of Artificial Sequence: Synthetic polypeptide
DEEEIRTTNPVATEQYGSVSCTNGGQRDSF

SEQ ID NO: 15033 - protein, 30 aa, Artificial Sequence
  Description of Artificial Sequence: Synthetic polypeptide
AEEEIRTTNPVATEQYGSVNSTNNQQTGNL

SEQ ID NO: 15034 - protein, 32 aa, Artificial Sequence
  Description of Artificial Sequence: Synthetic polypeptide
DEEEIRTTNPVATEQYGSVSTVNLTQDGINIP

SEQ ID NO: 15035 - protein, 28 aa, Artificial Sequence
  Description of Artificial Sequence: Synthetic peptide
YEEEITTTNPGATEQYGSVSTNLIRVER

SEQ ID NO: 15036 - protein, 30 aa, Artificial Sequence
  Description of Artificial Sequence: Synthetic polypeptide
DEHEIRTTNPVATEQYGSVSTNGDERGNHP

SEQ ID NO: 15037 - protein, 30 aa, Artificial Sequence
  Description of Artificial Sequence: Synthetic polypeptide
AEEEIRTTNPVATEQYGSVNTNLQAGGNNE

SEQ ID NO: 15038 - protein, 29 aa, Artificial Sequence
  Description of Artificial Sequence: Synthetic peptide
YEEEISTVNPVATEQYGSVSTNWQQRGER

SEQ ID NO: 15039 - protein, 31 aa, Artificial Sequence
  Description of Artificial Sequence: Synthetic polypeptide
DEHEIRTTNPVATEQYGSVSTNLDQANDGDR

SEQ ID NO: 15040 - protein, 30 aa, Artificial Sequence
  Description of Artificial Sequence: Synthetic polypeptide
DEHEIRTTNPVATEQYGSVSTNLDHGNNMM

SEQ ID NO: 15041 - protein, 30 aa, Artificial Sequence
  Description of Artificial Sequence: Synthetic polypeptide
DEHEIRTTNPVATEQYGSVSTNLDHDNGMR

SEQ ID NO: 15042 - protein, 30 aa, Artificial Sequence
  Description of Artificial Sequence: Synthetic polypeptide
DEHEIRTTNPVATEQYGSVSTNLDAGMNGQ

SEQ ID NO: 15043 - protein, 30 aa, Artificial Sequence
  Description of Artificial Sequence: Synthetic polypeptide
DEHEIRTTNPVATEQYGSVSTNLAGDGNDA

SEQ ID NO: 15044 - protein, 30 aa, Artificial Sequence
  Description of Artificial Sequence: Synthetic polypeptide
DEAEIATTNPVATEQYGSVSTNLQRENNDM

SEQ ID NO: 15045 - protein, 29 aa, Artificial Sequence
  Description of Artificial Sequence: Synthetic peptide
DEHEIRTTNPVATEQYGSVSTNHQGDANE

SEQ ID NO: 15046 - protein, 31 aa, Artificial Sequence
  Description of Artificial Sequence: Synthetic polypeptide
DEAEIRTTNPVATEQYGSVSTVLQHGGDNQR

SEQ ID NO: 15047 - protein, 30 aa, Artificial Sequence
  Description of Artificial Sequence: Synthetic polypeptide
DEHEIRTTNPVATEQYGSVSTNHQDNGDAR

SEQ ID NO: 15048 - protein, 31 aa, Artificial Sequence
  Description of Artificial Sequence: Synthetic polypeptide
DEHEIRTTNPVATEQYGSVSTNHEGQNSGNR

SEQ ID NO: 15049 - protein, 29 aa, Artificial Sequence
  Description of Artificial Sequence: Synthetic peptide
DEHEIRTTNPVATEQYGSVSTNHAEGGND

SEQ ID NO: 15050 - protein, 30 aa, Artificial Sequence
  Description of Artificial Sequence: Synthetic polypeptide
DEHEIRTTNPVATEQYGSVSTNGQVGDNMM

SEQ ID NO: 15051 - protein, 30 aa, Artificial Sequence
  Description of Artificial Sequence: Synthetic polypeptide
YEEEISTVNPVATEQYGSVSEWNLQRGNQR

SEQ ID NO: 15052 - protein, 30 aa, Artificial Sequence
  Description of Artificial Sequence: Synthetic polypeptide
AEEEIRTTNPVATEQYGSVNTNLQIGIGNN

SEQ ID NO: 15053 - protein, 30 aa, Artificial Sequence
  Description of Artificial Sequence: Synthetic polypeptide
DEAEIATTNPVATEQYGSVSTNLQREGDLE

SEQ ID NO: 15054 - protein, 32 aa, Artificial Sequence
  Description of Artificial Sequence: Synthetic polypeptide
DEEEIRTTNPVATEHYGSVCSCTNLSQGTGNR

SEQ ID NO: 15055 - protein, 30 aa, Artificial Sequence
  Description of Artificial Sequence: Synthetic polypeptide
DEHEIRTTNPVATEQYGSVSTNGQRGGDTD

SEQ ID NO: 15056 - protein, 30 aa, Artificial Sequence
  Description of Artificial Sequence: Synthetic polypeptide
DEAEIATTNPVATEQYGSVSTNLQRENNAE

SEQ ID NO: 15057 - protein, 31 aa, Artificial Sequence
  Description of Artificial Sequence: Synthetic polypeptide
DEHEIRTTNPVATEQYGSVSTNLQDGDNNEQ

SEQ ID NO: 15058 - protein, 31 aa, Artificial Sequence
  Description of Artificial Sequence: Synthetic polypeptide
DEHEIRTTNPVATEQYGSVSTNLQDGNGNDE

SEQ ID NO: 15059 - protein, 31 aa, Artificial Sequence
  Description of Artificial Sequence: Synthetic polypeptide
DEHEIRTTNPVATEQYGSVSTNLQDHGDVRG

SEQ ID NO: 15060 - protein, 32 aa, Artificial Sequence
  Description of Artificial Sequence: Synthetic polypeptide
DEHEIRTTNPVATEQYGSVSTNLQNDGQNENR

SEQ ID NO: 15061 - protein, 31 aa, Artificial Sequence
  Description of Artificial Sequence: Synthetic polypeptide
DEEEIRTTNPVATEQYGSVYTNEQQRGGMER

SEQ ID NO: 15062 - protein, 31 aa, Artificial Sequence
  Description of Artificial Sequence: Synthetic polypeptide
DEHEIRTTNPVATEQYGSVSTNLQMGDNGGS

SEQ ID NO: 15063 - protein, 31 aa, Artificial Sequence
  Description of Artificial Sequence: Synthetic polypeptide
DEHEIRTTNPVATEQYGSVSTNLQLNMGDER

SEQ ID NO: 15064 - protein, 31 aa, Artificial Sequence
  Description of Artificial Sequence: Synthetic polypeptide
DEHEIRTTNPVATEQYGSVSTNLQLGQNEDE

SEQ ID NO: 15065 - protein, 31 aa, Artificial Sequence
  Description of Artificial Sequence: Synthetic polypeptide
DEHEIRTTNPVATEQYGSVSTNLQLGQNDEG

SEQ ID NO: 15066 - protein, 31 aa, Artificial Sequence
  Description of Artificial Sequence: Synthetic polypeptide
DEHEIRTTNPVATEQYGSVSTNLQLGPNDES

SEQ ID NO: 15067 - protein, 30 aa, Artificial Sequence
  Description of Artificial Sequence: Synthetic polypeptide
YEEEITTTNPVATEQYGSVVSTNLEKGNFR

SEQ ID NO: 15068 - protein, 31 aa, Artificial Sequence
  Description of Artificial Sequence: Synthetic polypeptide
DEHEIRTTNPVATEQYGSVSTNLQNGDLQRG

SEQ ID NO: 15069 - protein, 31 aa, Artificial Sequence
  Description of Artificial Sequence: Synthetic polypeptide
DEHEIRTTNPVATEQYGSVSTNLQLGDGNEK

SEQ ID NO: 15070 - protein, 31 aa, Artificial Sequence
  Description of Artificial Sequence: Synthetic polypeptide
DEHEIRTTNPVATEQYGSVSTNLQLDGENQK

SEQ ID NO: 15071 - protein, 31 aa, Artificial Sequence
  Description of Artificial Sequence: Synthetic polypeptide
DEEEIRTTNPVATEQYGVVSAWTNLNQGMNR

SEQ ID NO: 15072 - protein, 29 aa, Artificial Sequence
  Description of Artificial Sequence: Synthetic peptide
YEEEITTTNPVATEQYGSVSWTNLVRSER

SEQ ID NO: 15073 - protein, 31 aa, Artificial Sequence
  Description of Artificial Sequence: Synthetic polypeptide
DEHEIRTTNPVATEQYGSVSTNLQKGEGQDR

SEQ ID NO: 15074 - protein, 30 aa, Artificial Sequence
  Description of Artificial Sequence: Synthetic polypeptide
AEEEIRTTNPVATEQYGSVSANLQNVGNGT

SEQ ID NO: 15075 - protein, 31 aa, Artificial Sequence
  Description of Artificial Sequence: Synthetic polypeptide
DEHEIRTTNPVATEQYGSVSTNLQHQGGNMM

SEQ ID NO: 15076 - protein, 31 aa, Artificial Sequence
  Description of Artificial Sequence: Synthetic polypeptide
DEHEIRTTNPVATEQYGSVSTNLQHQGDNDG

SEQ ID NO: 15077 - protein, 30 aa, Artificial Sequence
  Description of Artificial Sequence: Synthetic polypeptide
YEEEITTTNPVATEQYGSVSTNNLQKLNRM

SEQ ID NO: 15078 - protein, 30 aa, Artificial Sequence
  Description of Artificial Sequence: Synthetic polypeptide
DEEEIRTTNPVATEQYGVVQTELQERGSNQ

SEQ ID NO: 15079 - protein, 30 aa, Artificial Sequence
  Description of Artificial Sequence: Synthetic polypeptide
DEDEIRTTNPVATEQYGSVSTNLQANGEDA

SEQ ID NO: 15080 - protein, 31 aa, Artificial Sequence
  Description of Artificial Sequence: Synthetic polypeptide
DEEEIRTTNPVATEQYGSVNSTNDQRSQNDG

SEQ ID NO: 15081 - protein, 30 aa, Artificial Sequence
  Description of Artificial Sequence: Synthetic polypeptide
DEEEIRTTNPVATEQYGSVYTNEQRAGEDM

SEQ ID NO: 15082 - protein, 31 aa, Artificial Sequence
  Description of Artificial Sequence: Synthetic polypeptide
DEHEIRTTNPVATEQYGSVSTNLQQGDMGDR

SEQ ID NO: 15083 - protein, 31 aa, Artificial Sequence
  Description of Artificial Sequence: Synthetic polypeptide
DEEEIRTTNPVATEQYGSVSTVNLQPVENDF

SEQ ID NO: 15084 - protein, 32 aa, Artificial Sequence
  Description of Artificial Sequence: Synthetic polypeptide
DEHEIRTTNPVATEQYGSVSTNLQPQGDNDRN

SEQ ID NO: 15085 - protein, 32 aa, Artificial Sequence
  Description of Artificial Sequence: Synthetic polypeptide
DEDEIRTTNPVATEQYGSVSTNLPQNGDNDRN

SEQ ID NO: 15086 - protein, 30 aa, Artificial Sequence
  Description of Artificial Sequence: Synthetic polypeptide
AEEEIRTTNPVATEQYGSVSATNLNTEGNV

SEQ ID NO: 15087 - protein, 30 aa, Artificial Sequence
  Description of Artificial Sequence: Synthetic polypeptide
AEEEIRTTNPVATEQYGSVSATNLNLQGNN

SEQ ID NO: 15088 - protein, 32 aa, Artificial Sequence
  Description of Artificial Sequence: Synthetic polypeptide
DEEEIRTTNPVATEQYGSVSTVNLQPVGNLFQ

SEQ ID NO: 15089 - protein, 30 aa, Artificial Sequence
  Description of Artificial Sequence: Synthetic polypeptide
AEEEIRTTNPVATEQYGSVSATNLNGTGNE

SEQ ID NO: 15090 - protein, 31 aa, Artificial Sequence
  Description of Artificial Sequence: Synthetic polypeptide
DEEEIRTTNPVATEQYGVVNSTSNQLQRENN

SEQ ID NO: 15091 - protein, 30 aa, Artificial Sequence
  Description of Artificial Sequence: Synthetic polypeptide
YEEEITTTNPVAVEQYGSVSTNNLQGGNRI

SEQ ID NO: 15092 - protein, 31 aa, Artificial Sequence
  Description of Artificial Sequence: Synthetic polypeptide
DEHEIRTTNPVATEQYGSVSTNLQNMGDNGQ

SEQ ID NO: 15093 - protein, 31 aa, Artificial Sequence
  Description of Artificial Sequence: Synthetic polypeptide
DEHEIRTTNPVATEQYGSVSTNLQNGQNEYG

SEQ ID NO: 15094 - protein, 30 aa, Artificial Sequence
  Description of Artificial Sequence: Synthetic polypeptide
AEEEIRTTNPVATEQYGSVSATNLNENGNS

SEQ ID NO: 15095 - protein, 32 aa, Artificial Sequence
  Description of Artificial Sequence: Synthetic polypeptide
DEEEIRTTNPVATEQYGSVSTVNLQQNQGFNN

SEQ ID NO: 15096 - protein, 31 aa, Artificial Sequence
  Description of Artificial Sequence: Synthetic polypeptide
DEHEIRTTNPVATEQYGSVSTNLQNGGNEEQ

SEQ ID NO: 15097 - protein, 31 aa, Artificial Sequence
  Description of Artificial Sequence: Synthetic polypeptide
DEHEIRTTNPVATEQYGSVSTNLQNGGDERG

SEQ ID NO: 15098 - protein, 30 aa, Artificial Sequence
  Description of Artificial Sequence: Synthetic polypeptide
AEEEIRTTNPVATEQYGSVSATNLDELGNT

SEQ ID NO: 15099 - protein, 30 aa, Artificial Sequence
  Description of Artificial Sequence: Synthetic polypeptide
DEEEIRTTNPVATEQYGVVIWTNLNGGMNR

SEQ ID NO: 15100 - protein, 31 aa, Artificial Sequence
  Description of Artificial Sequence: Synthetic polypeptide
YEEEITTTNPVATEQYGTSVYSTNLQRGNGY

SEQ ID NO: 15101 - protein, 31 aa, Artificial Sequence
  Description of Artificial Sequence: Synthetic polypeptide
YEEEITTTNPVATEQYGSVSTNNLQKGNERA

SEQ ID NO: 15102 - protein, 30 aa, Artificial Sequence
  Description of Artificial Sequence: Synthetic polypeptide
DEEEIRTTNPVATEQYGVVSCTNGGQRGEF

SEQ ID NO: 15103 - protein, 31 aa, Artificial Sequence
  Description of Artificial Sequence: Synthetic polypeptide
YEEEITTTNPVATEQYGSVSTNNLQKGANRL

SEQ ID NO: 15104 - protein, 31 aa, Artificial Sequence
  Description of Artificial Sequence: Synthetic polypeptide
DEHEIRTTNPVATEQYGSVSTNLQGEDNNER

SEQ ID NO: 15105 - protein, 31 aa, Artificial Sequence
  Description of Artificial Sequence: Synthetic polypeptide
DEEEIRTTNPVATEQYGSVNSTNDQGGEERG

SEQ ID NO: 15106 - protein, 30 aa, Artificial Sequence
  Description of Artificial Sequence: Synthetic polypeptide
DEEEIRTTNPVATEQYGSVYTNDDRGENET

SEQ ID NO: 15107 - protein, 31 aa, Artificial Sequence
  Description of Artificial Sequence: Synthetic polypeptide
DEHEIRTTNPVATEQYGSVSTNLQGDGNGNV

SEQ ID NO: 15108 - protein, 31 aa, Artificial Sequence
  Description of Artificial Sequence: Synthetic polypeptide
DEHEIRTTNPVATEQYGSVSTNLQGDGNGMM

SEQ ID NO: 15109 - protein, 31 aa, Artificial Sequence
  Description of Artificial Sequence: Synthetic polypeptide
DEHEIRTTNPVATEQYGSVSTNLQGDGDDRR

SEQ ID NO: 15110 - protein, 31 aa, Artificial Sequence
  Description of Artificial Sequence: Synthetic polypeptide
DEDEIRTTNPVATEQYGSVSTNLQDAGNHND

SEQ ID NO: 15111 - protein, 32 aa, Artificial Sequence
  Description of Artificial Sequence: Synthetic polypeptide
DEHEIRTTNPVATEQYGSVSTNLQGDERGNEQ

SEQ ID NO: 15112 - protein, 32 aa, Artificial Sequence
  Description of Artificial Sequence: Synthetic polypeptide
DEEEIRTTNPVATEQYGSVNSTNDQGGTENGR

SEQ ID NO: 15113 - protein, 30 aa, Artificial Sequence
  Description of Artificial Sequence: Synthetic polypeptide
DEHEIRTTNPVATEQYGSVSTNLQGDAGEE

SEQ ID NO: 15114 - protein, 32 aa, Artificial Sequence
  Description of Artificial Sequence: Synthetic polypeptide
DEEEIRTTNPVATEAYGSVPSCTGNLQGEGNR

SEQ ID NO: 15115 - protein, 30 aa, Artificial Sequence
  Description of Artificial Sequence: Synthetic polypeptide
YEEEITTTNPVATEQYGSVSTMNLQHNLNR

SEQ ID NO: 15116 - protein, 30 aa, Artificial Sequence
  Description of Artificial Sequence: Synthetic polypeptide
YEEEITTTNPVATEQYGSVSTENLQKGTRI

SEQ ID NO: 15117 - protein, 30 aa, Artificial Sequence
  Description of Artificial Sequence: Synthetic polypeptide
DEAEIATTNPVATEQYGSVSTPNLQSDNRL

SEQ ID NO: 15118 - protein, 30 aa, Artificial Sequence
  Description of Artificial Sequence: Synthetic polypeptide
DEHEIRTTNPVATEQYGSVSTNLQEGGMSN

SEQ ID NO: 15119 - protein, 31 aa, Artificial Sequence
  Description of Artificial Sequence: Synthetic polypeptide
DEEEIRTTNPVATEAYGSVPSCTNLQRGGSE

SEQ ID NO: 15120 - protein, 31 aa, Artificial Sequence
  Description of Artificial Sequence: Synthetic polypeptide
DEEEIRTTNPVATEQYGSVYTMNNQRGNVMV

SEQ ID NO: 15121 - protein, 31 aa, Artificial Sequence
  Description of Artificial Sequence: Synthetic polypeptide
DEEEIRTTNPVATEQYGSVSTVNLQSESTNT

SEQ ID NO: 15122 - protein, 29 aa, Artificial Sequence
  Description of Artificial Sequence: Synthetic peptide
DEEEIRTTNPVATEQYGSVYTNDDREQER

SEQ ID NO: 15123 - protein, 31 aa, Artificial Sequence
  Description of Artificial Sequence: Synthetic polypeptide
DEHEIRTTNPVATEQYGSVSTNLQGEGNNMT

SEQ ID NO: 15124 - protein, 30 aa, Artificial Sequence
  Description of Artificial Sequence: Synthetic polypeptide
SNEEIRTTNPVATEQYGCVSTNLQDIGPNR

SEQ ID NO: 15125 - protein, 30 aa, Artificial Sequence
  Description of Artificial Sequence: Synthetic polypeptide
DEEEIRTTNPVATEQYGVVSDTNLNNGGNL

SEQ ID NO: 15126 - protein, 31 aa, Artificial Sequence
  Description of Artificial Sequence: Synthetic polypeptide
DEHEIRTTNPVATEQYGSVSTNLQHDNGGMR

SEQ ID NO: 15127 - protein, 31 aa, Artificial Sequence
  Description of Artificial Sequence: Synthetic polypeptide
DEHEIRTTNPVATEQYGSVSTNLQHDGGDMR

SEQ ID NO: 15128 - protein, 31 aa, Artificial Sequence
  Description of Artificial Sequence: Synthetic polypeptide
YEEEITTTNPVATEQYGSVSTNNLQKEGNRP

SEQ ID NO: 15129 - protein, 31 aa, Artificial Sequence
  Description of Artificial Sequence: Synthetic polypeptide
DEHEIRTTNPVATEQYGSVSTNLQGQMGDHR

SEQ ID NO: 15130 - protein, 31 aa, Artificial Sequence
  Description of Artificial Sequence: Synthetic polypeptide
DEHEIRTTNPVATEQYGSVSTNLQGQGDSRG

SEQ ID NO: 15131 - protein, 31 aa, Artificial Sequence
  Description of Artificial Sequence: Synthetic polypeptide
DEEEIRTTNPVATEQYGSVYTNDLEQHGNVE

SEQ ID NO: 15132 - protein, 30 aa, Artificial Sequence
  Description of Artificial Sequence: Synthetic polypeptide
AEEEIRTTNPVATEQYGSVSAENLDENGNR

SEQ ID NO: 15133 - protein, 30 aa, Artificial Sequence
  Description of Artificial Sequence: Synthetic polypeptide
AEEEIRTTNPVATEQYGSVSAANLTEFGNR

SEQ ID NO: 15134 - protein, 32 aa, Artificial Sequence
  Description of Artificial Sequence: Synthetic polypeptide
DEHEIRTTNPVATEQYGSVSTNLQGNMGNDNR

SEQ ID NO: 15135 - protein, 28 aa, Artificial Sequence
  Description of Artificial Sequence: Synthetic peptide
YEEEITTTNPVATEQYGSVSTNLVTHER

SEQ ID NO: 15136 - protein, 29 aa, Artificial Sequence
  Description of Artificial Sequence: Synthetic peptide
SNEEIRTTNPVATEQWGCVSTNLQEGNNR

SEQ ID NO: 15137 - protein, 31 aa, Artificial Sequence
  Description of Artificial Sequence: Synthetic polypeptide
DEEEIATTNPVATEQYGSVSTNLQAGGQQNE

SEQ ID NO: 15138 - protein, 28 aa, Artificial Sequence
  Description of Artificial Sequence: Synthetic peptide
SNEEIRTTNPVATEQWGTVSTNLQEMNR

SEQ ID NO: 15139 - protein, 32 aa, Artificial Sequence
  Description of Artificial Sequence: Synthetic polypeptide
DEHEIRTTNPVATEQYGSVSTNLQGNAGQNDR

SEQ ID NO: 15140 - protein, 29 aa, Artificial Sequence
  Description of Artificial Sequence: Synthetic peptide
YEEEITTTNPVATEQYGSVSTNLVRVERL

SEQ ID NO: 15141 - protein, 30 aa, Artificial Sequence
  Description of Artificial Sequence: Synthetic polypeptide
DEEEIRTTNPVATEQYGSVNSTNDQNQEER

SEQ ID NO: 15142 - protein, 31 aa, Artificial Sequence
  Description of Artificial Sequence: Synthetic polypeptide
DEHEIRTTNPVATEQYGSVSTNLQGGPNNQQ

SEQ ID NO: 15143 - protein, 31 aa, Artificial Sequence
  Description of Artificial Sequence: Synthetic polypeptide
DEEEIRTTNPVATEQYGVVSDTNALQNGERE

SEQ ID NO: 15144 - protein, 31 aa, Artificial Sequence
  Description of Artificial Sequence: Synthetic polypeptide
DEDEIRTTNPVATEQYGSVSTNLQDAGNDTS

SEQ ID NO: 15145 - protein, 30 aa, Artificial Sequence
  Description of Artificial Sequence: Synthetic polypeptide
DEAEIRTTNPVATEQYGSVSTTQDAQRGNE

SEQ ID NO: 15146 - protein, 30 aa, Artificial Sequence
  Description of Artificial Sequence: Synthetic polypeptide
YEEEISTTNPVATEQYGTSPSTNLEQRGTR

SEQ ID NO: 15147 - protein, 30 aa, Artificial Sequence
  Description of Artificial Sequence: Synthetic polypeptide
AEEEIRTTNPVATEQYGSVNSTNNNQDTNR

SEQ ID NO: 15148 - protein, 32 aa, Artificial Sequence
  Description of Artificial Sequence: Synthetic polypeptide
DEEEIRTTNPVATEQYGSVSTVNLTQNGINIQ

SEQ ID NO: 15149 - protein, 32 aa, Artificial Sequence
  Description of Artificial Sequence: Synthetic polypeptide
DEEEIRTTNPVATEQYGSVSCTNEHQETGNNR

SEQ ID NO: 15150 - protein, 32 aa, Artificial Sequence
  Description of Artificial Sequence: Synthetic polypeptide
DEEEIRTTNPVATEHYGSVSTNLQFFGSNDRL

SEQ ID NO: 15151 - protein, 31 aa, Artificial Sequence
  Description of Artificial Sequence: Synthetic polypeptide
DEHEIRTTNPVATEQYGSVPSQNALTRVGNR

SEQ ID NO: 15152 - protein, 31 aa, Artificial Sequence
  Description of Artificial Sequence: Synthetic polypeptide
YEEEISTTNPVATESYNGSFVSTSNLQRGNR

SEQ ID NO: 15153 - protein, 30 aa, Artificial Sequence
  Description of Artificial Sequence: Synthetic polypeptide
DEHEIRTTNPVATEQYGSVNSTNDQNNNER

SEQ ID NO: 15154 - protein, 31 aa, Artificial Sequence
  Description of Artificial Sequence: Synthetic polypeptide
DEHEIRTTNPVATEQYGSVISTNDLQQNGER

SEQ ID NO: 15155 - protein, 31 aa, Artificial Sequence
  Description of Artificial Sequence: Synthetic polypeptide
DEDEIRTTNPVATEQYGSVSTNLQGNAGNDE

SEQ ID NO: 15156 - protein, 30 aa, Artificial Sequence
  Description of Artificial Sequence: Synthetic polypeptide
DEEEIRTTNPVATEQYGVVSNTNLNSGVNM

SEQ ID NO: 15157 - protein, 33 aa, Artificial Sequence
  Description of Artificial Sequence: Synthetic polypeptide
DEEEIRTTNPVATEQYGSVNSTNDDQRGNEEGR

SEQ ID NO: 15158 - protein, 30 aa, Artificial Sequence
  Description of Artificial Sequence: Synthetic polypeptide
DEAEIATTNPVATEQYGSVSATNLQRENNE

SEQ ID NO: 15159 - protein, 32 aa, Artificial Sequence
  Description of Artificial Sequence: Synthetic polypeptide
AEEEIRTTNPVATEQYGSVCSTNNLQFGSNRV

SEQ ID NO: 15160 - protein, 30 aa, Artificial Sequence
  Description of Artificial Sequence: Synthetic polypeptide
DEAEIRTTNPVATEQYGSVSTPNDLQNQNS

SEQ ID NO: 15161 - protein, 31 aa, Artificial Sequence
  Description of Artificial Sequence: Synthetic polypeptide
DEEEIATTNPVATEQYGSVSTNLENRGNDNS

SEQ ID NO: 15162 - protein, 31 aa, Artificial Sequence
  Description of Artificial Sequence: Synthetic polypeptide
DEEEIRTTNPVATEQYGSVYSTNNQRDEEER

SEQ ID NO: 15163 - protein, 29 aa, Artificial Sequence
  Description of Artificial Sequence: Synthetic peptide
YEEEISTTNPVATEQYGYVSTNSLQVGNQ

SEQ ID NO: 15164 - protein, 29 aa, Artificial Sequence
  Description of Artificial Sequence: Synthetic peptide
DEEEIATTNPVATEQYGSVSTNLEDHGEL

SEQ ID NO: 15165 - protein, 31 aa, Artificial Sequence
  Description of Artificial Sequence: Synthetic polypeptide
DEEEIRTTNPVATEQYGSVYSTNNQQQGGND

SEQ ID NO: 15166 - protein, 30 aa, Artificial Sequence
  Description of Artificial Sequence: Synthetic polypeptide
DEHEIRTTNPVATEQYGSVATNNQMGDGNR

SEQ ID NO: 15167 - protein, 31 aa, Artificial Sequence
  Description of Artificial Sequence: Synthetic polypeptide
AEEEIRTTNPVATEQYGSVCSTTELQRGSNQ

SEQ ID NO: 15168 - protein, 28 aa, Artificial Sequence
  Description of Artificial Sequence: Synthetic peptide
SQEEIRSTNPVATEQWGTVSTNLQEGNR

SEQ ID NO: 15169 - protein, 32 aa, Artificial Sequence
  Description of Artificial Sequence: Synthetic polypeptide
DEEEIRTTNPVATEQYGSVNSTNDDQRGNEIG

SEQ ID NO: 15170 - protein, 30 aa, Artificial Sequence
  Description of Artificial Sequence: Synthetic polypeptide
DEHEIRTTNPVATEQYGSVSCTMDLQRENA

SEQ ID NO: 15171 - protein, 28 aa, Artificial Sequence
  Description of Artificial Sequence: Synthetic peptide
SQEEIRCTNPIATEQYGSVSENLMRGNR

SEQ ID NO: 15172 - protein, 32 aa, Artificial Sequence
  Description of Artificial Sequence: Synthetic polypeptide
DEEEIRTTNPVATEQYGSVNSTNDDQRGNTQL

SEQ ID NO: 15173 - protein, 29 aa, Artificial Sequence
  Description of Artificial Sequence: Synthetic peptide
DEAEIGTTNPVATEQYGSVATNLQETGNQ

SEQ ID NO: 15174 - protein, 28 aa, Artificial Sequence
  Description of Artificial Sequence: Synthetic peptide
DEAEIATTNPVATEQYGSVSTAIQRDTR

SEQ ID NO: 15175 - protein, 29 aa, Artificial Sequence
  Description of Artificial Sequence: Synthetic peptide
DEAEIRTTNPVATEQYGSVSTQGDHNGNR

SEQ ID NO: 15176 - protein, 33 aa, Artificial Sequence
  Description of Artificial Sequence: Synthetic polypeptide
DEEEIRTTNPVATEQYGSVSCTNELSQSVGNSR

SEQ ID NO: 15177 - protein, 28 aa, Artificial Sequence
  Description of Artificial Sequence: Synthetic peptide
YEEEISTTNPVATEYYGYVSTNLQYGNV

SEQ ID NO: 15178 - protein, 31 aa, Artificial Sequence
  Description of Artificial Sequence: Synthetic polypeptide
DEEEIRTTNPVATEQYGVVSMSNLQHGSNRT

SEQ ID NO: 15179 - protein, 30 aa, Artificial Sequence
  Description of Artificial Sequence: Synthetic polypeptide
DEAEIATTNPVATEQYGSVSGTNLGEDGNR

SEQ ID NO: 15180 - protein, 31 aa, Artificial Sequence
  Description of Artificial Sequence: Synthetic polypeptide
DEHEIRTTNPVATEQYGSVSETNGQGAGNNR

SEQ ID NO: 15181 - protein, 33 aa, Artificial Sequence
  Description of Artificial Sequence: Synthetic polypeptide
DEEEIRTTNPVATEQYGSVSCTNELQNGGNNRM

SEQ ID NO: 15182 - protein, 30 aa, Artificial Sequence
  Description of Artificial Sequence: Synthetic polypeptide
DEHEIRTTNPVATEQYGSVSDTNQQGMGNG

SEQ ID NO: 15183 - protein, 28 aa, Artificial Sequence
  Description of Artificial Sequence: Synthetic peptide
DEAEIATTNPVATEQYGSVSMNLQSGDV

SEQ ID NO: 15184 - protein, 30 aa, Artificial Sequence
  Description of Artificial Sequence: Synthetic polypeptide
DEHEIRTTNPVATEQYGSVSDNDQRGGNDA

SEQ ID NO: 15185 - protein, 31 aa, Artificial Sequence
  Description of Artificial Sequence: Synthetic polypeptide
DEEEIRTTNPVATEQYGSVYSTNQQQTGGNT

SEQ ID NO: 15186 - protein, 30 aa, Artificial Sequence
  Description of Artificial Sequence: Synthetic polypeptide
YEEEISTTNPVATEVYGSVTSTMNDQRGNR

SEQ ID NO: 15187 - protein, 31 aa, Artificial Sequence
  Description of Artificial Sequence: Synthetic polypeptide
YEEEISTTNPVATEVYGSMVSSTMNLQRGNR

SEQ ID NO: 15188 - protein, 31 aa, Artificial Sequence
  Description of Artificial Sequence: Synthetic polypeptide
DEEEIRTTNPVATEQYGVVSNSNLNRGMNQR

SEQ ID NO: 15189 - protein, 29 aa, Artificial Sequence
  Description of Artificial Sequence: Synthetic peptide
DEHEIRTTNPVATEQYGSVSENLFRNMNE

SEQ ID NO: 15190 - protein, 31 aa, Artificial Sequence
  Description of Artificial Sequence: Synthetic polypeptide
DEDEIRTTNPVATEQYGSVSTNLQGGPNDSN

SEQ ID NO: 15191 - protein, 31 aa, Artificial Sequence
  Description of Artificial Sequence: Synthetic polypeptide
DEAEIRTTNPVATEQYGSVSTPLQNQGENIR

SEQ ID NO: 15192 - protein, 29 aa, Artificial Sequence
  Description of Artificial Sequence: Synthetic peptide
DEHEIRTTNPVATEQYGSVATNNGRGGNE

SEQ ID NO: 15193 - protein, 29 aa, Artificial Sequence
  Description of Artificial Sequence: Synthetic peptide
DEHEIRTTNPVATEQYGSISTNTVRSGER

SEQ ID NO: 15194 - protein, 30 aa, Artificial Sequence
  Description of Artificial Sequence: Synthetic polypeptide
DEEEIATTNPVATEQYGSVSTNHSARVNNR

SEQ ID NO: 15195 - protein, 31 aa, Artificial Sequence
  Description of Artificial Sequence: Synthetic polypeptide
DEEEIRTTNPVATEQYGVVSSTNLNRMMNRV

SEQ ID NO: 15196 - protein, 30 aa, Artificial Sequence
  Description of Artificial Sequence: Synthetic polypeptide
DEHEIRTTNPVATEQYGSISTNTQRTGGMR

SEQ ID NO: 15197 - protein, 30 aa, Artificial Sequence
  Description of Artificial Sequence: Synthetic polypeptide
DEHEIRTTNPVATEQYGSISTNTQRGGDGR

SEQ ID NO: 15198 - protein, 28 aa, Artificial Sequence
  Description of Artificial Sequence: Synthetic peptide
DEEEIASVNPVATEQYGSVSTNLESGNQ

SEQ ID NO: 15199 - protein, 29 aa, Artificial Sequence
  Description of Artificial Sequence: Synthetic peptide
YEEEISTTNPVATEQYGTTVSTNLQVGNV

SEQ ID NO: 15200 - protein, 33 aa, Artificial Sequence
  Description of Artificial Sequence: Synthetic polypeptide
DEEEIRTTNPVATEAYGSVSCTDNLSQRGNNRT

SEQ ID NO: 15201 - protein, 32 aa, Artificial Sequence
  Description of Artificial Sequence: Synthetic polypeptide
DEEEIRTTNPVATEQYGSVYSTNNIQKGGNDR

SEQ ID NO: 15202 - protein, 31 aa, Artificial Sequence
  Description of Artificial Sequence: Synthetic polypeptide
DEDEIRTTNPVATEQYGSVSTNLQHQGNNDG

SEQ ID NO: 15203 - protein, 28 aa, Artificial Sequence
  Description of Artificial Sequence: Synthetic peptide
SQEEIRTTNPVATEQWGCVSTNLQEGNS

SEQ ID NO: 15204 - protein, 30 aa, Artificial Sequence
  Description of Artificial Sequence: Synthetic polypeptide
DEEEIATTNPVATEQYGSVSTNHQGNGNTE

SEQ ID NO: 15205 - protein, 29 aa, Artificial Sequence
  Description of Artificial Sequence: Synthetic peptide
DEHEIRTTNPVATEQYGSISTNSQGEGQR

SEQ ID NO: 15206 - protein, 29 aa, Artificial Sequence
  Description of Artificial Sequence: Synthetic peptide
DEHEIRTTNPVATEQYGSISTNQQRELLR

SEQ ID NO: 15207 - protein, 28 aa, Artificial Sequence
  Description of Artificial Sequence: Synthetic peptide
SQEEIRTTNPVATEQWGCVSTNLQYGNA

SEQ ID NO: 15208 - protein, 31 aa, Artificial Sequence
  Description of Artificial Sequence: Synthetic polypeptide
DEEEIRTTNPVATEQYGSVNSTNDDQRDIIR

SEQ ID NO: 15209 - protein, 31 aa, Artificial Sequence
  Description of Artificial Sequence: Synthetic polypeptide
DEDEIRTTNPVATEQYGSVSTNLQHQNGDER

SEQ ID NO: 15210 - protein, 32 aa, Artificial Sequence
  Description of Artificial Sequence: Synthetic polypeptide
DEEEIRTTNPVATEAYGSVSCTGNLQGPVGNR

SEQ ID NO: 15211 - protein, 29 aa, Artificial Sequence
  Description of Artificial Sequence: Synthetic peptide
DEHEIRTTNPVATEQYGSISTNTQREGGT

SEQ ID NO: 15212 - protein, 30 aa, Artificial Sequence
  Description of Artificial Sequence: Synthetic polypeptide
DEHEIRTTNPVATEQYGSVATNNQAGDTNR

SEQ ID NO: 15213 - protein, 31 aa, Artificial Sequence
  Description of Artificial Sequence: Synthetic polypeptide
DEEEIATTNPVATEQYGSVSTNIGDQDGDNR

SEQ ID NO: 15214 - protein, 32 aa, Artificial Sequence
  Description of Artificial Sequence: Synthetic polypeptide
DEEEIRTTNPVATEAYGSVSCTANHSQRGNNR

SEQ ID NO: 15215 - protein, 31 aa, Artificial Sequence
  Description of Artificial Sequence: Synthetic polypeptide
DEDEIRTTNPVATEQYGSVSTNLQGNDGGAR

SEQ ID NO: 15216 - protein, 30 aa, Artificial Sequence
  Description of Artificial Sequence: Synthetic polypeptide
DEHEIRTTNPVATEQYGSVATNLQNGDDRG

SEQ ID NO: 15217 - protein, 30 aa, Artificial Sequence
  Description of Artificial Sequence: Synthetic polypeptide
DEHEIRTTNPVATEQYGSVATNLQGDTGND

SEQ ID NO: 15218 - protein, 29 aa, Artificial Sequence
  Description of Artificial Sequence: Synthetic peptide
YEEEISTTNPVATEQYGYVSTNLQVGNVA

SEQ ID NO: 15219 - protein, 30 aa, Artificial Sequence
  Description of Artificial Sequence: Synthetic polypeptide
DEEEIATTNPVATEQYGSVSTNLDHGNGNN

SEQ ID NO: 15220 - protein, 30 aa, Artificial Sequence
  Description of Artificial Sequence: Synthetic polypeptide
DEHEIRTTNPVATEQYGSTVSQNLFRVENR

SEQ ID NO: 15221 - protein, 31 aa, Artificial Sequence
  Description of Artificial Sequence: Synthetic polypeptide
DEEEIRTTNPVATEQYGVVSSTNLNQQGMNM

SEQ ID NO: 15222 - protein, 31 aa, Artificial Sequence
  Description of Artificial Sequence: Synthetic polypeptide
DEEEIRTTNPVATEAYGSVSCNELSQIGGNR

SEQ ID NO: 15223 - protein, 28 aa, Artificial Sequence
  Description of Artificial Sequence: Synthetic peptide
DEEEIASVNPVATEQYGSVSTALQSGNQ

SEQ ID NO: 15224 - protein, 30 aa, Artificial Sequence
  Description of Artificial Sequence: Synthetic polypeptide
DEEEIRTTNPVATEQYGSVYSTNNLTRVDF

SEQ ID NO: 15225 - protein, 29 aa, Artificial Sequence
  Description of Artificial Sequence: Synthetic peptide
DEAEIATTNPVATEQYGSVSANLQSDNRP

SEQ ID NO: 15226 - protein, 30 aa, Artificial Sequence
  Description of Artificial Sequence: Synthetic polypeptide
DEEEIATTNPVATEQYGSVSTNLDDGNNNN

SEQ ID NO: 15227 - protein, 30 aa, Artificial Sequence
  Description of Artificial Sequence: Synthetic polypeptide
DEEEIATTNPVATEQYGSVSTNLANGSNQE

SEQ ID NO: 15228 - protein, 30 aa, Artificial Sequence
  Description of Artificial Sequence: Synthetic polypeptide
DEAEIATTNPVATEQYGSVSANLQREENRT

SEQ ID NO: 15229 - protein, 30 aa, Artificial Sequence
  Description of Artificial Sequence: Synthetic polypeptide
YEEEISTTNPVATEQYGYSVSTNTQRGARV

SEQ ID NO: 15230 - protein, 29 aa, Artificial Sequence
  Description of Artificial Sequence: Synthetic peptide
DEHEIRTTNPVATEQYGSSSTNTNREGLR

SEQ ID NO: 15231 - protein, 29 aa, Artificial Sequence
  Description of Artificial Sequence: Synthetic peptide
DEHEIRTTNPVATEQYGSSSTNEQREGLD

SEQ ID NO: 15232 - protein, 28 aa, Artificial Sequence
  Description of Artificial Sequence: Synthetic peptide
SQEEIRTTNPVATEQWGCVSTALQEGNR

SEQ ID NO: 15233 - protein, 31 aa, Artificial Sequence
  Description of Artificial Sequence: Synthetic polypeptide
DEDEIRTTNPVATEQYGSVSTNLQGNDGQDR

SEQ ID NO: 15234 - protein, 28 aa, Artificial Sequence
  Description of Artificial Sequence: Synthetic peptide
SQEEIRATNPVATEQWGTVSTNLQVGNR

SEQ ID NO: 15235 - protein, 31 aa, Artificial Sequence
  Description of Artificial Sequence: Synthetic polypeptide
DEAEIRTTNPVATEQYGSVSTQGNDQGGDNR

SEQ ID NO: 15236 - protein, 29 aa, Artificial Sequence
  Description of Artificial Sequence: Synthetic peptide
DEHEIRTTNPVATEQYGSVSPNLFRNMDR

SEQ ID NO: 15237 - protein, 30 aa, Artificial Sequence
  Description of Artificial Sequence: Synthetic polypeptide
DEHEIRTTNPVATEQYGSVSTAIEQGDGNR

SEQ ID NO: 15238 - protein, 28 aa, Artificial Sequence
  Description of Artificial Sequence: Synthetic peptide
DEAEICTTNVVAYNQYGSVSTNLQRGDR

SEQ ID NO: 15239 - protein, 31 aa, Artificial Sequence
  Description of Artificial Sequence: Synthetic polypeptide
DEEEIRTTNPVATEQYGSVSTVNMQGVGNEF

SEQ ID NO: 15240 - protein, 30 aa, Artificial Sequence
  Description of Artificial Sequence: Synthetic polypeptide
DEHEIRTTNPVATEQYGSVSTAGGQDGNQR

SEQ ID NO: 15241 - protein, 28 aa, Artificial Sequence
  Description of Artificial Sequence: Synthetic peptide
DEAEICTVNPVATEQYGSVSTNLINGNA

SEQ ID NO: 15242 - protein, 30 aa, Artificial Sequence
  Description of Artificial Sequence: Synthetic polypeptide
DEEEIRTTNPVATEQYGSVSCTNGGQGGLF

SEQ ID NO: 15243 - protein, 29 aa, Artificial Sequence
  Description of Artificial Sequence: Synthetic peptide
YEEEISTTNPVGTEQYGTVSTNLQYGNNR

SEQ ID NO: 15244 - protein, 29 aa, Artificial Sequence
  Description of Artificial Sequence: Synthetic peptide
DDAEIRTTNPVATEQYGCVSTNLHQNGDR

SEQ ID NO: 15245 - protein, 31 aa, Artificial Sequence
  Description of Artificial Sequence: Synthetic polypeptide
AEEEIRTTNPVATEQYGSVNSTNLQNNGNND

SEQ ID NO: 15246 - protein, 30 aa, Artificial Sequence
  Description of Artificial Sequence: Synthetic polypeptide
DEHEIRTTNPVATEQYGSVSTAGEHQDGNR

SEQ ID NO: 15247 - protein, 29 aa, Artificial Sequence
  Description of Artificial Sequence: Synthetic peptide
DEAEIATTNPVATEQYGSVSTNLQHGGDS

SEQ ID NO: 15248 - protein, 32 aa, Artificial Sequence
  Description of Artificial Sequence: Synthetic polypeptide
DEHEIRTTNPVATEQYGSVSSTNNLQHDGENR

SEQ ID NO: 15249 - protein, 33 aa, Artificial Sequence
  Description of Artificial Sequence: Synthetic polypeptide
DEEEIRTTNPVATEHYGSVPSCTQNLSQRTGNR

SEQ ID NO: 15250 - protein, 31 aa, Artificial Sequence
  Description of Artificial Sequence: Synthetic polypeptide
DEHEIRTTNPVATEQYGSVSSTNLQGEGNNN

SEQ ID NO: 15251 - protein, 31 aa, Artificial Sequence
  Description of Artificial Sequence: Synthetic polypeptide
DEHEIRTTNPVATEQYGSVSSTNLQDGNNNN

SEQ ID NO: 15252 - protein, 31 aa, Artificial Sequence
  Description of Artificial Sequence: Synthetic polypeptide
DEEEIRTTNPVATEQYGSVNSTNDEIRGLRE

SEQ ID NO: 15253 - protein, 31 aa, Artificial Sequence
  Description of Artificial Sequence: Synthetic polypeptide
DEAEIRTTNPVATEQYGSVSTTNGETQRGNA

SEQ ID NO: 15254 - protein, 31 aa, Artificial Sequence
  Description of Artificial Sequence: Synthetic polypeptide
DEAEIRTTNPVATEQYGSVSTTNGDRDGNGR

SEQ ID NO: 15255 - protein, 31 aa, Artificial Sequence
  Description of Artificial Sequence: Synthetic polypeptide
DEHEIRTTNPVATEQYGSVSSTNNPQGDGNR

SEQ ID NO: 15256 - protein, 30 aa, Artificial Sequence
  Description of Artificial Sequence: Synthetic polypeptide
DEHEIRTTNPVATEQYGSVSSNLFRNSNNR

SEQ ID NO: 15257 - protein, 31 aa, Artificial Sequence
  Description of Artificial Sequence: Synthetic polypeptide
DEHEIRTTNPVATEQYGSVSTALQQGDNGER

SEQ ID NO: 15258 - protein, 32 aa, Artificial Sequence
  Description of Artificial Sequence: Synthetic polypeptide
DEAEIRTTNPVATEQYGSVSTTNLEQGSGNER

SEQ ID NO: 15259 - protein, 32 aa, Artificial Sequence
  Description of Artificial Sequence: Synthetic polypeptide
DEHEIRTTNPVATEQYGSVSTGNLQSQGNNDR

SEQ ID NO: 15260 - protein, 31 aa, Artificial Sequence
  Description of Artificial Sequence: Synthetic polypeptide
DEDEIRTTNPVATEQYGSVSTNLQGEDGNEK

SEQ ID NO: 15261 - protein, 30 aa, Artificial Sequence
  Description of Artificial Sequence: Synthetic polypeptide
DEHEIRTTNPVATEQYGSVSTGNLLRNETR

SEQ ID NO: 15262 - protein, 30 aa, Artificial Sequence
  Description of Artificial Sequence: Synthetic polypeptide
DEHEIRTTNPVATEQYGSVSTGNDESSGNR

SEQ ID NO: 15263 - protein, 32 aa, Artificial Sequence
  Description of Artificial Sequence: Synthetic polypeptide
DEHEIRTTNPVATEQYGSVSTGNDEQREGNNR

SEQ ID NO: 15264 - protein, 30 aa, Artificial Sequence
  Description of Artificial Sequence: Synthetic polypeptide
DEEEIRTTNPVATEQYGSVYTENLQRNEQD

SEQ ID NO: 15265 - protein, 31 aa, Artificial Sequence
  Description of Artificial Sequence: Synthetic polypeptide
DEDEIRTTNPVATEQYGSVSTNLQGEGNDQE

SEQ ID NO: 15266 - protein, 29 aa, Artificial Sequence
  Description of Artificial Sequence: Synthetic peptide
DEHEIRTTNPVATEQYGSVSTGLQGDGMA

SEQ ID NO: 15267 - protein, 30 aa, Artificial Sequence
  Description of Artificial Sequence: Synthetic polypeptide
DEHEIRTTNPVATEQYGSVSTAVGGQDGNR

SEQ ID NO: 15268 - protein, 30 aa, Artificial Sequence
  Description of Artificial Sequence: Synthetic polypeptide
DEHEIRTTNPVATEQYGSVSTGLERGENNA

SEQ ID NO: 15269 - protein, 31 aa, Artificial Sequence
  Description of Artificial Sequence: Synthetic polypeptide
DEAEIATTNPVATEQYGSVSTNLQNGDNVRE

SEQ ID NO: 15270 - protein, 29 aa, Artificial Sequence
  Description of Artificial Sequence: Synthetic peptide
DEAEIATTNPVATEQYGSVSTNLQMGDTS

SEQ ID NO: 15271 - protein, 31 aa, Artificial Sequence
  Description of Artificial Sequence: Synthetic polypeptide
AEEEIRTTNPVATEQYGSVNSTNLQRSLDER

SEQ ID NO: 15272 - protein, 31 aa, Artificial Sequence
  Description of Artificial Sequence: Synthetic polypeptide
DEHEIRTTNPVATEQYGSVSTDNLQGGQNNQ

SEQ ID NO: 15273 - protein, 31 aa, Artificial Sequence
  Description of Artificial Sequence: Synthetic polypeptide
DEAEIRTTNPVATEQYGSVSTTNLQNGDNNM

SEQ ID NO: 15274 - protein, 31 aa, Artificial Sequence
  Description of Artificial Sequence: Synthetic polypeptide
DEHEIRTTNPVATEQYGSVSTDNAQDGNGRG

SEQ ID NO: 15275 - protein, 31 aa, Artificial Sequence
  Description of Artificial Sequence: Synthetic polypeptide
DEHEIRTTNPVATEQYGSVSTDNAQDDGNER

SEQ ID NO: 15276 - protein, 31 aa, Artificial Sequence
  Description of Artificial Sequence: Synthetic polypeptide
AEEEIRTTNPVATEQYGSVNSTNLQQNDGNI

SEQ ID NO: 15277 - protein, 30 aa, Artificial Sequence
  Description of Artificial Sequence: Synthetic polypeptide
DEHEIRTTNPVATEQYGSVSTGLDRGGNME

SEQ ID NO: 15278 - protein, 31 aa, Artificial Sequence
  Description of Artificial Sequence: Synthetic polypeptide
DEAEIRTTNPVATEQYGSVSTTNGADQRGNA

SEQ ID NO: 15279 - protein, 30 aa, Artificial Sequence
  Description of Artificial Sequence: Synthetic polypeptide
DEAEIATTNPVATEQYGSVSTNLQGDGNDV

SEQ ID NO: 15280 - protein, 30 aa, Artificial Sequence
  Description of Artificial Sequence: Synthetic polypeptide
DEEEIRTTNPVATEQYGSVYTDILQRVVDR

SEQ ID NO: 15281 - protein, 29 aa, Artificial Sequence
  Description of Artificial Sequence: Synthetic peptide
AEEEIRTTNPVATEQYGSVITNLQFGEMS

SEQ ID NO: 15282 - protein, 29 aa, Artificial Sequence
  Description of Artificial Sequence: Synthetic peptide
DEHEIRTTNPVATEQYGSVSQNLFINNNR

SEQ ID NO: 15283 - protein, 29 aa, Artificial Sequence
  Description of Artificial Sequence: Synthetic peptide
DEHEIRTTNPVATEQYGSVSQNLFGNNNR

SEQ ID NO: 15284 - protein, 31 aa, Artificial Sequence
  Description of Artificial Sequence: Synthetic polypeptide
DEEEIRTTNPVATEQYGSVSNTTLNQGSQNR

SEQ ID NO: 15285 - protein, 30 aa, Artificial Sequence
  Description of Artificial Sequence: Synthetic polypeptide
DEHEIRTTNPVATEQYGSVSQNLERVNMNR

SEQ ID NO: 15286 - protein, 30 aa, Artificial Sequence
  Description of Artificial Sequence: Synthetic polypeptide
DEHEIRTTNPVATEQYGSVSQNLDNRNMNR

SEQ ID NO: 15287 - protein, 30 aa, Artificial Sequence
  Description of Artificial Sequence: Synthetic polypeptide
DEAEIATTNPVATEQYGSVSTNLDQLGNEN

SEQ ID NO: 15288 - protein, 29 aa, Artificial Sequence
  Description of Artificial Sequence: Synthetic peptide
DEHEIRTTNPVATEQYGSVSQNHTRVTNR

SEQ ID NO: 15289 - protein, 32 aa, Artificial Sequence
  Description of Artificial Sequence: Synthetic polypeptide
DEEEIRTTNPVATEQYGSVSCTNELSVRGGNA

SEQ ID NO: 15290 - protein, 29 aa, Artificial Sequence
  Description of Artificial Sequence: Synthetic peptide
DEAEIATTNPVATEQYGSVSTNLDNGDND

SEQ ID NO: 15291 - protein, 30 aa, Artificial Sequence
  Description of Artificial Sequence: Synthetic polypeptide
DEHEIRTTNPVATEQYGSVSQNEHGRVGNR

SEQ ID NO: 15292 - protein, 31 aa, Artificial Sequence
  Description of Artificial Sequence: Synthetic polypeptide
DEAEIRTTNPVATEQYGSVSTQNLQVPGNDQ

SEQ ID NO: 15293 - protein, 29 aa, Artificial Sequence
  Description of Artificial Sequence: Synthetic peptide
YEEEISTTNPVATLQYGSVSANLPQGGNR

SEQ ID NO: 15294 - protein, 30 aa, Artificial Sequence
  Description of Artificial Sequence: Synthetic polypeptide
DEAEIATTNPVATEQYGSVSTNGEQRGNEA

SEQ ID NO: 15295 - protein, 29 aa, Artificial Sequence
  Description of Artificial Sequence: Synthetic peptide
DEAEIATTNPVATEQYGSVSTNAGQDANR

SEQ ID NO: 15296 - protein, 31 aa, Artificial Sequence
  Description of Artificial Sequence: Synthetic polypeptide
DEAEIATTNPVATEQYGSVSTGNGLQRGNDV

SEQ ID NO: 15297 - protein, 29 aa, Artificial Sequence
  Description of Artificial Sequence: Synthetic peptide
DEAEIATTNPVATEQYGSVSTELERGNAQ

SEQ ID NO: 15298 - protein, 31 aa, Artificial Sequence
  Description of Artificial Sequence: Synthetic polypeptide
DEEEIATTNPVATEQYGSVSTNLNGADGDNR

SEQ ID NO: 15299 - protein, 31 aa, Artificial Sequence
  Description of Artificial Sequence: Synthetic polypeptide
DEHEIRTTNPVATEQYGSVSQNELGRPGNNR

SEQ ID NO: 15300 - protein, 29 aa, Artificial Sequence
  Description of Artificial Sequence: Synthetic peptide
DEAEIATTNPVATEQYGSVSTNLGQMGDV

SEQ ID NO: 15301 - protein, 29 aa, Artificial Sequence
  Description of Artificial Sequence: Synthetic peptide
DEHEIRTTNPVATEQYGSVSQNLFREMND

SEQ ID NO: 15302 - protein, 31 aa, Artificial Sequence
  Description of Artificial Sequence: Synthetic polypeptide
DEEEIRTTNPVATEQYGSVSNTTLERMNQER

SEQ ID NO: 15303 - protein, 32 aa, Artificial Sequence
  Description of Artificial Sequence: Synthetic polypeptide
DEEEIRTTNPVATEHYGSVPSYTNLSQRVNNR

SEQ ID NO: 15304 - protein, 30 aa, Artificial Sequence
  Description of Artificial Sequence: Synthetic polypeptide
DEHEIRTTNPVATEQYGSVSQTNLGEDMNR

SEQ ID NO: 15305 - protein, 32 aa, Artificial Sequence
  Description of Artificial Sequence: Synthetic polypeptide
DEAEIRTTNPVATEQYGSVSTTNEDQREGPNR

SEQ ID NO: 15306 - protein, 31 aa, Artificial Sequence
  Description of Artificial Sequence: Synthetic polypeptide
DEEEIATTNPVATEQYGSVSTNLNGDGNNRE

SEQ ID NO: 15307 - protein, 29 aa, Artificial Sequence
  Description of Artificial Sequence: Synthetic peptide
AEEEIRTTNPVATEQYGSVNSSALQLGNS

SEQ ID NO: 15308 - protein, 29 aa, Artificial Sequence
  Description of Artificial Sequence: Synthetic peptide
DEHEIRTTNPVATEQYGSVSQNLTRNMNQ

SEQ ID NO: 15309 - protein, 30 aa, Artificial Sequence
  Description of Artificial Sequence: Synthetic polypeptide
DEHEIRTTNPVATEQYGSVSQNLPERPMNR

SEQ ID NO: 15310 - protein, 30 aa, Artificial Sequence
  Description of Artificial Sequence: Synthetic polypeptide
DEHEIRTTNPVATEQYGSVSQNLMREMNDR

SEQ ID NO: 15311 - protein, 29 aa, Artificial Sequence
  Description of Artificial Sequence: Synthetic peptide
DEHEIRTTNPVATEQYGSVSQNLMDNHNR

SEQ ID NO: 15312 - protein, 31 aa, Artificial Sequence
  Description of Artificial Sequence: Synthetic polypeptide
DEEEIRTTNPVATEAYGSVQSTYLQNGSNRL

SEQ ID NO: 15313 - protein, 29 aa, Artificial Sequence
  Description of Artificial Sequence: Synthetic peptide
DEHEIRTTNPVATEQYGSVSQNLIMEMNR

SEQ ID NO: 15314 - protein, 30 aa, Artificial Sequence
  Description of Artificial Sequence: Synthetic polypeptide
DEAEIATTNPVATEQYGSVSTNLQERGEDQ

SEQ ID NO: 15315 - protein, 29 aa, Artificial Sequence
  Description of Artificial Sequence: Synthetic peptide
DEHEIRTTNPVATEQYGSVSQNLGREMNH

SEQ ID NO: 15316 - protein, 31 aa, Artificial Sequence
  Description of Artificial Sequence: Synthetic polypeptide
DEEEIRTTNPVATEQYGVVSTGNPQRGSNQA

SEQ ID NO: 15317 - protein, 30 aa, Artificial Sequence
  Description of Artificial Sequence: Synthetic polypeptide
DDAEIRTTNPVATEQYGSVSTGNDLQFGDR

SEQ ID NO: 15318 - protein, 29 aa, Artificial Sequence
  Description of Artificial Sequence: Synthetic peptide
DEAEIATTNPVATEQYGSVSTNLQDGDQV

SEQ ID NO: 15319 - protein, 30 aa, Artificial Sequence
  Description of Artificial Sequence: Synthetic polypeptide
DEEEIRTTNPVATEQYGSVSTVNNQANGIN

SEQ ID NO: 15320 - protein, 30 aa, Artificial Sequence
  Description of Artificial Sequence: Synthetic polypeptide
DDAEIRTTNPVATEQYGSVSTNLQNGSNAE

SEQ ID NO: 15321 - protein, 29 aa, Artificial Sequence
  Description of Artificial Sequence: Synthetic peptide
DEHEIRTTNPVATEQYGSVSQNLFRNLNT

SEQ ID NO: 15322 - protein, 31 aa, Artificial Sequence
  Description of Artificial Sequence: Synthetic polypeptide
DEHEIRTTNPVATEQYGSVSTGNPQMDGGNR

SEQ ID NO: 15323 - protein, 32 aa, Artificial Sequence
  Description of Artificial Sequence: Synthetic polypeptide
DEEEIRTTNPVATEQYGSVSNTTLERGNNERN

SEQ ID NO: 15324 - protein, 30 aa, Artificial Sequence
  Description of Artificial Sequence: Synthetic polypeptide
DEEEIRTTNPVATEAYGSVSCTNQSQGGNA

SEQ ID NO: 15325 - protein, 31 aa, Artificial Sequence
  Description of Artificial Sequence: Synthetic polypeptide
DEEEIRTTNPVATEAYGSVSCTNLSQIGNNQ

SEQ ID NO: 15326 - protein, 31 aa, Artificial Sequence
  Description of Artificial Sequence: Synthetic polypeptide
DEEEIRTTNPVATEQYGSVSNVLNLQSSGND

SEQ ID NO: 15327 - protein, 31 aa, Artificial Sequence
  Description of Artificial Sequence: Synthetic polypeptide
DDEEIRSTNPVATEQYGSVSTNLQARNGQER

SEQ ID NO: 15328 - protein, 31 aa, Artificial Sequence
  Description of Artificial Sequence: Synthetic polypeptide
DEEEIRTTNPVATEPWGSVPSTGLSQRGGNR

SEQ ID NO: 15329 - protein, 30 aa, Artificial Sequence
  Description of Artificial Sequence: Synthetic polypeptide
DDEEIRSTNPVATEQYGSVSTNLQNYSGQR

SEQ ID NO: 15330 - protein, 28 aa, Artificial Sequence
  Description of Artificial Sequence: Synthetic peptide
DEEEIATTNPTATEQFGSVSENLQQGTR

SEQ ID NO: 15331 - protein, 32 aa, Artificial Sequence
  Description of Artificial Sequence: Synthetic polypeptide
DEEEIRTTNPVATEAYGSVSTNLSQRPGGTNE

SEQ ID NO: 15332 - protein, 30 aa, Artificial Sequence
  Description of Artificial Sequence: Synthetic polypeptide
DDEEIRSTNPVATEQYGSVSTNLQQDNGQR

SEQ ID NO: 15333 - protein, 30 aa, Artificial Sequence
  Description of Artificial Sequence: Synthetic polypeptide
DEEEIRTTNPVATEQYGSVSMMDLQVGNDD

SEQ ID NO: 15334 - protein, 32 aa, Artificial Sequence
  Description of Artificial Sequence: Synthetic polypeptide
DEEEIRTTNPVATEPWGSVSCTNLSQNRGTNR

SEQ ID NO: 15335 - protein, 29 aa, Artificial Sequence
  Description of Artificial Sequence: Synthetic peptide
DEEEIRTTNPVATEQYGSVSNVLNDNGNG

SEQ ID NO: 15336 - protein, 28 aa, Artificial Sequence
  Description of Artificial Sequence: Synthetic peptide
DEEEIATTNPTATEQYGGVSTNPQVGNA

SEQ ID NO: 15337 - protein, 33 aa, Artificial Sequence
  Description of Artificial Sequence: Synthetic polypeptide
DEEEIRTTNPVATEQYGSVCSTNNLQFSGSNRT

SEQ ID NO: 15338 - protein, 31 aa, Artificial Sequence
  Description of Artificial Sequence: Synthetic polypeptide
DEEEIRTTNPVATEPWGSVSTNLSDQGGNNR

SEQ ID NO: 15339 - protein, 31 aa, Artificial Sequence
  Description of Artificial Sequence: Synthetic polypeptide
DEEEIRTTNPVATEQYGSVPTHNLQRGDQQM

SEQ ID NO: 15340 - protein, 31 aa, Artificial Sequence
  Description of Artificial Sequence: Synthetic polypeptide
DEAEIRTTNPVATEQYGSVSTENLERGGNEG

SEQ ID NO: 15341 - protein, 29 aa, Artificial Sequence
  Description of Artificial Sequence: Synthetic peptide
SSEEIRTTNPVATTQYGSVSTWLQREGNF

SEQ ID NO: 15342 - protein, 30 aa, Artificial Sequence
  Description of Artificial Sequence: Synthetic polypeptide
DEEEIRTTNPVATEQYGVVSVTNELQLSNF

SEQ ID NO: 15343 - protein, 31 aa, Artificial Sequence
  Description of Artificial Sequence: Synthetic polypeptide
DEEEIATTNPTATEQYGSVPTNLQHRGDNGR

SEQ ID NO: 15344 - protein, 32 aa, Artificial Sequence
  Description of Artificial Sequence: Synthetic polypeptide
DEEEIRTTNPVATEPYGASVSTVNLQVRTNNR

SEQ ID NO: 15345 - protein, 32 aa, Artificial Sequence
  Description of Artificial Sequence: Synthetic polypeptide
DEEEIRTTNPVATEAYGSVSTNMLSQRVTNRD

SEQ ID NO: 15346 - protein, 31 aa, Artificial Sequence
  Description of Artificial Sequence: Synthetic polypeptide
DEEEIRTTNPVATEAYGSVSTNLVQGGGGNG

SEQ ID NO: 15347 - protein, 31 aa, Artificial Sequence
  Description of Artificial Sequence: Synthetic polypeptide
DEEEIRTTNPVATEQYGSVSNTNLFFGSNDQ

SEQ ID NO: 15348 - protein, 29 aa, Artificial Sequence
  Description of Artificial Sequence: Synthetic peptide
DEAEIATTNPVATEQYGSVATNEQTRGND

SEQ ID NO: 15349 - protein, 29 aa, Artificial Sequence
  Description of Artificial Sequence: Synthetic peptide
DEAEIRTTNCVAYYQYGSVSTNLQRGDRM

SEQ ID NO: 15350 - protein, 31 aa, Artificial Sequence
  Description of Artificial Sequence: Synthetic polypeptide
DEEEIRTTNPVATEGYGCVSTNLQNFGNFRS

SEQ ID NO: 15351 - protein, 30 aa, Artificial Sequence
  Description of Artificial Sequence: Synthetic polypeptide
DEEEIRTTNPVATEQYGSVSSEDLTQEGND

SEQ ID NO: 15352 - protein, 29 aa, Artificial Sequence
  Description of Artificial Sequence: Synthetic peptide
YEEEISTTNPVATECYSSVSTNVQRGSNR

SEQ ID NO: 15353 - protein, 30 aa, Artificial Sequence
  Description of Artificial Sequence: Synthetic polypeptide
DEAEIRTTNPVATEQYGSVSTGGDQRGNQS

SEQ ID NO: 15354 - protein, 32 aa, Artificial Sequence
  Description of Artificial Sequence: Synthetic polypeptide
DEEEIRTTNPVATEAYGSVSTNLSQRPGGNND

SEQ ID NO: 15355 - protein, 31 aa, Artificial Sequence
  Description of Artificial Sequence: Synthetic polypeptide
DEEEIRTTNPVATEQYGSVSNTYDTQDRGND

SEQ ID NO: 15356 - protein, 30 aa, Artificial Sequence
  Description of Artificial Sequence: Synthetic polypeptide
DDEEIRSTNPVATEQYGSVSTDLQQRNGQR

SEQ ID NO: 15357 - protein, 33 aa, Artificial Sequence
  Description of Artificial Sequence: Synthetic polypeptide
DEEEIRTTNPVATEQYGSVPSVTNELSQHGGNR

SEQ ID NO: 15358 - protein, 31 aa, Artificial Sequence
  Description of Artificial Sequence: Synthetic polypeptide
DEAEIRTTNPVATEQYGSVSTGELQGSGSNR

SEQ ID NO: 15359 - protein, 31 aa, Artificial Sequence
  Description of Artificial Sequence: Synthetic polypeptide
DDEEIRSTNPVATEQYGSVSTNLLQERNGQR

SEQ ID NO: 15360 - protein, 29 aa, Artificial Sequence
  Description of Artificial Sequence: Synthetic peptide
DEAEIATTNPVATEQYGSVATNLERGNSY

SEQ ID NO: 15361 - protein, 29 aa, Artificial Sequence
  Description of Artificial Sequence: Synthetic peptide
DEAEIATTNPVATEQYGSVATNLERGNDA

SEQ ID NO: 15362 - protein, 31 aa, Artificial Sequence
  Description of Artificial Sequence: Synthetic polypeptide
DEEEIRTTNPVATEQYGSVSNTNLIGGGNGD

SEQ ID NO: 15363 - protein, 31 aa, Artificial Sequence
  Description of Artificial Sequence: Synthetic polypeptide
DEEEIRTTNPVATEQYGVVSTVNLQEGNFGI

SEQ ID NO: 15364 - protein, 31 aa, Artificial Sequence
  Description of Artificial Sequence: Synthetic polypeptide
DEEEIRTTNPVATEQYGVVSTVNLQFNNGNV

SEQ ID NO: 15365 - protein, 31 aa, Artificial Sequence
  Description of Artificial Sequence: Synthetic polypeptide
DDEEIRSTNPVATEQYGSVSTNLQAREGQRE

SEQ ID NO: 15366 - protein, 30 aa, Artificial Sequence
  Description of Artificial Sequence: Synthetic polypeptide
DEEEIRTTNPVATEQYGVVSTYDDQFGSNR

SEQ ID NO: 15367 - protein, 32 aa, Artificial Sequence
  Description of Artificial Sequence: Synthetic polypeptide
DEEEIRTTNPVATEQYGSVNSDTNLQPGENGE

SEQ ID NO: 15368 - protein, 30 aa, Artificial Sequence
  Description of Artificial Sequence: Synthetic polypeptide
DEEEIRTTNPVATEQYGSVSNTYLQQQPER

SEQ ID NO: 15369 - protein, 29 aa, Artificial Sequence
  Description of Artificial Sequence: Synthetic peptide
YEEEISTTNPVATCQYGSVSMNLDQGGNR

SEQ ID NO: 15370 - protein, 30 aa, Artificial Sequence
  Description of Artificial Sequence: Synthetic polypeptide
DEEEIRTTNPVATEQYGSVPTDLQTRGEDM

SEQ ID NO: 15371 - protein, 30 aa, Artificial Sequence
  Description of Artificial Sequence: Synthetic polypeptide
DEEEIRTTNPVATEPYGAVCDTNLTRMGNR

SEQ ID NO: 15372 - protein, 30 aa, Artificial Sequence
  Description of Artificial Sequence: Synthetic polypeptide
DEDEIRTTNPVATEQYGSVSTTLNGDGNRQ

SEQ ID NO: 15373 - protein, 31 aa, Artificial Sequence
  Description of Artificial Sequence: Synthetic polypeptide
DEEEIRTTNPVATEQYGVVSVTNLNQLGMNL

SEQ ID NO: 15374 - protein, 30 aa, Artificial Sequence
  Description of Artificial Sequence: Synthetic polypeptide
DEEEIRTTNPVATEQYGSVSMNDLQGGHES

SEQ ID NO: 15375 - protein, 30 aa, Artificial Sequence
  Description of Artificial Sequence: Synthetic polypeptide
DEDEIRTTNPVATEQYGSVSTTNDGDGNRD

SEQ ID NO: 15376 - protein, 29 aa, Artificial Sequence
  Description of Artificial Sequence: Synthetic peptide
STEEIRTTNPVATEQWGTVSTNLQNGTNR

SEQ ID NO: 15377 - protein, 31 aa, Artificial Sequence
  Description of Artificial Sequence: Synthetic polypeptide
DEEEIRTTNPVATEQYGSVYCTDNIQKGGNR

SEQ ID NO: 15378 - protein, 29 aa, Artificial Sequence
  Description of Artificial Sequence: Synthetic peptide
DEGEIRTTNPVATEQYGSVSPTDSQRGDV

SEQ ID NO: 15379 - protein, 30 aa, Artificial Sequence
  Description of Artificial Sequence: Synthetic polypeptide
DEEEIRTTNPVATEQYGVVSWELQRGSQRA

SEQ ID NO: 15380 - protein, 31 aa, Artificial Sequence
  Description of Artificial Sequence: Synthetic polypeptide
DEEEIRTTNPVATEQYGVVSWGNLNRGSNRG

SEQ ID NO: 15381 - protein, 31 aa, Artificial Sequence
  Description of Artificial Sequence: Synthetic polypeptide
DEAEIRTTNPVATEQYGSVSTDNNDQRGERT

SEQ ID NO: 15382 - protein, 29 aa, Artificial Sequence
  Description of Artificial Sequence: Synthetic peptide
DEEEIRTTNPVATEQYGSVPTNDDQDGDS

SEQ ID NO: 15383 - protein, 33 aa, Artificial Sequence
  Description of Artificial Sequence: Synthetic polypeptide
DEEEIRTTNPVATEQYGSVCSTNPLQRFGSNND

SEQ ID NO: 15384 - protein, 30 aa, Artificial Sequence
  Description of Artificial Sequence: Synthetic polypeptide
DEEEIRTTNPVATEQYGSVNNTNNLEMGER

SEQ ID NO: 15385 - protein, 31 aa, Artificial Sequence
  Description of Artificial Sequence: Synthetic polypeptide
DEEEIRTTNPVATEQYGSVYATVLQRGEERN

SEQ ID NO: 15386 - protein, 31 aa, Artificial Sequence
  Description of Artificial Sequence: Synthetic polypeptide
DEEEIRTTNPVATEQYGSVYATNNEQRGNFM

SEQ ID NO: 15387 - protein, 31 aa, Artificial Sequence
  Description of Artificial Sequence: Synthetic polypeptide
DEEEIRTTNPVATEQYGVVSWPNLNRGENQR

SEQ ID NO: 15388 - protein, 31 aa, Artificial Sequence
  Description of Artificial Sequence: Synthetic polypeptide
DEAEIRTTNPVATEQYGSVSTDNHQGSGNRK

SEQ ID NO: 15389 - protein, 28 aa, Artificial Sequence
  Description of Artificial Sequence: Synthetic peptide
YEEEISTTNPVAHEQYGSVDTDLERGNR

SEQ ID NO: 15390 - protein, 30 aa, Artificial Sequence
  Description of Artificial Sequence: Synthetic polypeptide
DEEEIRTTNPVATEQYGVVSYELQRGSERL

SEQ ID NO: 15391 - protein, 30 aa, Artificial Sequence
  Description of Artificial Sequence: Synthetic polypeptide
DEEEIRTTNPVATEQYGSVWTVLPDRGDNQ

SEQ ID NO: 15392 - protein, 30 aa, Artificial Sequence
  Description of Artificial Sequence: Synthetic polypeptide
DEEEIRTTNPVATEQYGVVSYTGLNRGGNT

SEQ ID NO: 15393 - protein, 32 aa, Artificial Sequence
  Description of Artificial Sequence: Synthetic polypeptide
DEEEIRTTNPVATEPYGCVSYTNLQRTGGNNR

SEQ ID NO: 15394 - protein, 32 aa, Artificial Sequence
  Description of Artificial Sequence: Synthetic polypeptide
DEEEIRTTNPVATEPYGESVSTVNLQDGHKNR

SEQ ID NO: 15395 - protein, 29 aa, Artificial Sequence
  Description of Artificial Sequence: Synthetic peptide
DEGEIRTTNPVATEQYGSVQTTLEIRMNR

SEQ ID NO: 15396 - protein, 30 aa, Artificial Sequence
  Description of Artificial Sequence: Synthetic polypeptide
DEGEIRTTNPVATEQYGSVSTDDQRDNQRD

SEQ ID NO: 15397 - protein, 31 aa, Artificial Sequence
  Description of Artificial Sequence: Synthetic polypeptide
DEEEIRTTNPVATEQYGSVPSTTLQTGELRM

SEQ ID NO: 15398 - protein, 30 aa, Artificial Sequence
  Description of Artificial Sequence: Synthetic polypeptide
DEEEIRTTNPVATEQYGSVPTLLQRVGVTQ

SEQ ID NO: 15399 - protein, 31 aa, Artificial Sequence
  Description of Artificial Sequence: Synthetic polypeptide
DEEEIRTTNPVATEQYGSVSMNDLQNTGNQQ

SEQ ID NO: 15400 - protein, 28 aa, Artificial Sequence
  Description of Artificial Sequence: Synthetic peptide
STEEIRCTNPIATEQYGSVSENLMRGNR

SEQ ID NO: 15401 - protein, 30 aa, Artificial Sequence
  Description of Artificial Sequence: Synthetic polypeptide
DEEEIRTTNPVATEQYGSVSMNDLQNGSDM

SEQ ID NO: 15402 - protein, 30 aa, Artificial Sequence
  Description of Artificial Sequence: Synthetic polypeptide
DEEEIRTTNPVATEQYGSVSMNDLQNSGDD

SEQ ID NO: 15403 - protein, 32 aa, Artificial Sequence
  Description of Artificial Sequence: Synthetic polypeptide
DEEEIRTTNPVATEQYGSVYEPTNLEQRQGNL

SEQ ID NO: 15404 - protein, 28 aa, Artificial Sequence
  Description of Artificial Sequence: Synthetic peptide
STEEIRTTNPVATAQYGSVSTDLQHGNF

SEQ ID NO: 15405 - protein, 33 aa, Artificial Sequence
  Description of Artificial Sequence: Synthetic polypeptide
DEEEIRTTNPVATEQYGSVCSTNNLQRSGEERI

SEQ ID NO: 15406 - protein, 29 aa, Artificial Sequence
  Description of Artificial Sequence: Synthetic peptide
DEGEIRTTNPVATEQYGSVSTNDQMGEDE

SEQ ID NO: 15407 - protein, 31 aa, Artificial Sequence
  Description of Artificial Sequence: Synthetic polypeptide
DEEEIRTTNPVATEQYGSVSNWNLQFFGNQG

SEQ ID NO: 15408 - protein, 28 aa, Artificial Sequence
  Description of Artificial Sequence: Synthetic peptide
DEAEIRTTNPVATEQYGSVSTEMEGGER

SEQ ID NO: 15409 - protein, 31 aa, Artificial Sequence
  Description of Artificial Sequence: Synthetic polypeptide
DEDEIRTTNPVATEQYGSVSTTLQGDGENRQ

SEQ ID NO: 15410 - protein, 30 aa, Artificial Sequence
  Description of Artificial Sequence: Synthetic polypeptide
DEAEIRTTNPVATEQYGSVSTELQYGSNAA

SEQ ID NO: 15411 - protein, 31 aa, Artificial Sequence
  Description of Artificial Sequence: Synthetic polypeptide
DEEEIRTTNPVATEGYGCVCSTNLDQRGSNQ

SEQ ID NO: 15412 - protein, 32 aa, Artificial Sequence
  Description of Artificial Sequence: Synthetic polypeptide
DEEEIRTTNPVATEQYGSVSNWNLQRFGSNTQ

SEQ ID NO: 15413 - protein, 30 aa, Artificial Sequence
  Description of Artificial Sequence: Synthetic polypeptide
DEEEIRTTNPVATEQYGVVSVVNLNIGENR

SEQ ID NO: 15414 - protein, 32 aa, Artificial Sequence
  Description of Artificial Sequence: Synthetic polypeptide
DEEEIRTTNPVATEPYGCSVSTVNLQDRIPNR

SEQ ID NO: 15415 - protein, 30 aa, Artificial Sequence
  Description of Artificial Sequence: Synthetic polypeptide
DEGEIRTTNPVATEQYGSVSTLLEQGGNEE

SEQ ID NO: 15416 - protein, 29 aa, Artificial Sequence
  Description of Artificial Sequence: Synthetic peptide
STEEIRTTNPVATDQYGSVSTELQRGNNA

SEQ ID NO: 15417 - protein, 28 aa, Artificial Sequence
  Description of Artificial Sequence: Synthetic peptide
STEEIRTTNPVATDQYGSVSTPLQSGNL

SEQ ID NO: 15418 - protein, 29 aa, Artificial Sequence
  Description of Artificial Sequence: Synthetic peptide
STEEIRTTNPVATDQYGSVSTQLQRGENA

SEQ ID NO: 15419 - protein, 28 aa, Artificial Sequence
  Description of Artificial Sequence: Synthetic peptide
STEEIRTTNPVATDQYGSVSTRGQRGNF

SEQ ID NO: 15420 - protein, 30 aa, Artificial Sequence
  Description of Artificial Sequence: Synthetic polypeptide
DEEEIRTTNPVATEQYGSVNPTNDQLGNEM

SEQ ID NO: 15421 - protein, 29 aa, Artificial Sequence
  Description of Artificial Sequence: Synthetic peptide
DEGEIRTTNPVATEQYGSVSTDIQRDGDS

SEQ ID NO: 15422 - protein, 32 aa, Artificial Sequence
  Description of Artificial Sequence: Synthetic polypeptide
DEEEIRTTNPVATEQYGVVTISTNELQGGTNR

SEQ ID NO: 15423 - protein, 32 aa, Artificial Sequence
  Description of Artificial Sequence: Synthetic polypeptide
DEEEIRTTNPVATEAYGSVSTNLSQNHPGNRN

SEQ ID NO: 15424 - protein, 31 aa, Artificial Sequence
  Description of Artificial Sequence: Synthetic polypeptide
DEAEIRTTNPVATEQYGSVSTGNLEDRGENH

SEQ ID NO: 15425 - protein, 29 aa, Artificial Sequence
  Description of Artificial Sequence: Synthetic peptide
DEGEIRTTNPVATTQYGCVSTNLEGRGNP

SEQ ID NO: 15426 - protein, 29 aa, Artificial Sequence
  Description of Artificial Sequence: Synthetic peptide
SSEEIRTTNPVATHQYGSVSTGLQRGNDF

SEQ ID NO: 15427 - protein, 29 aa, Artificial Sequence
  Description of Artificial Sequence: Synthetic peptide
SSEEIRTTNPVATHQYGSVSTHLQRGNNQ

SEQ ID NO: 15428 - protein, 28 aa, Artificial Sequence
  Description of Artificial Sequence: Synthetic peptide
YEEEISTTNPVATEQYGAVMSNLQRGER

SEQ ID NO: 15429 - protein, 29 aa, Artificial Sequence
  Description of Artificial Sequence: Synthetic peptide
SSEEIRTTNPVATHQYGSVSTHLQRGTND

SEQ ID NO: 15430 - protein, 29 aa, Artificial Sequence
  Description of Artificial Sequence: Synthetic peptide
YEEEISTTNPVATEQYGAVMANLQRGVNR

SEQ ID NO: 15431 - protein, 29 aa, Artificial Sequence
  Description of Artificial Sequence: Synthetic peptide
SSEEIRTTNPVATHQYGSVSTLLQRGNFE

SEQ ID NO: 15432 - protein, 29 aa, Artificial Sequence
  Description of Artificial Sequence: Synthetic peptide
DEGEIRTTNPVATGHYGSVSTDNLQRTND

SEQ ID NO: 15433 - protein, 32 aa, Artificial Sequence
  Description of Artificial Sequence: Synthetic polypeptide
DEEEIRTTNPVATEQYGSVSMINLEQRGVNLV

SEQ ID NO: 15434 - protein, 32 aa, Artificial Sequence
  Description of Artificial Sequence: Synthetic polypeptide
DEEEIRTTNPVATEQYGSVCSTNMLQRSGESD

SEQ ID NO: 15435 - protein, 29 aa, Artificial Sequence
  Description of Artificial Sequence: Synthetic peptide
SSEEIRTTNPVATHQYGSVSTMLQRGENF

SEQ ID NO: 15436 - protein, 30 aa, Artificial Sequence
  Description of Artificial Sequence: Synthetic polypeptide
AEEEIRTTNPVATEQYGCVCSTNLQRNNFS

SEQ ID NO: 15437 - protein, 29 aa, Artificial Sequence
  Description of Artificial Sequence: Synthetic peptide
YEEEISTTNPVATEQYGAVDVANLQRGNR

SEQ ID NO: 15438 - protein, 30 aa, Artificial Sequence
  Description of Artificial Sequence: Synthetic polypeptide
DEEEIRTTNPVATEQYGSVSTWDLEREDFR

SEQ ID NO: 15439 - protein, 31 aa, Artificial Sequence
  Description of Artificial Sequence: Synthetic polypeptide
AEEEIRTTNPVATEQYGCVCSTNLQRFGNDL

SEQ ID NO: 15440 - protein, 31 aa, Artificial Sequence
  Description of Artificial Sequence: Synthetic polypeptide
DEEEIRTTNPVATEQYGVVSTSTLQRGINES

SEQ ID NO: 15441 - protein, 30 aa, Artificial Sequence
  Description of Artificial Sequence: Synthetic polypeptide
DEEEIRTTNPVATEQYGSVYNTSLQRLNDQ

SEQ ID NO: 15442 - protein, 30 aa, Artificial Sequence
  Description of Artificial Sequence: Synthetic polypeptide
DEGEIRTTNPVATEQYGSVYTDLQRGNEDM

SEQ ID NO: 15443 - protein, 29 aa, Artificial Sequence
  Description of Artificial Sequence: Synthetic peptide
DEEEIRTTNPVATEQYGSVYNTNMNGGNM

SEQ ID NO: 15444 - protein, 30 aa, Artificial Sequence
  Description of Artificial Sequence: Synthetic polypeptide
DEEEIATTNPIATEQYGSVPTNDQHRGNGR

SEQ ID NO: 15445 - protein, 30 aa, Artificial Sequence
  Description of Artificial Sequence: Synthetic polypeptide
DEEEIRTTNPVATEQYGSVSSEPALNRGNV

SEQ ID NO: 15446 - protein, 30 aa, Artificial Sequence
  Description of Artificial Sequence: Synthetic polypeptide
DEAEIATTNPVATEQYGSVATNLQRDGNHN

SEQ ID NO: 15447 - protein, 31 aa, Artificial Sequence
  Description of Artificial Sequence: Synthetic polypeptide
DEAEIATTNPVATEQYGSVATNLQRDGNTRM

SEQ ID NO: 15448 - protein, 29 aa, Artificial Sequence
  Description of Artificial Sequence: Synthetic peptide
DEAEIATTNPVATEQYGSVATNLQRDNDD

SEQ ID NO: 15449 - protein, 31 aa, Artificial Sequence
  Description of Artificial Sequence: Synthetic polypeptide
YEEEISTTNPVATEQYGESVNLDTNLQRGNR

SEQ ID NO: 15450 - protein, 31 aa, Artificial Sequence
  Description of Artificial Sequence: Synthetic polypeptide
DEEEIRTTNPVATEQYGSVSTVVLSQRGEDN

SEQ ID NO: 15451 - protein, 29 aa, Artificial Sequence
  Description of Artificial Sequence: Synthetic peptide
DDEEIRCTNPVATEQYGSVVSTNLQNGQQ

SEQ ID NO: 15452 - protein, 30 aa, Artificial Sequence
  Description of Artificial Sequence: Synthetic polypeptide
DEEEIRTTNPVATEQYGSVYPNLEQGGNVE

SEQ ID NO: 15453 - protein, 29 aa, Artificial Sequence
  Description of Artificial Sequence: Synthetic peptide
DEAEIATTNPVATEQYGSVATNLQRSNHE

SEQ ID NO: 15454 - protein, 32 aa, Artificial Sequence
  Description of Artificial Sequence: Synthetic polypeptide
DEEEIRTTNPVATEQYGSVPSTNLQHFGSNQS

SEQ ID NO: 15455 - protein, 30 aa, Artificial Sequence
  Description of Artificial Sequence: Synthetic polypeptide
DEEEIRTTNPVATEQYGSVSTVVQHGEERD

SEQ ID NO: 15456 - protein, 29 aa, Artificial Sequence
  Description of Artificial Sequence: Synthetic peptide
YEEEISTTNPVATEQYGCVSTVLFRGNRD

SEQ ID NO: 15457 - protein, 29 aa, Artificial Sequence
  Description of Artificial Sequence: Synthetic peptide
DEEEIRTTNPVATEQYGSVYPENLERDSR

SEQ ID NO: 15458 - protein, 30 aa, Artificial Sequence
  Description of Artificial Sequence: Synthetic polypeptide
DEGEIRTTNPVAYEQYGSVATNLQRGDNDN

SEQ ID NO: 15459 - protein, 29 aa, Artificial Sequence
  Description of Artificial Sequence: Synthetic peptide
DEEEIRTTNPVATEQYGSVSTVVQLGEMG

SEQ ID NO: 15460 - protein, 29 aa, Artificial Sequence
  Description of Artificial Sequence: Synthetic peptide
YEEEISTTNPVATEQYGAVYMVNLQRGNR

SEQ ID NO: 15461 - protein, 32 aa, Artificial Sequence
  Description of Artificial Sequence: Synthetic polypeptide
DEGEIRTTNPVAYEQYGSTVPSTNLSQRGTNR

SEQ ID NO: 15462 - protein, 31 aa, Artificial Sequence
  Description of Artificial Sequence: Synthetic polypeptide
DDEEIRGTNPVATEQYGSVSTNLDQARNGQR

SEQ ID NO: 15463 - protein, 28 aa, Artificial Sequence
  Description of Artificial Sequence: Synthetic peptide
DDEEIRSTNPVATEQYGASSTNQQRGNN

SEQ ID NO: 15464 - protein, 28 aa, Artificial Sequence
  Description of Artificial Sequence: Synthetic peptide
DEGEIRTTNPVAYEQYGSCSTNLEAMNR

SEQ ID NO: 15465 - protein, 30 aa, Artificial Sequence
  Description of Artificial Sequence: Synthetic polypeptide
DEEEIATTNPVATEQYGSVSGNGQGGNGRD

SEQ ID NO: 15466 - protein, 31 aa, Artificial Sequence
  Description of Artificial Sequence: Synthetic polypeptide
DEEEIRTTNPVATEQYGSVCSTNLVRVANEE

SEQ ID NO: 15467 - protein, 31 aa, Artificial Sequence
  Description of Artificial Sequence: Synthetic polypeptide
DEEEIRTTNPVATEQYGSVSNTWLQSGENDS

SEQ ID NO: 15468 - protein, 28 aa, Artificial Sequence
  Description of Artificial Sequence: Synthetic peptide
SSEEIRTTNPVATHQYGSVSTGLQPGNF

SEQ ID NO: 15469 - protein, 28 aa, Artificial Sequence
  Description of Artificial Sequence: Synthetic peptide
DEGEIRTTNPVAYEAYGSVSNNLQRGTW

SEQ ID NO: 15470 - protein, 31 aa, Artificial Sequence
  Description of Artificial Sequence: Synthetic polypeptide
YEEEISTTNPVATEQWYGVSVSTNLEQRGTR

SEQ ID NO: 15471 - protein, 32 aa, Artificial Sequence
  Description of Artificial Sequence: Synthetic polypeptide
DEEEIRTTNPVATEQYGSVSCTGNELHRGGNP

SEQ ID NO: 15472 - protein, 28 aa, Artificial Sequence
  Description of Artificial Sequence: Synthetic peptide
DDEEIRSTNPVATEQYGMSSTNEQRGNN

SEQ ID NO: 15473 - protein, 29 aa, Artificial Sequence
  Description of Artificial Sequence: Synthetic peptide
SSEEIRTTNPVATHQYGSVSTTALQRGND

SEQ ID NO: 15474 - protein, 31 aa, Artificial Sequence
  Description of Artificial Sequence: Synthetic polypeptide
DEEEIATTNPMATEQYGSVCPTNLQERGNNR

SEQ ID NO: 15475 - protein, 33 aa, Artificial Sequence
  Description of Artificial Sequence: Synthetic polypeptide
DEEEIRTTNPVATEQYGSVSCTENLSQMGGNNR

SEQ ID NO: 15476 - protein, 31 aa, Artificial Sequence
  Description of Artificial Sequence: Synthetic polypeptide
YEEEISTTNPVATEGQYGSVSETNLQGGNER

SEQ ID NO: 15477 - protein, 30 aa, Artificial Sequence
  Description of Artificial Sequence: Synthetic polypeptide
DDEEIRSTNPVATEQYGSVISTNMQRGNIN

SEQ ID NO: 15478 - protein, 32 aa, Artificial Sequence
  Description of Artificial Sequence: Synthetic polypeptide
DEEEIRTTNPVATEQYGSVPSTPNLQRGVFEI

SEQ ID NO: 15479 - protein, 32 aa, Artificial Sequence
  Description of Artificial Sequence: Synthetic polypeptide
DEEEIATTNPVATEQYGSVSCTGNLSQRGNDY

SEQ ID NO: 15480 - protein, 31 aa, Artificial Sequence
  Description of Artificial Sequence: Synthetic polypeptide
DEEEIRTTNPVATEQYGSVNSENSLDDRGER

SEQ ID NO: 15481 - protein, 30 aa, Artificial Sequence
  Description of Artificial Sequence: Synthetic polypeptide
DDEEIRSTNPVATEQYGSVSGTNMEQRGNN

SEQ ID NO: 15482 - protein, 33 aa, Artificial Sequence
  Description of Artificial Sequence: Synthetic polypeptide
DEEEIATTNPVATEQYGSVSCTGNLSQRGGNPR

SEQ ID NO: 15483 - protein, 29 aa, Artificial Sequence
  Description of Artificial Sequence: Synthetic peptide
DEEEIRTTNPVATEQYGSVSSELQNGSVQ

SEQ ID NO: 15484 - protein, 32 aa, Artificial Sequence
  Description of Artificial Sequence: Synthetic polypeptide
DEEEIATTNPVATEQYGSVSCTGNELSQSGNR

SEQ ID NO: 15485 - protein, 32 aa, Artificial Sequence
  Description of Artificial Sequence: Synthetic polypeptide
DEEEIRTTNPVATEQYGSVSNTNLIQRGVVEF

SEQ ID NO: 15486 - protein, 31 aa, Artificial Sequence
  Description of Artificial Sequence: Synthetic polypeptide
DEEEIRTTNPVATEQYGSVYLTNDIQADGNR

SEQ ID NO: 15487 - protein, 28 aa, Artificial Sequence
  Description of Artificial Sequence: Synthetic peptide
SSEEIRTTNPVATHQYGSVSTWLQHGNK

SEQ ID NO: 15488 - protein, 30 aa, Artificial Sequence
  Description of Artificial Sequence: Synthetic polypeptide
DEEEIRTTNPVATEGYGCVSTNLQNGSNQA

SEQ ID NO: 15489 - protein, 30 aa, Artificial Sequence
  Description of Artificial Sequence: Synthetic polypeptide
YEEEISTTNPVATEEYGSVNSTMNLQHGNR

SEQ ID NO: 15490 - protein, 29 aa, Artificial Sequence
  Description of Artificial Sequence: Synthetic peptide
DEAEIATTNPVATEQYGSVATNLEVRGND

SEQ ID NO: 15491 - protein, 31 aa, Artificial Sequence
  Description of Artificial Sequence: Synthetic polypeptide
DEEEIATTNPMATEQYGSVPTNLQERFGNGR

SEQ ID NO: 15492 - protein, 30 aa, Artificial Sequence
  Description of Artificial Sequence: Synthetic polypeptide
DDEEIRSTNPVATEQYGSVSSTNGQRGNDN

SEQ ID NO: 15493 - protein, 29 aa, Artificial Sequence
  Description of Artificial Sequence: Synthetic peptide
SSEEIRTTNPVATHQYGSVSTWLQRGNEG

SEQ ID NO: 15494 - protein, 30 aa, Artificial Sequence
  Description of Artificial Sequence: Synthetic polypeptide
DDEEIRSTNPVATEQYGSVSSTNMDQRGNI

SEQ ID NO: 15495 - protein, 30 aa, Artificial Sequence
  Description of Artificial Sequence: Synthetic polypeptide
DEDEIRTTNPVATEQYGSVSTTDLQERGEG

SEQ ID NO: 15496 - protein, 30 aa, Artificial Sequence
  Description of Artificial Sequence: Synthetic polypeptide
DEEEIATTNPMATEQYGSVPTNLQHRGNGT

SEQ ID NO: 15497 - protein, 29 aa, Artificial Sequence
  Description of Artificial Sequence: Synthetic peptide
DEGEIRTTNPVATEQYGSVTTWLIRMNRD

SEQ ID NO: 15498 - protein, 28 aa, Artificial Sequence
  Description of Artificial Sequence: Synthetic peptide
DDEEIRSTNPVATEQYGSSSTNMERGNV

SEQ ID NO: 15499 - protein, 31 aa, Artificial Sequence
  Description of Artificial Sequence: Synthetic polypeptide
DEEEIRTTNPVATEQYGVVSTTNLNQDGGNQ

SEQ ID NO: 15500 - protein, 31 aa, Artificial Sequence
  Description of Artificial Sequence: Synthetic polypeptide
DEEEIRTTNPVATEQYGVVSTTNLQDGNFGQ

SEQ ID NO: 15501 - protein, 29 aa, Artificial Sequence
  Description of Artificial Sequence: Synthetic peptide
DEGEIRTTNPVATEQYGSVVTAELIRVNR

SEQ ID NO: 15502 - protein, 30 aa, Artificial Sequence
  Description of Artificial Sequence: Synthetic polypeptide
YEEEISTTNPVATEPYGYSVSSTNLQRGNS

SEQ ID NO: 15503 - protein, 29 aa, Artificial Sequence
  Description of Artificial Sequence: Synthetic peptide
YEEEISTTNPVATEPYGSVSMNLQQGGNR

SEQ ID NO: 15504 - protein, 29 aa, Artificial Sequence
  Description of Artificial Sequence: Synthetic peptide
SSEEIRTTNPVATHQYGSVSTVLGQRGNF

SEQ ID NO: 15505 - protein, 31 aa, Artificial Sequence
  Description of Artificial Sequence: Synthetic polypeptide
DEEEIRTTNPVATEQYGSVYMTNFIQYDGNR

SEQ ID NO: 15506 - protein, 32 aa, Artificial Sequence
  Description of Artificial Sequence: Synthetic polypeptide
DEEEIATTNPVATEQYGSVSCTNALQERAGNL

SEQ ID NO: 15507 - protein, 29 aa, Artificial Sequence
  Description of Artificial Sequence: Synthetic peptide
DEAEIRTTNCVAYAQYGSVSTGNLQRGDR

SEQ ID NO: 15508 - protein, 28 aa, Artificial Sequence
  Description of Artificial Sequence: Synthetic peptide
DDEEIRSTNPVATEQYGSASTNMQTGNN

SEQ ID NO: 15509 - protein, 29 aa, Artificial Sequence
  Description of Artificial Sequence: Synthetic peptide
DDEEIRSTNPVATEQYGSCSSTNMQRGNN

SEQ ID NO: 15510 - protein, 31 aa, Artificial Sequence
  Description of Artificial Sequence: Synthetic polypeptide
DEEEIRTTNPVATEQYGSVYMTNCGQADGNR

SEQ ID NO: 15511 - protein, 30 aa, Artificial Sequence
  Description of Artificial Sequence: Synthetic polypeptide
YEEEISTTNPVATEPYGQSVSWTNLVRGNR

SEQ ID NO: 15512 - protein, 32 aa, Artificial Sequence
  Description of Artificial Sequence: Synthetic polypeptide
DEEEIRTTNPVATEQYGSVNSGNLQRGNNNEG

SEQ ID NO: 15513 - protein, 31 aa, Artificial Sequence
  Description of Artificial Sequence: Synthetic polypeptide
DEEEIRTTNPVATEQYGSVNSGNLQFEEGNG

SEQ ID NO: 15514 - protein, 29 aa, Artificial Sequence
  Description of Artificial Sequence: Synthetic peptide
DEAEIATTNPVATEQYGSVATNLQEDGND

SEQ ID NO: 15515 - protein, 31 aa, Artificial Sequence
  Description of Artificial Sequence: Synthetic polypeptide
DEEEIRTTNPVATEQYGSVSCTGLSGIGGNR

SEQ ID NO: 15516 - protein, 28 aa, Artificial Sequence
  Description of Artificial Sequence: Synthetic peptide
DDEEIRSTNPVATEQYGSSSTNDQSGNN

SEQ ID NO: 15517 - protein, 30 aa, Artificial Sequence
  Description of Artificial Sequence: Synthetic polypeptide
YEEEISTTNPVATEIYGSVNQDTNLQRGNR

SEQ ID NO: 15518 - protein, 28 aa, Artificial Sequence
  Description of Artificial Sequence: Synthetic peptide
DDEEIRSTNPVATEQYGSSSTNEQRGEN

SEQ ID NO: 15519 - protein, 31 aa, Artificial Sequence
  Description of Artificial Sequence: Synthetic polypeptide
DEEEIRTTNPVATEQYGSVPSTNSIQQAGNQ

SEQ ID NO: 15520 - protein, 28 aa, Artificial Sequence
  Description of Artificial Sequence: Synthetic peptide
DDEEIRSTNPVATEQYGSSSTNPQHGNQ

SEQ ID NO: 15521 - protein, 31 aa, Artificial Sequence
  Description of Artificial Sequence: Synthetic polypeptide
DEEEIRTTNPVATEQYGVVTISTNELQMGNM

SEQ ID NO: 15522 - protein, 30 aa, Artificial Sequence
  Description of Artificial Sequence: Synthetic polypeptide
DEEEIRTTNPVATEQYGSVWTSLEQRDDQR

SEQ ID NO: 15523 - protein, 32 aa, Artificial Sequence
  Description of Artificial Sequence: Synthetic polypeptide
DEEEIRTTNPVATEQYGVVTSTNLQRFGSNPQ

SEQ ID NO: 15524 - protein, 28 aa, Artificial Sequence
  Description of Artificial Sequence: Synthetic peptide
DEGEIRTTNCVAYCQYGEVSTNLQRGDR

SEQ ID NO: 15525 - protein, 31 aa, Artificial Sequence
  Description of Artificial Sequence: Synthetic polypeptide
DEEEIATTNPVATEQYGSVISTNPIQENGNR

SEQ ID NO: 15526 - protein, 30 aa, Artificial Sequence
  Description of Artificial Sequence: Synthetic polypeptide
YEEEISTCNPVATEQYGSVSTGNLQMYGNR

SEQ ID NO: 15527 - protein, 30 aa, Artificial Sequence
  Description of Artificial Sequence: Synthetic polypeptide
YEEEISTCNPVATEQYGSVSETHNLQYGNR

SEQ ID NO: 15528 - protein, 33 aa, Artificial Sequence
  Description of Artificial Sequence: Synthetic polypeptide
DEEEIRTTNPVATEAYGSVSVTNELSQRGGNRA

SEQ ID NO: 15529 - protein, 30 aa, Artificial Sequence
  Description of Artificial Sequence: Synthetic polypeptide
DEEEIRTTNPVATEQYGYIISTNDGQRGNG

SEQ ID NO: 15530 - protein, 32 aa, Artificial Sequence
  Description of Artificial Sequence: Synthetic polypeptide
DEEEIRTTNPVATEPYGISVSTGNLQDRSQNR

SEQ ID NO: 15531 - protein, 31 aa, Artificial Sequence
  Description of Artificial Sequence: Synthetic polypeptide
DEEEIATTNPVATEQYGSVDSTENHQRGSND

SEQ ID NO: 15532 - protein, 31 aa, Artificial Sequence
  Description of Artificial Sequence: Synthetic polypeptide
DEEEIRTTNPVATEQYGSVCSTPLQYLSNRG

SEQ ID NO: 15533 - protein, 31 aa, Artificial Sequence
  Description of Artificial Sequence: Synthetic polypeptide
DEEEIRTTNPVATEQYGSVCSTPLQRFLNQS

SEQ ID NO: 15534 - protein, 32 aa, Artificial Sequence
  Description of Artificial Sequence: Synthetic polypeptide
DEEEIRTTNPVATEQYGSVSMNLQQRSINERN

SEQ ID NO: 15535 - protein, 32 aa, Artificial Sequence
  Description of Artificial Sequence: Synthetic polypeptide
DEEEIRTTNPVATEPYGISVSTGNLQNRVTNR

SEQ ID NO: 15536 - protein, 28 aa, Artificial Sequence
  Description of Artificial Sequence: Synthetic peptide
TEEAIRTTNPVATEQYGSVSTNLSHLNV

SEQ ID NO: 15537 - protein, 29 aa, Artificial Sequence
  Description of Artificial Sequence: Synthetic peptide
DEAEIRTTNPVATEQYGSVSQNLDENMNR

SEQ ID NO: 15538 - protein, 30 aa, Artificial Sequence
  Description of Artificial Sequence: Synthetic polypeptide
AEEEIRTTNPVATEPYGSVVSTNQQRGEER

SEQ ID NO: 15539 - protein, 31 aa, Artificial Sequence
  Description of Artificial Sequence: Synthetic polypeptide
DEEEIRTTNPVATEQYGSVSCTDGDRIGLNR

SEQ ID NO: 15540 - protein, 30 aa, Artificial Sequence
  Description of Artificial Sequence: Synthetic polypeptide
DEEEIRTTNPVATEQYGSVCSTPPQNGGNQ

SEQ ID NO: 15541 - protein, 29 aa, Artificial Sequence
  Description of Artificial Sequence: Synthetic peptide
YEEEISPTNPVATEQYGSIVSTNLVRGNA

SEQ ID NO: 15542 - protein, 28 aa, Artificial Sequence
  Description of Artificial Sequence: Synthetic peptide
DEGEICTVNPVATEQYGSVSTNLEEGNE

SEQ ID NO: 15543 - protein, 28 aa, Artificial Sequence
  Description of Artificial Sequence: Synthetic peptide
DEGEICTVNPVATEQYGSVSTNLAEGNH

SEQ ID NO: 15544 - protein, 31 aa, Artificial Sequence
  Description of Artificial Sequence: Synthetic polypeptide
YEEEISSTNPVATEQYGSVVSETNLQGRGNR

SEQ ID NO: 15545 - protein, 30 aa, Artificial Sequence
  Description of Artificial Sequence: Synthetic polypeptide
DEGEIRTTNPCATEQYGIVSSTNLPQRGTR

SEQ ID NO: 15546 - protein, 32 aa, Artificial Sequence
  Description of Artificial Sequence: Synthetic polypeptide
DEEEIRTTNPVATEQYGSVSMNLQPRIGMPRM

SEQ ID NO: 15547 - protein, 30 aa, Artificial Sequence
  Description of Artificial Sequence: Synthetic polypeptide
DEEEIRTTNPVATEQYGSVSQTSSQRGIEL

SEQ ID NO: 15548 - protein, 31 aa, Artificial Sequence
  Description of Artificial Sequence: Synthetic polypeptide
DEEEIRTTNPVATEQYGSVCSTPDQRISNRV

SEQ ID NO: 15549 - protein, 28 aa, Artificial Sequence
  Description of Artificial Sequence: Synthetic peptide
DEGEIRTTNPVATEQWGVVSTPLQRPND

SEQ ID NO: 15550 - protein, 29 aa, Artificial Sequence
  Description of Artificial Sequence: Synthetic peptide
DEGEIRTTNPVATEQWGSVSENLQAGNED

SEQ ID NO: 15551 - protein, 30 aa, Artificial Sequence
  Description of Artificial Sequence: Synthetic polypeptide
YEEEISTCNPVATEQYGSVSTNNDLQYGNR

SEQ ID NO: 15552 - protein, 32 aa, Artificial Sequence
  Description of Artificial Sequence: Synthetic polypeptide
DEEEIRTTNPVATEQYGSVSTWNLTNVSGNER

SEQ ID NO: 15553 - protein, 33 aa, Artificial Sequence
  Description of Artificial Sequence: Synthetic polypeptide
DEEEIRTTNPVATEQYGSVSQTTNLQRGVNLVP

SEQ ID NO: 15554 - protein, 30 aa, Artificial Sequence
  Description of Artificial Sequence: Synthetic polypeptide
DEEEIRTTNPVATEQYGSVSCTDLQRNDQD

SEQ ID NO: 15555 - protein, 28 aa, Artificial Sequence
  Description of Artificial Sequence: Synthetic peptide
DEGEIRTTNPVATEPYGETSTNLQRGDS

SEQ ID NO: 15556 - protein, 31 aa, Artificial Sequence
  Description of Artificial Sequence: Synthetic polypeptide
DEEEIRTTNPVATEQYGSVCSTPHQRFQNRI

SEQ ID NO: 15557 - protein, 30 aa, Artificial Sequence
  Description of Artificial Sequence: Synthetic polypeptide
DEEEIRTTNPVATEQYGSVSMNLQNVNEIV

SEQ ID NO: 15558 - protein, 31 aa, Artificial Sequence
  Description of Artificial Sequence: Synthetic polypeptide
DEAEIRTTNPVATEQYGSVSSNLGQQGGNDR

SEQ ID NO: 15559 - protein, 31 aa, Artificial Sequence
  Description of Artificial Sequence: Synthetic polypeptide
DEEEIRTTNPVATEQYGYATTSTPELQRGNR

SEQ ID NO: 15560 - protein, 31 aa, Artificial Sequence
  Description of Artificial Sequence: Synthetic polypeptide
DEEEIRTTNPVATEQYGSVSTWNQDRLGDQR

SEQ ID NO: 15561 - protein, 32 aa, Artificial Sequence
  Description of Artificial Sequence: Synthetic polypeptide
DEGEIRTTNPVATEAYGSVPSCTNLSQRTGNR

SEQ ID NO: 15562 - protein, 30 aa, Artificial Sequence
  Description of Artificial Sequence: Synthetic polypeptide
DEEEIRTTNPVATEQYGSVSTWPLDNIGNI

SEQ ID NO: 15563 - protein, 28 aa, Artificial Sequence
  Description of Artificial Sequence: Synthetic peptide
DEGEIRTTNPVATDQYGSVNTPLVRGND

SEQ ID NO: 15564 - protein, 31 aa, Artificial Sequence
  Description of Artificial Sequence: Synthetic polypeptide
DEEEIRTTNPVATEQYGSVCSTPLQEYFGNV

SEQ ID NO: 15565 - protein, 31 aa, Artificial Sequence
  Description of Artificial Sequence: Synthetic polypeptide
DEEEIRTTNPVATEQYGSVSCTDLQCNGNDC

SEQ ID NO: 15566 - protein, 30 aa, Artificial Sequence
  Description of Artificial Sequence: Synthetic polypeptide
DEEEIRTTNPVATEQYGSVSTWVDQVRTNS

SEQ ID NO: 15567 - protein, 32 aa, Artificial Sequence
  Description of Artificial Sequence: Synthetic polypeptide
DEEEIRTTNPVATEQYGSVCSTPLQRFGNEQS

SEQ ID NO: 15568 - protein, 29 aa, Artificial Sequence
  Description of Artificial Sequence: Synthetic peptide
DEEEIATTNPVATEQYGSVNTNLNRGEGE

SEQ ID NO: 15569 - protein, 33 aa, Artificial Sequence
  Description of Artificial Sequence: Synthetic polypeptide
DEEEIRTTNPVATEQYGSVSCTANLSQRGGNNM

SEQ ID NO: 15570 - protein, 33 aa, Artificial Sequence
  Description of Artificial Sequence: Synthetic polypeptide
DEEEIRTTNPVATEQYGSVSCSTNELSQRVGNI

SEQ ID NO: 15571 - protein, 30 aa, Artificial Sequence
  Description of Artificial Sequence: Synthetic polypeptide
DEEEIATTNPVATEQYGSVCTNLQQGDERQ

SEQ ID NO: 15572 - protein, 30 aa, Artificial Sequence
  Description of Artificial Sequence: Synthetic polypeptide
YEEEISPTNPVATEQYGSIVSTNLQRGNNT

SEQ ID NO: 15573 - protein, 31 aa, Artificial Sequence
  Description of Artificial Sequence: Synthetic polypeptide
DEEEIRTTNPVATEQYGSVSTYLHQSRGEEE

SEQ ID NO: 15574 - protein, 31 aa, Artificial Sequence
  Description of Artificial Sequence: Synthetic polypeptide
DEEEIRTTNPVATEQYGSVCSTVADQRGNAE

SEQ ID NO: 15575 - protein, 30 aa, Artificial Sequence
  Description of Artificial Sequence: Synthetic polypeptide
YEEEIRTVNPVATIQYGSVSTMNLQRVGNN

SEQ ID NO: 15576 - protein, 31 aa, Artificial Sequence
  Description of Artificial Sequence: Synthetic polypeptide
DEEEIRTTNPVATEQYGSVCSTVDLNRNGNI

SEQ ID NO: 15577 - protein, 31 aa, Artificial Sequence
  Description of Artificial Sequence: Synthetic polypeptide
YEEEIRTVNPVATEYYGSVSTGNLNQRVGNR

SEQ ID NO: 15578 - protein, 30 aa, Artificial Sequence
  Description of Artificial Sequence: Synthetic polypeptide
AEEEIRTTNPVATEPYGSVATNLQPGVNSR

SEQ ID NO: 15579 - protein, 31 aa, Artificial Sequence
  Description of Artificial Sequence: Synthetic polypeptide
DEEEIRTTNPVATEQYGYSVTDSTNLQSESR

SEQ ID NO: 15580 - protein, 30 aa, Artificial Sequence
  Description of Artificial Sequence: Synthetic polypeptide
DEGEIATTNPVATEQYGSVSTNLQRENNQE

SEQ ID NO: 15581 - protein, 31 aa, Artificial Sequence
  Description of Artificial Sequence: Synthetic polypeptide
DEEEIATTNPVATEQYGSVCSTNVDQRDNER

SEQ ID NO: 15582 - protein, 31 aa, Artificial Sequence
  Description of Artificial Sequence: Synthetic polypeptide
DEEEIRTTNPVATEQYGSVSTYLNQFGSNQP

SEQ ID NO: 15583 - protein, 31 aa, Artificial Sequence
  Description of Artificial Sequence: Synthetic polypeptide
DEEEIRTTNPVATEQYGSVCSTVLQPGDQRD

SEQ ID NO: 15584 - protein, 32 aa, Artificial Sequence
  Description of Artificial Sequence: Synthetic polypeptide
DEEEIRTTNPVATEQYGSVSMNLQRGVENEIF

SEQ ID NO: 15585 - protein, 30 aa, Artificial Sequence
  Description of Artificial Sequence: Synthetic polypeptide
YEEEIRTVNPVATETYGSVYTGNLQRVGNR

SEQ ID NO: 15586 - protein, 28 aa, Artificial Sequence
  Description of Artificial Sequence: Synthetic peptide
DEGEIATTNPVATEQYGSVNTALIRMNR

SEQ ID NO: 15587 - protein, 30 aa, Artificial Sequence
  Description of Artificial Sequence: Synthetic polypeptide
DEEEIRTTNPVATEQYGSVPTNLERDEDMR

SEQ ID NO: 15588 - protein, 31 aa, Artificial Sequence
  Description of Artificial Sequence: Synthetic polypeptide
DEEEIRTTNPVATEQYGSVCSTVLQRTGEDG

SEQ ID NO: 15589 - protein, 28 aa, Artificial Sequence
  Description of Artificial Sequence: Synthetic peptide
AEEEIRTTNPVATEIYGSVVTNLEQGND

SEQ ID NO: 15590 - protein, 31 aa, Artificial Sequence
  Description of Artificial Sequence: Synthetic polypeptide
DEEEIRTTNPVATEQYGSVPTNLEREGVNED

SEQ ID NO: 15591 - protein, 32 aa, Artificial Sequence
  Description of Artificial Sequence: Synthetic polypeptide
DEEEIRTTNPVATEQYGSVCSTVNDLERGDRM

SEQ ID NO: 15592 - protein, 31 aa, Artificial Sequence
  Description of Artificial Sequence: Synthetic polypeptide
DEEEIATTNPVATEQYGSVCSTNPQRSNSNR

SEQ ID NO: 15593 - protein, 32 aa, Artificial Sequence
  Description of Artificial Sequence: Synthetic polypeptide
DEEEIRTTNPVATEQYGSVCSTVNDLQNQNQR

SEQ ID NO: 15594 - protein, 31 aa, Artificial Sequence
  Description of Artificial Sequence: Synthetic polypeptide
DEEEIRTTNPVATEQYGSVSTYLGQPRNENE

SEQ ID NO: 15595 - protein, 32 aa, Artificial Sequence
  Description of Artificial Sequence: Synthetic polypeptide
DEEEIRTTNPVATEQYGSVSQTTNLQRNNFEN

SEQ ID NO: 15596 - protein, 30 aa, Artificial Sequence
  Description of Artificial Sequence: Synthetic polypeptide
DEEEIRTTNPVATEQYGSVWTNLDRPGDSD

SEQ ID NO: 15597 - protein, 32 aa, Artificial Sequence
  Description of Artificial Sequence: Synthetic polypeptide
DEEEIRTTNPVATEQYGSVSCQNELSTRGGNR

SEQ ID NO: 15598 - protein, 30 aa, Artificial Sequence
  Description of Artificial Sequence: Synthetic polypeptide
DEEEIATTNPVATEQYGSVCTNLQEMGDER

SEQ ID NO: 15599 - protein, 30 aa, Artificial Sequence
  Description of Artificial Sequence: Synthetic polypeptide
YEEEISPTNPVATEQYGSIVSTNLQRGNIT

SEQ ID NO: 15600 - protein, 31 aa, Artificial Sequence
  Description of Artificial Sequence: Synthetic polypeptide
DEEEIRTTNPVATEQYGYSISVNELQRGEMR

SEQ ID NO: 15601 - protein, 31 aa, Artificial Sequence
  Description of Artificial Sequence: Synthetic polypeptide
DEEEIRTTNPVATEQYGSVSCSNLQDRMNDD

SEQ ID NO: 15602 - protein, 30 aa, Artificial Sequence
  Description of Artificial Sequence: Synthetic polypeptide
DEEEIRTTNPVATEQYGSVCSTSIQRVNDT

SEQ ID NO: 15603 - protein, 31 aa, Artificial Sequence
  Description of Artificial Sequence: Synthetic polypeptide
DEEEIRTTNPVATEQYGSVCSTSNDLQNQER

SEQ ID NO: 15604 - protein, 29 aa, Artificial Sequence
  Description of Artificial Sequence: Synthetic peptide
YEEEISPTNPVATEQYGSIVSTNLQGGND

SEQ ID NO: 15605 - protein, 29 aa, Artificial Sequence
  Description of Artificial Sequence: Synthetic peptide
DEEEIRTTNPVATEQYGSVNNTNDELGNG

SEQ ID NO: 15606 - protein, 30 aa, Artificial Sequence
  Description of Artificial Sequence: Synthetic polypeptide
DEEEIRTTNPVATEQYGSVSTYHQTFGSNQ

SEQ ID NO: 15607 - protein, 30 aa, Artificial Sequence
  Description of Artificial Sequence: Synthetic polypeptide
DEDEIRTTNPVATEQYGSVSTVDDQDGNPR

SEQ ID NO: 15608 - protein, 31 aa, Artificial Sequence
  Description of Artificial Sequence: Synthetic polypeptide
DEEEIRTTNPVATEQYGSVSTYILQEDGGNF

SEQ ID NO: 15609 - protein, 31 aa, Artificial Sequence
  Description of Artificial Sequence: Synthetic polypeptide
YEEEIRYTNPVATEQYGSVESTSNLQLRGNG

SEQ ID NO: 15610 - protein, 29 aa, Artificial Sequence
  Description of Artificial Sequence: Synthetic peptide
AEEEIRTTNPVATEPYGSVSTNLSGGNQI

SEQ ID NO: 15611 - protein, 29 aa, Artificial Sequence
  Description of Artificial Sequence: Synthetic peptide
YEEEIRVTNPVATEQYGSVSTNLQNAIGR

SEQ ID NO: 15612 - protein, 28 aa, Artificial Sequence
  Description of Artificial Sequence: Synthetic peptide
DEAEIATTNPVATEQYGSVAGNDQRGNY

SEQ ID NO: 15613 - protein, 31 aa, Artificial Sequence
  Description of Artificial Sequence: Synthetic polypeptide
DEDEIRTTNPVATEQYGSVSTVNLGQGGENQ

SEQ ID NO: 15614 - protein, 31 aa, Artificial Sequence
  Description of Artificial Sequence: Synthetic polypeptide
DEEEIRTTNPVATEQYGSVSTYLDQSGGNNE

SEQ ID NO: 15615 - protein, 30 aa, Artificial Sequence
  Description of Artificial Sequence: Synthetic polypeptide
DEEEIRTTNPVATEQYGSVSTYLDRGEQPE

SEQ ID NO: 15616 - protein, 28 aa, Artificial Sequence
  Description of Artificial Sequence: Synthetic peptide
YEEEIRVTNPVATEHYGSVSTNLQHNGR

SEQ ID NO: 15617 - protein, 32 aa, Artificial Sequence
  Description of Artificial Sequence: Synthetic polypeptide
DEEEIRTTNPVATEPYGISVSTLNLQDRISNR

SEQ ID NO: 15618 - protein, 33 aa, Artificial Sequence
  Description of Artificial Sequence: Synthetic polypeptide
DEEEIRTTNPVATEQYGSVCSTTNLQISGSNRG

SEQ ID NO: 15619 - protein, 30 aa, Artificial Sequence
  Description of Artificial Sequence: Synthetic polypeptide
DEEEIATTNPVATEQYGSVCSTVDQAGNDR

SEQ ID NO: 15620 - protein, 32 aa, Artificial Sequence
  Description of Artificial Sequence: Synthetic polypeptide
DEEEIRTTNPVATEQYGSVSTWNLQTEGNLFQ

SEQ ID NO: 15621 - protein, 30 aa, Artificial Sequence
  Description of Artificial Sequence: Synthetic polypeptide
AEEEIRTTNPVATEQYGCVATNLQNRGNQI

SEQ ID NO: 15622 - protein, 30 aa, Artificial Sequence
  Description of Artificial Sequence: Synthetic polypeptide
YEEEISTCNPVATEQYGSVSTNNLPQPGNR

SEQ ID NO: 15623 - protein, 29 aa, Artificial Sequence
  Description of Artificial Sequence: Synthetic peptide
DEEEIRTTNPVATEQYGSVWTNMNGSGNS

SEQ ID NO: 15624 - protein, 30 aa, Artificial Sequence
  Description of Artificial Sequence: Synthetic polypeptide
DEEEIRTTNPVATEQYGSVWTNMLENGEDR

SEQ ID NO: 15625 - protein, 30 aa, Artificial Sequence
  Description of Artificial Sequence: Synthetic polypeptide
DEEEIRTTNPVATEQYGSVCSTNPQNGGEA

SEQ ID NO: 15626 - protein, 30 aa, Artificial Sequence
  Description of Artificial Sequence: Synthetic polypeptide
DEEEIRTTNPVATEQYGVWSTTNPLQRENN

SEQ ID NO: 15627 - protein, 31 aa, Artificial Sequence
  Description of Artificial Sequence: Synthetic polypeptide
DEEEIRTTNPVATEQYGSVNNTNDQRSGNDQ

SEQ ID NO: 15628 - protein, 29 aa, Artificial Sequence
  Description of Artificial Sequence: Synthetic peptide
TDEEIRTTNPVATEQWGTVSTNLQEGENR

SEQ ID NO: 15629 - protein, 30 aa, Artificial Sequence
  Description of Artificial Sequence: Synthetic polypeptide
DDEEIRTTNPVATDQYGSVSTNGGQQGNVR

SEQ ID NO: 15630 - protein, 28 aa, Artificial Sequence
  Description of Artificial Sequence: Synthetic peptide
TEACIRTTNPVATEQYGSVSTNLAYLNR

SEQ ID NO: 15631 - protein, 30 aa, Artificial Sequence
  Description of Artificial Sequence: Synthetic polypeptide
DDEEIRTTNPVATDQYGSVSTNGPQEGNDR

SEQ ID NO: 15632 - protein, 32 aa, Artificial Sequence
  Description of Artificial Sequence: Synthetic polypeptide
DEDEIRTTNPVATEQYGSVSTTNLGGQDGNRQ

SEQ ID NO: 15633 - protein, 29 aa, Artificial Sequence
  Description of Artificial Sequence: Synthetic peptide
YEEEISTTNPMATEQYGSVETPNLQRGLR

SEQ ID NO: 15634 - protein, 30 aa, Artificial Sequence
  Description of Artificial Sequence: Synthetic polypeptide
YEEEISTTNPMATEQYGGSVSTNLEQRGTR

SEQ ID NO: 15635 - protein, 30 aa, Artificial Sequence
  Description of Artificial Sequence: Synthetic polypeptide
YEEEISTTNPMATEMYGSFVSTGNLQRGNR

SEQ ID NO: 15636 - protein, 31 aa, Artificial Sequence
  Description of Artificial Sequence: Synthetic polypeptide
DEDEIRTTNPVATEQYGSVSTTNLGSGGDNR

SEQ ID NO: 15637 - protein, 31 aa, Artificial Sequence
  Description of Artificial Sequence: Synthetic polypeptide
DEEEIRTTNPVATEQYGSVCSTNPQNLGNAV

SEQ ID NO: 15638 - protein, 31 aa, Artificial Sequence
  Description of Artificial Sequence: Synthetic polypeptide
DEEEIRTTNPVATEQYGSVNNTNDQRETNRV

SEQ ID NO: 15639 - protein, 28 aa, Artificial Sequence
  Description of Artificial Sequence: Synthetic peptide
DEGEIRTTNPVATEQYGSVCTALIEMNR

SEQ ID NO: 15640 - protein, 31 aa, Artificial Sequence
  Description of Artificial Sequence: Synthetic polypeptide
DEDEIRTTNPVATEQYGSVSTTNLPQGGNEK

SEQ ID NO: 15641 - protein, 30 aa, Artificial Sequence
  Description of Artificial Sequence: Synthetic polypeptide
DEEEIRTTNPVATEQYGCVCSTELQVGNAA

SEQ ID NO: 15642 - protein, 32 aa, Artificial Sequence
  Description of Artificial Sequence: Synthetic polypeptide
DEEEIRTTNPVATEQYGSVSTWNLNQRDEDDR

SEQ ID NO: 15643 - protein, 33 aa, Artificial Sequence
  Description of Artificial Sequence: Synthetic polypeptide
DEEEIRTTNPVATEQYGSVSNTNLDQRAGDNDL

SEQ ID NO: 15644 - protein, 29 aa, Artificial Sequence
  Description of Artificial Sequence: Synthetic peptide
DEGEIRTTNPVATEQYGSVEDTALERENR

SEQ ID NO: 15645 - protein, 32 aa, Artificial Sequence
  Description of Artificial Sequence: Synthetic polypeptide
DEDEIRTTNPVATEQYGSVSTTNLQDHEGNNR

SEQ ID NO: 15646 - protein, 31 aa, Artificial Sequence
  Description of Artificial Sequence: Synthetic polypeptide
DEDEIRTTNPVATEQYGSVSTTNGQVGNNDR

SEQ ID NO: 15647 - protein, 30 aa, Artificial Sequence
  Description of Artificial Sequence: Synthetic polypeptide
DEGEIRTTNPVATEQYGSVNCTALIRVGNR

SEQ ID NO: 15648 - protein, 30 aa, Artificial Sequence
  Description of Artificial Sequence: Synthetic polypeptide
DEAEIRTTNPVATEQYGSVSTDNHNQMGNM

SEQ ID NO: 15649 - protein, 30 aa, Artificial Sequence
  Description of Artificial Sequence: Synthetic polypeptide
DEDEIRTTNPVATEQYGSVSTTNDHGNGNR

SEQ ID NO: 15650 - protein, 29 aa, Artificial Sequence
  Description of Artificial Sequence: Synthetic peptide
DEGEIRTTNPVATEQYGSVQTQPLIRMNR

SEQ ID NO: 15651 - protein, 31 aa, Artificial Sequence
  Description of Artificial Sequence: Synthetic polypeptide
DEEEIRTTNPVATEQYGSVSNTNLEQHGDFE

SEQ ID NO: 15652 - protein, 31 aa, Artificial Sequence
  Description of Artificial Sequence: Synthetic polypeptide
DEEEIATTNPVATEQYGSVSATNLQQEGNTV

SEQ ID NO: 15653 - protein, 29 aa, Artificial Sequence
  Description of Artificial Sequence: Synthetic peptide
DEGEIRTTNPVATEQYGSVQTANLIDENR

SEQ ID NO: 15654 - protein, 29 aa, Artificial Sequence
  Description of Artificial Sequence: Synthetic peptide
DEGEIRTTNPVATEQYGSVQTALSMRVNR

SEQ ID NO: 15655 - protein, 30 aa, Artificial Sequence
  Description of Artificial Sequence: Synthetic polypeptide
DEEEIRTTNPVATEQYGSVWTPLQNGSQRQ

SEQ ID NO: 15656 - protein, 32 aa, Artificial Sequence
  Description of Artificial Sequence: Synthetic polypeptide
DEEEIRTTNPVATEPYGEVSCTNLSQRGGNYR

SEQ ID NO: 15657 - protein, 28 aa, Artificial Sequence
  Description of Artificial Sequence: Synthetic peptide
DEGEIRTTNPVATEQYGSVQTALNPMNR

SEQ ID NO: 15658 - protein, 28 aa, Artificial Sequence
  Description of Artificial Sequence: Synthetic peptide
DEGEIRTTNPVATEQYGSVQTALITTNR

SEQ ID NO: 15659 - protein, 29 aa, Artificial Sequence
  Description of Artificial Sequence: Synthetic peptide
DEGEIRTTNPVATEQYGSVQTALIRNNRA

SEQ ID NO: 15660 - protein, 31 aa, Artificial Sequence
  Description of Artificial Sequence: Synthetic polypeptide
DEEEIRTTNPVATEQYGSVSMNHQRFGSNTQ

SEQ ID NO: 15661 - protein, 30 aa, Artificial Sequence
  Description of Artificial Sequence: Synthetic polypeptide
DEAEIRTTNPVATEQYGSVSTDLQDRGEGN

SEQ ID NO: 15662 - protein, 30 aa, Artificial Sequence
  Description of Artificial Sequence: Synthetic polypeptide
DEEEIRTTNPVATEQYGSVSCTEGDQRGEF

SEQ ID NO: 15663 - protein, 31 aa, Artificial Sequence
  Description of Artificial Sequence: Synthetic polypeptide
DEEEIRTTNPVATEQYGSVSMNLDDNGENRM

SEQ ID NO: 15664 - protein, 31 aa, Artificial Sequence
  Description of Artificial Sequence: Synthetic polypeptide
DEEEIRTTNPVATEQYGVVTSTNNPLQRENN

SEQ ID NO: 15665 - protein, 30 aa, Artificial Sequence
  Description of Artificial Sequence: Synthetic polypeptide
DEGEIRTTNPVATEQYGSVQTALERGMDNR

SEQ ID NO: 15666 - protein, 29 aa, Artificial Sequence
  Description of Artificial Sequence: Synthetic peptide
DEGEIRTTNPVATEQYGSVPTALSTRMNR

SEQ ID NO: 15667 - protein, 28 aa, Artificial Sequence
  Description of Artificial Sequence: Synthetic peptide
DEGEIRTTNPVATEQYGSVPTADIRMNR

SEQ ID NO: 15668 - protein, 29 aa, Artificial Sequence
  Description of Artificial Sequence: Synthetic peptide
DEEEIRTTNPVATEQYGSVWTNNDNRGDP

SEQ ID NO: 15669 - protein, 31 aa, Artificial Sequence
  Description of Artificial Sequence: Synthetic polypeptide
DEEEIRTTNPVATEAYGSVSTTNLTQGGNVN

SEQ ID NO: 15670 - protein, 28 aa, Artificial Sequence
  Description of Artificial Sequence: Synthetic peptide
SSEEIRTTNPVATHQYGSVSTGAQRGNF

SEQ ID NO: 15671 - protein, 30 aa, Artificial Sequence
  Description of Artificial Sequence: Synthetic polypeptide
DDEEIRTTNPVATDQYGSVSTNIVQNGNSR

SEQ ID NO: 15672 - protein, 31 aa, Artificial Sequence
  Description of Artificial Sequence: Synthetic polypeptide
DEEEIRTTNPVATEPYGISVGTHLQRSGNNR

SEQ ID NO: 15673 - protein, 28 aa, Artificial Sequence
  Description of Artificial Sequence: Synthetic peptide
TEAEIRTTNPVAYEQYGSISTNLTRPNR

SEQ ID NO: 15674 - protein, 31 aa, Artificial Sequence
  Description of Artificial Sequence: Synthetic polypeptide
DEAEIRTTNPVATEQYGSVSSTNLQDGNMDQ

SEQ ID NO: 15675 - protein, 30 aa, Artificial Sequence
  Description of Artificial Sequence: Synthetic polypeptide
DEEEIRTTNPVATEQYGSVCSTNTQNFNDT

SEQ ID NO: 15676 - protein, 32 aa, Artificial Sequence
  Description of Artificial Sequence: Synthetic polypeptide
DEEEIRTTNPVATEQYGSVSNTNHQMRGNDQV

SEQ ID NO: 15677 - protein, 31 aa, Artificial Sequence
  Description of Artificial Sequence: Synthetic polypeptide
DEEEIRTTNPVATEQYGSVSCTDLQRVDPRD

SEQ ID NO: 15678 - protein, 29 aa, Artificial Sequence
  Description of Artificial Sequence: Synthetic peptide
DEEEIRTTNPVATEQYGSVSSDDDRGERD

SEQ ID NO: 15679 - protein, 31 aa, Artificial Sequence
  Description of Artificial Sequence: Synthetic polypeptide
DEEEIRTTNPVATEQYGSVSMNLQHGQNADP

SEQ ID NO: 15680 - protein, 32 aa, Artificial Sequence
  Description of Artificial Sequence: Synthetic polypeptide
DEEEIATTNPVATEQYGSVQSCTNELQNGGNR

SEQ ID NO: 15681 - protein, 28 aa, Artificial Sequence
  Description of Artificial Sequence: Synthetic peptide
TECEIRTTNPVATEQYGVVSTGLQRVND

SEQ ID NO: 15682 - protein, 29 aa, Artificial Sequence
  Description of Artificial Sequence: Synthetic peptide
DEGEIRTTNPVATEQYGCVSTNTDQRGEF

SEQ ID NO: 15683 - protein, 31 aa, Artificial Sequence
  Description of Artificial Sequence: Synthetic polypeptide
DEEEIRTTNPVATEQYGSVCSTNVQRSNNDS

SEQ ID NO: 15684 - protein, 31 aa, Artificial Sequence
  Description of Artificial Sequence: Synthetic polypeptide
DEDEIRTTNPVATEQYGSVSTTNPQEGNERE

SEQ ID NO: 15685 - protein, 30 aa, Artificial Sequence
  Description of Artificial Sequence: Synthetic polypeptide
YEEEISTTNPAATEFYGSVSTNLQRGNVRG

SEQ ID NO: 15686 - protein, 29 aa, Artificial Sequence
  Description of Artificial Sequence: Synthetic peptide
YEEEISTTNPAATEFYGSVSTNLQRGNGM

SEQ ID NO: 15687 - protein, 30 aa, Artificial Sequence
  Description of Artificial Sequence: Synthetic polypeptide
YEEEISTTNPAATEFYGSVSTNLNQRGNRQ

SEQ ID NO: 15688 - protein, 29 aa, Artificial Sequence
  Description of Artificial Sequence: Synthetic peptide
YEEEISTTNPAATEFYGGVSTNLQRGNRV

SEQ ID NO: 15689 - protein, 30 aa, Artificial Sequence
  Description of Artificial Sequence: Synthetic polypeptide
DEGEIRTTNPVATEQYGCVSTNLQNGDNDA

SEQ ID NO: 15690 - protein, 30 aa, Artificial Sequence
  Description of Artificial Sequence: Synthetic polypeptide
DEEEIATTNPVATEQYGSVPTNIQDRGETR

SEQ ID NO: 15691 - protein, 31 aa, Artificial Sequence
  Description of Artificial Sequence: Synthetic polypeptide
DEEEIRTTNPVATEQYGSVSMNLQHGQNQLN

SEQ ID NO: 15692 - protein, 30 aa, Artificial Sequence
  Description of Artificial Sequence: Synthetic polypeptide
DEGEIRTTNPVATEQYGCVSTNLNRGSNQE

SEQ ID NO: 15693 - protein, 32 aa, Artificial Sequence
  Description of Artificial Sequence: Synthetic polypeptide
TEDEIRTTNPVATEQYGSVSCTNMLSQRGNQR

SEQ ID NO: 15694 - protein, 29 aa, Artificial Sequence
  Description of Artificial Sequence: Synthetic peptide
DEEEIRTTNPVATEQYGWVSTEPQRGSED

SEQ ID NO: 15695 - protein, 28 aa, Artificial Sequence
  Description of Artificial Sequence: Synthetic peptide
DEGEIRTTNPVATEQYGSVATQLTMMNR

SEQ ID NO: 15696 - protein, 30 aa, Artificial Sequence
  Description of Artificial Sequence: Synthetic polypeptide
YEEEISTTNPCATEFYGSVSTNLQNRGNRM

SEQ ID NO: 15697 - protein, 29 aa, Artificial Sequence
  Description of Artificial Sequence: Synthetic peptide
DDEEIRTTNPVATEAWGSVTSTDLQRGTR

SEQ ID NO: 15698 - protein, 29 aa, Artificial Sequence
  Description of Artificial Sequence: Synthetic peptide
DEEEIRTTNPVATEQYGSVNNTNDQLGQQ

SEQ ID NO: 15699 - protein, 28 aa, Artificial Sequence
  Description of Artificial Sequence: Synthetic peptide
TEAEIRTTNPVATEAYGSVWTNLQIGSR

SEQ ID NO: 15700 - protein, 30 aa, Artificial Sequence
  Description of Artificial Sequence: Synthetic polypeptide
DEGEIRTTNPVATEQYGSVATNLQERGDSM

SEQ ID NO: 15701 - protein, 30 aa, Artificial Sequence
  Description of Artificial Sequence: Synthetic polypeptide
DEGEIRTTNPVATEQYGSVATNLERGDNDP

SEQ ID NO: 15702 - protein, 30 aa, Artificial Sequence
  Description of Artificial Sequence: Synthetic polypeptide
DEEEIATTNPVATEAWGSVSTNELSQRPNR

SEQ ID NO: 15703 - protein, 30 aa, Artificial Sequence
  Description of Artificial Sequence: Synthetic polypeptide
DEGEIRTTNPVATEQYGSVATNLDRGNEAL

SEQ ID NO: 15704 - protein, 31 aa, Artificial Sequence
  Description of Artificial Sequence: Synthetic polypeptide
DEDEIRTTNPVATEQYGSVSTTNLQHGGNDK

SEQ ID NO: 15705 - protein, 32 aa, Artificial Sequence
  Description of Artificial Sequence: Synthetic polypeptide
DEDEIRTTNPVATEQYGSVSTTNLQTRGPNEQ

SEQ ID NO: 15706 - protein, 28 aa, Artificial Sequence
  Description of Artificial Sequence: Synthetic peptide
DEGEIRTTNPVATEQYGSVATALSRSNM

SEQ ID NO: 15707 - protein, 31 aa, Artificial Sequence
  Description of Artificial Sequence: Synthetic polypeptide
DEAEIRTTNPVATEQYGSVSSTNMGDRGNER

SEQ ID NO: 15708 - protein, 31 aa, Artificial Sequence
  Description of Artificial Sequence: Synthetic polypeptide
DEEEIRTTNPVATEQYGSVSSDNLQQHGENP

SEQ ID NO: 15709 - protein, 28 aa, Artificial Sequence
  Description of Artificial Sequence: Synthetic peptide
DEGEIRTTNPVATEQYGSVATALNRMMR

SEQ ID NO: 15710 - protein, 29 aa, Artificial Sequence
  Description of Artificial Sequence: Synthetic peptide
DEEEIRTTNPVATEQYGSVSMNLDRELID

SEQ ID NO: 15711 - protein, 31 aa, Artificial Sequence
  Description of Artificial Sequence: Synthetic polypeptide
DEEEIRTTNPVATEQYGSVCSTNPQRTENIE

SEQ ID NO: 15712 - protein, 30 aa, Artificial Sequence
  Description of Artificial Sequence: Synthetic polypeptide
YEEEISTTNPEATEFYGSVSTNNLQRGNRM

SEQ ID NO: 15713 - protein, 31 aa, Artificial Sequence
  Description of Artificial Sequence: Synthetic polypeptide
YEEEISTTNPDATEQYGSVVSDTNLQGRGNR

SEQ ID NO: 15714 - protein, 30 aa, Artificial Sequence
  Description of Artificial Sequence: Synthetic polypeptide
DEEEIATTNPVATEQYGSVSANDLQNGNDQ

SEQ ID NO: 15715 - protein, 31 aa, Artificial Sequence
  Description of Artificial Sequence: Synthetic polypeptide
DEEEIRTTNPVATEQYGSVCSTNPQRTSNIT

SEQ ID NO: 15716 - protein, 31 aa, Artificial Sequence
  Description of Artificial Sequence: Synthetic polypeptide
DEEEIRTTNPVATEQYGSVSMNLDRNGNDSD

SEQ ID NO: 15717 - protein, 30 aa, Artificial Sequence
  Description of Artificial Sequence: Synthetic polypeptide
DEGEIRTTNPVATEQYGSVAATNLENRGNE

SEQ ID NO: 15718 - protein, 32 aa, Artificial Sequence
  Description of Artificial Sequence: Synthetic polypeptide
TEAEIRTTNPVATEQYGSVSCTNMLSQDRGNR

SEQ ID NO: 15719 - protein, 29 aa, Artificial Sequence
  Description of Artificial Sequence: Synthetic peptide
DEGEIRTTNPVATEQYGSCSTNTQREGLS

SEQ ID NO: 15720 - protein, 32 aa, Artificial Sequence
  Description of Artificial Sequence: Synthetic polypeptide
DEEEIRTTNPVATEQYGSVNSGTNLQEEGNGQ

SEQ ID NO: 15721 - protein, 29 aa, Artificial Sequence
  Description of Artificial Sequence: Synthetic peptide
SSEEIRTTNPVATHQYGSVSTELTQRGND

SEQ ID NO: 15722 - protein, 29 aa, Artificial Sequence
  Description of Artificial Sequence: Synthetic peptide
DEEEIRTTNPVATEQYGSVSTVVASGERD

SEQ ID NO: 15723 - protein, 32 aa, Artificial Sequence
  Description of Artificial Sequence: Synthetic polypeptide
YEEEISTTNPVATEQYGSVGSTNLTQRSGTNR

SEQ ID NO: 15724 - protein, 28 aa, Artificial Sequence
  Description of Artificial Sequence: Synthetic peptide
SQEEIRTTNPVATEQWGTVSTNLQYGER

SEQ ID NO: 15725 - protein, 30 aa, Artificial Sequence
  Description of Artificial Sequence: Synthetic polypeptide
DEEEIATTNPVATEQYGSVSTALPQGNNDR

SEQ ID NO: 15726 - protein, 31 aa, Artificial Sequence
  Description of Artificial Sequence: Synthetic polypeptide
DEAEIRTTNPVATEQYGSVSTNLQGFGSNQS

SEQ ID NO: 15727 - protein, 30 aa, Artificial Sequence
  Description of Artificial Sequence: Synthetic polypeptide
DEEEIRTTNPVATEQYGSVCSTNLERAPEE

SEQ ID NO: 15728 - protein, 29 aa, Artificial Sequence
  Description of Artificial Sequence: Synthetic peptide
DEHEIRTTNPVATAQYGSVATQLQRGPND

SEQ ID NO: 15729 - protein, 29 aa, Artificial Sequence
  Description of Artificial Sequence: Synthetic peptide
AEEEIRTTNPVATEQYGQVSTNLDESGNF

SEQ ID NO: 15730 - protein, 30 aa, Artificial Sequence
  Description of Artificial Sequence: Synthetic polypeptide
DEHEIRTTNPTATEQYGSVSTNLDRGNNQD

SEQ ID NO: 15731 - protein, 31 aa, Artificial Sequence
  Description of Artificial Sequence: Synthetic polypeptide
AEEEIRTTNPVATEQYGQSVSTNPQNGSNRM

SEQ ID NO: 15732 - protein, 31 aa, Artificial Sequence
  Description of Artificial Sequence: Synthetic polypeptide
DEEEIRTTNPVATEQYGSVNSPTGLQRGEFT

SEQ ID NO: 15733 - protein, 28 aa, Artificial Sequence
  Description of Artificial Sequence: Synthetic peptide
YEEEISTTNPVATEQYGSVFTELEDGNR

SEQ ID NO: 15734 - protein, 31 aa, Artificial Sequence
  Description of Artificial Sequence: Synthetic polypeptide
DEEEIRTTNPVATEAYGSVSCTNLSTHGNNR

SEQ ID NO: 15735 - protein, 33 aa, Artificial Sequence
  Description of Artificial Sequence: Synthetic polypeptide
DEEEIRTTNPVATEQYGSVCSTNLFQHMGSNRE

SEQ ID NO: 15736 - protein, 32 aa, Artificial Sequence
  Description of Artificial Sequence: Synthetic polypeptide
DEEEIRTTNPVATEQYGSVCSTNLHQGFGNQG

SEQ ID NO: 15737 - protein, 31 aa, Artificial Sequence
  Description of Artificial Sequence: Synthetic polypeptide
DEAEIRTTNPVATEQYGSVSTNLQGEHGNEQ

SEQ ID NO: 15738 - protein, 31 aa, Artificial Sequence
  Description of Artificial Sequence: Synthetic polypeptide
DEAEIRTTNPVATEQYGSVSTNLQGEGGMNN

SEQ ID NO: 15739 - protein, 31 aa, Artificial Sequence
  Description of Artificial Sequence: Synthetic polypeptide
DEEEIRTTNPVATEAYGSVSCTNMLSQAGNA

SEQ ID NO: 15740 - protein, 29 aa, Artificial Sequence
  Description of Artificial Sequence: Synthetic peptide
YEEEISTTNPVATEQYGSVFTDLERPGNR

SEQ ID NO: 15741 - protein, 28 aa, Artificial Sequence
  Description of Artificial Sequence: Synthetic peptide
SQEEIRTTNPVATEQWGTVSWNLQGGNR

SEQ ID NO: 15742 - protein, 32 aa, Artificial Sequence
  Description of Artificial Sequence: Synthetic polypeptide
DEAEIRTTNPVATEQYGSVSTNLQGDGDNLRA

SEQ ID NO: 15743 - protein, 33 aa, Artificial Sequence
  Description of Artificial Sequence: Synthetic polypeptide
DEEEIRTTNPVATEAYGSVSCTNLSQRTGNNRV

SEQ ID NO: 15744 - protein, 31 aa, Artificial Sequence
  Description of Artificial Sequence: Synthetic polypeptide
DEAEIRTTNPVATEQYGSVSTNLQGGHNDAQ

SEQ ID NO: 15745 - protein, 29 aa, Artificial Sequence
  Description of Artificial Sequence: Synthetic peptide
YEEEISTTNPVATEQYGSVHTHDLERGNR

SEQ ID NO: 15746 - protein, 29 aa, Artificial Sequence
  Description of Artificial Sequence: Synthetic peptide
YEEEISTTNPVATEQYGSVITDLERGNRD

SEQ ID NO: 15747 - protein, 29 aa, Artificial Sequence
  Description of Artificial Sequence: Synthetic peptide
DEHEIRTTNPVATDQYGSVNTGLEQRGND

SEQ ID NO: 15748 - protein, 32 aa, Artificial Sequence
  Description of Artificial Sequence: Synthetic polypeptide
DEEEIRTTNPVATEQYGSVNSQTGNLQFTGNE

SEQ ID NO: 15749 - protein, 29 aa, Artificial Sequence
  Description of Artificial Sequence: Synthetic peptide
DEHEIRTTNPVATDQYGSVNTDLQRGNES

SEQ ID NO: 15750 - protein, 32 aa, Artificial Sequence
  Description of Artificial Sequence: Synthetic polypeptide
DEEEIRTTNPVATEQYGSVNSPTVLQRGQNLN

SEQ ID NO: 15751 - protein, 28 aa, Artificial Sequence
  Description of Artificial Sequence: Synthetic peptide
DEHEIRTTNPVATDQYGSVNTDLQEGND

SEQ ID NO: 15752 - protein, 33 aa, Artificial Sequence
  Description of Artificial Sequence: Synthetic polypeptide
DEEEIRTTNPVATEQYGSVCSTNLEQFGNSNRE

SEQ ID NO: 15753 - protein, 30 aa, Artificial Sequence
  Description of Artificial Sequence: Synthetic polypeptide
DEEEIATTNPVATEQYGSVSTDGDEQSGNR

SEQ ID NO: 15754 - protein, 30 aa, Artificial Sequence
  Description of Artificial Sequence: Synthetic polypeptide
DEEEIATTNPVATEQYGSVSTAQGQERGNQ

SEQ ID NO: 15755 - protein, 31 aa, Artificial Sequence
  Description of Artificial Sequence: Synthetic polypeptide
DEAEIRTTNPVATEQYGSVSTNLQGMGGNEH

SEQ ID NO: 15756 - protein, 32 aa, Artificial Sequence
  Description of Artificial Sequence: Synthetic polypeptide
DEEEIRTTNPVATEQYGSVNSPTVLQRGNELT

SEQ ID NO: 15757 - protein, 28 aa, Artificial Sequence
  Description of Artificial Sequence: Synthetic peptide
AEEEIRTTNPVATEQYGSTSTDLQDQGR

SEQ ID NO: 15758 - protein, 32 aa, Artificial Sequence
  Description of Artificial Sequence: Synthetic polypeptide
DEEEIRTTNPVATEAYGSVSCTNLSQRPGNYA

SEQ ID NO: 15759 - protein, 28 aa, Artificial Sequence
  Description of Artificial Sequence: Synthetic peptide
DEHEIRTTNPVATDQYGSVCTQLARGND

SEQ ID NO: 15760 - protein, 31 aa, Artificial Sequence
  Description of Artificial Sequence: Synthetic polypeptide
DEEEIRTTNPVATEQYGSVYSENSLDRGERQ

SEQ ID NO: 15761 - protein, 31 aa, Artificial Sequence
  Description of Artificial Sequence: Synthetic polypeptide
DEEEIATTNPVATEQYGSVSTANLQEGNGNV

SEQ ID NO: 15762 - protein, 31 aa, Artificial Sequence
  Description of Artificial Sequence: Synthetic polypeptide
DEAEIRTTNPVATEQYGSVSTNLQGGMGNEA

SEQ ID NO: 15763 - protein, 30 aa, Artificial Sequence
  Description of Artificial Sequence: Synthetic polypeptide
YEEEISTTNPVATEQYGSVNHDTNMQRGNR

SEQ ID NO: 15764 - protein, 30 aa, Artificial Sequence
  Description of Artificial Sequence: Synthetic polypeptide
DEEEIATTNPVATEQYGSVSTANGQDGERN

SEQ ID NO: 15765 - protein, 28 aa, Artificial Sequence
  Description of Artificial Sequence: Synthetic peptide
DEEEIRTTNPVATELYGSVATNEQNGDN

SEQ ID NO: 15766 - protein, 29 aa, Artificial Sequence
  Description of Artificial Sequence: Synthetic peptide
DEHEIRTTNPVATDQYGSVANTQLQRGNN

SEQ ID NO: 15767 - protein, 29 aa, Artificial Sequence
  Description of Artificial Sequence: Synthetic peptide
DEHEIRTTNPVATDQYGSVAATQLQRGNQ

SEQ ID NO: 15768 - protein, 31 aa, Artificial Sequence
  Description of Artificial Sequence: Synthetic polypeptide
DEAEIRTTNPVATEQYGSVSTNLQGDGDNAE

SEQ ID NO: 15769 - protein, 30 aa, Artificial Sequence
  Description of Artificial Sequence: Synthetic polypeptide
DEEEIATTNPCATEQYGSVSTGNMQGNGNR

SEQ ID NO: 15770 - protein, 32 aa, Artificial Sequence
  Description of Artificial Sequence: Synthetic polypeptide
DEEEIRTTNPVATEQYGSVYSATNDLQNEDNR

SEQ ID NO: 15771 - protein, 30 aa, Artificial Sequence
  Description of Artificial Sequence: Synthetic polypeptide
DEAEIRTTNPVATEQYGSVSTNLQGAQGDA

SEQ ID NO: 15772 - protein, 30 aa, Artificial Sequence
  Description of Artificial Sequence: Synthetic polypeptide
DEHEIRTTNPCATEQYGSVSTGLQRGDNNA

SEQ ID NO: 15773 - protein, 28 aa, Artificial Sequence
  Description of Artificial Sequence: Synthetic peptide
SSEEICTTNPVATAQYGSVSTVLQRGNF

SEQ ID NO: 15774 - protein, 30 aa, Artificial Sequence
  Description of Artificial Sequence: Synthetic polypeptide
DEHEIRTTNPCATEQYGSVSENLQGGGNNR

SEQ ID NO: 15775 - protein, 30 aa, Artificial Sequence
  Description of Artificial Sequence: Synthetic polypeptide
DEHEIRTTNPCATEQYGSVSENLQEGGSNR

SEQ ID NO: 15776 - protein, 31 aa, Artificial Sequence
  Description of Artificial Sequence: Synthetic polypeptide
DEAEIRTTNPVATEQYGSVSTNLNQLGNGEM

SEQ ID NO: 15777 - protein, 28 aa, Artificial Sequence
  Description of Artificial Sequence: Synthetic peptide
SSEEIRCTNPIATEQYGSVSENLMRGNR

SEQ ID NO: 15778 - protein, 31 aa, Artificial Sequence
  Description of Artificial Sequence: Synthetic polypeptide
DEEEIRTTNPVATEQYGSVCSTNLQDLNDMI

SEQ ID NO: 15779 - protein, 32 aa, Artificial Sequence
  Description of Artificial Sequence: Synthetic polypeptide
DEEEIRTTNPVATEQYGSVSCTNALTMTGGNR

SEQ ID NO: 15780 - protein, 28 aa, Artificial Sequence
  Description of Artificial Sequence: Synthetic peptide
DDEDIRTTNPVATEQYGNVSTNQQRVND

SEQ ID NO: 15781 - protein, 28 aa, Artificial Sequence
  Description of Artificial Sequence: Synthetic peptide
DDEDIRTTNPVATEQYGTVSTNEQRNNL

SEQ ID NO: 15782 - protein, 28 aa, Artificial Sequence
  Description of Artificial Sequence: Synthetic peptide
DDEDIRTTNPVATEQYGTVSTNGQRVND

SEQ ID NO: 15783 - protein, 29 aa, Artificial Sequence
  Description of Artificial Sequence: Synthetic peptide
YEEEISTTNPVATEQYGSVCTNINMRGNR

SEQ ID NO: 15784 - protein, 28 aa, Artificial Sequence
  Description of Artificial Sequence: Synthetic peptide
DDEDIRTTNPVATEQYGTVSTNHQRVNS

SEQ ID NO: 15785 - protein, 28 aa, Artificial Sequence
  Description of Artificial Sequence: Synthetic peptide
DDEDIRTTNPVATEQYGVVSTNGQRNNL

SEQ ID NO: 15786 - protein, 30 aa, Artificial Sequence
  Description of Artificial Sequence: Synthetic polypeptide
DEDEIRTTNPVATEQYGSVSTNNDQLGNEQ

SEQ ID NO: 15787 - protein, 30 aa, Artificial Sequence
  Description of Artificial Sequence: Synthetic polypeptide
DEHEIRTTNPCATEQYGEVSTNLQGDGNNR

SEQ ID NO: 15788 - protein, 31 aa, Artificial Sequence
  Description of Artificial Sequence: Synthetic polypeptide
DEEEIRTTNPVATEQYGVVSTNLQNGGNGGN

SEQ ID NO: 15789 - protein, 31 aa, Artificial Sequence
  Description of Artificial Sequence: Synthetic polypeptide
DEEEIRTTNPVATEQYGSVCSTNLQEGGDQP

SEQ ID NO: 15790 - protein, 31 aa, Artificial Sequence
  Description of Artificial Sequence: Synthetic polypeptide
DEAEIRTTNPVATEQYGSVSTNLNQGEGMNM

SEQ ID NO: 15791 - protein, 29 aa, Artificial Sequence
  Description of Artificial Sequence: Synthetic peptide
YEEEISTTNPVATEQYGSVCTDDLERGNR

SEQ ID NO: 15792 - protein, 29 aa, Artificial Sequence
  Description of Artificial Sequence: Synthetic peptide
SSEEIRTTNPVATAQYGSVSTEALQRGNF

SEQ ID NO: 15793 - protein, 30 aa, Artificial Sequence
  Description of Artificial Sequence: Synthetic polypeptide
DEAEIRTTNPVATEQYGSVSTNLNRNENQS

SEQ ID NO: 15794 - protein, 29 aa, Artificial Sequence
  Description of Artificial Sequence: Synthetic peptide
DEHEIRTTNPVATDQYGSVNTHLQRGNDG

SEQ ID NO: 15795 - protein, 31 aa, Artificial Sequence
  Description of Artificial Sequence: Synthetic polypeptide
DEEEIRTTNPVATEQYGSVSNTVDNQRGSER

SEQ ID NO: 15796 - protein, 31 aa, Artificial Sequence
  Description of Artificial Sequence: Synthetic polypeptide
DEEEIRTTNPVATEAYGSVSCTTLSIRGGNR

SEQ ID NO: 15797 - protein, 31 aa, Artificial Sequence
  Description of Artificial Sequence: Synthetic polypeptide
DEEEIRTTNPVATEQYGVVSTNLEQGGSNLV

SEQ ID NO: 15798 - protein, 30 aa, Artificial Sequence
  Description of Artificial Sequence: Synthetic polypeptide
DEHEIRTTNPCATEQYGSVSTNLQGDGNSE

SEQ ID NO: 15799 - protein, 32 aa, Artificial Sequence
  Description of Artificial Sequence: Synthetic polypeptide
DEDEIRTTNPVATEQYGSVSTNLQRNGDNDDP

SEQ ID NO: 15800 - protein, 31 aa, Artificial Sequence
  Description of Artificial Sequence: Synthetic polypeptide
DEEEIRTTNPVATEQYGVVSTNLEQRGDVDI

SEQ ID NO: 15801 - protein, 28 aa, Artificial Sequence
  Description of Artificial Sequence: Synthetic peptide
SQEEIRTTNPVATHQYGSVSTDLQEGNF

SEQ ID NO: 15802 - protein, 28 aa, Artificial Sequence
  Description of Artificial Sequence: Synthetic peptide
DEEEIRTTNPVATELYGVVSENLQNFNI

SEQ ID NO: 15803 - protein, 31 aa, Artificial Sequence
  Description of Artificial Sequence: Synthetic polypeptide
DEEEIRTTNPVATEQYGSVCSTNLIGGSNLA

SEQ ID NO: 15804 - protein, 29 aa, Artificial Sequence
  Description of Artificial Sequence: Synthetic peptide
SQEEIRTTNPVATHQYGSVSTELQREGND

SEQ ID NO: 15805 - protein, 31 aa, Artificial Sequence
  Description of Artificial Sequence: Synthetic polypeptide
DEAEIRTTNPVATEQYGSVSTNLQDNGDNNA

SEQ ID NO: 15806 - protein, 29 aa, Artificial Sequence
  Description of Artificial Sequence: Synthetic peptide
DEEEIRTTNPVATEMYGEVSMNDVQRGND

SEQ ID NO: 15807 - protein, 30 aa, Artificial Sequence
  Description of Artificial Sequence: Synthetic polypeptide
DEEEIRTTNPVATEMYGSVATNLERGVDRL

SEQ ID NO: 15808 - protein, 31 aa, Artificial Sequence
  Description of Artificial Sequence: Synthetic polypeptide
DEAEIRTTNPVATEQYGSVSTNLQAQGNDDM

SEQ ID NO: 15809 - protein, 31 aa, Artificial Sequence
  Description of Artificial Sequence: Synthetic polypeptide
DEHEIRTTNPCATEQYGSVSTNLGQDGGMNR

SEQ ID NO: 15810 - protein, 31 aa, Artificial Sequence
  Description of Artificial Sequence: Synthetic polypeptide
DEEEIRTTNPVATEQYGVVSTNLQEESGNEG

SEQ ID NO: 15811 - protein, 32 aa, Artificial Sequence
  Description of Artificial Sequence: Synthetic polypeptide
DEAEIRTTNPVATEQYGSVSTNLQANGDNGMR

SEQ ID NO: 15812 - protein, 33 aa, Artificial Sequence
  Description of Artificial Sequence: Synthetic polypeptide
DEEEIRTTNPVATEQYGSVCSTNLNQGSGSNRM

SEQ ID NO: 15813 - protein, 31 aa, Artificial Sequence
  Description of Artificial Sequence: Synthetic polypeptide
DEAEIRTTNPVATEQYGSVSTNLQAGGGNAM

SEQ ID NO: 15814 - protein, 28 aa, Artificial Sequence
  Description of Artificial Sequence: Synthetic peptide
SQEEIVTTNPVATEQWGTVSTNLQEGNR

SEQ ID NO: 15815 - protein, 30 aa, Artificial Sequence
  Description of Artificial Sequence: Synthetic polypeptide
DEAEIRTTNPVATEQYGSVSTNLQAGDGEH

SEQ ID NO: 15816 - protein, 32 aa, Artificial Sequence
  Description of Artificial Sequence: Synthetic polypeptide
DEEEIRTTNPVATEQYGSVCSTNLNQRFNSQA

SEQ ID NO: 15817 - protein, 31 aa, Artificial Sequence
  Description of Artificial Sequence: Synthetic polypeptide
DEDEIRTTNPVATEQYGSVSTNLQVGGENEP

SEQ ID NO: 15818 - protein, 30 aa, Artificial Sequence
  Description of Artificial Sequence: Synthetic polypeptide
DEAEIRTTNPVATEQYGSVSTNLNSGGNEN

SEQ ID NO: 15819 - protein, 29 aa, Artificial Sequence
  Description of Artificial Sequence: Synthetic peptide
DEHEIRTTNPVATDQYGSVNTMLLQRGNQ

SEQ ID NO: 15820 - protein, 32 aa, Artificial Sequence
  Description of Artificial Sequence: Synthetic polypeptide
DEAEIRTTNPVATEQYGSVSTNLQGNGDNNGR

SEQ ID NO: 15821 - protein, 29 aa, Artificial Sequence
  Description of Artificial Sequence: Synthetic peptide
DEHEIRTTNPVATDQYGSVNTPALQRGND

SEQ ID NO: 15822 - protein, 31 aa, Artificial Sequence
  Description of Artificial Sequence: Synthetic polypeptide
DEEEIRTTNPVATEQYGSVYSTNCIQIEVNR

SEQ ID NO: 15823 - protein, 31 aa, Artificial Sequence
  Description of Artificial Sequence: Synthetic polypeptide
DEHEIRTTNPVATEFYGSVSTTNLGQDGNER

SEQ ID NO: 15824 - protein, 32 aa, Artificial Sequence
  Description of Artificial Sequence: Synthetic polypeptide
DEAEIRTTNPVATEQYGSVSTNLQNDEGQNSR

SEQ ID NO: 15825 - protein, 32 aa, Artificial Sequence
  Description of Artificial Sequence: Synthetic polypeptide
DEEEIRTTNPVATEQYGSVYSTNAIQEHGNRI

SEQ ID NO: 15826 - protein, 32 aa, Artificial Sequence
  Description of Artificial Sequence: Synthetic polypeptide
DEEEIRTTNPVATEQYGSVYSTMNEIQECGNR

SEQ ID NO: 15827 - protein, 32 aa, Artificial Sequence
  Description of Artificial Sequence: Synthetic polypeptide
DEEEIRTTNPVATEQYGSVNSTGNLQGEGTND

SEQ ID NO: 15828 - protein, 30 aa, Artificial Sequence
  Description of Artificial Sequence: Synthetic polypeptide
DEHEIRTTNPVATEEYGSVSTNLQGDGNSE

SEQ ID NO: 15829 - protein, 32 aa, Artificial Sequence
  Description of Artificial Sequence: Synthetic polypeptide
DEEEIRTTNPVATEQYGSVNSTGNLQDTGNEE

SEQ ID NO: 15830 - protein, 30 aa, Artificial Sequence
  Description of Artificial Sequence: Synthetic polypeptide
DEHEIRTTNPVATECYGTVSTNLQMDGNNR

SEQ ID NO: 15831 - protein, 31 aa, Artificial Sequence
  Description of Artificial Sequence: Synthetic polypeptide
DEAEIRTTNPVATEQYGSVSTNLQMQGGNEA

SEQ ID NO: 15832 - protein, 29 aa, Artificial Sequence
  Description of Artificial Sequence: Synthetic peptide
AEEEIRTTNPVATEQYGSVANNLQDDGND

SEQ ID NO: 15833 - protein, 30 aa, Artificial Sequence
  Description of Artificial Sequence: Synthetic polypeptide
DEAEIRTTNPVATEQYGSVSTNLQMGGDMT

SEQ ID NO: 15834 - protein, 32 aa, Artificial Sequence
  Description of Artificial Sequence: Synthetic polypeptide
DEEEIRTTNPVATEQYGSVNSTENLQMNGNIG

SEQ ID NO: 15835 - protein, 30 aa, Artificial Sequence
  Description of Artificial Sequence: Synthetic polypeptide
AEEEIRTTNPVATEQYGSVAATNLQVGNDD

SEQ ID NO: 15836 - protein, 31 aa, Artificial Sequence
  Description of Artificial Sequence: Synthetic polypeptide
DEEEIRTTNPVATEQYGSVYSTEQIQKGGNR

SEQ ID NO: 15837 - protein, 30 aa, Artificial Sequence
  Description of Artificial Sequence: Synthetic polypeptide
AEEEIRTTNPVATEQYGSVAATNLQRQNDP

SEQ ID NO: 15838 - protein, 28 aa, Artificial Sequence
  Description of Artificial Sequence: Synthetic peptide
DDECIRTTNPVATEQYGIVSTNHQRVNA

SEQ ID NO: 15839 - protein, 28 aa, Artificial Sequence
  Description of Artificial Sequence: Synthetic peptide
DDECIRTTNPVATEQYGIVSTNQQRVNL

SEQ ID NO: 15840 - protein, 30 aa, Artificial Sequence
  Description of Artificial Sequence: Synthetic polypeptide
DEEEIRTTNPVATEQYGSVNSTDNPQEGEV

SEQ ID NO: 15841 - protein, 29 aa, Artificial Sequence
  Description of Artificial Sequence: Synthetic peptide
DEHEIRTTNPVATECYGSVSTNLQNGDFD

SEQ ID NO: 15842 - protein, 31 aa, Artificial Sequence
  Description of Artificial Sequence: Synthetic polypeptide
DEEEIRTTNPVATEQYGSVYSSNSLDRGESR

SEQ ID NO: 15843 - protein, 29 aa, Artificial Sequence
  Description of Artificial Sequence: Synthetic peptide
DEEEIATTNPVATEQYGSVSTGLTAGERH

SEQ ID NO: 15844 - protein, 31 aa, Artificial Sequence
  Description of Artificial Sequence: Synthetic polypeptide
DEAEIRTTNPVATEQYGSVSTNLQLDGENEV

SEQ ID NO: 15845 - protein, 30 aa, Artificial Sequence
  Description of Artificial Sequence: Synthetic polypeptide
DEHEIRTTNPVATEGYGSVSTNLQGEGNVN

SEQ ID NO: 15846 - protein, 30 aa, Artificial Sequence
  Description of Artificial Sequence: Synthetic polypeptide
YEEEISTTNPVATEQYGSVSPVNLPQGGNR

SEQ ID NO: 15847 - protein, 30 aa, Artificial Sequence
  Description of Artificial Sequence: Synthetic polypeptide
DEHEIRTTNPVATEHYGSVSTNLQNDGNTN

SEQ ID NO: 15848 - protein, 31 aa, Artificial Sequence
  Description of Artificial Sequence: Synthetic polypeptide
DEAEIRTTNPVATEQYGSVSTNLQNQGDNDM

SEQ ID NO: 15849 - protein, 30 aa, Artificial Sequence
  Description of Artificial Sequence: Synthetic polypeptide
DEHEIRTTNPVATEHYGSVSTNLQMDGNNT

SEQ ID NO: 15850 - protein, 30 aa, Artificial Sequence
  Description of Artificial Sequence: Synthetic polypeptide
DEHEIRTTNPVATEHYGSVSTNLQHQGNND

SEQ ID NO: 15851 - protein, 31 aa, Artificial Sequence
  Description of Artificial Sequence: Synthetic polypeptide
DEAEIRTTNPVATEQYGSVSTNLQNNGDNNT

SEQ ID NO: 15852 - protein, 30 aa, Artificial Sequence
  Description of Artificial Sequence: Synthetic polypeptide
DEHEIRTTNPVATEHYGSVSTNLQGEGNPE

SEQ ID NO: 15853 - protein, 32 aa, Artificial Sequence
  Description of Artificial Sequence: Synthetic polypeptide
DEEEIRTTNPVATEQYGSVYSTNCIQKPGNRD

SEQ ID NO: 15854 - protein, 32 aa, Artificial Sequence
  Description of Artificial Sequence: Synthetic polypeptide
DEEEIRTTNPVATEQYGSVYSTNCIQKIGNNR

SEQ ID NO: 15855 - protein, 31 aa, Artificial Sequence
  Description of Artificial Sequence: Synthetic polypeptide
DEAEIRTTNPVATEQYGSVSTNLQNGSNTAA

SEQ ID NO: 15856 - protein, 31 aa, Artificial Sequence
  Description of Artificial Sequence: Synthetic polypeptide
DEAEIRTTNPVATEQYGSVSTNLQNGQNESG

SEQ ID NO: 15857 - protein, 30 aa, Artificial Sequence
  Description of Artificial Sequence: Synthetic polypeptide
DEAEIRTTNPVATEQYGSVSTNLQNGMGDA

SEQ ID NO: 15858 - protein, 31 aa, Artificial Sequence
  Description of Artificial Sequence: Synthetic polypeptide
DEEEIRTTNPVATEQYGVVSTINLQVNGNGN

SEQ ID NO: 15859 - protein, 30 aa, Artificial Sequence
  Description of Artificial Sequence: Synthetic polypeptide
DEHEIRTTNPVATEHYGSVSTNLQFGNGDL

SEQ ID NO: 15860 - protein, 30 aa, Artificial Sequence
  Description of Artificial Sequence: Synthetic polypeptide
DEHEIRTTNPVATEHYGSVSTNLQDGQDND

SEQ ID NO: 15861 - protein, 30 aa, Artificial Sequence
  Description of Artificial Sequence: Synthetic polypeptide
DEHEIRTTNPVATEHYGSVSTNLQDGNNAT

SEQ ID NO: 15862 - protein, 31 aa, Artificial Sequence
  Description of Artificial Sequence: Synthetic polypeptide
DEAEIRTTNPVATEQYGSVSTNLQNGGENDP

SEQ ID NO: 15863 - protein, 31 aa, Artificial Sequence
  Description of Artificial Sequence: Synthetic polypeptide
DEAEIRTTNPVATEQYGSVSTNLQNGDQNMT

SEQ ID NO: 15864 - protein, 30 aa, Artificial Sequence
  Description of Artificial Sequence: Synthetic polypeptide
AEEEIRTTNPVATEQYGSVASTNNQQGNAT

SEQ ID NO: 15865 - protein, 31 aa, Artificial Sequence
  Description of Artificial Sequence: Synthetic polypeptide
DEAEIRTTNPVATEQYGSVSTNLQNGDNNDV

SEQ ID NO: 15866 - protein, 30 aa, Artificial Sequence
  Description of Artificial Sequence: Synthetic polypeptide
DEHEIRTTNPVATEHYGSVSTNLNQDGNND

SEQ ID NO: 15867 - protein, 30 aa, Artificial Sequence
  Description of Artificial Sequence: Synthetic polypeptide
AEEEIRTTNPVATEQYGSVASTNNDQGGNE

SEQ ID NO: 15868 - protein, 30 aa, Artificial Sequence
  Description of Artificial Sequence: Synthetic polypeptide
DEHEIRTTNPVATEGYGSVSTNLQGGGNEG

SEQ ID NO: 15869 - protein, 32 aa, Artificial Sequence
  Description of Artificial Sequence: Synthetic polypeptide
DEEEIRTTNPVATEQYGVVSTNLQREGSNPQL

SEQ ID NO: 15870 - protein, 31 aa, Artificial Sequence
  Description of Artificial Sequence: Synthetic polypeptide
AEEEIRTTNPVATEQYGSVAATNLQRGNPQP

SEQ ID NO: 15871 - protein, 31 aa, Artificial Sequence
  Description of Artificial Sequence: Synthetic polypeptide
DEAEIRTTNPVATEQYGSVSTNLQHSGGNNM

SEQ ID NO: 15872 - protein, 30 aa, Artificial Sequence
  Description of Artificial Sequence: Synthetic polypeptide
DEEEIRTTNPVATEQYGSVNSTDLDQRSEV

SEQ ID NO: 15873 - protein, 29 aa, Artificial Sequence
  Description of Artificial Sequence: Synthetic peptide
DEHEIRTTNPVATDQYGSVSNTDLQGGND

SEQ ID NO: 15874 - protein, 31 aa, Artificial Sequence
  Description of Artificial Sequence: Synthetic polypeptide
DEEEIRTTNPVATEQYGSVNSTDLDQRGEQE

SEQ ID NO: 15875 - protein, 31 aa, Artificial Sequence
  Description of Artificial Sequence: Synthetic polypeptide
DEEEIRTTNPVATEQYGSVNSTDLDQRGEIA

SEQ ID NO: 15876 - protein, 31 aa, Artificial Sequence
  Description of Artificial Sequence: Synthetic polypeptide
DEEEIATTNPVATEQYGSVSTDNGHQNGNSR

SEQ ID NO: 15877 - protein, 29 aa, Artificial Sequence
  Description of Artificial Sequence: Synthetic peptide
AEEEIRTTNPVATEQYGSTSTLLQQGQER

SEQ ID NO: 15878 - protein, 30 aa, Artificial Sequence
  Description of Artificial Sequence: Synthetic polypeptide
DEAEIRTTNPVATEQYGSVSTNLQGQGDAG

SEQ ID NO: 15879 - protein, 31 aa, Artificial Sequence
  Description of Artificial Sequence: Synthetic polypeptide
YEEEISTTNPVATEQYGSVNNITNLQRIGNR

SEQ ID NO: 15880 - protein, 29 aa, Artificial Sequence
  Description of Artificial Sequence: Synthetic peptide
DEHEIRTTNPVATDQYGSVNTTGLQRGND

SEQ ID NO: 15881 - protein, 29 aa, Artificial Sequence
  Description of Artificial Sequence: Synthetic peptide
DEEEIATTNPVATEQYGSVSTDLQINGEL

SEQ ID NO: 15882 - protein, 30 aa, Artificial Sequence
  Description of Artificial Sequence: Synthetic polypeptide
DEEEIRTTNPVATEQYGSVYSNPNLQLGIQ

SEQ ID NO: 15883 - protein, 30 aa, Artificial Sequence
  Description of Artificial Sequence: Synthetic polypeptide
DEEEIRTTNPVATEQYGSVYSMNIQGGNDG

SEQ ID NO: 15884 - protein, 30 aa, Artificial Sequence
  Description of Artificial Sequence: Synthetic polypeptide
DEEEIRTTNPVATEQYGSVPSPYPLIRGNL

SEQ ID NO: 15885 - protein, 29 aa, Artificial Sequence
  Description of Artificial Sequence: Synthetic peptide
DEEEIATTNPVATEQYGSVSTDLPDGMNA

SEQ ID NO: 15886 - protein, 31 aa, Artificial Sequence
  Description of Artificial Sequence: Synthetic polypeptide
DEAEIRTTNPVATEQYGSVSTNLQGQEGNAM

SEQ ID NO: 15887 - protein, 31 aa, Artificial Sequence
  Description of Artificial Sequence: Synthetic polypeptide
DEEEIRTTNPVATEQYGVVSTMNLVQGEGNQ

SEQ ID NO: 15888 - protein, 28 aa, Artificial Sequence
  Description of Artificial Sequence: Synthetic peptide
AEEEIRTTNPVATEQYGSTSTGLQRTGG

SEQ ID NO: 15889 - protein, 28 aa, Artificial Sequence
  Description of Artificial Sequence: Synthetic peptide
AEEEIRTTNPVATEQYGSTSTDLQRIGV

SEQ ID NO: 15890 - protein, 28 aa, Artificial Sequence
  Description of Artificial Sequence: Synthetic peptide
DEHEIRTTNPVATDQYGSVNTQLQHGNS

SEQ ID NO: 15891 - protein, 29 aa, Artificial Sequence
  Description of Artificial Sequence: Synthetic peptide
DEHEIRTTNPVATDQYGSVNTPLQRGIND

SEQ ID NO: 15892 - protein, 31 aa, Artificial Sequence
  Description of Artificial Sequence: Synthetic polypeptide
DEEEIRTTNPVATEQYGSVNSQTNEQRLNQT

SEQ ID NO: 15893 - protein, 32 aa, Artificial Sequence
  Description of Artificial Sequence: Synthetic polypeptide
DEEEIRTTNPVATEAYGSVSCTNLSQRGGNSP

SEQ ID NO: 15894 - protein, 30 aa, Artificial Sequence
  Description of Artificial Sequence: Synthetic polypeptide
AEEEIRTTNPVATEQYGSVAATNLQDGNMV

SEQ ID NO: 15895 - protein, 32 aa, Artificial Sequence
  Description of Artificial Sequence: Synthetic polypeptide
DEEEIATTNPVATEQYGSVSTDNLQSGGNDSR

SEQ ID NO: 15896 - protein, 31 aa, Artificial Sequence
  Description of Artificial Sequence: Synthetic polypeptide
DEEEIRTTNPVATEQYGSVNSTDLQAVGNIP

SEQ ID NO: 15897 - protein, 28 aa, Artificial Sequence
  Description of Artificial Sequence: Synthetic peptide
DEEEIRTTNPVATELWGSVSENDQIGNF

SEQ ID NO: 15898 - protein, 31 aa, Artificial Sequence
  Description of Artificial Sequence: Synthetic polypeptide
YEEEISTTNPVATEQYGSVNPDTNLSQRGNR

SEQ ID NO: 15899 - protein, 29 aa, Artificial Sequence
  Description of Artificial Sequence: Synthetic peptide
DEHEIRTTNPVATECYGSVSTNAQGGNEP

SEQ ID NO: 15900 - protein, 31 aa, Artificial Sequence
  Description of Artificial Sequence: Synthetic polypeptide
YEEEISTTNPVATEQYGSVNNTTNLQRGNRM

SEQ ID NO: 15901 - protein, 32 aa, Artificial Sequence
  Description of Artificial Sequence: Synthetic polypeptide
DEDEIRTTNPVATEQYGSVSTNLQREGDNGED

SEQ ID NO: 15902 - protein, 31 aa, Artificial Sequence
  Description of Artificial Sequence: Synthetic polypeptide
DEEEIATTNPVATEQYGSVSTENANQGGENR

SEQ ID NO: 15903 - protein, 32 aa, Artificial Sequence
  Description of Artificial Sequence: Synthetic polypeptide
DEEEIRTTNPVATEQYGSVYSQTPNLQRLNDD

SEQ ID NO: 15904 - protein, 30 aa, Artificial Sequence
  Description of Artificial Sequence: Synthetic polypeptide
DEHEIRTTNPVATEAYGSVSTNLQLGGDNS

SEQ ID NO: 15905 - protein, 29 aa, Artificial Sequence
  Description of Artificial Sequence: Synthetic peptide
AEEEIRTTNPVATEQYGSTSTTLQNGQER

SEQ ID NO: 15906 - protein, 31 aa, Artificial Sequence
  Description of Artificial Sequence: Synthetic polypeptide
DEEEIRTTNPVATEAYGSVSCTNLSQITGNV

SEQ ID NO: 15907 - protein, 31 aa, Artificial Sequence
  Description of Artificial Sequence: Synthetic polypeptide
DEAEIRTTNPVATEQYGSVSTNLQHMGGNDA

SEQ ID NO: 15908 - protein, 31 aa, Artificial Sequence
  Description of Artificial Sequence: Synthetic polypeptide
DEEEIRTTNPVATEQYGVVSTMNLQVNGNGQ

SEQ ID NO: 15909 - protein, 30 aa, Artificial Sequence
  Description of Artificial Sequence: Synthetic polypeptide
DEEEIATTNPVATEQYGSVSTELQFGSNQP

SEQ ID NO: 15910 - protein, 28 aa, Artificial Sequence
  Description of Artificial Sequence: Synthetic peptide
AEEEIRTTNPVATEQYGSTSTSLQAQER

SEQ ID NO: 15911 - protein, 32 aa, Artificial Sequence
  Description of Artificial Sequence: Synthetic polypeptide
DEEEIRTTNPVATEQYGSVNSTDLQNRVGDGR

SEQ ID NO: 15912 - protein, 31 aa, Artificial Sequence
  Description of Artificial Sequence: Synthetic polypeptide
DEAEIRTTNPVATEQYGSVSTNLQGSGGNAA

SEQ ID NO: 15913 - protein, 28 aa, Artificial Sequence
  Description of Artificial Sequence: Synthetic peptide
DDECIRTTNPVATEQYGTVSTNHQRTNL

SEQ ID NO: 15914 - protein, 32 aa, Artificial Sequence
  Description of Artificial Sequence: Synthetic polypeptide
DEEEIRTTNPVATEQYGSVYSPTNLPQDRGQQ

SEQ ID NO: 15915 - protein, 28 aa, Artificial Sequence
  Description of Artificial Sequence: Synthetic peptide
AEEEIRTTNPVATEQYGSTSTQLQRNGE

SEQ ID NO: 15916 - protein, 32 aa, Artificial Sequence
  Description of Artificial Sequence: Synthetic polypeptide
DEEEIRTTNPVATEQYGSVYSPTNDHQKGGNR

SEQ ID NO: 15917 - protein, 30 aa, Artificial Sequence
  Description of Artificial Sequence: Synthetic polypeptide
YEEEISTTNPVATEQYGSVNNPTNLQYGNR

SEQ ID NO: 15918 - protein, 29 aa, Artificial Sequence
  Description of Artificial Sequence: Synthetic peptide
DEHEIRTTNPVATDQYGSVVTMLDQRGND

SEQ ID NO: 15919 - protein, 31 aa, Artificial Sequence
  Description of Artificial Sequence: Synthetic polypeptide
DEHEIRTTNPVATEHYGSVSTNLQSGGGNTR

SEQ ID NO: 15920 - protein, 32 aa, Artificial Sequence
  Description of Artificial Sequence: Synthetic polypeptide
DEEEIRTTNPVATEQYGCVCSTENMLQFGSNR

SEQ ID NO: 15921 - protein, 28 aa, Artificial Sequence
  Description of Artificial Sequence: Synthetic peptide
DEHEIRATNPVATDQYGSVATALQRGND

SEQ ID NO: 15922 - protein, 29 aa, Artificial Sequence
  Description of Artificial Sequence: Synthetic peptide
DEAEIRTTNPVATEQYGSVSTNDQMGGEE

SEQ ID NO: 15923 - protein, 31 aa, Artificial Sequence
  Description of Artificial Sequence: Synthetic polypeptide
DEAEIRTTNPVATEQYGSVSTNDLNQERDND

SEQ ID NO: 15924 - protein, 28 aa, Artificial Sequence
  Description of Artificial Sequence: Synthetic peptide
DEGVIRATNPVATEQYGSFSTNLDNGNR

SEQ ID NO: 15925 - protein, 28 aa, Artificial Sequence
  Description of Artificial Sequence: Synthetic peptide
DEGVIRATNPVATEQYGSCSTNLADGNR

SEQ ID NO: 15926 - protein, 30 aa, Artificial Sequence
  Description of Artificial Sequence: Synthetic polypeptide
DEEEIRTTNPVATEQYGVVSTQLSQGSGNE

SEQ ID NO: 15927 - protein, 31 aa, Artificial Sequence
  Description of Artificial Sequence: Synthetic polypeptide
DEEEIRTTNPVATEQYGSVYPTNPLQNMGNI

SEQ ID NO: 15928 - protein, 31 aa, Artificial Sequence
  Description of Artificial Sequence: Synthetic polypeptide
DEEEIRTTNPVATEQYGSVSCTINGGQRGEF

SEQ ID NO: 15929 - protein, 30 aa, Artificial Sequence
  Description of Artificial Sequence: Synthetic polypeptide
AEEEIRTTNPVATEQYGCVSTNHQAGSNTR

SEQ ID NO: 15930 - protein, 31 aa, Artificial Sequence
  Description of Artificial Sequence: Synthetic polypeptide
DEAEIRTTNPVATEQYGSVSTNDGDRGGPNR

SEQ ID NO: 15931 - protein, 31 aa, Artificial Sequence
  Description of Artificial Sequence: Synthetic polypeptide
DEEEIRTTNPVATEQYGSVCSTNLQSNSNLM

SEQ ID NO: 15932 - protein, 30 aa, Artificial Sequence
  Description of Artificial Sequence: Synthetic polypeptide
AEEEIRTTNPVATEQYGCVSTNDTQNGSNR

SEQ ID NO: 15933 - protein, 31 aa, Artificial Sequence
  Description of Artificial Sequence: Synthetic polypeptide
DEEEIRTTNPVATEQYGSVCSTNLQSSGVDP

SEQ ID NO: 15934 - protein, 29 aa, Artificial Sequence
  Description of Artificial Sequence: Synthetic peptide
YEEEISTTNPVATEQYGPVSTNLIQGNNR

SEQ ID NO: 15935 - protein, 30 aa, Artificial Sequence
  Description of Artificial Sequence: Synthetic polypeptide
DEEEIRTTNPVATEQYGSVYPTNLQIINLE

SEQ ID NO: 15936 - protein, 30 aa, Artificial Sequence
  Description of Artificial Sequence: Synthetic polypeptide
DEAEIRTTNPVATEQYGSVSTNAGQNDDNR

SEQ ID NO: 15937 - protein, 31 aa, Artificial Sequence
  Description of Artificial Sequence: Synthetic polypeptide
DEEEIRTTNPVATEQYGSVNSNLQRNGNNEQ

SEQ ID NO: 15938 - protein, 31 aa, Artificial Sequence
  Description of Artificial Sequence: Synthetic polypeptide
DEEEIRTTNPVATEAYGSVSTNISTRGGNNR

SEQ ID NO: 15939 - protein, 31 aa, Artificial Sequence
  Description of Artificial Sequence: Synthetic polypeptide
DEEEIRTTNPVATEMYGSVSTNLQQIGNNEL

SEQ ID NO: 15940 - protein, 31 aa, Artificial Sequence
  Description of Artificial Sequence: Synthetic polypeptide
DEAEIRTTNPVATEQYGSVSTNAGQDGDNER

SEQ ID NO: 15941 - protein, 31 aa, Artificial Sequence
  Description of Artificial Sequence: Synthetic polypeptide
DEEEIRTTNPVATEQYGSVNSNLQRGVNMVN

SEQ ID NO: 15942 - protein, 31 aa, Artificial Sequence
  Description of Artificial Sequence: Synthetic polypeptide
DEEEIRTTNPVATEQYGSVPSTHLSTRGGNA

SEQ ID NO: 15943 - protein, 29 aa, Artificial Sequence
  Description of Artificial Sequence: Synthetic peptide
DEGVIRTTNPVATEQYGSASTNLDIGENR

SEQ ID NO: 15944 - protein, 29 aa, Artificial Sequence
  Description of Artificial Sequence: Synthetic peptide
DEEEIRTTNPVATEQYGSVYPTNPQRNEL

SEQ ID NO: 15945 - protein, 30 aa, Artificial Sequence
  Description of Artificial Sequence: Synthetic polypeptide
YEEEISTTNPVATEQYGPVSTNLQGHGVNR

SEQ ID NO: 15946 - protein, 28 aa, Artificial Sequence
  Description of Artificial Sequence: Synthetic peptide
SSEEIRTTNPVATEQWGTVSCNLQEGNR

SEQ ID NO: 15947 - protein, 32 aa, Artificial Sequence
  Description of Artificial Sequence: Synthetic polypeptide
DEEEIRTTNPVATEQYGSVPSTGNLQGGSNDP

SEQ ID NO: 15948 - protein, 30 aa, Artificial Sequence
  Description of Artificial Sequence: Synthetic polypeptide
DEEEIATTNPVATEQYGSVSQNLQGGGENQ

SEQ ID NO: 15949 - protein, 32 aa, Artificial Sequence
  Description of Artificial Sequence: Synthetic polypeptide
DEEEIRTTNPVATEQYGSVCSTNLQSFGENQS

SEQ ID NO: 15950 - protein, 29 aa, Artificial Sequence
  Description of Artificial Sequence: Synthetic peptide
SSEEIRTTNPVATEQWGTVSTNLQENGNR

SEQ ID NO: 15951 - protein, 31 aa, Artificial Sequence
  Description of Artificial Sequence: Synthetic polypeptide
DEEEIRTTNPVATEQYGSVCSTNLQSGDPQT

SEQ ID NO: 15952 - protein, 29 aa, Artificial Sequence
  Description of Artificial Sequence: Synthetic peptide
YEEEISTTNPVATEQYGPVSTNLQPGNNQ

SEQ ID NO: 15953 - protein, 31 aa, Artificial Sequence
  Description of Artificial Sequence: Synthetic polypeptide
DEEEIRTTNPVATEQYGSVCSTNLQSGGEPW

SEQ ID NO: 15954 - protein, 30 aa, Artificial Sequence
  Description of Artificial Sequence: Synthetic polypeptide
DDEEIRATNPVATEQYGSVSSTNMQTRGNN

SEQ ID NO: 15955 - protein, 30 aa, Artificial Sequence
  Description of Artificial Sequence: Synthetic polypeptide
DDEEIRATNPVATEQYGSVSSTNNGQRGNN

SEQ ID NO: 15956 - protein, 30 aa, Artificial Sequence
  Description of Artificial Sequence: Synthetic polypeptide
AEEEIRTTNPVATEQYGCVSTNLQYFGSDR

SEQ ID NO: 15957 - protein, 30 aa, Artificial Sequence
  Description of Artificial Sequence: Synthetic polypeptide
AEEEIRTTNPVATEQYGCVSTNLQYFGNQG

SEQ ID NO: 15958 - protein, 30 aa, Artificial Sequence
  Description of Artificial Sequence: Synthetic polypeptide
AEEEIRTTNPVATEQYGCVSTNLQRNSNFA

SEQ ID NO: 15959 - protein, 31 aa, Artificial Sequence
  Description of Artificial Sequence: Synthetic polypeptide
DEEEIRTTNPVATEQYGSVCSTNLQSGSDQP

SEQ ID NO: 15960 - protein, 30 aa, Artificial Sequence
  Description of Artificial Sequence: Synthetic polypeptide
DEAEIRTTNPVATEQYGSVSTNGGQNNGNY

SEQ ID NO: 15961 - protein, 28 aa, Artificial Sequence
  Description of Artificial Sequence: Synthetic peptide
DEGVIRTTNPVAYEQYGSISTNLIIGNR

SEQ ID NO: 15962 - protein, 30 aa, Artificial Sequence
  Description of Artificial Sequence: Synthetic polypeptide
AEEEIRTTNPVATEQYGCVSTNLQRNSDRD

SEQ ID NO: 15963 - protein, 30 aa, Artificial Sequence
  Description of Artificial Sequence: Synthetic polypeptide
AEEEIRTTNPVATEQYGCVSTNLQRNMNFA

SEQ ID NO: 15964 - protein, 31 aa, Artificial Sequence
  Description of Artificial Sequence: Synthetic polypeptide
DEEEIRTTNPVATEQYGSVSCTLLQRIGDQQ

SEQ ID NO: 15965 - protein, 30 aa, Artificial Sequence
  Description of Artificial Sequence: Synthetic polypeptide
DEEEIRTTNPVATEQYGVVSTQLAQGNGNE

SEQ ID NO: 15966 - protein, 28 aa, Artificial Sequence
  Description of Artificial Sequence: Synthetic peptide
DEGVIRTTNPVATEQYGSSSTNLIHGND

SEQ ID NO: 15967 - protein, 30 aa, Artificial Sequence
  Description of Artificial Sequence: Synthetic polypeptide
DEAEIRTTNPVATEQYGSVSTNAGGEGDNR

SEQ ID NO: 15968 - protein, 31 aa, Artificial Sequence
  Description of Artificial Sequence: Synthetic polypeptide
DEEEIRTTNPVATEQYGSVCSTNLQSSNNIM

SEQ ID NO: 15969 - protein, 30 aa, Artificial Sequence
  Description of Artificial Sequence: Synthetic polypeptide
DEAEIRTTNPVATEQYGSVSTNAGDQGDNR

SEQ ID NO: 15970 - protein, 29 aa, Artificial Sequence
  Description of Artificial Sequence: Synthetic peptide
DEEEIRTTNPVATEQYGSVNSNLQDNEER

SEQ ID NO: 15971 - protein, 29 aa, Artificial Sequence
  Description of Artificial Sequence: Synthetic peptide
DEGEIYTTNPVATEQYGSVSTNLNYGNVT

SEQ ID NO: 15972 - protein, 30 aa, Artificial Sequence
  Description of Artificial Sequence: Synthetic polypeptide
YEEEISTTNPVATEQYGGSVSTNNEQRGIR

SEQ ID NO: 15973 - protein, 29 aa, Artificial Sequence
  Description of Artificial Sequence: Synthetic peptide
DDEEIRCTNPVATEQYGNVSENLMSRGNR

SEQ ID NO: 15974 - protein, 32 aa, Artificial Sequence
  Description of Artificial Sequence: Synthetic polypeptide
DEEEIRTTNPVATEQYGSVPSTNEHSQYTGNR

SEQ ID NO: 15975 - protein, 30 aa, Artificial Sequence
  Description of Artificial Sequence: Synthetic polypeptide
DEAEIRTTNPVATEQYGSVSTMNDERGNMG

SEQ ID NO: 15976 - protein, 32 aa, Artificial Sequence
  Description of Artificial Sequence: Synthetic polypeptide
DEEEIRTTNPVATEQYGSVPSTNGSQKPGGNR

SEQ ID NO: 15977 - protein, 30 aa, Artificial Sequence
  Description of Artificial Sequence: Synthetic polypeptide
DEEEIRTTNPVATEQYGSVSSGLARYGEVR

SEQ ID NO: 15978 - protein, 32 aa, Artificial Sequence
  Description of Artificial Sequence: Synthetic polypeptide
DEEEIRTTNPVATEQYGSVNSINDLDQRGDRI

SEQ ID NO: 15979 - protein, 29 aa, Artificial Sequence
  Description of Artificial Sequence: Synthetic peptide
DEEEIRTTNPVATEQYGSVSTVTQDGEHD

SEQ ID NO: 15980 - protein, 31 aa, Artificial Sequence
  Description of Artificial Sequence: Synthetic polypeptide
DEEEIRTTNPVATEQYGSVCSTNLQYNSQRT

SEQ ID NO: 15981 - protein, 30 aa, Artificial Sequence
  Description of Artificial Sequence: Synthetic polypeptide
DEEEIRTTNPVATEQYGSVCSTNLQYQDQP

SEQ ID NO: 15982 - protein, 31 aa, Artificial Sequence
  Description of Artificial Sequence: Synthetic polypeptide
DEEEIRTTNPVATEQYGSVPSTNHSQHTGSR

SEQ ID NO: 15983 - protein, 28 aa, Artificial Sequence
  Description of Artificial Sequence: Synthetic peptide
SSEEIRTTNPVATHQYGSVSTANQRGNF

SEQ ID NO: 15984 - protein, 30 aa, Artificial Sequence
  Description of Artificial Sequence: Synthetic polypeptide
DEEEIATTNPVATEQYGSVSGNLQEAGDAR

SEQ ID NO: 15985 - protein, 29 aa, Artificial Sequence
  Description of Artificial Sequence: Synthetic peptide
DEAEIATTNPVATEQYGSVATNLQTDGNE

SEQ ID NO: 15986 - protein, 32 aa, Artificial Sequence
  Description of Artificial Sequence: Synthetic polypeptide
DEEEIRTTNPVATEQYGSVNSGTNLQQEFGNA

SEQ ID NO: 15987 - protein, 29 aa, Artificial Sequence
  Description of Artificial Sequence: Synthetic peptide
DEGEIRTTNPVGTEQYGSVSTNELGRGDP

SEQ ID NO: 15988 - protein, 29 aa, Artificial Sequence
  Description of Artificial Sequence: Synthetic peptide
SSEEIRTTNPVATHQYGSVSTDLQRGENF

SEQ ID NO: 15989 - protein, 29 aa, Artificial Sequence
  Description of Artificial Sequence: Synthetic peptide
SSEEIRTTNPVATHQYGSVSTDLQRGNFY

SEQ ID NO: 15990 - protein, 30 aa, Artificial Sequence
  Description of Artificial Sequence: Synthetic polypeptide
DEEEIRTTNPVATEQYGSVCSTNLTGSQNQ

SEQ ID NO: 15991 - protein, 32 aa, Artificial Sequence
  Description of Artificial Sequence: Synthetic polypeptide
DEEEIRTTNPVATEQYGSVPSTNHSQSGGSNR

SEQ ID NO: 15992 - protein, 30 aa, Artificial Sequence
  Description of Artificial Sequence: Synthetic polypeptide
YEEEISTTNPVATEQYGHSVSTNLEQRMTR

SEQ ID NO: 15993 - protein, 29 aa, Artificial Sequence
  Description of Artificial Sequence: Synthetic peptide
DEEEIATTNPVATEQYGSVSQNPQDGNDE

SEQ ID NO: 15994 - protein, 30 aa, Artificial Sequence
  Description of Artificial Sequence: Synthetic polypeptide
DEAEIRTTNPVATEQYGSVSTMNDLWDGNP

SEQ ID NO: 15995 - protein, 30 aa, Artificial Sequence
  Description of Artificial Sequence: Synthetic polypeptide
DEEEIRTTNPVATEQYGSVSTVPQRGEEDG

SEQ ID NO: 15996 - protein, 31 aa, Artificial Sequence
  Description of Artificial Sequence: Synthetic polypeptide
DEEEIRTTNPVATEQYGSVSMETEDQRGERF

SEQ ID NO: 15997 - protein, 31 aa, Artificial Sequence
  Description of Artificial Sequence: Synthetic polypeptide
DEEEIRTTNPVATEQYGSVSSGTNEDQSGND

SEQ ID NO: 15998 - protein, 31 aa, Artificial Sequence
  Description of Artificial Sequence: Synthetic polypeptide
DEEEIRTTNPVATEQYGSVCSTNLQVFNNQG

SEQ ID NO: 15999 - protein, 32 aa, Artificial Sequence
  Description of Artificial Sequence: Synthetic polypeptide
DEEEIATTNPVATEQYGSVSGTNLQEGDNDRT

SEQ ID NO: 16000 - protein, 30 aa, Artificial Sequence
  Description of Artificial Sequence: Synthetic polypeptide
DEEEIRTTNPVATEQYGSVSTVNVQVALNQ

SEQ ID NO: 16001 - protein, 28 aa, Artificial Sequence
  Description of Artificial Sequence: Synthetic peptide
YEEEISTTNPVATEQYGKVSTNIQVGNV

SEQ ID NO: 16002 - protein, 32 aa, Artificial Sequence
  Description of Artificial Sequence: Synthetic polypeptide
DEEEIRTTNPVATEQYGSVCSTNLQVNNSNRS

SEQ ID NO: 16003 - protein, 28 aa, Artificial Sequence
  Description of Artificial Sequence: Synthetic peptide
DEGTIRTTNPVATEQYGSCSTNLIGGER

SEQ ID NO: 16004 - protein, 33 aa, Artificial Sequence
  Description of Artificial Sequence: Synthetic polypeptide
DEEEIRTTNPVATEQYGSVSCTGNLSQTGTGNR

SEQ ID NO: 16005 - protein, 29 aa, Artificial Sequence
  Description of Artificial Sequence: Synthetic peptide
DEGTICTTNPVATEQYGSVISTNLIIGNR

SEQ ID NO: 16006 - protein, 29 aa, Artificial Sequence
  Description of Artificial Sequence: Synthetic peptide
DEAEIATTNPVATEQYGSVATNLTRQGND

SEQ ID NO: 16007 - protein, 28 aa, Artificial Sequence
  Description of Artificial Sequence: Synthetic peptide
DEGTICTTNPVATEQYGSFSTNLIGGNR

SEQ ID NO: 16008 - protein, 28 aa, Artificial Sequence
  Description of Artificial Sequence: Synthetic peptide
DEEEIRTTNPVATEQYGSVSSGLPPGDV

SEQ ID NO: 16009 - protein, 30 aa, Artificial Sequence
  Description of Artificial Sequence: Synthetic polypeptide
DEEEIRTTNPVATEAYGSVSTNLQFISNDY

SEQ ID NO: 16010 - protein, 31 aa, Artificial Sequence
  Description of Artificial Sequence: Synthetic polypeptide
DEEEIRTTNPVATEQYGSVYPTNLERDENER

SEQ ID NO: 16011 - protein, 29 aa, Artificial Sequence
  Description of Artificial Sequence: Synthetic peptide
DEGNIRTTNPVATEQYGSFSTPNLEIGNR

SEQ ID NO: 16012 - protein, 31 aa, Artificial Sequence
  Description of Artificial Sequence: Synthetic polypeptide
DEEEIRTTNPVATEAYGSVSTNLQGEGNNDD

SEQ ID NO: 16013 - protein, 31 aa, Artificial Sequence
  Description of Artificial Sequence: Synthetic polypeptide
DEEEIRTTNPVATEQYGSVYPTNHDQRGDRQ

SEQ ID NO: 16014 - protein, 31 aa, Artificial Sequence
  Description of Artificial Sequence: Synthetic polypeptide
DEEEIRTTNPVATEQYGSVSTVPLQGFGNQG

SEQ ID NO: 16015 - protein, 32 aa, Artificial Sequence
  Description of Artificial Sequence: Synthetic polypeptide
DEEEIRTTNPVATEQYGVVSTSNLQRFGNGGQ

SEQ ID NO: 16016 - protein, 31 aa, Artificial Sequence
  Description of Artificial Sequence: Synthetic polypeptide
DEEEIRTTNPVATEAYGSVSTNLQMGGNNVT

SEQ ID NO: 16017 - protein, 28 aa, Artificial Sequence
  Description of Artificial Sequence: Synthetic peptide
DEGMIRTTNPVATEQYGSASTNLIQENR

SEQ ID NO: 16018 - protein, 31 aa, Artificial Sequence
  Description of Artificial Sequence: Synthetic polypeptide
DEEEIRTTNPVATEAYGSVSTNEASQRVNNR

SEQ ID NO: 16019 - protein, 31 aa, Artificial Sequence
  Description of Artificial Sequence: Synthetic polypeptide
DEEEIRTTNPVATEAYGSVSTNALSQSGNYT

SEQ ID NO: 16020 - protein, 28 aa, Artificial Sequence
  Description of Artificial Sequence: Synthetic peptide
DEHEIATTNPVATAQYGMVSTALQRGDR

SEQ ID NO: 16021 - protein, 32 aa, Artificial Sequence
  Description of Artificial Sequence: Synthetic polypeptide
DEEEIRTTNPVATEQYGSVCSTNLQNAGSERG

SEQ ID NO: 16022 - protein, 30 aa, Artificial Sequence
  Description of Artificial Sequence: Synthetic polypeptide
DEDEIRTTNPVATEQYGSVSTNPLEGGNNN

SEQ ID NO: 16023 - protein, 30 aa, Artificial Sequence
  Description of Artificial Sequence: Synthetic polypeptide
DEDEIRTTNPVATEQYGSVSTNPMQDGNFA

SEQ ID NO: 16024 - protein, 31 aa, Artificial Sequence
  Description of Artificial Sequence: Synthetic polypeptide
DEEEIRTTNPVATEQYGSVCSTNLQNFNNDQ

SEQ ID NO: 16025 - protein, 31 aa, Artificial Sequence
  Description of Artificial Sequence: Synthetic polypeptide
DEEEIRTTNPVATEQYGSVCSTNLQNFNNTM

SEQ ID NO: 16026 - protein, 29 aa, Artificial Sequence
  Description of Artificial Sequence: Synthetic peptide
YEEEISTTNPVATEQYGQVSTNLQYGNND

SEQ ID NO: 16027 - protein, 31 aa, Artificial Sequence
  Description of Artificial Sequence: Synthetic polypeptide
DEEEIRTTNPVATEQYGVVSTNLVQQGGNDQ

SEQ ID NO: 16028 - protein, 31 aa, Artificial Sequence
  Description of Artificial Sequence: Synthetic polypeptide
DEAEIRTTNPVATEQYGSVSTNLGQEGDNNM

SEQ ID NO: 16029 - protein, 31 aa, Artificial Sequence
  Description of Artificial Sequence: Synthetic polypeptide
DEEEIRTTNPVATEAYGSVSTDNLQESGNIQ

SEQ ID NO: 16030 - protein, 31 aa, Artificial Sequence
  Description of Artificial Sequence: Synthetic polypeptide
DEEEIRTTNPVATEAYGSVSTEDLQNGSNRS

SEQ ID NO: 16031 - protein, 30 aa, Artificial Sequence
  Description of Artificial Sequence: Synthetic polypeptide
DEAEIRTTNPVATEQYGSVSTNLGHGNNQA

SEQ ID NO: 16032 - protein, 30 aa, Artificial Sequence
  Description of Artificial Sequence: Synthetic polypeptide
DEAEIRTTNPVATEQYGSVSTNLGHGNNPF

SEQ ID NO: 16033 - protein, 31 aa, Artificial Sequence
  Description of Artificial Sequence: Synthetic polypeptide
DDEEIGTTNPVATEQYGQSVSTNLQRFGSNQ

SEQ ID NO: 16034 - protein, 32 aa, Artificial Sequence
  Description of Artificial Sequence: Synthetic polypeptide
DEEEIRTTNPVATEQYGSVCSTNLQNGQNQLM

SEQ ID NO: 16035 - protein, 30 aa, Artificial Sequence
  Description of Artificial Sequence: Synthetic polypeptide
DEAEIRTTNPVATEQYGSVSTNLGHGENGM

SEQ ID NO: 16036 - protein, 33 aa, Artificial Sequence
  Description of Artificial Sequence: Synthetic polypeptide
DEEEIRTTNPVATEQYGSVCSTNLQNIGSNNRV

SEQ ID NO: 16037 - protein, 29 aa, Artificial Sequence
  Description of Artificial Sequence: Synthetic peptide
DDEEIKPTNPVATEQWGSVSDTNLQRGTR

SEQ ID NO: 16038 - protein, 30 aa, Artificial Sequence
  Description of Artificial Sequence: Synthetic polypeptide
DEAEIRTTNPVATEQYGSVSTNLGGGNNNF

SEQ ID NO: 16039 - protein, 31 aa, Artificial Sequence
  Description of Artificial Sequence: Synthetic polypeptide
DEEEIRTTNPVATEQYGSVCSTNLQNNENQL

SEQ ID NO: 16040 - protein, 29 aa, Artificial Sequence
  Description of Artificial Sequence: Synthetic peptide
SSEEIRTTNPVATDQYGSVSTELQRGNQD

SEQ ID NO: 16041 - protein, 30 aa, Artificial Sequence
  Description of Artificial Sequence: Synthetic polypeptide
DEHEIATTNPVATEQYGSVSTNLQGDGNSE

SEQ ID NO: 16042 - protein, 31 aa, Artificial Sequence
  Description of Artificial Sequence: Synthetic polypeptide
DEAEIRTTNPVATEQYGSVSTNLGSEGGDNR

SEQ ID NO: 16043 - protein, 31 aa, Artificial Sequence
  Description of Artificial Sequence: Synthetic polypeptide
YEEEISTTNPVATEQYGQSVYSTNLQRGNPY

SEQ ID NO: 16044 - protein, 30 aa, Artificial Sequence
  Description of Artificial Sequence: Synthetic polypeptide
DEHEIATTNPVATEVYGSVSTNLQGDGNNR

SEQ ID NO: 16045 - protein, 30 aa, Artificial Sequence
  Description of Artificial Sequence: Synthetic polypeptide
YEEEISTTNPVATEQYGQVVSETNLVRGNR

SEQ ID NO: 16046 - protein, 31 aa, Artificial Sequence
  Description of Artificial Sequence: Synthetic polypeptide
DEHEIGTTNPVATEQYGSVSTGNLDQDGNKR

SEQ ID NO: 16047 - protein, 30 aa, Artificial Sequence
  Description of Artificial Sequence: Synthetic polypeptide
YEEEISTTNPVATEQYGSSVSTNLQCGNGY

SEQ ID NO: 16048 - protein, 31 aa, Artificial Sequence
  Description of Artificial Sequence: Synthetic polypeptide
DEAEIRTTNPVATEQYGSVSTNLNQEGGNSG

SEQ ID NO: 16049 - protein, 30 aa, Artificial Sequence
  Description of Artificial Sequence: Synthetic polypeptide
DEHEICTTNPVATEQYGSVSANLQRGNEDF

SEQ ID NO: 16050 - protein, 28 aa, Artificial Sequence
  Description of Artificial Sequence: Synthetic peptide
DEHEICTTNPVATDQYGSVNTDLQRGND

SEQ ID NO: 16051 - protein, 32 aa, Artificial Sequence
  Description of Artificial Sequence: Synthetic polypeptide
DEEEIRTTNPVATEQYGSVCSTNLQFSGQNDG

SEQ ID NO: 16052 - protein, 28 aa, Artificial Sequence
  Description of Artificial Sequence: Synthetic peptide
SSEEIRTTNPVATCQYGSVSTPLQSGNF

SEQ ID NO: 16053 - protein, 29 aa, Artificial Sequence
  Description of Artificial Sequence: Synthetic peptide
SSEEIRTTNPVATCQYGSVSTWLQRGNFP

SEQ ID NO: 16054 - protein, 30 aa, Artificial Sequence
  Description of Artificial Sequence: Synthetic polypeptide
DEAEIRTTNPVATEQYGSVSTNLNNGDSNM

SEQ ID NO: 16055 - protein, 31 aa, Artificial Sequence
  Description of Artificial Sequence: Synthetic polypeptide
DEEEIRTTNPVATEQYGSVCSTNLQGQSNFA

SEQ ID NO: 16056 - protein, 31 aa, Artificial Sequence
  Description of Artificial Sequence: Synthetic polypeptide
DEAEIRTTNPVATEQYGSVSTNLNHQGDGNM

SEQ ID NO: 16057 - protein, 33 aa, Artificial Sequence
  Description of Artificial Sequence: Synthetic polypeptide
DEEEIRTTNPVATEQYGSVCSTNLQHFGSDNRE

SEQ ID NO: 16058 - protein, 33 aa, Artificial Sequence
  Description of Artificial Sequence: Synthetic polypeptide
DEEEIRTTNPVATEQYGSVSCTNAHSQRTEGNR

SEQ ID NO: 16059 - protein, 28 aa, Artificial Sequence
  Description of Artificial Sequence: Synthetic peptide
YEEEISTTNPVATEQYGSGGTDLERGNR

SEQ ID NO: 16060 - protein, 32 aa, Artificial Sequence
  Description of Artificial Sequence: Synthetic polypeptide
DEEEIRTTNPVATEQYGSVSNTNLLQIGIQRQ

SEQ ID NO: 16061 - protein, 32 aa, Artificial Sequence
  Description of Artificial Sequence: Synthetic polypeptide
DEEEIRTTNPVATEQYGSVCSTNLQHMGSNVI

SEQ ID NO: 16062 - protein, 31 aa, Artificial Sequence
  Description of Artificial Sequence: Synthetic polypeptide
DEDEIRTTNPVATEQYGSVSTNNQGDGNQRA

SEQ ID NO: 16063 - protein, 28 aa, Artificial Sequence
  Description of Artificial Sequence: Synthetic peptide
DDEEIATTNPVATTQYGSVSTNPMRGNE

SEQ ID NO: 16064 - protein, 30 aa, Artificial Sequence
  Description of Artificial Sequence: Synthetic polypeptide
DEAEIRTTNPVATEQYGSVSTNLNAGDGNA

SEQ ID NO: 16065 - protein, 30 aa, Artificial Sequence
  Description of Artificial Sequence: Synthetic polypeptide
DEDEIRTTNPVATEQYGSVSTNNQHQGNTG

SEQ ID NO: 16066 - protein, 30 aa, Artificial Sequence
  Description of Artificial Sequence: Synthetic polypeptide
DEAEIRTTNPVATEQYGSVSTNLGTGDNNM

SEQ ID NO: 16067 - protein, 30 aa, Artificial Sequence
  Description of Artificial Sequence: Synthetic polypeptide
DEHEIATTNPVATEVYGSVSTNLQRGENDM

SEQ ID NO: 16068 - protein, 33 aa, Artificial Sequence
  Description of Artificial Sequence: Synthetic polypeptide
DEEEIRTTNPVATEAYGSVSITNALSQRGGDNR

SEQ ID NO: 16069 - protein, 30 aa, Artificial Sequence
  Description of Artificial Sequence: Synthetic polypeptide
DEHEIATTNPVATEQYGSVSTNLQAGNNMM

SEQ ID NO: 16070 - protein, 31 aa, Artificial Sequence
  Description of Artificial Sequence: Synthetic polypeptide
DEDEIRTTNPVATEQYGSVSTNPTQNAGNDR

SEQ ID NO: 16071 - protein, 32 aa, Artificial Sequence
  Description of Artificial Sequence: Synthetic polypeptide
DEEEIRTTNPVATEQYGSVCSTNLQRFNQNDA

SEQ ID NO: 16072 - protein, 30 aa, Artificial Sequence
  Description of Artificial Sequence: Synthetic polypeptide
DEEEIRTTNPVATEQYGVVSTNPHQGGSNQ

SEQ ID NO: 16073 - protein, 32 aa, Artificial Sequence
  Description of Artificial Sequence: Synthetic polypeptide
DEEEIRTTNPVATEQYGSVSCTNAASQRVNNR

SEQ ID NO: 16074 - protein, 30 aa, Artificial Sequence
  Description of Artificial Sequence: Synthetic polypeptide
DEHEIATTNPVATENYGSVSTNLQAGGNTR

SEQ ID NO: 16075 - protein, 31 aa, Artificial Sequence
  Description of Artificial Sequence: Synthetic polypeptide
YEEEISTTNPVATEQYGQSVSQTNLEARGNR

SEQ ID NO: 16076 - protein, 30 aa, Artificial Sequence
  Description of Artificial Sequence: Synthetic polypeptide
DEEEIATTNPVATEQYGSVSSNLQDGGDNQ

SEQ ID NO: 16077 - protein, 31 aa, Artificial Sequence
  Description of Artificial Sequence: Synthetic polypeptide
DEEEIATTNPCATEQYGSVVSTNLQRGNENP

SEQ ID NO: 16078 - protein, 31 aa, Artificial Sequence
  Description of Artificial Sequence: Synthetic polypeptide
DEDEIRTTNPVATEQYGSVSTQDLEDRGGNR

SEQ ID NO: 16079 - protein, 29 aa, Artificial Sequence
  Description of Artificial Sequence: Synthetic peptide
SSEEIRTTNPVATDQYGSVSTYLQRTGNI

SEQ ID NO: 16080 - protein, 32 aa, Artificial Sequence
  Description of Artificial Sequence: Synthetic polypeptide
DEEEIRTTNPVATEQYGSVPSTGDNLQHEGNP

SEQ ID NO: 16081 - protein, 32 aa, Artificial Sequence
  Description of Artificial Sequence: Synthetic polypeptide
DEEEIRTTNPVATEQYGSVSMEENLQRGVNEQ

SEQ ID NO: 16082 - protein, 33 aa, Artificial Sequence
  Description of Artificial Sequence: Synthetic polypeptide
DEEEIRTTNPVATEQYGSVSCTMNEHSQRGGNR

SEQ ID NO: 16083 - protein, 31 aa, Artificial Sequence
  Description of Artificial Sequence: Synthetic polypeptide
DEEEIRTTNPVATEQYGVVSTPNLQPGNDGV

SEQ ID NO: 16084 - protein, 29 aa, Artificial Sequence
  Description of Artificial Sequence: Synthetic peptide
AEEEIRTTNPVATEQYGNVSTSLQNGNTQ

SEQ ID NO: 16085 - protein, 33 aa, Artificial Sequence
  Description of Artificial Sequence: Synthetic polypeptide
DEEEIRTTNPVATEQYGSVPSTGNALSQRGGNE

SEQ ID NO: 16086 - protein, 31 aa, Artificial Sequence
  Description of Artificial Sequence: Synthetic polypeptide
DEEEIRTTNPVATEQYGVVSTPNLQQGNEFE

SEQ ID NO: 16087 - protein, 30 aa, Artificial Sequence
  Description of Artificial Sequence: Synthetic polypeptide
YEEEISTTNPVATEQYGQSVSGTNLVRGGR

SEQ ID NO: 16088 - protein, 31 aa, Artificial Sequence
  Description of Artificial Sequence: Synthetic polypeptide
DEEEIRTTNPVATEQYGCVCSTENLQNGSND

SEQ ID NO: 16089 - protein, 31 aa, Artificial Sequence
  Description of Artificial Sequence: Synthetic polypeptide
DEEEIRTTNPVATEQYGSVNSPTALERGNNT

SEQ ID NO: 16090 - protein, 31 aa, Artificial Sequence
  Description of Artificial Sequence: Synthetic polypeptide
YEEEISTTNPVATEQYGQSVSDTNLVERGNR

SEQ ID NO: 16091 - protein, 32 aa, Artificial Sequence
  Description of Artificial Sequence: Synthetic polypeptide
DEEEIRTTNPVATEQYGSVPSTGNEIQTTGNR

SEQ ID NO: 16092 - protein, 29 aa, Artificial Sequence
  Description of Artificial Sequence: Synthetic peptide
SSEEIRTTNPVATDQYGSVSTTLQRGGNF

SEQ ID NO: 16093 - protein, 30 aa, Artificial Sequence
  Description of Artificial Sequence: Synthetic polypeptide
DEAEIRTTNPVATEQYGSVSTNLGDGNNPN

SEQ ID NO: 16094 - protein, 30 aa, Artificial Sequence
  Description of Artificial Sequence: Synthetic polypeptide
DEAEIRTTNPVATEQYGSVSTNLEHEGNSN

SEQ ID NO: 16095 - protein, 32 aa, Artificial Sequence
  Description of Artificial Sequence: Synthetic polypeptide
DEEEIRTTNPVATEAYGSVSTGNLSTRGNNRY

SEQ ID NO: 16096 - protein, 30 aa, Artificial Sequence
  Description of Artificial Sequence: Synthetic polypeptide
DEAEIRTTNPVATEQYGSVSTNLGDEGMNN

SEQ ID NO: 16097 - protein, 29 aa, Artificial Sequence
  Description of Artificial Sequence: Synthetic peptide
DEHEIATTNPVATEQYGSVSTNLMYGNEN

SEQ ID NO: 16098 - protein, 28 aa, Artificial Sequence
  Description of Artificial Sequence: Synthetic peptide
DEHEIATTNPVATEQYGSVSTNHQGGDT

SEQ ID NO: 16099 - protein, 29 aa, Artificial Sequence
  Description of Artificial Sequence: Synthetic peptide
DEHEIATTNPVATEQYGSVSTNHGQNGNT

SEQ ID NO: 16100 - protein, 31 aa, Artificial Sequence
  Description of Artificial Sequence: Synthetic polypeptide
DEDEIRTTNPVATEQYGSVSTNSGQDGNNGR

SEQ ID NO: 16101 - protein, 32 aa, Artificial Sequence
  Description of Artificial Sequence: Synthetic polypeptide
DEEEIRTTNPVATEAYGSVSTGNELSQNGNRC

SEQ ID NO: 16102 - protein, 29 aa, Artificial Sequence
  Description of Artificial Sequence: Synthetic peptide
DEHEIATTNPVATEQYGSVSSNLPDQGNR

SEQ ID NO: 16103 - protein, 28 aa, Artificial Sequence
  Description of Artificial Sequence: Synthetic peptide
DEHEIATTNPVATEQYGSVSENGQHGNE

SEQ ID NO: 16104 - protein, 30 aa, Artificial Sequence
  Description of Artificial Sequence: Synthetic polypeptide
YEEEISTTNPVATEQYGQSVSTTNEVRGNR

SEQ ID NO: 16105 - protein, 29 aa, Artificial Sequence
  Description of Artificial Sequence: Synthetic peptide
DEHEIATTNPVATEQYGSVSANLQRDNDE

SEQ ID NO: 16106 - protein, 31 aa, Artificial Sequence
  Description of Artificial Sequence: Synthetic polypeptide
DEAEIRTTNPVATEQYGSVSTNLERIGSNQS

SEQ ID NO: 16107 - protein, 33 aa, Artificial Sequence
  Description of Artificial Sequence: Synthetic polypeptide
DEEEIRTTNPVATEQYGSVCSTNLQPDDGNERP

SEQ ID NO: 16108 - protein, 31 aa, Artificial Sequence
  Description of Artificial Sequence: Synthetic polypeptide
DEEEIRTTNPVATEQYGVVSTNPDQRSGNES

SEQ ID NO: 16109 - protein, 29 aa, Artificial Sequence
  Description of Artificial Sequence: Synthetic peptide
SSEEIRTTNPVATDQYGSVSTLLQREGNI

SEQ ID NO: 16110 - protein, 31 aa, Artificial Sequence
  Description of Artificial Sequence: Synthetic polypeptide
DEAEIRTTNPVATEQYGSVSTNLEQGEGNTG

SEQ ID NO: 16111 - protein, 32 aa, Artificial Sequence
  Description of Artificial Sequence: Synthetic polypeptide
DEAEIRTTNPVATEQYGSVSTNLEQGEGGNAR

SEQ ID NO: 16112 - protein, 28 aa, Artificial Sequence
  Description of Artificial Sequence: Synthetic peptide
SSEEIRTTNPVATDQYGSVSTLQQRGND

SEQ ID NO: 16113 - protein, 31 aa, Artificial Sequence
  Description of Artificial Sequence: Synthetic polypeptide
DEDEIRTTNPVATEQYGSVSTNSQQGGNNDR

SEQ ID NO: 16114 - protein, 32 aa, Artificial Sequence
  Description of Artificial Sequence: Synthetic polypeptide
DEEEIRTTNPVATEQYGSVCSTNLQQGENETI

SEQ ID NO: 16115 - protein, 29 aa, Artificial Sequence
  Description of Artificial Sequence: Synthetic peptide
DEHEIATTNPVATEQYGSISTNTQRFGER

SEQ ID NO: 16116 - protein, 31 aa, Artificial Sequence
  Description of Artificial Sequence: Synthetic polypeptide
DEEEIRTTNPVATEAYGSVSTGNLSTDGNNR

SEQ ID NO: 16117 - protein, 28 aa, Artificial Sequence
  Description of Artificial Sequence: Synthetic peptide
SSEEIRTTNPVATDQYGSVSTTLQNGND

SEQ ID NO: 16118 - protein, 32 aa, Artificial Sequence
  Description of Artificial Sequence: Synthetic polypeptide
DEEEIRTTNPVATEQYGSVSTVNLQPTGGGNA

SEQ ID NO: 16119 - protein, 30 aa, Artificial Sequence
  Description of Artificial Sequence: Synthetic polypeptide
DEHEIRTTNPVATEQYGSVTTNLGQGDQNR

SEQ ID NO: 16120 - protein, 31 aa, Artificial Sequence
  Description of Artificial Sequence: Synthetic polypeptide
DEHEIRTTNPVATEQYGSVSTNLQQGNNDMK

SEQ ID NO: 16121 - protein, 28 aa, Artificial Sequence
  Description of Artificial Sequence: Synthetic peptide
DEDEIRTTNPVATEQYGSVATALSRMNL

SEQ ID NO: 16122 - protein, 29 aa, Artificial Sequence
  Description of Artificial Sequence: Synthetic peptide
DENEIACTNPVATEQYGEVSENLQREGNR

SEQ ID NO: 16123 - protein, 32 aa, Artificial Sequence
  Description of Artificial Sequence: Synthetic polypeptide
DEEEIRTTNPVATEQYGSVSTTNLQFGQNSGD

SEQ ID NO: 16124 - protein, 30 aa, Artificial Sequence
  Description of Artificial Sequence: Synthetic polypeptide
DEEEIRTTNPVATEQYGTSSTVNPLQRINN

SEQ ID NO: 16125 - protein, 28 aa, Artificial Sequence
  Description of Artificial Sequence: Synthetic peptide
DENEIACTNPVATEQYGEVSENLQFGNR

SEQ ID NO: 16126 - protein, 30 aa, Artificial Sequence
  Description of Artificial Sequence: Synthetic polypeptide
DEDEIRTTNPVATEQYGSVATNDQRGNTEG

SEQ ID NO: 16127 - protein, 32 aa, Artificial Sequence
  Description of Artificial Sequence: Synthetic polypeptide
DEEEIRTTNPVATEQYGSVSTTNLQGEENIRS

SEQ ID NO: 16128 - protein, 33 aa, Artificial Sequence
  Description of Artificial Sequence: Synthetic polypeptide
DEEEIRTTNPVATEQYGSVPHTNALSQRPGNNR

SEQ ID NO: 16129 - protein, 31 aa, Artificial Sequence
  Description of Artificial Sequence: Synthetic polypeptide
DEEEIRTTNPVATEQYGSVSTTNLQGFEPRQ

SEQ ID NO: 16130 - protein, 31 aa, Artificial Sequence
  Description of Artificial Sequence: Synthetic polypeptide
DEEEIRTTNPVATEQYGSWSIPNDLQREDNR

SEQ ID NO: 16131 - protein, 28 aa, Artificial Sequence
  Description of Artificial Sequence: Synthetic peptide
DENEIACTNPVATEQYGEVSENLQRGGR

SEQ ID NO: 16132 - protein, 32 aa, Artificial Sequence
  Description of Artificial Sequence: Synthetic polypeptide
DEEEIRTTNPVATEQYGSVSTTNLQGFGNNDG

SEQ ID NO: 16133 - protein, 28 aa, Artificial Sequence
  Description of Artificial Sequence: Synthetic peptide
SETEIRATNPVATEQYGSVGTNLQHGNQ

SEQ ID NO: 16134 - protein, 32 aa, Artificial Sequence
  Description of Artificial Sequence: Synthetic polypeptide
DEEEIRTTNPVATEQYGSVCSTENELQSSSNR

SEQ ID NO: 16135 - protein, 31 aa, Artificial Sequence
  Description of Artificial Sequence: Synthetic polypeptide
DEEEIRTTNPVATEQYGSVSTTNLQGGEVGG

SEQ ID NO: 16136 - protein, 28 aa, Artificial Sequence
  Description of Artificial Sequence: Synthetic peptide
DEAEIRTTNPVATQQYGMVSTDLERGNP

SEQ ID NO: 16137 - protein, 30 aa, Artificial Sequence
  Description of Artificial Sequence: Synthetic polypeptide
DEDEIRTTNPVATEQYGSVATNLERGDNGN

SEQ ID NO: 16138 - protein, 29 aa, Artificial Sequence
  Description of Artificial Sequence: Synthetic peptide
DEAEIRTTNPVATQQYGCVSTNLGRGGNP

SEQ ID NO: 16139 - protein, 29 aa, Artificial Sequence
  Description of Artificial Sequence: Synthetic peptide
DEAEIRTTNPVATQQYGCVSTNLERQGNP

SEQ ID NO: 16140 - protein, 29 aa, Artificial Sequence
  Description of Artificial Sequence: Synthetic peptide
DEDEIRTTNPVATEQYGSVATNLERGPDS

SEQ ID NO: 16141 - protein, 32 aa, Artificial Sequence
  Description of Artificial Sequence: Synthetic polypeptide
DEEEIRTTNPVATEQYGSVCSTENEQRGSNTA

SEQ ID NO: 16142 - protein, 28 aa, Artificial Sequence
  Description of Artificial Sequence: Synthetic peptide
DEAEIRTTNPVATQQYGCVSTNLEMGNE

SEQ ID NO: 16143 - protein, 31 aa, Artificial Sequence
  Description of Artificial Sequence: Synthetic polypeptide
DEEEIRTTNPVATEQYGTSVCSTNLERGSVQ

SEQ ID NO: 16144 - protein, 28 aa, Artificial Sequence
  Description of Artificial Sequence: Synthetic peptide
DEDSIRTTNPAATEQFGSVSFNLQGGNR

SEQ ID NO: 16145 - protein, 31 aa, Artificial Sequence
  Description of Artificial Sequence: Synthetic polypeptide
DEEEIRTTNPVATEQYGSVSLTPALTRGERI

SEQ ID NO: 16146 - protein, 30 aa, Artificial Sequence
  Description of Artificial Sequence: Synthetic polypeptide
DEDEIRTTNPVATEQYGSVAITNLERGNES

SEQ ID NO: 16147 - protein, 30 aa, Artificial Sequence
  Description of Artificial Sequence: Synthetic polypeptide
AEEEIRTTNPVATEQYGSVSSTNNNQVENR

SEQ ID NO: 16148 - protein, 29 aa, Artificial Sequence
  Description of Artificial Sequence: Synthetic peptide
DEAEIRTTNPVAVEQYGSISTNLERNNRS

SEQ ID NO: 16149 - protein, 28 aa, Artificial Sequence
  Description of Artificial Sequence: Synthetic peptide
DEAEIRTTNPVAVEQYGSISTNLERMNG

SEQ ID NO: 16150 - protein, 32 aa, Artificial Sequence
  Description of Artificial Sequence: Synthetic polypeptide
DEEEIRTTNPVATEQYGSVCSTELQEYFGNRF

SEQ ID NO: 16151 - protein, 29 aa, Artificial Sequence
  Description of Artificial Sequence: Synthetic peptide
DENEIACTNPVATEQYGSVSTNLEDRGGR

SEQ ID NO: 16152 - protein, 31 aa, Artificial Sequence
  Description of Artificial Sequence: Synthetic polypeptide
AEEEIRTTNPVATEQYGSVSSTNNNQRGNSN

SEQ ID NO: 16153 - protein, 30 aa, Artificial Sequence
  Description of Artificial Sequence: Synthetic polypeptide
DEEEIRTTNPVATEQYGSVNTNDQGENNRD

SEQ ID NO: 16154 - protein, 29 aa, Artificial Sequence
  Description of Artificial Sequence: Synthetic peptide
DENEIACTNPVATEQYGSVSTNGPQRGGR

SEQ ID NO: 16155 - protein, 28 aa, Artificial Sequence
  Description of Artificial Sequence: Synthetic peptide
DEAEIRTTNPVAVEQYGSIPTNLERTNR

SEQ ID NO: 16156 - protein, 28 aa, Artificial Sequence
  Description of Artificial Sequence: Synthetic peptide
DEAEIRTTNPVAVEQYGSCSWNLERPNR

SEQ ID NO: 16157 - protein, 31 aa, Artificial Sequence
  Description of Artificial Sequence: Synthetic polypeptide
DEEEIRTTNPVATEQYGSVCSTELQRSGEQI

SEQ ID NO: 16158 - protein, 31 aa, Artificial Sequence
  Description of Artificial Sequence: Synthetic polypeptide
DEEEIRTTNPVATEQYGSVCSTELQGGENQS

SEQ ID NO: 16159 - protein, 29 aa, Artificial Sequence
  Description of Artificial Sequence: Synthetic peptide
DEDEIRTTNPVATEQYGSTSTNTQNEGIR

SEQ ID NO: 16160 - protein, 30 aa, Artificial Sequence
  Description of Artificial Sequence: Synthetic polypeptide
DEEEIRTTNPVATEQYGTSSTINGLQRENN

SEQ ID NO: 16161 - protein, 28 aa, Artificial Sequence
  Description of Artificial Sequence: Synthetic peptide
DENEIACTNPVATEQYGSASTNLQRGGL

SEQ ID NO: 16162 - protein, 31 aa, Artificial Sequence
  Description of Artificial Sequence: Synthetic polypeptide
DEEEIRTTNPVATEQYGSVPFTNSSGRGNRA

SEQ ID NO: 16163 - protein, 30 aa, Artificial Sequence
  Description of Artificial Sequence: Synthetic polypeptide
DEEEIRTTNPVATEQYGTSSTINPLQRNNA

SEQ ID NO: 16164 - protein, 29 aa, Artificial Sequence
  Description of Artificial Sequence: Synthetic peptide
DEEEIRTTNPVATEQYGSVNTNDNDGERN

SEQ ID NO: 16165 - protein, 31 aa, Artificial Sequence
  Description of Artificial Sequence: Synthetic polypeptide
DEEEIRTTNPVATEQYGSWSLPNDLQRYDNR

SEQ ID NO: 16166 - protein, 29 aa, Artificial Sequence
  Description of Artificial Sequence: Synthetic peptide
DEEEIRTTNPVATEQYGSVNTNDLTNGEE

SEQ ID NO: 16167 - protein, 30 aa, Artificial Sequence
  Description of Artificial Sequence: Synthetic polypeptide
DEDEIRTTNPVATEQYGSVAATNLPREGNE

SEQ ID NO: 16168 - protein, 30 aa, Artificial Sequence
  Description of Artificial Sequence: Synthetic polypeptide
AEEEIRTTNPVATEQYGSVSSTNNNQGGNQ

SEQ ID NO: 16169 - protein, 31 aa, Artificial Sequence
  Description of Artificial Sequence: Synthetic polypeptide
DEEEIRTTNPVATEQYGSVSTTNLQEVLPRG

SEQ ID NO: 16170 - protein, 31 aa, Artificial Sequence
  Description of Artificial Sequence: Synthetic polypeptide
DEEEIRTTNPVATEQYGSVSTTNLQGGGEVD

SEQ ID NO: 16171 - protein, 33 aa, Artificial Sequence
  Description of Artificial Sequence: Synthetic polypeptide
DEEEIRTTNPVATEQYGSVCSTENHQRFGNFRV

SEQ ID NO: 16172 - protein, 32 aa, Artificial Sequence
  Description of Artificial Sequence: Synthetic polypeptide
DEEEIRTTNPVATEQYGSVCSTENHQRFGNLS

SEQ ID NO: 16173 - protein, 29 aa, Artificial Sequence
  Description of Artificial Sequence: Synthetic peptide
DEDEIRTTNPVATEQYGSVATNLQMGGDH

SEQ ID NO: 16174 - protein, 30 aa, Artificial Sequence
  Description of Artificial Sequence: Synthetic polypeptide
DEAEIRTTNPVATEYYGSVSTNLEQGGNSG

SEQ ID NO: 16175 - protein, 31 aa, Artificial Sequence
  Description of Artificial Sequence: Synthetic polypeptide
DEEEIRTTNPVATEAYGCVSTNDLQNGSNRI

SEQ ID NO: 16176 - protein, 29 aa, Artificial Sequence
  Description of Artificial Sequence: Synthetic peptide
DEEEIATTNPVAYEPYGSVATNLDQRGND

SEQ ID NO: 16177 - protein, 31 aa, Artificial Sequence
  Description of Artificial Sequence: Synthetic polypeptide
DEDEIRTTNPVATEQYGSVATNLQREGNSQE

SEQ ID NO: 16178 - protein, 32 aa, Artificial Sequence
  Description of Artificial Sequence: Synthetic polypeptide
DEEEIRTTNPVATEQYGSVSTTNLQLNGNEDG

SEQ ID NO: 16179 - protein, 31 aa, Artificial Sequence
  Description of Artificial Sequence: Synthetic polypeptide
DEEEIRTTNPVATEQYGSVSNTNLQLTIQRQ

SEQ ID NO: 16180 - protein, 32 aa, Artificial Sequence
  Description of Artificial Sequence: Synthetic polypeptide
DEEEIRTTNPVATEQYGSVCSTEPLQGSGNRS

SEQ ID NO: 16181 - protein, 29 aa, Artificial Sequence
  Description of Artificial Sequence: Synthetic peptide
DEDQIATTNPVATEQWGSVSTDGLQRGNR

SEQ ID NO: 16182 - protein, 32 aa, Artificial Sequence
  Description of Artificial Sequence: Synthetic polypeptide
DEEEIRTTNPVATEQYGSVSTTNLQMDGNVGG

SEQ ID NO: 16183 - protein, 29 aa, Artificial Sequence
  Description of Artificial Sequence: Synthetic peptide
DEDEIRTTNPVATEQYGSVATNLQEQGDE

SEQ ID NO: 16184 - protein, 30 aa, Artificial Sequence
  Description of Artificial Sequence: Synthetic polypeptide
DEEEIRTTNPVATEQYGSVCSTEPQNGNNA

SEQ ID NO: 16185 - protein, 31 aa, Artificial Sequence
  Description of Artificial Sequence: Synthetic polypeptide
DEEEIRTTNPVATEQYGSVSTTNLQMNGETE

SEQ ID NO: 16186 - protein, 31 aa, Artificial Sequence
  Description of Artificial Sequence: Synthetic polypeptide
DEEEIRTTNPVATEQYGSVSTTNLQNGGDQP

SEQ ID NO: 16187 - protein, 32 aa, Artificial Sequence
  Description of Artificial Sequence: Synthetic polypeptide
DEEEIRTTNPVATEQYGSVSTTNLQNGGVNNP

SEQ ID NO: 16188 - protein, 31 aa, Artificial Sequence
  Description of Artificial Sequence: Synthetic polypeptide
AEEEIRTTNPVATEQYGSVSSTNNLNQFGNE

SEQ ID NO: 16189 - protein, 32 aa, Artificial Sequence
  Description of Artificial Sequence: Synthetic polypeptide
DEEEIRTTNPVATEQYGSVSTTNLQPGFGNFG

SEQ ID NO: 16190 - protein, 29 aa, Artificial Sequence
  Description of Artificial Sequence: Synthetic peptide
DEEEIACTNPVATEQYGSVSEDLMRGNDR

SEQ ID NO: 16191 - protein, 28 aa, Artificial Sequence
  Description of Artificial Sequence: Synthetic peptide
DEMEISTTNPVATQQYGCVSTNLERGNL

SEQ ID NO: 16192 - protein, 31 aa, Artificial Sequence
  Description of Artificial Sequence: Synthetic polypeptide
DEAEIRTTNPVATEVYGSVSTTNLGQDGNER

SEQ ID NO: 16193 - protein, 28 aa, Artificial Sequence
  Description of Artificial Sequence: Synthetic peptide
DEMEISTTNPVATEQYGSVSTNDDYGNT

SEQ ID NO: 16194 - protein, 31 aa, Artificial Sequence
  Description of Artificial Sequence: Synthetic polypeptide
AEEEIRTTNPVATEQYGSVSSTNNLGAGNQR

SEQ ID NO: 16195 - protein, 32 aa, Artificial Sequence
  Description of Artificial Sequence: Synthetic polypeptide
DEEEIRTTNPVATEQYGSVSTTNLQMGENGGG

SEQ ID NO: 16196 - protein, 31 aa, Artificial Sequence
  Description of Artificial Sequence: Synthetic polypeptide
DEAEIRTTNPVATEYYGSVSTNLQPGGDNRD

SEQ ID NO: 16197 - protein, 28 aa, Artificial Sequence
  Description of Artificial Sequence: Synthetic peptide
DEMVIRTTNPVATEQYGCVATNDQRGNT

SEQ ID NO: 16198 - protein, 29 aa, Artificial Sequence
  Description of Artificial Sequence: Synthetic peptide
DEMVIRTTNPVATEQYGCVATNPQRGNER

SEQ ID NO: 16199 - protein, 33 aa, Artificial Sequence
  Description of Artificial Sequence: Synthetic polypeptide
DEEEIRTTNPVATEQYGSVCSTENHQRFGSNRA

SEQ ID NO: 16200 - protein, 31 aa, Artificial Sequence
  Description of Artificial Sequence: Synthetic polypeptide
DEEEIRTTNPVATEQYGSVCSTENHQSFGDR

SEQ ID NO: 16201 - protein, 29 aa, Artificial Sequence
  Description of Artificial Sequence: Synthetic peptide
DEAEIRTTNPVATNHYGSVSTNLQRTSNM

SEQ ID NO: 16202 - protein, 31 aa, Artificial Sequence
  Description of Artificial Sequence: Synthetic polypeptide
DEEEIRTTNPVATEQYGSVCSTENHQSGQRS

SEQ ID NO: 16203 - protein, 31 aa, Artificial Sequence
  Description of Artificial Sequence: Synthetic polypeptide
AEEEIRTTNPVATEQYGSVSSTNNNLQFGNF

SEQ ID NO: 16204 - protein, 33 aa, Artificial Sequence
  Description of Artificial Sequence: Synthetic polypeptide
DEEEIRTTNPVATEQYGSVCSTENLNQHGSNRA

SEQ ID NO: 16205 - protein, 30 aa, Artificial Sequence
  Description of Artificial Sequence: Synthetic polypeptide
DEDEIRTTNPVATEQYGSVATNLQDGMNEM

SEQ ID NO: 16206 - protein, 31 aa, Artificial Sequence
  Description of Artificial Sequence: Synthetic polypeptide
DEEEIRTTNPVATEQYGTSVSTNLARFGSDD

SEQ ID NO: 16207 - protein, 31 aa, Artificial Sequence
  Description of Artificial Sequence: Synthetic polypeptide
AEEEIRTTNPVATEQYGSVSSTNNLQYGNES

SEQ ID NO: 16208 - protein, 32 aa, Artificial Sequence
  Description of Artificial Sequence: Synthetic polypeptide
DEEEIRTTNPVATEQYGSVCSTENLQGGSNDY

SEQ ID NO: 16209 - protein, 32 aa, Artificial Sequence
  Description of Artificial Sequence: Synthetic polypeptide
DEEEIRTTNPVATEQYGSVCSTENLQQGLNLE

SEQ ID NO: 16210 - protein, 33 aa, Artificial Sequence
  Description of Artificial Sequence: Synthetic polypeptide
DEEEIRTTNPVATEQYGSVCSTENLQSFGNNNR

SEQ ID NO: 16211 - protein, 31 aa, Artificial Sequence
  Description of Artificial Sequence: Synthetic polypeptide
DEEEIRTTNPVATEQYGSVSTTNLQGVVNEH

SEQ ID NO: 16212 - protein, 32 aa, Artificial Sequence
  Description of Artificial Sequence: Synthetic polypeptide
DEEEIRTTNPVATEQYGSVCSTENLQYGSNAS

SEQ ID NO: 16213 - protein, 32 aa, Artificial Sequence
  Description of Artificial Sequence: Synthetic polypeptide
DEEEIRTTNPVATEAYGCTVSCTGNLQRPGNR

SEQ ID NO: 16214 - protein, 30 aa, Artificial Sequence
  Description of Artificial Sequence: Synthetic polypeptide
DENAIRTTNPVATEQYGSVSTNLTRGSNQM

SEQ ID NO: 16215 - protein, 28 aa, Artificial Sequence
  Description of Artificial Sequence: Synthetic peptide
DENAIRTTNPVATEQYGSTSTNLIITNR

SEQ ID NO: 16216 - protein, 28 aa, Artificial Sequence
  Description of Artificial Sequence: Synthetic peptide
DENAIRTTNPVATEQYGSFSTNLIIGGR

SEQ ID NO: 16217 - protein, 32 aa, Artificial Sequence
  Description of Artificial Sequence: Synthetic polypeptide
DEEEIRTTNPVATEAYGCVSCTNELQRGGNER

SEQ ID NO: 16218 - protein, 31 aa, Artificial Sequence
  Description of Artificial Sequence: Synthetic polypeptide
DEEEIRTTNPVATEQYGSWSESPNGLQRDNR

SEQ ID NO: 16219 - protein, 32 aa, Artificial Sequence
  Description of Artificial Sequence: Synthetic polypeptide
DEEEIRTTNPVATEQYGSVSNTNLQMNGNVGG

SEQ ID NO: 16220 - protein, 32 aa, Artificial Sequence
  Description of Artificial Sequence: Synthetic polypeptide
DEEEIRTTNPVATEAYGCVSCTNLSQRGDSNR

SEQ ID NO: 16221 - protein, 28 aa, Artificial Sequence
  Description of Artificial Sequence: Synthetic peptide
DEEEIATTNPVAYEPYGSVATNLQQGNL

SEQ ID NO: 16222 - protein, 28 aa, Artificial Sequence
  Description of Artificial Sequence: Synthetic peptide
DEAEIRTTNPVAVEQYGSISTPLERENR

SEQ ID NO: 16223 - protein, 31 aa, Artificial Sequence
  Description of Artificial Sequence: Synthetic polypeptide
DEMEISTTNPVATEQYGCVSTNLQERGSNRS

SEQ ID NO: 16224 - protein, 31 aa, Artificial Sequence
  Description of Artificial Sequence: Synthetic polypeptide
DEEEIRTTNPVATEQYGSVSDTDLYQRSQTR

SEQ ID NO: 16225 - protein, 32 aa, Artificial Sequence
  Description of Artificial Sequence: Synthetic polypeptide
DEEEIRTTNPVATEQYGSVSTTNLQEVGEDRD

SEQ ID NO: 16226 - protein, 29 aa, Artificial Sequence
  Description of Artificial Sequence: Synthetic peptide
CEMEIRTTNPVATEQYGSVCSTNLQGGEQ

SEQ ID NO: 16227 - protein, 31 aa, Artificial Sequence
  Description of Artificial Sequence: Synthetic polypeptide
DEEEIRTTNPVATEQYGTCVSTINPLQRENF

SEQ ID NO: 16228 - protein, 29 aa, Artificial Sequence
  Description of Artificial Sequence: Synthetic peptide
CEMEIRTTNPVATEQYGSVSTNLQFGSDQ

SEQ ID NO: 16229 - protein, 29 aa, Artificial Sequence
  Description of Artificial Sequence: Synthetic peptide
DEEEIRTTNPVATEQYGSVNTNLGLGEVE

SEQ ID NO: 16230 - protein, 32 aa, Artificial Sequence
  Description of Artificial Sequence: Synthetic polypeptide
DEEEIRTTNPVATEQYGSVSNTNLQPGGNTME

SEQ ID NO: 16231 - protein, 31 aa, Artificial Sequence
  Description of Artificial Sequence: Synthetic polypeptide
AEEEIRTTNPVATEQYGSVSSTNTLNQGGNF

SEQ ID NO: 16232 - protein, 32 aa, Artificial Sequence
  Description of Artificial Sequence: Synthetic polypeptide
DEEEIRTTNPVATEQYGSWSMTENLSQRIGSR

SEQ ID NO: 16233 - protein, 30 aa, Artificial Sequence
  Description of Artificial Sequence: Synthetic polypeptide
AEEEIRTTNPVATEQYGSVSSTNSQIGGNQ

SEQ ID NO: 16234 - protein, 28 aa, Artificial Sequence
  Description of Artificial Sequence: Synthetic peptide
DENEIATTNPVATEQYGSVAMNLQMGNH

SEQ ID NO: 16235 - protein, 30 aa, Artificial Sequence
  Description of Artificial Sequence: Synthetic polypeptide
DEEEIRTTNPVATEQYGSWSLPNSLQIDNR

SEQ ID NO: 16236 - protein, 30 aa, Artificial Sequence
  Description of Artificial Sequence: Synthetic polypeptide
AEEEIRTTNPVATEQYGSVSSTNTQANGNG

SEQ ID NO: 16237 - protein, 32 aa, Artificial Sequence
  Description of Artificial Sequence: Synthetic polypeptide
DEEEIRTTNPVATEQYGSVSNTNLQNSGANVQ

SEQ ID NO: 16238 - protein, 30 aa, Artificial Sequence
  Description of Artificial Sequence: Synthetic polypeptide
DEEEIRTTNPVATEQYGSVCSSELQYGNVS

SEQ ID NO: 16239 - protein, 29 aa, Artificial Sequence
  Description of Artificial Sequence: Synthetic peptide
DEDEIRTTNPVATEQYGNVTSTNLQLGTS

SEQ ID NO: 16240 - protein, 30 aa, Artificial Sequence
  Description of Artificial Sequence: Synthetic polypeptide
DEAEIATTNPVAYEQYGSVSTNLQRGQNDM

SEQ ID NO: 16241 - protein, 29 aa, Artificial Sequence
  Description of Artificial Sequence: Synthetic peptide
DENEIATTNPVATEQYGSCSTNPQRDGGR

SEQ ID NO: 16242 - protein, 30 aa, Artificial Sequence
  Description of Artificial Sequence: Synthetic polypeptide
DEEEIRTTNPVATEQYGTFSTINELQRENN

SEQ ID NO: 16243 - protein, 32 aa, Artificial Sequence
  Description of Artificial Sequence: Synthetic polypeptide
DEEEIRTTNPVATEQYGSVSTTNLDQNTGGNI

SEQ ID NO: 16244 - protein, 31 aa, Artificial Sequence
  Description of Artificial Sequence: Synthetic polypeptide
DEEEIRTTNPVATEQYGSVSSTEPALNRGNV

SEQ ID NO: 16245 - protein, 32 aa, Artificial Sequence
  Description of Artificial Sequence: Synthetic polypeptide
DEEEIRTTNPVATEQYGSVSTTNLDQTRGDEG

SEQ ID NO: 16246 - protein, 31 aa, Artificial Sequence
  Description of Artificial Sequence: Synthetic polypeptide
DEEEIRTTNPVATEQYGSVCSSNLQRFNQNQ

SEQ ID NO: 16247 - protein, 31 aa, Artificial Sequence
  Description of Artificial Sequence: Synthetic polypeptide
DEEEIRTTNPVATEQYGSVSDTENVQGDGNI

SEQ ID NO: 16248 - protein, 30 aa, Artificial Sequence
  Description of Artificial Sequence: Synthetic polypeptide
AEEEIRTTNPVATEQYGSVSSTNSQAGNTE

SEQ ID NO: 16249 - protein, 28 aa, Artificial Sequence
  Description of Artificial Sequence: Synthetic peptide
DENEIATTNPVATEQYGDVSENLQSGNQ

SEQ ID NO: 16250 - protein, 31 aa, Artificial Sequence
  Description of Artificial Sequence: Synthetic polypeptide
YESEIRTTNPVATEQYGSVSTNLQRGLNQTV

SEQ ID NO: 16251 - protein, 29 aa, Artificial Sequence
  Description of Artificial Sequence: Synthetic peptide
DEEEIRTTNPVATEQYGSVSDTLSDHGNE

SEQ ID NO: 16252 - protein, 29 aa, Artificial Sequence
  Description of Artificial Sequence: Synthetic peptide
DEEEIRTTNPVATEQYGSVSTTNDRGVGL

SEQ ID NO: 16253 - protein, 28 aa, Artificial Sequence
  Description of Artificial Sequence: Synthetic peptide
DENEIATTNPVATEQYGSVSMNLQQNNE

SEQ ID NO: 16254 - protein, 31 aa, Artificial Sequence
  Description of Artificial Sequence: Synthetic polypeptide
DEEEIRTTNPVATEQYGSVSDTNGGQRGELI

SEQ ID NO: 16255 - protein, 31 aa, Artificial Sequence
  Description of Artificial Sequence: Synthetic polypeptide
DEEEIRTTNPVATEQYGSVSTTNEDSAAGNR

SEQ ID NO: 16256 - protein, 30 aa, Artificial Sequence
  Description of Artificial Sequence: Synthetic polypeptide
DEEEIRTTNPVATEQYGSVSDTNGGQFGEF

SEQ ID NO: 16257 - protein, 29 aa, Artificial Sequence
  Description of Artificial Sequence: Synthetic peptide
DEEEIRTTNPVATEQYGSVNTNLMDGEMI

SEQ ID NO: 16258 - protein, 31 aa, Artificial Sequence
  Description of Artificial Sequence: Synthetic polypeptide
AEEEIRTTNPVATEQYGSVSSTSNLQNNGNQ

SEQ ID NO: 16259 - protein, 31 aa, Artificial Sequence
  Description of Artificial Sequence: Synthetic polypeptide
DEEEIRTTNPVATEQYGSVSDTNDQEGGGNE

SEQ ID NO: 16260 - protein, 30 aa, Artificial Sequence
  Description of Artificial Sequence: Synthetic polypeptide
AEEEIRTTNPVATEQYGSVSSTSNAQNGNN

SEQ ID NO: 16261 - protein, 32 aa, Artificial Sequence
  Description of Artificial Sequence: Synthetic polypeptide
DEEEIRTTNPVATEQYGSVSDTNDLTRNGDRE

SEQ ID NO: 16262 - protein, 29 aa, Artificial Sequence
  Description of Artificial Sequence: Synthetic peptide
DENEIATTNPVATEQYGSVATNGQRGNDL

SEQ ID NO: 16263 - protein, 29 aa, Artificial Sequence
  Description of Artificial Sequence: Synthetic peptide
AEEEIRTTNPVATEQYGSVSSTSLNEANR

SEQ ID NO: 16264 - protein, 31 aa, Artificial Sequence
  Description of Artificial Sequence: Synthetic polypeptide
DENEIATTNPVATEQYGSVDSTDLVQRGENR

SEQ ID NO: 16265 - protein, 31 aa, Artificial Sequence
  Description of Artificial Sequence: Synthetic polypeptide
AEEEIRTTNPVATEQYGSVSSTQNLNQGGNA

SEQ ID NO: 16266 - protein, 30 aa, Artificial Sequence
  Description of Artificial Sequence: Synthetic polypeptide
DEEEIRTTNPVATEQYGSVSTTNGGQIGQT

SEQ ID NO: 16267 - protein, 31 aa, Artificial Sequence
  Description of Artificial Sequence: Synthetic polypeptide
DEEEIRTTNPVATEQYGSVSDTNAEQNPGNQ

SEQ ID NO: 16268 - protein, 32 aa, Artificial Sequence
  Description of Artificial Sequence: Synthetic polypeptide
DEEEIRTTNPVATEQYGSVCSPTNLNQRIERI

SEQ ID NO: 16269 - protein, 31 aa, Artificial Sequence
  Description of Artificial Sequence: Synthetic polypeptide
DEEEIRTTNPVATEQYGSVCSPTNLNREERN

SEQ ID NO: 16270 - protein, 31 aa, Artificial Sequence
  Description of Artificial Sequence: Synthetic polypeptide
DEEEIRTTNPVATEQYGSVSTTNGIQEIGNQ

SEQ ID NO: 16271 - protein, 30 aa, Artificial Sequence
  Description of Artificial Sequence: Synthetic polypeptide
AEEEIRTTNPVATEQYGSVSSTQNEQQGNV

SEQ ID NO: 16272 - protein, 31 aa, Artificial Sequence
  Description of Artificial Sequence: Synthetic polypeptide
DEEEIRTTNPVATEQYGSVCSPTNLQVDERI

SEQ ID NO: 16273 - protein, 31 aa, Artificial Sequence
  Description of Artificial Sequence: Synthetic polypeptide
DEEEIRTTNPVATEQYGSWSPPNMLQRDNRQ

SEQ ID NO: 16274 - protein, 30 aa, Artificial Sequence
  Description of Artificial Sequence: Synthetic polypeptide
DEEEIRTTNPVATEQYGSVSTTNGGQAGEN

SEQ ID NO: 16275 - protein, 32 aa, Artificial Sequence
  Description of Artificial Sequence: Synthetic polypeptide
DEEEIRTTNPVATEQYGSVCSSTNLQRMQNDQ

SEQ ID NO: 16276 - protein, 30 aa, Artificial Sequence
  Description of Artificial Sequence: Synthetic polypeptide
SESEIRTTNPVATEQYGSVSCNLPMDRGNR

SEQ ID NO: 16277 - protein, 32 aa, Artificial Sequence
  Description of Artificial Sequence: Synthetic polypeptide
DEEEIRTTNPVATEQYGSVSTTNLEQIGIERT

SEQ ID NO: 16278 - protein, 30 aa, Artificial Sequence
  Description of Artificial Sequence: Synthetic polypeptide
DEEEIRTTNPVATEQYGSVSDTEDLQEGIQ

SEQ ID NO: 16279 - protein, 29 aa, Artificial Sequence
  Description of Artificial Sequence: Synthetic peptide
DENEIATTNPVATECYGSVSCNEPQRGNR

SEQ ID NO: 16280 - protein, 31 aa, Artificial Sequence
  Description of Artificial Sequence: Synthetic polypeptide
DEEEIRTTNPVATEQYGTISTINPLQREGNQ

SEQ ID NO: 16281 - protein, 30 aa, Artificial Sequence
  Description of Artificial Sequence: Synthetic polypeptide
DEDEIRTTNPVATEQYGSCSTNEQREGGDR

SEQ ID NO: 16282 - protein, 30 aa, Artificial Sequence
  Description of Artificial Sequence: Synthetic polypeptide
DEEEIRTTNPVATEQYGTISTINPLQRVNV

SEQ ID NO: 16283 - protein, 32 aa, Artificial Sequence
  Description of Artificial Sequence: Synthetic polypeptide
DEEEIRTTNPVATEQYGSVSDTDSLGQRNQNR

SEQ ID NO: 16284 - protein, 30 aa, Artificial Sequence
  Description of Artificial Sequence: Synthetic polypeptide
DEEEIRTTNPVATEQYGSVCSTEHQGGNQS

SEQ ID NO: 16285 - protein, 30 aa, Artificial Sequence
  Description of Artificial Sequence: Synthetic polypeptide
DEEEIRTTNPVATEQYGTNSTINNLQRENE

SEQ ID NO: 16286 - protein, 29 aa, Artificial Sequence
  Description of Artificial Sequence: Synthetic peptide
DEDEIRTTNPVATEQYGSISTNTQTEGLR

SEQ ID NO: 16287 - protein, 31 aa, Artificial Sequence
  Description of Artificial Sequence: Synthetic polypeptide
DEEEIRTTNPVATEQYGSVSTTNLQAIGLQE

SEQ ID NO: 16288 - protein, 32 aa, Artificial Sequence
  Description of Artificial Sequence: Synthetic polypeptide
DEEEIRTTNPVATEQYGSVSTTNLLQGGGENT

SEQ ID NO: 16289 - protein, 30 aa, Artificial Sequence
  Description of Artificial Sequence: Synthetic polypeptide
DEEEIRTTNPVATEQYGTNSTQNPLQRENN

SEQ ID NO: 16290 - protein, 33 aa, Artificial Sequence
  Description of Artificial Sequence: Synthetic polypeptide
DEEEIRTTNPVATEQYGSVSTTNLQAVFGNPRQ

SEQ ID NO: 16291 - protein, 32 aa, Artificial Sequence
  Description of Artificial Sequence: Synthetic polypeptide
DEDEIRTTNPVATEQYGSLVSCTNLSQRGETR

SEQ ID NO: 16292 - protein, 32 aa, Artificial Sequence
  Description of Artificial Sequence: Synthetic polypeptide
DEEEIRTTNPVATEQYGSVSTTNLQEDGFNDT

SEQ ID NO: 16293 - protein, 33 aa, Artificial Sequence
  Description of Artificial Sequence: Synthetic polypeptide
DEEEIRTTNPVATEQYGSVSNTNNTLDERGNRN

SEQ ID NO: 16294 - protein, 28 aa, Artificial Sequence
  Description of Artificial Sequence: Synthetic peptide
DEAEIRTTNPVAVEQYGSTSTNLNRTNN

SEQ ID NO: 16295 - protein, 30 aa, Artificial Sequence
  Description of Artificial Sequence: Synthetic polypeptide
DEEEIRTTNPVATEQYGTQSTINPLQRQNN

SEQ ID NO: 16296 - protein, 30 aa, Artificial Sequence
  Description of Artificial Sequence: Synthetic polypeptide
DEEEIRTTNPVATEQYGSVNTNDQQDGAND

SEQ ID NO: 16297 - protein, 28 aa, Artificial Sequence
  Description of Artificial Sequence: Synthetic peptide
DEAEIRTTNPVAVEQYGSTSTNLELVNR

SEQ ID NO: 16298 - protein, 32 aa, Artificial Sequence
  Description of Artificial Sequence: Synthetic polypeptide
DEEEIRTTNPVATEQYGSVSLTNPLQRGELLI

SEQ ID NO: 16299 - protein, 31 aa, Artificial Sequence
  Description of Artificial Sequence: Synthetic polypeptide
DEEEIRTTNPVATEQYGSVSTTNLQELGLDQ

SEQ ID NO: 16300 - protein, 29 aa, Artificial Sequence
  Description of Artificial Sequence: Synthetic peptide
DEAEIRTTNPVAWEQYGSISTNLEERPNR

SEQ ID NO: 16301 - protein, 28 aa, Artificial Sequence
  Description of Artificial Sequence: Synthetic peptide
DENEIATTNPVATECYGSVSTDLQHGER

SEQ ID NO: 16302 - protein, 32 aa, Artificial Sequence
  Description of Artificial Sequence: Synthetic polypeptide
DEEEIRTTNPVATEQYGSVSTTNLIQGNGNTG

SEQ ID NO: 16303 - protein, 30 aa, Artificial Sequence
  Description of Artificial Sequence: Synthetic polypeptide
DEEEIRTTNPVATEQYGSVSTTNLGTRNQE

SEQ ID NO: 16304 - protein, 31 aa, Artificial Sequence
  Description of Artificial Sequence: Synthetic polypeptide
DEEEIRTTNPVATEQYGSWSLPNNLQRDNRD

SEQ ID NO: 16305 - protein, 32 aa, Artificial Sequence
  Description of Artificial Sequence: Synthetic polypeptide
DEEEIRTTNPVATEQYGSVSTTNLEQRGEELN

SEQ ID NO: 16306 - protein, 29 aa, Artificial Sequence
  Description of Artificial Sequence: Synthetic peptide
DEAEICTTNPVATECYGSVSTNLQDGNTN

SEQ ID NO: 16307 - protein, 32 aa, Artificial Sequence
  Description of Artificial Sequence: Synthetic polypeptide
DEEEIRTTNPVATEQYGSVCSTALQNFGSNRQ

SEQ ID NO: 16308 - protein, 28 aa, Artificial Sequence
  Description of Artificial Sequence: Synthetic peptide
YESEIRTTNPVATEQYGSVHTYLQRGEI

SEQ ID NO: 16309 - protein, 32 aa, Artificial Sequence
  Description of Artificial Sequence: Synthetic polypeptide
YESEIRTTNPVATEQYGSVDSTPNLQRQGSNR

SEQ ID NO: 16310 - protein, 30 aa, Artificial Sequence
  Description of Artificial Sequence: Synthetic polypeptide
DEEEIRTTNPVATEQYGSVNTNIDRENNRV

SEQ ID NO: 16311 - protein, 28 aa, Artificial Sequence
  Description of Artificial Sequence: Synthetic peptide
DENEIATTNPVATEQYGDVSDNLQSGNQ

SEQ ID NO: 16312 - protein, 30 aa, Artificial Sequence
  Description of Artificial Sequence: Synthetic polypeptide
AEEEIRTTNPVATEQYGSVSSTNQQDEGNQ

SEQ ID NO: 16313 - protein, 32 aa, Artificial Sequence
  Description of Artificial Sequence: Synthetic polypeptide
DEEEIRTTNPVATEQYGSVSNTNNLQGTSGNL

SEQ ID NO: 16314 - protein, 28 aa, Artificial Sequence
  Description of Artificial Sequence: Synthetic peptide
DEECIATVNPVATEHYGSVSINLERGNR

SEQ ID NO: 16315 - protein, 31 aa, Artificial Sequence
  Description of Artificial Sequence: Synthetic polypeptide
DEEEIRTTNPVATEAYGCAVSTNLQRFGSER

SEQ ID NO: 16316 - protein, 29 aa, Artificial Sequence
  Description of Artificial Sequence: Synthetic peptide
DEEEIRTTNPVATEQYGSVNTNHQLDEQR

SEQ ID NO: 16317 - protein, 31 aa, Artificial Sequence
  Description of Artificial Sequence: Synthetic polypeptide
AEEEIRTTNPVATEQYGSVSSTNQLQAGAND

SEQ ID NO: 16318 - protein, 32 aa, Artificial Sequence
  Description of Artificial Sequence: Synthetic polypeptide
DEEEIRTTNPVATEQYGSVSTTNLERNGNDFD

SEQ ID NO: 16319 - protein, 33 aa, Artificial Sequence
  Description of Artificial Sequence: Synthetic polypeptide
DEEEIRTTNPVATEQYGSVCSTDNDLQRGENSL

SEQ ID NO: 16320 - protein, 30 aa, Artificial Sequence
  Description of Artificial Sequence: Synthetic polypeptide
SESEIRTTNPVATEQYGSVSENLPMDRGNR

SEQ ID NO: 16321 - protein, 33 aa, Artificial Sequence
  Description of Artificial Sequence: Synthetic polypeptide
DEEEIRTTNPVATEQYGSVCSTDNDLQRGVNML

SEQ ID NO: 16322 - protein, 32 aa, Artificial Sequence
  Description of Artificial Sequence: Synthetic polypeptide
DEEEIRTTNPVATEQYGSVSTTNLETRGNQEG

SEQ ID NO: 16323 - protein, 30 aa, Artificial Sequence
  Description of Artificial Sequence: Synthetic polypeptide
DEEEIRTTNPVATEQYGSVNTNHIQREDNN

SEQ ID NO: 16324 - protein, 33 aa, Artificial Sequence
  Description of Artificial Sequence: Synthetic polypeptide
DEEEIRTTNPVATEQYGSVCSTEALQRGSNDRV

SEQ ID NO: 16325 - protein, 32 aa, Artificial Sequence
  Description of Artificial Sequence: Synthetic polypeptide
DEEEIRTTNPVATEQYGSVSNTNLQNGGNVTT

SEQ ID NO: 16326 - protein, 31 aa, Artificial Sequence
  Description of Artificial Sequence: Synthetic polypeptide
AEEEIRTTNPVATEQYGSVSSTNNSQEGENR

SEQ ID NO: 16327 - protein, 28 aa, Artificial Sequence
  Description of Artificial Sequence: Synthetic peptide
DENEIACTNPVATEQYGTVSENLQFGNR

SEQ ID NO: 16328 - protein, 30 aa, Artificial Sequence
  Description of Artificial Sequence: Synthetic polypeptide
DEAEIRTTNPVATEVYGSVSTNLQGGGDND

SEQ ID NO: 16329 - protein, 31 aa, Artificial Sequence
  Description of Artificial Sequence: Synthetic polypeptide
DEEEIRTTNPVATEQYGSVSNTNVQRVGVVI

SEQ ID NO: 16330 - protein, 31 aa, Artificial Sequence
  Description of Artificial Sequence: Synthetic polypeptide
DEEEIRTTNPVATEGYGSVSTMNLQAVGNGG

SEQ ID NO: 16331 - protein, 28 aa, Artificial Sequence
  Description of Artificial Sequence: Synthetic peptide
DEAEIRTTNPVATEQYGVVSTHLQSPND

SEQ ID NO: 16332 - protein, 32 aa, Artificial Sequence
  Description of Artificial Sequence: Synthetic polypeptide
DEEEIRTTNPVATEQYGSVSTTNLQTGNELND

SEQ ID NO: 16333 - protein, 32 aa, Artificial Sequence
  Description of Artificial Sequence: Synthetic polypeptide
DEEEIRTTNPVATEQYGSVSDPNLQERGDVRD

SEQ ID NO: 16334 - protein, 31 aa, Artificial Sequence
  Description of Artificial Sequence: Synthetic polypeptide
AEEEIRTTNPVATEQYGSVSSTNLQIGGNED

SEQ ID NO: 16335 - protein, 33 aa, Artificial Sequence
  Description of Artificial Sequence: Synthetic polypeptide
DEEEIRTTNPVATEQYGSVSLTPNPLQRGENGQ

SEQ ID NO: 16336 - protein, 30 aa, Artificial Sequence
  Description of Artificial Sequence: Synthetic polypeptide
AEEEIRTTNPVATEQYGSVSSTNLQGTGTI

SEQ ID NO: 16337 - protein, 30 aa, Artificial Sequence
  Description of Artificial Sequence: Synthetic polypeptide
DEEEIRTTNPVATEQYGTVCSTNPQSGNQL

SEQ ID NO: 16338 - protein, 31 aa, Artificial Sequence
  Description of Artificial Sequence: Synthetic polypeptide
AEEEIRTTNPVATEQYGSVSSTNLQGQGTNP

SEQ ID NO: 16339 - protein, 30 aa, Artificial Sequence
  Description of Artificial Sequence: Synthetic polypeptide
DEEEIRTTNPVATEQYGSVPPTNLIRGLQD

SEQ ID NO: 16340 - protein, 33 aa, Artificial Sequence
  Description of Artificial Sequence: Synthetic polypeptide
DEEEIRTTNPVATEQYGSVSNTPLGQRFGSNRD

SEQ ID NO: 16341 - protein, 32 aa, Artificial Sequence
  Description of Artificial Sequence: Synthetic polypeptide
DEEEIRTTNPVATEQYGSVSNTPGLMMRGNER

SEQ ID NO: 16342 - protein, 31 aa, Artificial Sequence
  Description of Artificial Sequence: Synthetic polypeptide
DEEEIRTTNPVATEQYGSVYTVNLEQRGEEE

SEQ ID NO: 16343 - protein, 31 aa, Artificial Sequence
  Description of Artificial Sequence: Synthetic polypeptide
DEMEIRTTNPVATEQYGSVSTNLERFGSNQN

SEQ ID NO: 16344 - protein, 32 aa, Artificial Sequence
  Description of Artificial Sequence: Synthetic polypeptide
DEEEIRTTNPVATEQYGSVSDPNLQEREGDGR

SEQ ID NO: 16345 - protein, 29 aa, Artificial Sequence
  Description of Artificial Sequence: Synthetic peptide
DEEEIRTTNPVATEQYGSVNTELDRGEHE

SEQ ID NO: 16346 - protein, 30 aa, Artificial Sequence
  Description of Artificial Sequence: Synthetic polypeptide
DEAEIRTTNPVATEQYGVVSCTSLQRPGND

SEQ ID NO: 16347 - protein, 32 aa, Artificial Sequence
  Description of Artificial Sequence: Synthetic polypeptide
DEEEIRTTNPVATEQYGSVCSTMNLQHGSEFR

SEQ ID NO: 16348 - protein, 31 aa, Artificial Sequence
  Description of Artificial Sequence: Synthetic polypeptide
DEEEIRTTNPVATEQYGTVESGTNLQGGNIF

SEQ ID NO: 16349 - protein, 31 aa, Artificial Sequence
  Description of Artificial Sequence: Synthetic polypeptide
DEEEIRTTNPVATEGYGSVSTNDLQNGSDRG

SEQ ID NO: 16350 - protein, 30 aa, Artificial Sequence
  Description of Artificial Sequence: Synthetic polypeptide
DEMEIRTTNPVATEQYGSVSTNDQMGNEEQ

SEQ ID NO: 16351 - protein, 30 aa, Artificial Sequence
  Description of Artificial Sequence: Synthetic polypeptide
DEEEIRTTNPVATEQYGSVSDPLDQRGGEI

SEQ ID NO: 16352 - protein, 31 aa, Artificial Sequence
  Description of Artificial Sequence: Synthetic polypeptide
AEEEIRTTNPVATEQYGSVSSTNLQENGNPG

SEQ ID NO: 16353 - protein, 31 aa, Artificial Sequence
  Description of Artificial Sequence: Synthetic polypeptide
DEEEIRTTNPVATEGYGSVSTNDHQNGSNRS

SEQ ID NO: 16354 - protein, 28 aa, Artificial Sequence
  Description of Artificial Sequence: Synthetic peptide
SETEIRCTNPIATEQYGSVSENLMRGNR

SEQ ID NO: 16355 - protein, 30 aa, Artificial Sequence
  Description of Artificial Sequence: Synthetic polypeptide
AEEEIRTTNPVATEQYGSVSSTNLQINENG

SEQ ID NO: 16356 - protein, 31 aa, Artificial Sequence
  Description of Artificial Sequence: Synthetic polypeptide
AEEEIRTTNPVATEQYGSVSSTNLQLGTNPE

SEQ ID NO: 16357 - protein, 28 aa, Artificial Sequence
  Description of Artificial Sequence: Synthetic peptide
DEAEIRTTNPVATEQYGVVSTPLQNPNQ

SEQ ID NO: 16358 - protein, 31 aa, Artificial Sequence
  Description of Artificial Sequence: Synthetic polypeptide
AEEEIRTTNPVATEQYGSVSSTNLQNIGNLI

SEQ ID NO: 16359 - protein, 30 aa, Artificial Sequence
  Description of Artificial Sequence: Synthetic polypeptide
DEAEIRTTNPVATEQYGVVSTNLQIGDNDL

SEQ ID NO: 16360 - protein, 33 aa, Artificial Sequence
  Description of Artificial Sequence: Synthetic polypeptide
DEEEIRTTNPVATEQYGSVCSTMNDLQRGSENQ

SEQ ID NO: 16361 - protein, 31 aa, Artificial Sequence
  Description of Artificial Sequence: Synthetic polypeptide
DEMEIRTTNPVATEQYGSVSTPNDEQRGERN

SEQ ID NO: 16362 - protein, 29 aa, Artificial Sequence
  Description of Artificial Sequence: Synthetic peptide
DEAEIRTTNPVATEQYGVVSTNLQHGDAH

SEQ ID NO: 16363 - protein, 29 aa, Artificial Sequence
  Description of Artificial Sequence: Synthetic peptide
DEAEIRTTNPVATEQYGVVSTNLQHEGDH

SEQ ID NO: 16364 - protein, 31 aa, Artificial Sequence
  Description of Artificial Sequence: Synthetic polypeptide
AEEEIRTTNPVATEQYGSVSSTNLQNGVNDD

SEQ ID NO: 16365 - protein, 32 aa, Artificial Sequence
  Description of Artificial Sequence: Synthetic polypeptide
DEEEIRTTNPVATEQYGSVSSPNDLQRDNIRA

SEQ ID NO: 16366 - protein, 31 aa, Artificial Sequence
  Description of Artificial Sequence: Synthetic polypeptide
AEEEIRTTNPVATEQYGSVSSTNLQMGSNGG

SEQ ID NO: 16367 - protein, 30 aa, Artificial Sequence
  Description of Artificial Sequence: Synthetic polypeptide
AEEEIRTTNPVATEQYGSVSSTNLQLGAAT

SEQ ID NO: 16368 - protein, 29 aa, Artificial Sequence
  Description of Artificial Sequence: Synthetic peptide
DEMEIRTTNPVATEQYGSVSTPLNNREDR

SEQ ID NO: 16369 - protein, 31 aa, Artificial Sequence
  Description of Artificial Sequence: Synthetic polypeptide
DEEEIRTTNPVATEQYGSVCSTMNHQGGNQV

SEQ ID NO: 16370 - protein, 31 aa, Artificial Sequence
  Description of Artificial Sequence: Synthetic polypeptide
AEEEIRTTNPVATEQYGSVSSTNLQMGGNGE

SEQ ID NO: 16371 - protein, 31 aa, Artificial Sequence
  Description of Artificial Sequence: Synthetic polypeptide
DEEEIRTTNPVATEQYGSVYVPNLQRTIINR

SEQ ID NO: 16372 - protein, 30 aa, Artificial Sequence
  Description of Artificial Sequence: Synthetic polypeptide
DEAEIRTTNPVATEQYGVVSTNHQRNSNRT

SEQ ID NO: 16373 - protein, 32 aa, Artificial Sequence
  Description of Artificial Sequence: Synthetic polypeptide
DEEEIRTTNPVATEQYGTVCSTNLQFFGNNRQ

SEQ ID NO: 16374 - protein, 31 aa, Artificial Sequence
  Description of Artificial Sequence: Synthetic polypeptide
DEEEIRTTNPVATEQYGSVSSNWLQNGSNDM

SEQ ID NO: 16375 - protein, 31 aa, Artificial Sequence
  Description of Artificial Sequence: Synthetic polypeptide
AEEEIRTTNPVATEQYGSVSSTNLQLNGVNA

SEQ ID NO: 16376 - protein, 30 aa, Artificial Sequence
  Description of Artificial Sequence: Synthetic polypeptide
DEMEIRTTNPVATEQYGSVSTNPVEREGND

SEQ ID NO: 16377 - protein, 31 aa, Artificial Sequence
  Description of Artificial Sequence: Synthetic polypeptide
DEEEIACTNPVATEQYGSVSTNPLQNRMGNL

SEQ ID NO: 16378 - protein, 31 aa, Artificial Sequence
  Description of Artificial Sequence: Synthetic polypeptide
AEEEIRTTNPVATEQYGSVSSTNLQLNGNPS

SEQ ID NO: 16379 - protein, 30 aa, Artificial Sequence
  Description of Artificial Sequence: Synthetic polypeptide
DEAEIRTTNPVATEQYGVVSTNLQGDGNNP

SEQ ID NO: 16380 - protein, 31 aa, Artificial Sequence
  Description of Artificial Sequence: Synthetic polypeptide
DEMEIRTTNPVATEQYGSVSTNDHQEGGNRV

SEQ ID NO: 16381 - protein, 28 aa, Artificial Sequence
  Description of Artificial Sequence: Synthetic peptide
DEMEIRTTNPVATEQYGSVSTNDEMGEE

SEQ ID NO: 16382 - protein, 31 aa, Artificial Sequence
  Description of Artificial Sequence: Synthetic polypeptide
DEEEIRTTNPVATEGYGSVSTNLQAGGNNPN

SEQ ID NO: 16383 - protein, 30 aa, Artificial Sequence
  Description of Artificial Sequence: Synthetic polypeptide
DEEEIRTTNPVATEQYGSVSSNLTQGGDTL

SEQ ID NO: 16384 - protein, 32 aa, Artificial Sequence
  Description of Artificial Sequence: Synthetic polypeptide
DEEEIRTTNPVATEQYGSVSTTNLTRNGEDRE

SEQ ID NO: 16385 - protein, 33 aa, Artificial Sequence
  Description of Artificial Sequence: Synthetic polypeptide
DEEEIRTTNPVATEQYGSVCSTMNLQRGSNGIS

SEQ ID NO: 16386 - protein, 31 aa, Artificial Sequence
  Description of Artificial Sequence: Synthetic polypeptide
DEMEIRTTNPVATEQYGSVSPTNLERAGEQR

SEQ ID NO: 16387 - protein, 31 aa, Artificial Sequence
  Description of Artificial Sequence: Synthetic polypeptide
DEEEIRTTNPVATEQYGSVSTTNLVDGLEAR

SEQ ID NO: 16388 - protein, 32 aa, Artificial Sequence
  Description of Artificial Sequence: Synthetic polypeptide
DEEEIRTTNPVATEQYGTVSCTNELSQRTGSR

SEQ ID NO: 16389 - protein, 30 aa, Artificial Sequence
  Description of Artificial Sequence: Synthetic polypeptide
DEEEIATTNPVATETYGSVSTNLQSGGNNT

SEQ ID NO: 16390 - protein, 30 aa, Artificial Sequence
  Description of Artificial Sequence: Synthetic polypeptide
DEEEIRTTNPVATEQYGSVSSNLSQVSNFM

SEQ ID NO: 16391 - protein, 30 aa, Artificial Sequence
  Description of Artificial Sequence: Synthetic polypeptide
DEEEIATTNPVATETYGSVSTNLQSGGNAE

SEQ ID NO: 16392 - protein, 31 aa, Artificial Sequence
  Description of Artificial Sequence: Synthetic polypeptide
DEEEIRTTNPVATEQYGSVYTTNLQVAGNIY

SEQ ID NO: 16393 - protein, 30 aa, Artificial Sequence
  Description of Artificial Sequence: Synthetic polypeptide
DEEEIATTNPVATEVYGSVATNLQMDGNQR

SEQ ID NO: 16394 - protein, 29 aa, Artificial Sequence
  Description of Artificial Sequence: Synthetic peptide
ADEEIRTTNPVATEQWGSVTSTLLQRGQR

SEQ ID NO: 16395 - protein, 30 aa, Artificial Sequence
  Description of Artificial Sequence: Synthetic polypeptide
AEEEIRTTNPVATEQYGSVSSTNLNQGQNS

SEQ ID NO: 16396 - protein, 30 aa, Artificial Sequence
  Description of Artificial Sequence: Synthetic polypeptide
YENEIRTTNPVATEQYGSYSTNDLQNQGNR

SEQ ID NO: 16397 - protein, 30 aa, Artificial Sequence
  Description of Artificial Sequence: Synthetic polypeptide
DEEEIATTNPVATETYGSVSTNLQDGGNTH

SEQ ID NO: 16398 - protein, 31 aa, Artificial Sequence
  Description of Artificial Sequence: Synthetic polypeptide
DEMEIRTTNPVATEQYGSVSNTNLQRSGSQQ

SEQ ID NO: 16399 - protein, 30 aa, Artificial Sequence
  Description of Artificial Sequence: Synthetic polypeptide
DEAEIRTTNPVATEQYGTVSTNLQVGGDDR

SEQ ID NO: 16400 - protein, 31 aa, Artificial Sequence
  Description of Artificial Sequence: Synthetic polypeptide
YENEIRTTNPVATEQYGSVSVWNTLGQRGNR

SEQ ID NO: 16401 - protein, 31 aa, Artificial Sequence
  Description of Artificial Sequence: Synthetic polypeptide
DEAEIRTTNPVATEQYGTVSTNLQSDGGNIR

SEQ ID NO: 16402 - protein, 31 aa, Artificial Sequence
  Description of Artificial Sequence: Synthetic polypeptide
DEDEIRTTNPVATEQYGSVCTNLQGGENDRA

SEQ ID NO: 16403 - protein, 28 aa, Artificial Sequence
  Description of Artificial Sequence: Synthetic peptide
DEAEIATTNPVAYEQYGSISTNLERVNR

SEQ ID NO: 16404 - protein, 30 aa, Artificial Sequence
  Description of Artificial Sequence: Synthetic polypeptide
DEAEIRTTNPVATEQYGTVSTNLQNGDNNL

SEQ ID NO: 16405 - protein, 30 aa, Artificial Sequence
  Description of Artificial Sequence: Synthetic polypeptide
DEEEIATTNPVATETYGSVSTNLQGEGGNA

SEQ ID NO: 16406 - protein, 33 aa, Artificial Sequence
  Description of Artificial Sequence: Synthetic polypeptide
DEEEIRTTNPVATEAYGISVSVTNLSQRGGNRQ

SEQ ID NO: 16407 - protein, 29 aa, Artificial Sequence
  Description of Artificial Sequence: Synthetic peptide
DEEEIRTTNPVATEQYGSVSSNLYSVENI

SEQ ID NO: 16408 - protein, 31 aa, Artificial Sequence
  Description of Artificial Sequence: Synthetic polypeptide
DEEEIRTTNPVATEQYGTVNSTVNPLQRENN

SEQ ID NO: 16409 - protein, 30 aa, Artificial Sequence
  Description of Artificial Sequence: Synthetic polypeptide
DEEEIRTTNPVATEQYGTVISTNLVVGNGG

SEQ ID NO: 16410 - protein, 29 aa, Artificial Sequence
  Description of Artificial Sequence: Synthetic peptide
DEEEIATTNPVATEWYGSVSTNLQHDGDS

SEQ ID NO: 16411 - protein, 31 aa, Artificial Sequence
  Description of Artificial Sequence: Synthetic polypeptide
DEMEIRTTNPVATEQYGSVSTMNDMQGGNRN

SEQ ID NO: 16412 - protein, 33 aa, Artificial Sequence
  Description of Artificial Sequence: Synthetic polypeptide
DEEEIRTTNPVATEQYGSVSSNTNDLQERGEND

SEQ ID NO: 16413 - protein, 30 aa, Artificial Sequence
  Description of Artificial Sequence: Synthetic polypeptide
DEEEIATTNPVATEWYGSVSSTNLQDNGNE

SEQ ID NO: 16414 - protein, 30 aa, Artificial Sequence
  Description of Artificial Sequence: Synthetic polypeptide
DEEEIATTNPVATEVYGSVSTNLQVGGNNH

SEQ ID NO: 16415 - protein, 30 aa, Artificial Sequence
  Description of Artificial Sequence: Synthetic polypeptide
DEEEIATTNPVATEVYGSVSTNLQVGGNAQ

SEQ ID NO: 16416 - protein, 31 aa, Artificial Sequence
  Description of Artificial Sequence: Synthetic polypeptide
AEEEIRTTNPVATEQYGSVSSTNLQEGENED

SEQ ID NO: 16417 - protein, 30 aa, Artificial Sequence
  Description of Artificial Sequence: Synthetic polypeptide
DEEEIRTTNPVATEQYGTVITNLTQNGGND

SEQ ID NO: 16418 - protein, 30 aa, Artificial Sequence
  Description of Artificial Sequence: Synthetic polypeptide
AEEEIRTTNPVATEQYGSVSSTNLQEENQE

SEQ ID NO: 16419 - protein, 31 aa, Artificial Sequence
  Description of Artificial Sequence: Synthetic polypeptide
AEEEIRTTNPVATEQYGSVSSTNLQEEGNND

SEQ ID NO: 16420 - protein, 30 aa, Artificial Sequence
  Description of Artificial Sequence: Synthetic polypeptide
DEEEIATTNPVATEVYGSVSTNLQSGGNNA

SEQ ID NO: 16421 - protein, 32 aa, Artificial Sequence
  Description of Artificial Sequence: Synthetic polypeptide
DEEEIRTTNPVATEQYGSVSTTNLQTSGANNP

SEQ ID NO: 16422 - protein, 30 aa, Artificial Sequence
  Description of Artificial Sequence: Synthetic polypeptide
DEEEIRTTNPVATEQYGSVSSNPQFFGNDG

SEQ ID NO: 16423 - protein, 30 aa, Artificial Sequence
  Description of Artificial Sequence: Synthetic polypeptide
DEMEIRTTNPVATEQYGSVSTEDQNGSNRV

SEQ ID NO: 16424 - protein, 32 aa, Artificial Sequence
  Description of Artificial Sequence: Synthetic polypeptide
DEEEIRTTNPVATEQYGSVSTTNLQTVGLIRD

SEQ ID NO: 16425 - protein, 31 aa, Artificial Sequence
  Description of Artificial Sequence: Synthetic polypeptide
DEEEIRTTNPVATEQYGSVSSNPNQLQTDNR

SEQ ID NO: 16426 - protein, 31 aa, Artificial Sequence
  Description of Artificial Sequence: Synthetic polypeptide
DEEEIATTNPVATEVYGSVSTNLQGGGNDNR

SEQ ID NO: 16427 - protein, 32 aa, Artificial Sequence
  Description of Artificial Sequence: Synthetic polypeptide
DEEEIRTTNPVATEQYGSVSTTNLQVETVGNV

SEQ ID NO: 16428 - protein, 31 aa, Artificial Sequence
  Description of Artificial Sequence: Synthetic polypeptide
DEEEIRTTNPVATEQYGSVSLTPNQQTGNLY

SEQ ID NO: 16429 - protein, 30 aa, Artificial Sequence
  Description of Artificial Sequence: Synthetic polypeptide
DEEEIATTNPVATEVYGSVSTNLQDGGGNH

SEQ ID NO: 16430 - protein, 31 aa, Artificial Sequence
  Description of Artificial Sequence: Synthetic polypeptide
AEEEIRTTNPVATEQYGSVSSTNLQAGINND

SEQ ID NO: 16431 - protein, 32 aa, Artificial Sequence
  Description of Artificial Sequence: Synthetic polypeptide
DEEEIRTTNPVATEQYGSVYTTNNDQRGNERN

SEQ ID NO: 16432 - protein, 33 aa, Artificial Sequence
  Description of Artificial Sequence: Synthetic polypeptide
DEEEIRTTNPVATEQYGSVCSTMALQERGSNRT

SEQ ID NO: 16433 - protein, 29 aa, Artificial Sequence
  Description of Artificial Sequence: Synthetic peptide
DEAEIRTTNPVATEQYGVVSTSLQRPNDL

SEQ ID NO: 16434 - protein, 29 aa, Artificial Sequence
  Description of Artificial Sequence: Synthetic peptide
DEEEIACTNPVATEQYGSVSTNLQNGPEE

SEQ ID NO: 16435 - protein, 31 aa, Artificial Sequence
  Description of Artificial Sequence: Synthetic polypeptide
AEEEIRTTNPVATEQYGSVSSTNLQNLGNGA

SEQ ID NO: 16436 - protein, 29 aa, Artificial Sequence
  Description of Artificial Sequence: Synthetic peptide
CNEEIATTNPVATEQYGVVSTNLQDGDNR

SEQ ID NO: 16437 - protein, 32 aa, Artificial Sequence
  Description of Artificial Sequence: Synthetic polypeptide
DEEEIRTTNPVATEQYGSVSNTNLQLAGENGE

SEQ ID NO: 16438 - protein, 30 aa, Artificial Sequence
  Description of Artificial Sequence: Synthetic polypeptide
DEAEIRTTNPVATETYGEVSTNLQRGENDQ

SEQ ID NO: 16439 - protein, 32 aa, Artificial Sequence
  Description of Artificial Sequence: Synthetic polypeptide
DEEEIRTTNPVATEQYGSVSDTALDQRFSQNR

SEQ ID NO: 16440 - protein, 31 aa, Artificial Sequence
  Description of Artificial Sequence: Synthetic polypeptide
AEEEIRTTNPVATEQYGSVSSTNLQYGNINN

SEQ ID NO: 16441 - protein, 32 aa, Artificial Sequence
  Description of Artificial Sequence: Synthetic polypeptide
DEEEIRTTNPVATEQYGSVSLTPNLQRGQMLE

SEQ ID NO: 16442 - protein, 31 aa, Artificial Sequence
  Description of Artificial Sequence: Synthetic polypeptide
DEEEIRTTNPVATEGYGSVSTMNLQDGGNDG

SEQ ID NO: 16443 - protein, 30 aa, Artificial Sequence
  Description of Artificial Sequence: Synthetic polypeptide
AEEEIRTTNPVATEQYGSVSSTNLQVAGTN

SEQ ID NO: 16444 - protein, 32 aa, Artificial Sequence
  Description of Artificial Sequence: Synthetic polypeptide
DEEEIRTTNPVATEQYGSVSTTNLQQGNTEEE

SEQ ID NO: 16445 - protein, 32 aa, Artificial Sequence
  Description of Artificial Sequence: Synthetic polypeptide
DEEEIRTTNPVATEQYGTTSCTENLSQRNGNR

SEQ ID NO: 16446 - protein, 28 aa, Artificial Sequence
  Description of Artificial Sequence: Synthetic peptide
DEMEIRTTNPVATQQYGCVSTNHIRGNQ

SEQ ID NO: 16447 - protein, 31 aa, Artificial Sequence
  Description of Artificial Sequence: Synthetic polypeptide
DEEEIRTTNPVATEQYGSVPINLQEREGDQR

SEQ ID NO: 16448 - protein, 30 aa, Artificial Sequence
  Description of Artificial Sequence: Synthetic polypeptide
DEEEIRTTNPVATEQYGSVPITELQRGLQV

SEQ ID NO: 16449 - protein, 30 aa, Artificial Sequence
  Description of Artificial Sequence: Synthetic polypeptide
DEEEIRTTNPVATEQYGTTSTDNLLQRTNN

SEQ ID NO: 16450 - protein, 31 aa, Artificial Sequence
  Description of Artificial Sequence: Synthetic polypeptide
DEEEIRTTNPVATEQYGSVSTTNLQQGPEET

SEQ ID NO: 16451 - protein, 28 aa, Artificial Sequence
  Description of Artificial Sequence: Synthetic peptide
DEMEIRTTNPVATGHYGSVSTNLTRTNM

SEQ ID NO: 16452 - protein, 30 aa, Artificial Sequence
  Description of Artificial Sequence: Synthetic polypeptide
AEEEIRTTNPVATEQYGSVSSTNLQTGGTT

SEQ ID NO: 16453 - protein, 30 aa, Artificial Sequence
  Description of Artificial Sequence: Synthetic polypeptide
DEEEIRTTNPVATEQYGTTSTINILQRENN

SEQ ID NO: 16454 - protein, 32 aa, Artificial Sequence
  Description of Artificial Sequence: Synthetic polypeptide
DEEEIRTTNPVATEQYGSVSTTNLQQGPNPEF

SEQ ID NO: 16455 - protein, 32 aa, Artificial Sequence
  Description of Artificial Sequence: Synthetic polypeptide
DEEEIRTTNPVATEQYGSVSNTNYDLQQGDVR

SEQ ID NO: 16456 - protein, 30 aa, Artificial Sequence
  Description of Artificial Sequence: Synthetic polypeptide
DEMEIRTTNPVATEQYGVVSTVLQRGNEDG

SEQ ID NO: 16457 - protein, 31 aa, Artificial Sequence
  Description of Artificial Sequence: Synthetic polypeptide
AEEEIRTTNPVATEQYGSVSSTNLQTGGNTL

SEQ ID NO: 16458 - protein, 28 aa, Artificial Sequence
  Description of Artificial Sequence: Synthetic peptide
DEMEIRTTNPVATKHYGSVSTNQQRTNM

SEQ ID NO: 16459 - protein, 28 aa, Artificial Sequence
  Description of Artificial Sequence: Synthetic peptide
DEMEIRTTNPVATQQYGCVSTNIERGNI

SEQ ID NO: 16460 - protein, 32 aa, Artificial Sequence
  Description of Artificial Sequence: Synthetic polypeptide
DEEEIRTTNPVATEQYGSVSLTPNLQRGEQLN

SEQ ID NO: 16461 - protein, 30 aa, Artificial Sequence
  Description of Artificial Sequence: Synthetic polypeptide
DEAEIRTTNPVATETYGSVSTNLQEGDNEH

SEQ ID NO: 16462 - protein, 30 aa, Artificial Sequence
  Description of Artificial Sequence: Synthetic polypeptide
DEEEIRTTNPVATEQYGSVCSTGLDTRGDN

SEQ ID NO: 16463 - protein, 31 aa, Artificial Sequence
  Description of Artificial Sequence: Synthetic polypeptide
DEEEIRTTNPVATEQYGSVSDTALYQRSSDR

SEQ ID NO: 16464 - protein, 29 aa, Artificial Sequence
  Description of Artificial Sequence: Synthetic peptide
DEEEIRTTNPVATEQYGSWSEDLQNGERV

SEQ ID NO: 16465 - protein, 31 aa, Artificial Sequence
  Description of Artificial Sequence: Synthetic polypeptide
DEEEIRTTNPVATEQYGSVSSTDLQIGGNEQ

SEQ ID NO: 16466 - protein, 30 aa, Artificial Sequence
  Description of Artificial Sequence: Synthetic polypeptide
DEEEIRTTNPVATEQYGSVSTTNLQQDLIG

SEQ ID NO: 16467 - protein, 32 aa, Artificial Sequence
  Description of Artificial Sequence: Synthetic polypeptide
DEEEIRTTNPVATEQYGSVSTTNLQQEAGGNT

SEQ ID NO: 16468 - protein, 29 aa, Artificial Sequence
  Description of Artificial Sequence: Synthetic peptide
DEMEIRTTNPVATTQYGTVSTNLEVRGNG

SEQ ID NO: 16469 - protein, 29 aa, Artificial Sequence
  Description of Artificial Sequence: Synthetic peptide
DEMEIRTTNPVATTQYGCVSTNLERGNQL

SEQ ID NO: 16470 - protein, 29 aa, Artificial Sequence
  Description of Artificial Sequence: Synthetic peptide
DEMEIRTTNPVATSQYGCVSTNLERGNDM

SEQ ID NO: 16471 - protein, 32 aa, Artificial Sequence
  Description of Artificial Sequence: Synthetic polypeptide
DEEEIRTTNPVATEQYGSVSTTNLQQELVVNR

SEQ ID NO: 16472 - protein, 31 aa, Artificial Sequence
  Description of Artificial Sequence: Synthetic polypeptide
DEEEIRTTNPVATEQYGSVSSTDLQGEGNEF

SEQ ID NO: 16473 - protein, 32 aa, Artificial Sequence
  Description of Artificial Sequence: Synthetic polypeptide
DEEEIRTTNPVATEQYGSVSTTNLQQETMGNQ

SEQ ID NO: 16474 - protein, 28 aa, Artificial Sequence
  Description of Artificial Sequence: Synthetic peptide
DEMEIRTTNPVATQQYGCVSTNLERTND

SEQ ID NO: 16475 - protein, 31 aa, Artificial Sequence
  Description of Artificial Sequence: Synthetic polypeptide
AEEEIRTTNPVATEQYGSVSSTNNEQAGQNR

SEQ ID NO: 16476 - protein, 29 aa, Artificial Sequence
  Description of Artificial Sequence: Synthetic peptide
DEMEIRTTNPVATQQYGCVSTNLERQGNT

SEQ ID NO: 16477 - protein, 32 aa, Artificial Sequence
  Description of Artificial Sequence: Synthetic polypeptide
DEEEIRTTNPVATEAYGESVSTVNLQTRISNR

SEQ ID NO: 16478 - protein, 30 aa, Artificial Sequence
  Description of Artificial Sequence: Synthetic polypeptide
CETEIRTTNPVATEQYGSCSFTNLNQRVNR

SEQ ID NO: 16479 - protein, 32 aa, Artificial Sequence
  Description of Artificial Sequence: Synthetic polypeptide
DEEEIRTTNPVATEQYGSVSLTPNLQNRSMNV

SEQ ID NO: 16480 - protein, 30 aa, Artificial Sequence
  Description of Artificial Sequence: Synthetic polypeptide
AEEEIRTTNPVATEQYGSVSSTNNDQFGNP

SEQ ID NO: 16481 - protein, 28 aa, Artificial Sequence
  Description of Artificial Sequence: Synthetic peptide
DEMEIRTTNPVATQQYGCVSTNLERGQQ

SEQ ID NO: 16482 - protein, 30 aa, Artificial Sequence
  Description of Artificial Sequence: Synthetic polypeptide
DEEEIRTTNPVATEQYGSVCSTGLQVGPDQ

SEQ ID NO: 16483 - protein, 29 aa, Artificial Sequence
  Description of Artificial Sequence: Synthetic peptide
DEMEIRTTNPVATQQYGCVSTNLERGNEY

SEQ ID NO: 16484 - protein, 28 aa, Artificial Sequence
  Description of Artificial Sequence: Synthetic peptide
DEMEIRTTNPVATQQYGCVSTNLERGMN

SEQ ID NO: 16485 - protein, 28 aa, Artificial Sequence
  Description of Artificial Sequence: Synthetic peptide
DEEEIRTTNPVATEQYGSWETNEQEEDR

SEQ ID NO: 16486 - protein, 30 aa, Artificial Sequence
  Description of Artificial Sequence: Synthetic polypeptide
AEEEIRTTNPVATEQYGSVSSTSNNQGGNY

SEQ ID NO: 16487 - protein, 30 aa, Artificial Sequence
  Description of Artificial Sequence: Synthetic polypeptide
DEMEIRTTNPVATEQYGVVSTNLQENGQRL

SEQ ID NO: 16488 - protein, 28 aa, Artificial Sequence
  Description of Artificial Sequence: Synthetic peptide
DEEEIRTTNPVATEQYGSWETNEERDNN

SEQ ID NO: 16489 - protein, 29 aa, Artificial Sequence
  Description of Artificial Sequence: Synthetic peptide
DEMEIRTTNPVATEQYGSVSWDLQNGERV

SEQ ID NO: 16490 - protein, 28 aa, Artificial Sequence
  Description of Artificial Sequence: Synthetic peptide
DEEEIRTTNPVATEQYGSVPMSLQTNNT

SEQ ID NO: 16491 - protein, 31 aa, Artificial Sequence
  Description of Artificial Sequence: Synthetic polypeptide
DEEEIRTTNPVATEQYGSVSLTPNNQRDERA

SEQ ID NO: 16492 - protein, 31 aa, Artificial Sequence
  Description of Artificial Sequence: Synthetic polypeptide
DEEEIRTTNPVATEQYGSVCSTGNLQNGDLL

SEQ ID NO: 16493 - protein, 31 aa, Artificial Sequence
  Description of Artificial Sequence: Synthetic polypeptide
DEEEIRTTNPVATEQYGTVCSTDNPVERGNR

SEQ ID NO: 16494 - protein, 32 aa, Artificial Sequence
  Description of Artificial Sequence: Synthetic polypeptide
DEEEIRTTNPVATEQYGSVSTTNLQRTGVDLD

SEQ ID NO: 16495 - protein, 32 aa, Artificial Sequence
  Description of Artificial Sequence: Synthetic polypeptide
DEEEIRTTNPVATEQYGSVSTTNLQRTLTNVS

SEQ ID NO: 16496 - protein, 33 aa, Artificial Sequence
  Description of Artificial Sequence: Synthetic polypeptide
DEEEIRTTNPVATEQYGSVCSTGNLQRGSNDQP

SEQ ID NO: 16497 - protein, 32 aa, Artificial Sequence
  Description of Artificial Sequence: Synthetic polypeptide
DEEEIRTTNPVATEQYGSVSLTPNNQRGENLI

SEQ ID NO: 16498 - protein, 30 aa, Artificial Sequence
  Description of Artificial Sequence: Synthetic polypeptide
AEEEIRTTNPVATEQYGSVSSTNLQQFENE

SEQ ID NO: 16499 - protein, 31 aa, Artificial Sequence
  Description of Artificial Sequence: Synthetic polypeptide
DEEEIRTTNPVATEQYGSVPITNELPQINNR

SEQ ID NO: 16500 - protein, 28 aa, Artificial Sequence
  Description of Artificial Sequence: Synthetic peptide
DEEEIRTTNPVATEQYGSVPMTLQTNNN

SEQ ID NO: 16501 - protein, 31 aa, Artificial Sequence
  Description of Artificial Sequence: Synthetic polypeptide
DEEEIRTTNPVATEQYGSVSSPNLQREVNDE

SEQ ID NO: 16502 - protein, 31 aa, Artificial Sequence
  Description of Artificial Sequence: Synthetic polypeptide
DEAEIRTTNPVATEQYGVVVSTNLQHGNDER

SEQ ID NO: 16503 - protein, 33 aa, Artificial Sequence
  Description of Artificial Sequence: Synthetic polypeptide
DEEEIRTTNPVATEQYGSVCSTGNPLQRGSQRV

SEQ ID NO: 16504 - protein, 29 aa, Artificial Sequence
  Description of Artificial Sequence: Synthetic peptide
DEAEICTTNPVATEGYGSVSTNLDRGNQD

SEQ ID NO: 16505 - protein, 31 aa, Artificial Sequence
  Description of Artificial Sequence: Synthetic polypeptide
DEEEIRTTNPVATEQYGSVCSTHLQRGSDLI

SEQ ID NO: 16506 - protein, 30 aa, Artificial Sequence
  Description of Artificial Sequence: Synthetic polypeptide
AEEEIRTTNPVATEQYGSVSSTNLQNQNIM

SEQ ID NO: 16507 - protein, 31 aa, Artificial Sequence
  Description of Artificial Sequence: Synthetic polypeptide
AEEEIRTTNPVATEQYGSVSSTNLQNQGNLD

SEQ ID NO: 16508 - protein, 31 aa, Artificial Sequence
  Description of Artificial Sequence: Synthetic polypeptide
AEEEIRTTNPVATEQYGSVSSTNLQNQENIR

SEQ ID NO: 16509 - protein, 31 aa, Artificial Sequence
  Description of Artificial Sequence: Synthetic polypeptide
DEEEIRTTNPVATEQYGSVCSTINLFGGSND

SEQ ID NO: 16510 - protein, 30 aa, Artificial Sequence
  Description of Artificial Sequence: Synthetic polypeptide
DEEEIACTNPVATEQYGSVSTNLQGENPRD

SEQ ID NO: 16511 - protein, 31 aa, Artificial Sequence
  Description of Artificial Sequence: Synthetic polypeptide
DEEEIRTTNPVATEQYGSVCSTGNLTGSNNR

SEQ ID NO: 16512 - protein, 30 aa, Artificial Sequence
  Description of Artificial Sequence: Synthetic polypeptide
AEEEIRTTNPVATEQYGSVSSTNLQQQNDG

SEQ ID NO: 16513 - protein, 32 aa, Artificial Sequence
  Description of Artificial Sequence: Synthetic polypeptide
DEEEIRTTNPVATEQYGSVSTTNLQRDGVTEI

SEQ ID NO: 16514 - protein, 29 aa, Artificial Sequence
  Description of Artificial Sequence: Synthetic peptide
DEMEIRTTNPVATEQYGSVSWNLQQQERQ

SEQ ID NO: 16515 - protein, 28 aa, Artificial Sequence
  Description of Artificial Sequence: Synthetic peptide
DEMEIRTTNPVATEQYGVVSTELQRNVD

SEQ ID NO: 16516 - protein, 33 aa, Artificial Sequence
  Description of Artificial Sequence: Synthetic polypeptide
DEEEIRTTNPVATEQYGSVCSTGNLDFRFGSNR

SEQ ID NO: 16517 - protein, 30 aa, Artificial Sequence
  Description of Artificial Sequence: Synthetic polypeptide
DEAEIRTTNPVATESYGSVSTNLQMDGNNA

SEQ ID NO: 16518 - protein, 31 aa, Artificial Sequence
  Description of Artificial Sequence: Synthetic polypeptide
DEEEIRTTNPVATEGYGSVSTMNLQEVGNGG

SEQ ID NO: 16519 - protein, 28 aa, Artificial Sequence
  Description of Artificial Sequence: Synthetic peptide
CSEEIRTTNPVATAQYGSVSTELQDGNF

SEQ ID NO: 16520 - protein, 32 aa, Artificial Sequence
  Description of Artificial Sequence: Synthetic polypeptide
DEEEIRTTNPVATEQYGTTVSCTNLQRGGNNT

SEQ ID NO: 16521 - protein, 31 aa, Artificial Sequence
  Description of Artificial Sequence: Synthetic polypeptide
DEEEIRTTNPVATEQYGSVSTTNLQQGSETY

SEQ ID NO: 16522 - protein, 31 aa, Artificial Sequence
  Description of Artificial Sequence: Synthetic polypeptide
DEEEIRTTNPVATEQYGSVSDSYDLQRGVDR

SEQ ID NO: 16523 - protein, 32 aa, Artificial Sequence
  Description of Artificial Sequence: Synthetic polypeptide
DEEEIRTTNPVATEQYGSVCSTGNLQAGSNAY

SEQ ID NO: 16524 - protein, 31 aa, Artificial Sequence
  Description of Artificial Sequence: Synthetic polypeptide
DEEEIRTTNPVATEGYGSVSTMNLQSEGNIQ

SEQ ID NO: 16525 - protein, 33 aa, Artificial Sequence
  Description of Artificial Sequence: Synthetic polypeptide
DEEEIRTTNPVATEQYGSVCSTGNLQASGSNRG

SEQ ID NO: 16526 - protein, 31 aa, Artificial Sequence
  Description of Artificial Sequence: Synthetic polypeptide
DEAEIRTTNPVATESYGSVATNLSQRTGGNR

SEQ ID NO: 16527 - protein, 31 aa, Artificial Sequence
  Description of Artificial Sequence: Synthetic polypeptide
DEEEIRTTNPVATEQYGSVSTTNLQQVAGGL

SEQ ID NO: 16528 - protein, 32 aa, Artificial Sequence
  Description of Artificial Sequence: Synthetic polypeptide
DEEEIRTTNPVATEQYGSVSTTNLQQVEGNGS

SEQ ID NO: 16529 - protein, 30 aa, Artificial Sequence
  Description of Artificial Sequence: Synthetic polypeptide
DEAEIRTTNPVATEQYGYTISTDELQRGNR

SEQ ID NO: 16530 - protein, 30 aa, Artificial Sequence
  Description of Artificial Sequence: Synthetic polypeptide
DEEEIRTTNPVATEQYGTVCSNTHLQSGDR

SEQ ID NO: 16531 - protein, 30 aa, Artificial Sequence
  Description of Artificial Sequence: Synthetic polypeptide
DEEEIRTTNPVATEQYGSVSSTAGNRGMNV

SEQ ID NO: 16532 - protein, 32 aa, Artificial Sequence
  Description of Artificial Sequence: Synthetic polypeptide
DEEEIRTTNPVATEQYGSVCSTGNLQGGSNVF

SEQ ID NO: 16533 - protein, 32 aa, Artificial Sequence
  Description of Artificial Sequence: Synthetic polypeptide
DEEEIRTTNPVATEQYGSVCSTGNLQGGSQNQ

SEQ ID NO: 16534 - protein, 28 aa, Artificial Sequence
  Description of Artificial Sequence: Synthetic peptide
CTEEIRCTNPIATEQYGSVSENLMRGNR

SEQ ID NO: 16535 - protein, 28 aa, Artificial Sequence
  Description of Artificial Sequence: Synthetic peptide
CTEEIRTTNPVATEFWGTVSTNLQEGNR

SEQ ID NO: 16536 - protein, 28 aa, Artificial Sequence
  Description of Artificial Sequence: Synthetic peptide
CTEEIRTTNPVATEQWGMVSTNLQEGNI

SEQ ID NO: 16537 - protein, 32 aa, Artificial Sequence
  Description of Artificial Sequence: Synthetic polypeptide
DEEEIRTTNPVATEQYGSVSTTNLQQVSGGRD

SEQ ID NO: 16538 - protein, 30 aa, Artificial Sequence
  Description of Artificial Sequence: Synthetic polypeptide
DEEEIRTTNPVATEQYGTTSTQNGLQRENN

SEQ ID NO: 16539 - protein, 29 aa, Artificial Sequence
  Description of Artificial Sequence: Synthetic peptide
DEEEIRTTNPVATEQYGSVSTTNDRGEDN

SEQ ID NO: 16540 - protein, 31 aa, Artificial Sequence
  Description of Artificial Sequence: Synthetic polypeptide
DEEEIRTTNPVATEQYGSVSDTNGGQRTGEQ

SEQ ID NO: 16541 - protein, 31 aa, Artificial Sequence
  Description of Artificial Sequence: Synthetic polypeptide
YESEIRTTNPVATEQYGSVSTNQTQQRGNRF

SEQ ID NO: 16542 - protein, 31 aa, Artificial Sequence
  Description of Artificial Sequence: Synthetic polypeptide
DEEEIRTTNPVATDQYGSVSTNLQYQEGNEF

SEQ ID NO: 16543 - protein, 29 aa, Artificial Sequence
  Description of Artificial Sequence: Synthetic peptide
DEDEIRTTNPVATEQYGETSTNLQQRGDE

SEQ ID NO: 16544 - protein, 31 aa, Artificial Sequence
  Description of Artificial Sequence: Synthetic polypeptide
DEEEIRTTNPVATEQYGSVCNTMNLTNRGSR

SEQ ID NO: 16545 - protein, 31 aa, Artificial Sequence
  Description of Artificial Sequence: Synthetic polypeptide
DEEEIRTTNPVATEQYGSVSDTWLLQRSQND

SEQ ID NO: 16546 - protein, 30 aa, Artificial Sequence
  Description of Artificial Sequence: Synthetic polypeptide
AEEEIRTTNPVATEQYGSVSTANNENGTNR

SEQ ID NO: 16547 - protein, 29 aa, Artificial Sequence
  Description of Artificial Sequence: Synthetic peptide
DEDEIRTTNPVATEQYGETSTNLQRGDAE

SEQ ID NO: 16548 - protein, 29 aa, Artificial Sequence
  Description of Artificial Sequence: Synthetic peptide
DENEIRTTNPVATEPYGDVSNNLQRGNDF

SEQ ID NO: 16549 - protein, 32 aa, Artificial Sequence
  Description of Artificial Sequence: Synthetic polypeptide
DEEEIRTTNPVATEQYGSVSTTGLQRMENARF

SEQ ID NO: 16550 - protein, 31 aa, Artificial Sequence
  Description of Artificial Sequence: Synthetic polypeptide
DEEEIRTTNPVATEQYGSVCNTNDLNRNGND

SEQ ID NO: 16551 - protein, 30 aa, Artificial Sequence
  Description of Artificial Sequence: Synthetic polypeptide
YPEEIRTTNPVATEQYGAVSTNLATRGNDR

SEQ ID NO: 16552 - protein, 28 aa, Artificial Sequence
  Description of Artificial Sequence: Synthetic peptide
DEDEIRTTNPVATEQYGETSTNLQNGTN

SEQ ID NO: 16553 - protein, 29 aa, Artificial Sequence
  Description of Artificial Sequence: Synthetic peptide
AEEEIRTTNPVATEQYGSVSTANNEEGNQ

SEQ ID NO: 16554 - protein, 29 aa, Artificial Sequence
  Description of Artificial Sequence: Synthetic peptide
DENEIRTTNPVATEIYGSVSWNLQRIGEA

SEQ ID NO: 16555 - protein, 32 aa, Artificial Sequence
  Description of Artificial Sequence: Synthetic polypeptide
DEEEIRTTNPVATEQYGSVCNTNLDQNRGDGR

SEQ ID NO: 16556 - protein, 30 aa, Artificial Sequence
  Description of Artificial Sequence: Synthetic polypeptide
DEEEIRTTNPVATEQYGSVNYTDLDQRGEQ

SEQ ID NO: 16557 - protein, 32 aa, Artificial Sequence
  Description of Artificial Sequence: Synthetic polypeptide
DEEEIRTTNPVATEQYGSVSDTWLEQRSQNRG

SEQ ID NO: 16558 - protein, 32 aa, Artificial Sequence
  Description of Artificial Sequence: Synthetic polypeptide
DEEEIRTTNPVATEQYGSVCNTNLEAREGDNR

SEQ ID NO: 16559 - protein, 28 aa, Artificial Sequence
  Description of Artificial Sequence: Synthetic peptide
DENEIRTTNPVATEIYGSVSVNLQRMTW

SEQ ID NO: 16560 - protein, 29 aa, Artificial Sequence
  Description of Artificial Sequence: Synthetic peptide
DENEIRTTNPVATEIYGSVSVNLQRGTWG

SEQ ID NO: 16561 - protein, 28 aa, Artificial Sequence
  Description of Artificial Sequence: Synthetic peptide
DEEEIRTTNPVATEQYGSYSTVLNREDS

SEQ ID NO: 16562 - protein, 30 aa, Artificial Sequence
  Description of Artificial Sequence: Synthetic polypeptide
DEEEIRTTNPVATEQYGSVNTTLNLARDER

SEQ ID NO: 16563 - protein, 32 aa, Artificial Sequence
  Description of Artificial Sequence: Synthetic polypeptide
DEEEIRTTNPVATEQYGSVCNTNLIMRGGNRE

SEQ ID NO: 16564 - protein, 29 aa, Artificial Sequence
  Description of Artificial Sequence: Synthetic peptide
DEDEIRTTNPVATEQYGETSTNLQRGDMP

SEQ ID NO: 16565 - protein, 30 aa, Artificial Sequence
  Description of Artificial Sequence: Synthetic polypeptide
AEEEIRTTNPVATEQYGSVSTANNDNGGNR

SEQ ID NO: 16566 - protein, 31 aa, Artificial Sequence
  Description of Artificial Sequence: Synthetic polypeptide
DEEEIRTTNPVATEQYGSVCNTMNLTGRGTR

SEQ ID NO: 16567 - protein, 31 aa, Artificial Sequence
  Description of Artificial Sequence: Synthetic polypeptide
DEEEIATTNPVAYEQYGSTVSTNLQRGGNNL

SEQ ID NO: 16568 - protein, 29 aa, Artificial Sequence
  Description of Artificial Sequence: Synthetic peptide
AEEEIRTTNPVATEQYGSVSTANQQNGTQ

SEQ ID NO: 16569 - protein, 30 aa, Artificial Sequence
  Description of Artificial Sequence: Synthetic polypeptide
AEEEIRTTNPVATEQYGSVSTANQQAGTNE

SEQ ID NO: 16570 - protein, 30 aa, Artificial Sequence
  Description of Artificial Sequence: Synthetic polypeptide
YQEEIRTTNPVATEQYGMVSTNLEQRDNRT

SEQ ID NO: 16571 - protein, 30 aa, Artificial Sequence
  Description of Artificial Sequence: Synthetic polypeptide
DEEEIRTTNPVATDQYGSVSTNGQPTVNRD

SEQ ID NO: 16572 - protein, 30 aa, Artificial Sequence
  Description of Artificial Sequence: Synthetic polypeptide
DEEEIRTTNPVATDQYGSVSTNGQSRVVRD

SEQ ID NO: 16573 - protein, 31 aa, Artificial Sequence
  Description of Artificial Sequence: Synthetic polypeptide
DEEEIRTTNPVATEQYGSVCNTFNLYARGAR

SEQ ID NO: 16574 - protein, 29 aa, Artificial Sequence
  Description of Artificial Sequence: Synthetic peptide
DEEEIRTTNPVATEQYGSVSSTLERQEAR

SEQ ID NO: 16575 - protein, 32 aa, Artificial Sequence
  Description of Artificial Sequence: Synthetic polypeptide
DEEEIRTTNPVATEQYGSVCNTFNLYGRGNIR

SEQ ID NO: 16576 - protein, 30 aa, Artificial Sequence
  Description of Artificial Sequence: Synthetic polypeptide
AEEEIRTTNPVATEQYGSVSTANQLENGNL

SEQ ID NO: 16577 - protein, 31 aa, Artificial Sequence
  Description of Artificial Sequence: Synthetic polypeptide
DEEEIRTTNPVATEQYGSVCNTGNLDGRGVR

SEQ ID NO: 16578 - protein, 31 aa, Artificial Sequence
  Description of Artificial Sequence: Synthetic polypeptide
DEEEIRTTNPVATEQYGSVCNTHNLEGRGQR

SEQ ID NO: 16579 - protein, 32 aa, Artificial Sequence
  Description of Artificial Sequence: Synthetic polypeptide
DEEEIRTTNPVATEQYGSVSTTENLQEGGNEG

SEQ ID NO: 16580 - protein, 32 aa, Artificial Sequence
  Description of Artificial Sequence: Synthetic polypeptide
DEEEIRTTNPVATEQYGSVSTTENLQRGVFVD

SEQ ID NO: 16581 - protein, 30 aa, Artificial Sequence
  Description of Artificial Sequence: Synthetic polypeptide
AEEEIRTTNPVATEQYGSVSTANNQEQGNE

SEQ ID NO: 16582 - protein, 31 aa, Artificial Sequence
  Description of Artificial Sequence: Synthetic polypeptide
DEEEIRTTNPVATEQYGSVCNTGNLGVRGTR

SEQ ID NO: 16583 - protein, 31 aa, Artificial Sequence
  Description of Artificial Sequence: Synthetic polypeptide
DEEEIRTTNPVATEQYGSVNTTNDQRGNNQD

SEQ ID NO: 16584 - protein, 31 aa, Artificial Sequence
  Description of Artificial Sequence: Synthetic polypeptide
DEEEIRTTNPVATEQYGSVSDTWLYQLNQNR

SEQ ID NO: 16585 - protein, 30 aa, Artificial Sequence
  Description of Artificial Sequence: Synthetic polypeptide
AEEEIRTTNPVATEQYGSVSTANNQAGNSA

SEQ ID NO: 16586 - protein, 28 aa, Artificial Sequence
  Description of Artificial Sequence: Synthetic peptide
SESEIRCTNPIATEGYGSVSENLQRGNR

SEQ ID NO: 16587 - protein, 28 aa, Artificial Sequence
  Description of Artificial Sequence: Synthetic peptide
DEDEIRTTNPVATEQYGETSTNLQLGDH

SEQ ID NO: 16588 - protein, 29 aa, Artificial Sequence
  Description of Artificial Sequence: Synthetic peptide
DENEIRTTNPVATEQFGTSVSTYLLRGNQ

SEQ ID NO: 16589 - protein, 30 aa, Artificial Sequence
  Description of Artificial Sequence: Synthetic polypeptide
AEEEIRTTNPVATEQYGSVSTANNIGTGNR

SEQ ID NO: 16590 - protein, 30 aa, Artificial Sequence
  Description of Artificial Sequence: Synthetic polypeptide
DEEEIRTTNPVATEQYGSVNTTSLQQDNRI

SEQ ID NO: 16591 - protein, 31 aa, Artificial Sequence
  Description of Artificial Sequence: Synthetic polypeptide
DEEEIRTTNPVATEQYGSVCNTNLQRTLNDG

SEQ ID NO: 16592 - protein, 29 aa, Artificial Sequence
  Description of Artificial Sequence: Synthetic peptide
DEDEIRTTNPVATEQYGETSTNLQRGGDM

SEQ ID NO: 16593 - protein, 28 aa, Artificial Sequence
  Description of Artificial Sequence: Synthetic peptide
DEDVIRTTNPVATEQYGCVATNDQDGNR

SEQ ID NO: 16594 - protein, 32 aa, Artificial Sequence
  Description of Artificial Sequence: Synthetic polypeptide
DEEEIRTTNPVATEQYGSVSDTSDLYQRSQNR

SEQ ID NO: 16595 - protein, 29 aa, Artificial Sequence
  Description of Artificial Sequence: Synthetic peptide
DEEEIRTTNPVATDQYGSVTNTQVNTGNR

SEQ ID NO: 16596 - protein, 31 aa, Artificial Sequence
  Description of Artificial Sequence: Synthetic polypeptide
DEEEIRTTNPVATEQYGSVSTTLERGGNDID

SEQ ID NO: 16597 - protein, 28 aa, Artificial Sequence
  Description of Artificial Sequence: Synthetic peptide
DENEIRTTNPVATEIYGSVSNNLQIGTQ

SEQ ID NO: 16598 - protein, 29 aa, Artificial Sequence
  Description of Artificial Sequence: Synthetic peptide
YNEEIRTTNPVATEQYGSVSLNGQMRGER

SEQ ID NO: 16599 - protein, 28 aa, Artificial Sequence
  Description of Artificial Sequence: Synthetic peptide
DENEIRTTNPVATEIYGSVSNNLQEGTP

SEQ ID NO: 16600 - protein, 30 aa, Artificial Sequence
  Description of Artificial Sequence: Synthetic polypeptide
DEEEIRTTNPVATEQYGSVSTTLGEDSGNE

SEQ ID NO: 16601 - protein, 30 aa, Artificial Sequence
  Description of Artificial Sequence: Synthetic polypeptide
YNEEIRTTNPVATEQYGQVSTNEQQRGNRI

SEQ ID NO: 16602 - protein, 28 aa, Artificial Sequence
  Description of Artificial Sequence: Synthetic peptide
DENEIRTTNPVATEIYGSVSNNLQDGTA

SEQ ID NO: 16603 - protein, 28 aa, Artificial Sequence
  Description of Artificial Sequence: Synthetic peptide
DENEIRTTNPVATEIYGSVSNNLQAGTP

SEQ ID NO: 16604 - protein, 28 aa, Artificial Sequence
  Description of Artificial Sequence: Synthetic peptide
DENEIRTTNPVATEIYGSVSNNLQRETD

SEQ ID NO: 16605 - protein, 28 aa, Artificial Sequence
  Description of Artificial Sequence: Synthetic peptide
DENEIRTTNPVATEIYGSVSNNLERGTI

SEQ ID NO: 16606 - protein, 30 aa, Artificial Sequence
  Description of Artificial Sequence: Synthetic polypeptide
DEEEIRTTNPVATEQYGSWYSTTDQRGEDR

SEQ ID NO: 16607 - protein, 30 aa, Artificial Sequence
  Description of Artificial Sequence: Synthetic polypeptide
YNEEIRTTNPVATEQYGAVSTNLQARGNMQ

SEQ ID NO: 16608 - protein, 28 aa, Artificial Sequence
  Description of Artificial Sequence: Synthetic peptide
DENEIRTTNPVATEIYGSVSNNLARGTG

SEQ ID NO: 16609 - protein, 31 aa, Artificial Sequence
  Description of Artificial Sequence: Synthetic polypeptide
AEEEIRTTNPVATEQYGSVSTANELQQGNNQ

SEQ ID NO: 16610 - protein, 29 aa, Artificial Sequence
  Description of Artificial Sequence: Synthetic peptide
CEEEISTTNPVATEQYGNVSVTRLQGGNR

SEQ ID NO: 16611 - protein, 29 aa, Artificial Sequence
  Description of Artificial Sequence: Synthetic peptide
CEEEISTTNPVATEQYGNVSVTTLQLGNR

SEQ ID NO: 16612 - protein, 31 aa, Artificial Sequence
  Description of Artificial Sequence: Synthetic polypeptide
DEEEIRTTNPVATEQYGSVCSANLNQGGSER

SEQ ID NO: 16613 - protein, 32 aa, Artificial Sequence
  Description of Artificial Sequence: Synthetic polypeptide
DEEEIRTTNPVATEQYGSVSDTNTQHFGSNRA

SEQ ID NO: 16614 - protein, 31 aa, Artificial Sequence
  Description of Artificial Sequence: Synthetic polypeptide
DEEEIRTTNPVATEQYGSVCSATNDLNNQNR

SEQ ID NO: 16615 - protein, 29 aa, Artificial Sequence
  Description of Artificial Sequence: Synthetic peptide
AEEEIRTTNPVATEQYGSVSTANAEGGND

SEQ ID NO: 16616 - protein, 31 aa, Artificial Sequence
  Description of Artificial Sequence: Synthetic polypeptide
AEEEIRTTNPVATEQYGSVSTANGEQGGNER

SEQ ID NO: 16617 - protein, 31 aa, Artificial Sequence
  Description of Artificial Sequence: Synthetic polypeptide
AEEEIRTTNPVATEQYGSVSTANLDSGGTNR

SEQ ID NO: 16618 - protein, 31 aa, Artificial Sequence
  Description of Artificial Sequence: Synthetic polypeptide
AEEEIRTTNPVATEQYGSVSTANLNQEFGNA

SEQ ID NO: 16619 - protein, 29 aa, Artificial Sequence
  Description of Artificial Sequence: Synthetic peptide
DENEIRTTNPVATEIYGSVSNNLQRGGTE

SEQ ID NO: 16620 - protein, 29 aa, Artificial Sequence
  Description of Artificial Sequence: Synthetic peptide
DENEIRTTNPVATEIYGSVSSNNLQRGTT

SEQ ID NO: 16621 - protein, 29 aa, Artificial Sequence
  Description of Artificial Sequence: Synthetic peptide
DEEEIRTTNPVATEQYGSYITNLQRQIEG

SEQ ID NO: 16622 - protein, 29 aa, Artificial Sequence
  Description of Artificial Sequence: Synthetic peptide
DENEIRTTNPVATEIYGSVSSNLQRHGTW

SEQ ID NO: 16623 - protein, 28 aa, Artificial Sequence
  Description of Artificial Sequence: Synthetic peptide
DENEIRTTNPVATEIYGSVSSNLQHGEA

SEQ ID NO: 16624 - protein, 28 aa, Artificial Sequence
  Description of Artificial Sequence: Synthetic peptide
DENEIRTTNPVATEIYGSVSPNQQRGTE

SEQ ID NO: 16625 - protein, 31 aa, Artificial Sequence
  Description of Artificial Sequence: Synthetic polypeptide
DEEEIRTTNPVATDQYGSVSTVNLQTGGNEV

SEQ ID NO: 16626 - protein, 31 aa, Artificial Sequence
  Description of Artificial Sequence: Synthetic polypeptide
DEEEIRTTNPVATEQYGSVCNTTNLDDRGTR

SEQ ID NO: 16627 - protein, 30 aa, Artificial Sequence
  Description of Artificial Sequence: Synthetic polypeptide
DEEEIRTTNPVATEQYGSYDLPNMLQRDNR

SEQ ID NO: 16628 - protein, 28 aa, Artificial Sequence
  Description of Artificial Sequence: Synthetic peptide
DENEIRTTNPVATEIYGSVSNVLQRGEQ

SEQ ID NO: 16629 - protein, 30 aa, Artificial Sequence
  Description of Artificial Sequence: Synthetic polypeptide
AEEEIRTTNPVATEQYGSVSTANLQQGEQQ

SEQ ID NO: 16630 - protein, 29 aa, Artificial Sequence
  Description of Artificial Sequence: Synthetic peptide
DENEIRTTNPVATEIYGSVSNSNLQRGTT

SEQ ID NO: 16631 - protein, 31 aa, Artificial Sequence
  Description of Artificial Sequence: Synthetic polypeptide
AEEEIRTTNPVATEQYGSVSTANLQNVGNET

SEQ ID NO: 16632 - protein, 31 aa, Artificial Sequence
  Description of Artificial Sequence: Synthetic polypeptide
DEEEIRTTNPVATEQYGSVSDTTIYQRSQNR

SEQ ID NO: 16633 - protein, 32 aa, Artificial Sequence
  Description of Artificial Sequence: Synthetic polypeptide
DEEEIRTTNPVATEQYGSVSTTIGLQTGENRD

SEQ ID NO: 16634 - protein, 29 aa, Artificial Sequence
  Description of Artificial Sequence: Synthetic peptide
DEEEIRTTNPVATEQYGSVSDTTDQRMEI

SEQ ID NO: 16635 - protein, 33 aa, Artificial Sequence
  Description of Artificial Sequence: Synthetic polypeptide
DEEEIRTTNPVATEQYGSVSTTINLQRQGIERY

SEQ ID NO: 16636 - protein, 30 aa, Artificial Sequence
  Description of Artificial Sequence: Synthetic polypeptide
AEEEIRTTNPVATEQYGSVSTANLQNINNS

SEQ ID NO: 16637 - protein, 31 aa, Artificial Sequence
  Description of Artificial Sequence: Synthetic polypeptide
DEEEIRTTNPVATEQYGSYCTPNLQRGNDND

SEQ ID NO: 16638 - protein, 31 aa, Artificial Sequence
  Description of Artificial Sequence: Synthetic polypeptide
AEEEIRTTNPVATEQYGSVSTANLQLTGTRS

SEQ ID NO: 16639 - protein, 32 aa, Artificial Sequence
  Description of Artificial Sequence: Synthetic polypeptide
DEEEIRTTNPVATEQYGSVSDTSNLGQNIGNQ

SEQ ID NO: 16640 - protein, 30 aa, Artificial Sequence
  Description of Artificial Sequence: Synthetic polypeptide
DEEEIRTTNPVATEQYGSYCSTNLERTNLA

SEQ ID NO: 16641 - protein, 30 aa, Artificial Sequence
  Description of Artificial Sequence: Synthetic polypeptide
DEEEIRTTNPVATEQYGSVNYTNLEGDNER

SEQ ID NO: 16642 - protein, 29 aa, Artificial Sequence
  Description of Artificial Sequence: Synthetic peptide
DENEIRTTNPVATEIYGSVSNNLQRVGTG

SEQ ID NO: 16643 - protein, 31 aa, Artificial Sequence
  Description of Artificial Sequence: Synthetic polypeptide
DEEEIRTTNPVATEQYGSVCNTFNLVGRGVR

SEQ ID NO: 16644 - protein, 28 aa, Artificial Sequence
  Description of Artificial Sequence: Synthetic peptide
DEDEIRTTNPVATEQYGETSTNLQGGES

SEQ ID NO: 16645 - protein, 30 aa, Artificial Sequence
  Description of Artificial Sequence: Synthetic polypeptide
DENEIRTTNPVATEQYGCTISTNELQRGNS

SEQ ID NO: 16646 - protein, 32 aa, Artificial Sequence
  Description of Artificial Sequence: Synthetic polypeptide
DEEEIRTTNPVATEQYGSVSDTWLYQRSDQNR

SEQ ID NO: 16647 - protein, 30 aa, Artificial Sequence
  Description of Artificial Sequence: Synthetic polypeptide
DEEEIRTTNPVATEQYGSVSTSNQQQGEIE

SEQ ID NO: 16648 - protein, 29 aa, Artificial Sequence
  Description of Artificial Sequence: Synthetic peptide
DEDEIRTTNPVATEQYGELSTNLQRGDSI

SEQ ID NO: 16649 - protein, 32 aa, Artificial Sequence
  Description of Artificial Sequence: Synthetic polypeptide
DEEEIRTTNPVATEQYGCVCSTNDHQRGNNRQ

SEQ ID NO: 16650 - protein, 32 aa, Artificial Sequence
  Description of Artificial Sequence: Synthetic polypeptide
DEEEIRTTNPVATEQYGSVSSTLPNELQNDNR

SEQ ID NO: 16651 - protein, 28 aa, Artificial Sequence
  Description of Artificial Sequence: Synthetic peptide
SEQEIRTTNPIATEQYGSVSEDLMRGNR

SEQ ID NO: 16652 - protein, 31 aa, Artificial Sequence
  Description of Artificial Sequence: Synthetic polypeptide
DEEEIRTTNPVATEQYGSVCGTNDLQTAGND

SEQ ID NO: 16653 - protein, 31 aa, Artificial Sequence
  Description of Artificial Sequence: Synthetic polypeptide
DEEEIRTTNPVATEQYGSVSELALQRGFNDV

SEQ ID NO: 16654 - protein, 30 aa, Artificial Sequence
  Description of Artificial Sequence: Synthetic polypeptide
DEEEIRTTNPVATEQYGSVSEINLQQLSNV

SEQ ID NO: 16655 - protein, 31 aa, Artificial Sequence
  Description of Artificial Sequence: Synthetic polypeptide
DENEIRTTNPVATEQYGSVISTNGGQREGLR

SEQ ID NO: 16656 - protein, 31 aa, Artificial Sequence
  Description of Artificial Sequence: Synthetic polypeptide
DENEIRTTNPVATEQYGSVISFTNLQERGDF

SEQ ID NO: 16657 - protein, 30 aa, Artificial Sequence
  Description of Artificial Sequence: Synthetic polypeptide
DEEEIRTTNPVATEQYGSYSTGLQRINIED

SEQ ID NO: 16658 - protein, 31 aa, Artificial Sequence
  Description of Artificial Sequence: Synthetic polypeptide
AEEEIRTTNPVATEQYGSVSTDNLGQGEGNN

SEQ ID NO: 16659 - protein, 32 aa, Artificial Sequence
  Description of Artificial Sequence: Synthetic polypeptide
DEEEIRTTNPVATEQYGSVSTSNVLQGGNNTE

SEQ ID NO: 16660 - protein, 29 aa, Artificial Sequence
  Description of Artificial Sequence: Synthetic peptide
YSEEIRTTNPVATESYGSCSTNLQRHGNV

SEQ ID NO: 16661 - protein, 30 aa, Artificial Sequence
  Description of Artificial Sequence: Synthetic polypeptide
DEEEIRTTNPVATEQYGSYSTNDARGNASL

SEQ ID NO: 16662 - protein, 31 aa, Artificial Sequence
  Description of Artificial Sequence: Synthetic polypeptide
DEEEIRTTNPVATEQYGSVSEGNNEQRGERD

SEQ ID NO: 16663 - protein, 29 aa, Artificial Sequence
  Description of Artificial Sequence: Synthetic peptide
CEEEIRVTNPVATEQYGSVSTNLQHIGRT

SEQ ID NO: 16664 - protein, 31 aa, Artificial Sequence
  Description of Artificial Sequence: Synthetic polypeptide
DEEEIRTTNPVATEQYGSYSLPNGLQRDSNR

SEQ ID NO: 16665 - protein, 30 aa, Artificial Sequence
  Description of Artificial Sequence: Synthetic polypeptide
DEEEIRTTNPVATEQYGSYSTNDQRINTDG

SEQ ID NO: 16666 - protein, 31 aa, Artificial Sequence
  Description of Artificial Sequence: Synthetic polypeptide
DEEEIRTTNPVATEQYGSVCITENLQRGQDN

SEQ ID NO: 16667 - protein, 29 aa, Artificial Sequence
  Description of Artificial Sequence: Synthetic peptide
DEEEIRTTNPVATEQYGSVSEGLQNRTDD

SEQ ID NO: 16668 - protein, 31 aa, Artificial Sequence
  Description of Artificial Sequence: Synthetic polypeptide
DEEEIRTTNPVATEQYGSVSEENLQVGSQRQ

SEQ ID NO: 16669 - protein, 30 aa, Artificial Sequence
  Description of Artificial Sequence: Synthetic polypeptide
YSEEISTTNPVATEQYGQSVSTNLQRGNGY

SEQ ID NO: 16670 - protein, 28 aa, Artificial Sequence
  Description of Artificial Sequence: Synthetic peptide
SEQEIRPTNPVATEQYGSVETNLQDGNQ

SEQ ID NO: 16671 - protein, 28 aa, Artificial Sequence
  Description of Artificial Sequence: Synthetic peptide
DEEEIRTTNPVATEQYGSVSELLARQEI

SEQ ID NO: 16672 - protein, 32 aa, Artificial Sequence
  Description of Artificial Sequence: Synthetic polypeptide
DEEEIRTTNPVATEQYGSVSTSNPNELQNDNR

SEQ ID NO: 16673 - protein, 31 aa, Artificial Sequence
  Description of Artificial Sequence: Synthetic polypeptide
DEEEIRTTNPVATEQYGSVSTSNLQSNGTFN

SEQ ID NO: 16674 - protein, 28 aa, Artificial Sequence
  Description of Artificial Sequence: Synthetic peptide
SEQEIRCTNPVATEQYGSVDTNLQHGNQ

SEQ ID NO: 16675 - protein, 31 aa, Artificial Sequence
  Description of Artificial Sequence: Synthetic polypeptide
DEEEIRTTNPVATEQYGSYSSPNMLQRFDNR

SEQ ID NO: 16676 - protein, 29 aa, Artificial Sequence
  Description of Artificial Sequence: Synthetic peptide
DENEIRTTNPVATEQYGSVSANLFENMNR

SEQ ID NO: 16677 - protein, 30 aa, Artificial Sequence
  Description of Artificial Sequence: Synthetic polypeptide
AEEEIRTTNPVATEQYGSVSTDQLQDGNIS

SEQ ID NO: 16678 - protein, 32 aa, Artificial Sequence
  Description of Artificial Sequence: Synthetic polypeptide
DEEEIRTTNPVATEQYGSVSTSNLVQIGTGNL

SEQ ID NO: 16679 - protein, 30 aa, Artificial Sequence
  Description of Artificial Sequence: Synthetic polypeptide
AEEEIRTTNPVATEQYGSVSTDNQQIGNEV

SEQ ID NO: 16680 - protein, 32 aa, Artificial Sequence
  Description of Artificial Sequence: Synthetic polypeptide
DEEEIRTTNPVATEQYGSVSTSNNLDQGPGNT

SEQ ID NO: 16681 - protein, 29 aa, Artificial Sequence
  Description of Artificial Sequence: Synthetic peptide
DEEEIRTTNPVATEQYGSYSTDLNREVDR

SEQ ID NO: 16682 - protein, 30 aa, Artificial Sequence
  Description of Artificial Sequence: Synthetic polypeptide
DEEEIRTTNPVATEQYGSVSELVQRGEIER

SEQ ID NO: 16683 - protein, 28 aa, Artificial Sequence
  Description of Artificial Sequence: Synthetic peptide
SEQEIRCTNPVATEQYGSVNTNLQHGNQ

SEQ ID NO: 16684 - protein, 31 aa, Artificial Sequence
  Description of Artificial Sequence: Synthetic polypeptide
DEEEIRTTNPVATEQYGSVSTSNNLQNGGEE

SEQ ID NO: 16685 - protein, 32 aa, Artificial Sequence
  Description of Artificial Sequence: Synthetic polypeptide
CEEEIRTTNPVAYEQYGSVSTGNLSQRGENYR

SEQ ID NO: 16686 - protein, 31 aa, Artificial Sequence
  Description of Artificial Sequence: Synthetic polypeptide
CEEEIRTTNPVAYEQYGSVVSCTNLQRGGNQ

SEQ ID NO: 16687 - protein, 28 aa, Artificial Sequence
  Description of Artificial Sequence: Synthetic peptide
DENEIRTTNPVATEQYGSVQTDLIRMND

SEQ ID NO: 16688 - protein, 30 aa, Artificial Sequence
  Description of Artificial Sequence: Synthetic polypeptide
DEEEIRTTNPVATEQYGSYSTDLQRGEIDN

SEQ ID NO: 16689 - protein, 28 aa, Artificial Sequence
  Description of Artificial Sequence: Synthetic peptide
SEQEIRCTNPVATEQYGSVSENLMRGER

SEQ ID NO: 16690 - protein, 30 aa, Artificial Sequence
  Description of Artificial Sequence: Synthetic polypeptide
DEEEIRTTNPVATEQYGSVNVNLDRGNNNI

SEQ ID NO: 16691 - protein, 29 aa, Artificial Sequence
  Description of Artificial Sequence: Synthetic peptide
DEEEIRTTNPVATEQYGSYSTELQVVELR

SEQ ID NO: 16692 - protein, 29 aa, Artificial Sequence
  Description of Artificial Sequence: Synthetic peptide
CEEEIRTTNPVGTEQYGSVSNNMQERGNC

SEQ ID NO: 16693 - protein, 28 aa, Artificial Sequence
  Description of Artificial Sequence: Synthetic peptide
DENEIRTTNPVATEQYGSVQTALIRMND

SEQ ID NO: 16694 - protein, 28 aa, Artificial Sequence
  Description of Artificial Sequence: Synthetic peptide
DENEIRTTNPVATEQYGSVQTALARMER

SEQ ID NO: 16695 - protein, 31 aa, Artificial Sequence
  Description of Artificial Sequence: Synthetic polypeptide
DEEEIRTTNPVATEQYGSVCFTNPQRGSNND

SEQ ID NO: 16696 - protein, 28 aa, Artificial Sequence
  Description of Artificial Sequence: Synthetic peptide
SEREIRCTNPIATEQYGSVSENLMRGNR

SEQ ID NO: 16697 - protein, 29 aa, Artificial Sequence
  Description of Artificial Sequence: Synthetic peptide
YNEEIRTTNPVATEGYGSVSTNIEQRGER

SEQ ID NO: 16698 - protein, 31 aa, Artificial Sequence
  Description of Artificial Sequence: Synthetic polypeptide
SEREIRTTNPVATEQYGCVSTNLQRFGSNRT

SEQ ID NO: 16699 - protein, 30 aa, Artificial Sequence
  Description of Artificial Sequence: Synthetic polypeptide
DEEEIRTTNPVATEQYGSYSTNLERIINEN

SEQ ID NO: 16700 - protein, 32 aa, Artificial Sequence
  Description of Artificial Sequence: Synthetic polypeptide
DEEEIRTTNPVATEQYGSVSDYNLNQRGEDDR

SEQ ID NO: 16701 - protein, 28 aa, Artificial Sequence
  Description of Artificial Sequence: Synthetic peptide
DENEIRTTNPVATEQYGDVSEDPQRGNA

SEQ ID NO: 16702 - protein, 31 aa, Artificial Sequence
  Description of Artificial Sequence: Synthetic polypeptide
DEEEIRTTNPVATEQYGSVSLTNLQRIELVN

SEQ ID NO: 16703 - protein, 30 aa, Artificial Sequence
  Description of Artificial Sequence: Synthetic polypeptide
DEEEIRTTNPVATEQYGSVSTTALERIDFR

SEQ ID NO: 16704 - protein, 31 aa, Artificial Sequence
  Description of Artificial Sequence: Synthetic polypeptide
DEEEIRTTNPVATEQYGSVSTTALNQNSTNR

SEQ ID NO: 16705 - protein, 31 aa, Artificial Sequence
  Description of Artificial Sequence: Synthetic polypeptide
DEEEIRTTNPVATEQYGSVCNTFNLEARGTR

SEQ ID NO: 16706 - protein, 29 aa, Artificial Sequence
  Description of Artificial Sequence: Synthetic peptide
DENEIRTTNPVATEQYGCVSTVLQRPNDG

SEQ ID NO: 16707 - protein, 28 aa, Artificial Sequence
  Description of Artificial Sequence: Synthetic peptide
DEDEIRTTNPVATEQYGETSTNDQRGHS

SEQ ID NO: 16708 - protein, 32 aa, Artificial Sequence
  Description of Artificial Sequence: Synthetic polypeptide
DEEEIRTTNPVATEQYGSVCNTFNLEDRGNTR

SEQ ID NO: 16709 - protein, 31 aa, Artificial Sequence
  Description of Artificial Sequence: Synthetic polypeptide
DEEEIRTTNPVATEQYGSVCNTFNLEDRGTR

SEQ ID NO: 16710 - protein, 31 aa, Artificial Sequence
  Description of Artificial Sequence: Synthetic polypeptide
DEEEIRTTNPVATEQYGSVCNTENLYERGER

SEQ ID NO: 16711 - protein, 32 aa, Artificial Sequence
  Description of Artificial Sequence: Synthetic polypeptide
DEEEIRTTNPVATEQYGSVSTTDGLQQGSTNR

SEQ ID NO: 16712 - protein, 31 aa, Artificial Sequence
  Description of Artificial Sequence: Synthetic polypeptide
DEEEIRTTNPVATEQYGSVSDTWLYQSSVNR

SEQ ID NO: 16713 - protein, 31 aa, Artificial Sequence
  Description of Artificial Sequence: Synthetic polypeptide
DEEEIRTTNPVATEQYGSVCNTFNLESRGTR

SEQ ID NO: 16714 - protein, 29 aa, Artificial Sequence
  Description of Artificial Sequence: Synthetic peptide
DEEEIRTTNPVATEQYGSVSTTDIRINGG

SEQ ID NO: 16715 - protein, 31 aa, Artificial Sequence
  Description of Artificial Sequence: Synthetic polypeptide
DEEEIRTTNPVATEQYGSVSTTDLLQRLQLR

SEQ ID NO: 16716 - protein, 31 aa, Artificial Sequence
  Description of Artificial Sequence: Synthetic polypeptide
DEEEIATTNPVAYEQYGSVACTQNLQRTGNR

SEQ ID NO: 16717 - protein, 31 aa, Artificial Sequence
  Description of Artificial Sequence: Synthetic polypeptide
DEEEIRTTNPVATEQYGSVSDTWLYQRTQNG

SEQ ID NO: 16718 - protein, 32 aa, Artificial Sequence
  Description of Artificial Sequence: Synthetic polypeptide
DEEEIRTTNPVATEQYGSVSNTNLQSEGSNIE

SEQ ID NO: 16719 - protein, 28 aa, Artificial Sequence
  Description of Artificial Sequence: Synthetic peptide
DEDEIRTTNPVATEQYGETSTNLQAGDD

SEQ ID NO: 16720 - protein, 31 aa, Artificial Sequence
  Description of Artificial Sequence: Synthetic polypeptide
DEEEIRTTNPVATEQYGSVSTTDLQSGGNED

SEQ ID NO: 16721 - protein, 31 aa, Artificial Sequence
  Description of Artificial Sequence: Synthetic polypeptide
DEEEIRTTNPVATEGYGSVSGTNLQDVGTNA

SEQ ID NO: 16722 - protein, 31 aa, Artificial Sequence
  Description of Artificial Sequence: Synthetic polypeptide
DEEEIRTTNPVATEQYGSVSDTWNYQTSQNR

SEQ ID NO: 16723 - protein, 28 aa, Artificial Sequence
  Description of Artificial Sequence: Synthetic peptide
DEDEIRTTNPVATEQYGETSQNLQRGGG

SEQ ID NO: 16724 - protein, 31 aa, Artificial Sequence
  Description of Artificial Sequence: Synthetic polypeptide
DEEEIRTTNPVATEQYGCVCSTNAPQECGNR

SEQ ID NO: 16725 - protein, 29 aa, Artificial Sequence
  Description of Artificial Sequence: Synthetic peptide
DENEIRTTNPVATEQYGEMTSTNLQRGDS

SEQ ID NO: 16726 - protein, 29 aa, Artificial Sequence
  Description of Artificial Sequence: Synthetic peptide
AEEEIRTTNPVATEQYGSVSTDNGNGGNT

SEQ ID NO: 16727 - protein, 32 aa, Artificial Sequence
  Description of Artificial Sequence: Synthetic polypeptide
DEEEIRTTNPVATEQYGSVSTSPNLDQHGPNL

SEQ ID NO: 16728 - protein, 29 aa, Artificial Sequence
  Description of Artificial Sequence: Synthetic peptide
DENEIRTTNPVATEQYGSVATALIRDMNR

SEQ ID NO: 16729 - protein, 30 aa, Artificial Sequence
  Description of Artificial Sequence: Synthetic polypeptide
DEEEIRTTNPVATEQYGSVSTSSPQRGVEL

SEQ ID NO: 16730 - protein, 32 aa, Artificial Sequence
  Description of Artificial Sequence: Synthetic polypeptide
DEEEIRTTNPVATEQYGSVSTSTLMQEVGENR

SEQ ID NO: 16731 - protein, 32 aa, Artificial Sequence
  Description of Artificial Sequence: Synthetic polypeptide
DEEEIRTTNPVATDQYGSVSCTGNLSQRGGNG

SEQ ID NO: 16732 - protein, 28 aa, Artificial Sequence
  Description of Artificial Sequence: Synthetic peptide
DEDEIRTTNPVATEQYGEMTTNLQRGDS

SEQ ID NO: 16733 - protein, 29 aa, Artificial Sequence
  Description of Artificial Sequence: Synthetic peptide
DENEIRTTNPVATEQYGSISTNQQREILR

SEQ ID NO: 16734 - protein, 29 aa, Artificial Sequence
  Description of Artificial Sequence: Synthetic peptide
DENEIRTTNPVATEQYGSISTNQQREGEQ

SEQ ID NO: 16735 - protein, 30 aa, Artificial Sequence
  Description of Artificial Sequence: Synthetic polypeptide
DEEEIRTTNPVATEQYGSVNTVLQMGVDDR

SEQ ID NO: 16736 - protein, 29 aa, Artificial Sequence
  Description of Artificial Sequence: Synthetic peptide
DEDEIRTTNPVATEQYGESSTNLQRGSDA

SEQ ID NO: 16737 - protein, 29 aa, Artificial Sequence
  Description of Artificial Sequence: Synthetic peptide
AEEEIRTTNPVATEQYGSVSTDLQQANST

SEQ ID NO: 16738 - protein, 31 aa, Artificial Sequence
  Description of Artificial Sequence: Synthetic polypeptide
YSEEIRTTNPVATEQYGSVSCTNALERMGNR

SEQ ID NO: 16739 - protein, 30 aa, Artificial Sequence
  Description of Artificial Sequence: Synthetic polypeptide
AEEEIRTTNPVATEQYGSVSTDLQIGGNTE

SEQ ID NO: 16740 - protein, 30 aa, Artificial Sequence
  Description of Artificial Sequence: Synthetic polypeptide
AEEEIRTTNPVATEQYGSVSTDLQGQGNAA

SEQ ID NO: 16741 - protein, 31 aa, Artificial Sequence
  Description of Artificial Sequence: Synthetic polypeptide
DEEEIRTTNPVATEQYGSVCNTCNLYGRGPR

SEQ ID NO: 16742 - protein, 29 aa, Artificial Sequence
  Description of Artificial Sequence: Synthetic peptide
AEEEIRTTNPVATEQYGSVSTDLQEINAT

SEQ ID NO: 16743 - protein, 30 aa, Artificial Sequence
  Description of Artificial Sequence: Synthetic polypeptide
DEEEIRTTNPVATEQYGSYSTNLQQAVTRI

SEQ ID NO: 16744 - protein, 30 aa, Artificial Sequence
  Description of Artificial Sequence: Synthetic polypeptide
DENEIRTTNPVATEQYGHVSWTNLNRGMDR

SEQ ID NO: 16745 - protein, 31 aa, Artificial Sequence
  Description of Artificial Sequence: Synthetic polypeptide
DEEEIRTTNPVATEQYGSVCNTELQRTGEQR

SEQ ID NO: 16746 - protein, 29 aa, Artificial Sequence
  Description of Artificial Sequence: Synthetic peptide
AEEEIRTTNPVATEQYGSVSTDGQAGINV

SEQ ID NO: 16747 - protein, 29 aa, Artificial Sequence
  Description of Artificial Sequence: Synthetic peptide
DEEEIRTTNPVATEQYGSVSSTLERQNVN

SEQ ID NO: 16748 - protein, 30 aa, Artificial Sequence
  Description of Artificial Sequence: Synthetic polypeptide
DEEEIRTTNPVATEQYGSYSTNLQQRLEPD

SEQ ID NO: 16749 - protein, 30 aa, Artificial Sequence
  Description of Artificial Sequence: Synthetic polypeptide
DEEEIRTTNPVATEQYGSVCLTNLQNGLLI

SEQ ID NO: 16750 - protein, 29 aa, Artificial Sequence
  Description of Artificial Sequence: Synthetic peptide
DEAEIRTTNPVATEQYGTVSTNLQHNGEQ

SEQ ID NO: 16751 - protein, 29 aa, Artificial Sequence
  Description of Artificial Sequence: Synthetic peptide
DENEIRTTNPVATEIYGSVSNDNLQRGQF

SEQ ID NO: 16752 - protein, 29 aa, Artificial Sequence
  Description of Artificial Sequence: Synthetic peptide
YLEEIGTTNPVATEQYGSVAITNLQRGER

SEQ ID NO: 16753 - protein, 32 aa, Artificial Sequence
  Description of Artificial Sequence: Synthetic polypeptide
DEEEIRTTNPVATEAWGSVSCTNELSQRNGNR

SEQ ID NO: 16754 - protein, 30 aa, Artificial Sequence
  Description of Artificial Sequence: Synthetic polypeptide
DEEEIRTTNPVATEAWGSVSCTNHQRGGNQ

SEQ ID NO: 16755 - protein, 31 aa, Artificial Sequence
  Description of Artificial Sequence: Synthetic polypeptide
DEEEIRTTNPVATEQYGSVCSNTNHQRFQNI

SEQ ID NO: 16756 - protein, 29 aa, Artificial Sequence
  Description of Artificial Sequence: Synthetic peptide
YETEIRTTNPVATEQYGSASTNLQRVNSG

SEQ ID NO: 16757 - protein, 33 aa, Artificial Sequence
  Description of Artificial Sequence: Synthetic polypeptide
DEEEIRTTNPVATEQYGSVCSNTNLGQRLGNAI

SEQ ID NO: 16758 - protein, 32 aa, Artificial Sequence
  Description of Artificial Sequence: Synthetic polypeptide
DEEEIRTTNPVATEQYGSVSLTNLQRTGMEIE

SEQ ID NO: 16759 - protein, 31 aa, Artificial Sequence
  Description of Artificial Sequence: Synthetic polypeptide
AEEEIRTTNPVATEQYGSVSSTTNLSQTGNQ

SEQ ID NO: 16760 - protein, 33 aa, Artificial Sequence
  Description of Artificial Sequence: Synthetic polypeptide
DEEEIRTTNPVATEQYGSVCSNTNLQARGGSNI

SEQ ID NO: 16761 - protein, 32 aa, Artificial Sequence
  Description of Artificial Sequence: Synthetic polypeptide
DEEEIRTTNPVATEQYGSVSTTMNLGQNDGNG

SEQ ID NO: 16762 - protein, 31 aa, Artificial Sequence
  Description of Artificial Sequence: Synthetic polypeptide
AEEEIRTTNPVATEQYGSVSSTTNLQSGVNA

SEQ ID NO: 16763 - protein, 31 aa, Artificial Sequence
  Description of Artificial Sequence: Synthetic polypeptide
DEEEIRTTNPVATEQYGSVCSNTNDQRGQQT

SEQ ID NO: 16764 - protein, 31 aa, Artificial Sequence
  Description of Artificial Sequence: Synthetic polypeptide
DEEEIRTTNPVATEQYGTCAVSTNPQRGSNE

SEQ ID NO: 16765 - protein, 32 aa, Artificial Sequence
  Description of Artificial Sequence: Synthetic polypeptide
AEEEIRTTNPVATEQYGSVSSTTNLQQNGVNR

SEQ ID NO: 16766 - protein, 32 aa, Artificial Sequence
  Description of Artificial Sequence: Synthetic polypeptide
DEEEIRTTNPVATEQYGSVSLTNLQRVGAIFD

SEQ ID NO: 16767 - protein, 31 aa, Artificial Sequence
  Description of Artificial Sequence: Synthetic polypeptide
DEEEIRTTNPVATEQYGSVCSNTNLQHINQM

SEQ ID NO: 16768 - protein, 31 aa, Artificial Sequence
  Description of Artificial Sequence: Synthetic polypeptide
AEEEIRTTNPVATEQYGSVSSTTNLQQGENP

SEQ ID NO: 16769 - protein, 31 aa, Artificial Sequence
  Description of Artificial Sequence: Synthetic polypeptide
DEEEIRTTNPVATEQYGSVCSNTNLQNNNAM

SEQ ID NO: 16770 - protein, 29 aa, Artificial Sequence
  Description of Artificial Sequence: Synthetic peptide
DENEIRCTNPIATEQYGSVSENLMRNGNR

SEQ ID NO: 16771 - protein, 32 aa, Artificial Sequence
  Description of Artificial Sequence: Synthetic polypeptide
DEEEIRTTNPVATEAWGSVSCTNSLSQRGTNR

SEQ ID NO: 16772 - protein, 32 aa, Artificial Sequence
  Description of Artificial Sequence: Synthetic polypeptide
DEEEIRTTNPVATEQYGSVSTTMNLQQGENIG

SEQ ID NO: 16773 - protein, 28 aa, Artificial Sequence
  Description of Artificial Sequence: Synthetic peptide
DENEIRCTNPIATEQYGDVSENLMRGNR

SEQ ID NO: 16774 - protein, 31 aa, Artificial Sequence
  Description of Artificial Sequence: Synthetic polypeptide
AEEEIRTTNPVATEQYGSVSSTTNLQNVGNN

SEQ ID NO: 16775 - protein, 33 aa, Artificial Sequence
  Description of Artificial Sequence: Synthetic polypeptide
DEEEIRTTNPVATEQYGSVCSNTNLQEYGSNNR

SEQ ID NO: 16776 - protein, 32 aa, Artificial Sequence
  Description of Artificial Sequence: Synthetic polypeptide
DEEEIRTTNPVATEQYGSVCSNTNLQRIGEQT

SEQ ID NO: 16777 - protein, 32 aa, Artificial Sequence
  Description of Artificial Sequence: Synthetic polypeptide
DEEEIRTTNPVATEAWGSVSCTNELQRTGNRW

SEQ ID NO: 16778 - protein, 30 aa, Artificial Sequence
  Description of Artificial Sequence: Synthetic polypeptide
YETEIRTTNPVATEQYGSAVSNPNLQRGNT

SEQ ID NO: 16779 - protein, 30 aa, Artificial Sequence
  Description of Artificial Sequence: Synthetic polypeptide
YETEIRTTNPVATEQYGSVSTNLALTGNQR

SEQ ID NO: 16780 - protein, 30 aa, Artificial Sequence
  Description of Artificial Sequence: Synthetic polypeptide
DEEEIRTTNPVATEQYGSVSTTMLDRGEEN

SEQ ID NO: 16781 - protein, 31 aa, Artificial Sequence
  Description of Artificial Sequence: Synthetic polypeptide
YETEIRTTNPVATEQYGSVSPTNLQNRPGIR

SEQ ID NO: 16782 - protein, 31 aa, Artificial Sequence
  Description of Artificial Sequence: Synthetic polypeptide
YETEIRTTNPVATEQYGSVLSTENLARGNRP

SEQ ID NO: 16783 - protein, 29 aa, Artificial Sequence
  Description of Artificial Sequence: Synthetic peptide
YETEIRTTNPVATEQYGSVCYSNLQRGNV

SEQ ID NO: 16784 - protein, 29 aa, Artificial Sequence
  Description of Artificial Sequence: Synthetic peptide
SESEIRTTNPIATEQYGSVSENLMDRGNR

SEQ ID NO: 16785 - protein, 32 aa, Artificial Sequence
  Description of Artificial Sequence: Synthetic polypeptide
DEEEIRTTNPVATEQYGSVCSNTELQRDSNRA

SEQ ID NO: 16786 - protein, 31 aa, Artificial Sequence
  Description of Artificial Sequence: Synthetic polypeptide
DEEEIRTTNPVATEQYGSVSTTMLDRGEQRE

SEQ ID NO: 16787 - protein, 30 aa, Artificial Sequence
  Description of Artificial Sequence: Synthetic polypeptide
YETEIRTTNPVATEQYGSMVSTPLQPGNGR

SEQ ID NO: 16788 - protein, 30 aa, Artificial Sequence
  Description of Artificial Sequence: Synthetic polypeptide
DENEIRTTNPIATEQYGSVSEENLQMRGNH

SEQ ID NO: 16789 - protein, 32 aa, Artificial Sequence
  Description of Artificial Sequence: Synthetic polypeptide
DEEEIRTTNPVATEQYGSVSDTNLQRNSNFQP

SEQ ID NO: 16790 - protein, 32 aa, Artificial Sequence
  Description of Artificial Sequence: Synthetic polypeptide
DEEEIRTTNPVATEQYGSVSTTMMLERGNERP

SEQ ID NO: 16791 - protein, 32 aa, Artificial Sequence
  Description of Artificial Sequence: Synthetic polypeptide
DEEEIRTTNPVATEQYGSVSSTGNLQDGNFGQ

SEQ ID NO: 16792 - protein, 30 aa, Artificial Sequence
  Description of Artificial Sequence: Synthetic polypeptide
YETEIRTTNPVATEQYGSCSFTNLNQRMNR

SEQ ID NO: 16793 - protein, 30 aa, Artificial Sequence
  Description of Artificial Sequence: Synthetic polypeptide
DEEEIRTTNPVATEQYGTASTINNLQRENN

SEQ ID NO: 16794 - protein, 30 aa, Artificial Sequence
  Description of Artificial Sequence: Synthetic polypeptide
DEDEIRTTNPVATEQYGHVSTNLQNGDGNS

SEQ ID NO: 16795 - protein, 28 aa, Artificial Sequence
  Description of Artificial Sequence: Synthetic peptide
DENEIRTTNGVAYCQYGSVSTNLQRGEQ

SEQ ID NO: 16796 - protein, 29 aa, Artificial Sequence
  Description of Artificial Sequence: Synthetic peptide
DEDEIRTTNPVATEQYGITSTNPLQRGGS

SEQ ID NO: 16797 - protein, 28 aa, Artificial Sequence
  Description of Artificial Sequence: Synthetic peptide
DENEIRTTNGVAYCQYGSVSTNLQRGDD

SEQ ID NO: 16798 - protein, 30 aa, Artificial Sequence
  Description of Artificial Sequence: Synthetic polypeptide
DEEEIRTTNPVATEQYGTASTNNTLQRENN

SEQ ID NO: 16799 - protein, 30 aa, Artificial Sequence
  Description of Artificial Sequence: Synthetic polypeptide
DEDEIRTTNPVATEQYGIVSTNLQDGMGNH

SEQ ID NO: 16800 - protein, 32 aa, Artificial Sequence
  Description of Artificial Sequence: Synthetic polypeptide
DEEEIRTTNPVATEQYGSVCSNTNDLDRNGNV

SEQ ID NO: 16801 - protein, 31 aa, Artificial Sequence
  Description of Artificial Sequence: Synthetic polypeptide
DEEEIRTTNPVATEQYGSVSTTMMLERTNDR

SEQ ID NO: 16802 - protein, 31 aa, Artificial Sequence
  Description of Artificial Sequence: Synthetic polypeptide
DEEEIRTTNPVATEQYGSVCSNTNLQRQIQT

SEQ ID NO: 16803 - protein, 30 aa, Artificial Sequence
  Description of Artificial Sequence: Synthetic polypeptide
DEEEIRTTNPVATEQYGTCSTDNELQRENN

SEQ ID NO: 16804 - protein, 29 aa, Artificial Sequence
  Description of Artificial Sequence: Synthetic peptide
YETEIRTTNPVATEQYGSASTNLQRDNGG

SEQ ID NO: 16805 - protein, 30 aa, Artificial Sequence
  Description of Artificial Sequence: Synthetic polypeptide
DEEEIRTTNPVATEQYGTCSTINELQRDNN

SEQ ID NO: 16806 - protein, 32 aa, Artificial Sequence
  Description of Artificial Sequence: Synthetic polypeptide
DEEEIRTTNPVATEQYGSVSTTNDLERGNENF

SEQ ID NO: 16807 - protein, 31 aa, Artificial Sequence
  Description of Artificial Sequence: Synthetic polypeptide
DEEEIRTTNPVATEQYGSVCSNTYLQHFNNR

SEQ ID NO: 16808 - protein, 31 aa, Artificial Sequence
  Description of Artificial Sequence: Synthetic polypeptide
AEEEIRTTNPVATEQYGSVSSTTNLGGGNER

SEQ ID NO: 16809 - protein, 32 aa, Artificial Sequence
  Description of Artificial Sequence: Synthetic polypeptide
DEEEIRTTNPVATEGYGSVSTGNLQFGSNNRG

SEQ ID NO: 16810 - protein, 29 aa, Artificial Sequence
  Description of Artificial Sequence: Synthetic peptide
DENEIATTNPVAYEQYGSVSTNLSQKGNL

SEQ ID NO: 16811 - protein, 32 aa, Artificial Sequence
  Description of Artificial Sequence: Synthetic polypeptide
DEEEIRTTNPVATEQYGSVCSPDNLQNGNERG

SEQ ID NO: 16812 - protein, 30 aa, Artificial Sequence
  Description of Artificial Sequence: Synthetic polypeptide
DEEEIRTTNPVATEQYGSVCSPELQRGDDG

SEQ ID NO: 16813 - protein, 32 aa, Artificial Sequence
  Description of Artificial Sequence: Synthetic polypeptide
DEEEIRTTNPVATEQYGSVSTTNDLQRNENGI

SEQ ID NO: 16814 - protein, 32 aa, Artificial Sequence
  Description of Artificial Sequence: Synthetic polypeptide
DEEEIRTTNPVATEQYGSVCSPLLQRQGENRL

SEQ ID NO: 16815 - protein, 30 aa, Artificial Sequence
  Description of Artificial Sequence: Synthetic polypeptide
YESELRTTNPVATEQYGSVSTNNLQRGGVR

SEQ ID NO: 16816 - protein, 31 aa, Artificial Sequence
  Description of Artificial Sequence: Synthetic polypeptide
DEEEIRTTNPVATEQYGSVCSPMLDQREGVR

SEQ ID NO: 16817 - protein, 30 aa, Artificial Sequence
  Description of Artificial Sequence: Synthetic polypeptide
AEEEIRTTNPVATEQYGSVSSTTLLQQGNS

SEQ ID NO: 16818 - protein, 30 aa, Artificial Sequence
  Description of Artificial Sequence: Synthetic polypeptide
AEEEIRTTNPVATEQYGSVSSTSNVQGGND

SEQ ID NO: 16819 - protein, 29 aa, Artificial Sequence
  Description of Artificial Sequence: Synthetic peptide
DEDVIATTNPVATEQFGSVSTQGLQRGNR

SEQ ID NO: 16820 - protein, 30 aa, Artificial Sequence
  Description of Artificial Sequence: Synthetic polypeptide
AEEEIRTTNPVATEQYGSVSSTSNNQTGNN

SEQ ID NO: 16821 - protein, 31 aa, Artificial Sequence
  Description of Artificial Sequence: Synthetic polypeptide
DEEEIRTTNPVATEQYGSWSSPNMLQERDNR

SEQ ID NO: 16822 - protein, 31 aa, Artificial Sequence
  Description of Artificial Sequence: Synthetic polypeptide
DEEEIRTTNPVATEQYGSVSNTNNGQSGEDR

SEQ ID NO: 16823 - protein, 29 aa, Artificial Sequence
  Description of Artificial Sequence: Synthetic peptide
DEDEIRTTNPVATEQYGNTSTNLQDRGDS

SEQ ID NO: 16824 - protein, 30 aa, Artificial Sequence
  Description of Artificial Sequence: Synthetic polypeptide
DEEEIRTTNPVATEQYGSVNTNLNRNENVS

SEQ ID NO: 16825 - protein, 28 aa, Artificial Sequence
  Description of Artificial Sequence: Synthetic peptide
DENEIATTNPVATEQYGSVSTDLEHGNL

SEQ ID NO: 16826 - protein, 32 aa, Artificial Sequence
  Description of Artificial Sequence: Synthetic polypeptide
DEEEIRTTNPVATEQYGSVCSPTNLDQRVEND

SEQ ID NO: 16827 - protein, 31 aa, Artificial Sequence
  Description of Artificial Sequence: Synthetic polypeptide
DEEEIRTTNPVATEQYGSVSLTNLQVNENDQ

SEQ ID NO: 16828 - protein, 30 aa, Artificial Sequence
  Description of Artificial Sequence: Synthetic polypeptide
DEEEIRTTNPVATEQYGSVSSTGLQGGELG

SEQ ID NO: 16829 - protein, 31 aa, Artificial Sequence
  Description of Artificial Sequence: Synthetic polypeptide
DEEEIRTTNPVATEQYGSWSTNELQETGNQA

SEQ ID NO: 16830 - protein, 31 aa, Artificial Sequence
  Description of Artificial Sequence: Synthetic polypeptide
DEEEIRTTNPVATEQYGSVSDTNIQRGEEHE

SEQ ID NO: 16831 - protein, 28 aa, Artificial Sequence
  Description of Artificial Sequence: Synthetic peptide
DENEICTVNPVATEQYGSVSTNLFNGNH

SEQ ID NO: 16832 - protein, 31 aa, Artificial Sequence
  Description of Artificial Sequence: Synthetic polypeptide
YETEIRTTNPVATEQYGNVSTNLNQRSGNRA

SEQ ID NO: 16833 - protein, 28 aa, Artificial Sequence
  Description of Artificial Sequence: Synthetic peptide
DENEICTVNPVATEQYGSVSTNLFEGNT

SEQ ID NO: 16834 - protein, 28 aa, Artificial Sequence
  Description of Artificial Sequence: Synthetic peptide
DENEICTVNPVATEQYGSVSTNLFEGNS

SEQ ID NO: 16835 - protein, 28 aa, Artificial Sequence
  Description of Artificial Sequence: Synthetic peptide
DENEICTVNPVATEQYGSVSTNLAEGNA

SEQ ID NO: 16836 - protein, 32 aa, Artificial Sequence
  Description of Artificial Sequence: Synthetic polypeptide
AEEEIRTTNPVATEQYGSVSSTTNLQEQGNIR

SEQ ID NO: 16837 - protein, 32 aa, Artificial Sequence
  Description of Artificial Sequence: Synthetic polypeptide
DEEEIRTTNPVATEQYGSVCSNTNLQRSGIQA

SEQ ID NO: 16838 - protein, 32 aa, Artificial Sequence
  Description of Artificial Sequence: Synthetic polypeptide
DEEEIRTTNPVATEQYGSVSLTNLQSIGENQE

SEQ ID NO: 16839 - protein, 29 aa, Artificial Sequence
  Description of Artificial Sequence: Synthetic peptide
DENEICTTNPVATEQYGSVSTNLDNGNED

SEQ ID NO: 16840 - protein, 29 aa, Artificial Sequence
  Description of Artificial Sequence: Synthetic peptide
DENEICTTNPVATEQYGSVATNLERGNEQ

SEQ ID NO: 16841 - protein, 29 aa, Artificial Sequence
  Description of Artificial Sequence: Synthetic peptide
DENEICTTNPVATEPYGSVSTNLQHGNEN

SEQ ID NO: 16842 - protein, 28 aa, Artificial Sequence
  Description of Artificial Sequence: Synthetic peptide
DENEICTTNPVATEPYGSVSNNLQRGTS

SEQ ID NO: 16843 - protein, 29 aa, Artificial Sequence
  Description of Artificial Sequence: Synthetic peptide
DEEEIRTTNPVATEQYGSVNTNLQNPEDN

SEQ ID NO: 16844 - protein, 31 aa, Artificial Sequence
  Description of Artificial Sequence: Synthetic polypeptide
DEEEIRTTNPVATEGYGSVSTGELQSGSNNR

SEQ ID NO: 16845 - protein, 32 aa, Artificial Sequence
  Description of Artificial Sequence: Synthetic polypeptide
DEEEIRTTNPVATEQYGSVCSNTNLQSSGNFV

SEQ ID NO: 16846 - protein, 30 aa, Artificial Sequence
  Description of Artificial Sequence: Synthetic polypeptide
DEEEIRTTNPVATEQYGSVNTNLQLEGDQD

SEQ ID NO: 16847 - protein, 28 aa, Artificial Sequence
  Description of Artificial Sequence: Synthetic peptide
CEEYICTTNPVATEQYGSVSMNSQRGNS

SEQ ID NO: 16848 - protein, 30 aa, Artificial Sequence
  Description of Artificial Sequence: Synthetic polypeptide
DENEICTTNPTATEQYGSVATNLQNRGNDR

SEQ ID NO: 16849 - protein, 33 aa, Artificial Sequence
  Description of Artificial Sequence: Synthetic polypeptide
DEEEIRTTNPVATEQYGSVCSNTNNLQFGSNRA

SEQ ID NO: 16850 - protein, 30 aa, Artificial Sequence
  Description of Artificial Sequence: Synthetic polypeptide
DENEICTTNPCATEQYGSVPTNLQHRGNGR

SEQ ID NO: 16851 - protein, 28 aa, Artificial Sequence
  Description of Artificial Sequence: Synthetic peptide
DENEICTTNGVAYDQYGSVSTNLQRGDR

SEQ ID NO: 16852 - protein, 29 aa, Artificial Sequence
  Description of Artificial Sequence: Synthetic peptide
YESNIRTTNPVATEQYGSVSTMNLQSGNV

SEQ ID NO: 16853 - protein, 30 aa, Artificial Sequence
  Description of Artificial Sequence: Synthetic polypeptide
DEEEIRTTNPVATEQYGSVSTTNDIQGGSD

SEQ ID NO: 16854 - protein, 31 aa, Artificial Sequence
  Description of Artificial Sequence: Synthetic polypeptide
DEEEIRTTNPVATEQYGSVNTNLQSMGLDDR

SEQ ID NO: 16855 - protein, 28 aa, Artificial Sequence
  Description of Artificial Sequence: Synthetic peptide
DENEIRTTNPVATDQYGSVATQLQDGND

SEQ ID NO: 16856 - protein, 29 aa, Artificial Sequence
  Description of Artificial Sequence: Synthetic peptide
DEDEIRTTNPVATEQYGEVTSTNLQSGDG

SEQ ID NO: 16857 - protein, 29 aa, Artificial Sequence
  Description of Artificial Sequence: Synthetic peptide
DENEIRTTNPVATDQYGSVNTGLQRGLND

SEQ ID NO: 16858 - protein, 28 aa, Artificial Sequence
  Description of Artificial Sequence: Synthetic peptide
DENEIRTTNPVATEGYGSVSNNLQHGTW

SEQ ID NO: 16859 - protein, 28 aa, Artificial Sequence
  Description of Artificial Sequence: Synthetic peptide
SESEIRCTNPIATEQYGSVSENLQRGQR

SEQ ID NO: 16860 - protein, 30 aa, Artificial Sequence
  Description of Artificial Sequence: Synthetic polypeptide
DEDEIRTTNPVATEQYGEVSTNLQEGGNNH

SEQ ID NO: 16861 - protein, 32 aa, Artificial Sequence
  Description of Artificial Sequence: Synthetic polypeptide
DEEEIRTTNPVATEQYGSVCSDWNHQRGSNNR

SEQ ID NO: 16862 - protein, 31 aa, Artificial Sequence
  Description of Artificial Sequence: Synthetic polypeptide
DEEEIRTTNPVATEQYGSVNTNLSQHGTNDN

SEQ ID NO: 16863 - protein, 30 aa, Artificial Sequence
  Description of Artificial Sequence: Synthetic polypeptide
DEDEIRTTNPVATEQYGEVSTNLQGGGQNH

SEQ ID NO: 16864 - protein, 31 aa, Artificial Sequence
  Description of Artificial Sequence: Synthetic polypeptide
DEEEIRTTNPVATEQYGSVSNTNLVHRMGLQ

SEQ ID NO: 16865 - protein, 28 aa, Artificial Sequence
  Description of Artificial Sequence: Synthetic peptide
DENEIRTTNPVATECYGSVSTDDQIGNL

SEQ ID NO: 16866 - protein, 32 aa, Artificial Sequence
  Description of Artificial Sequence: Synthetic polypeptide
DEEEIRTTNPVATEQYGSVSLTNLQRNTVNQD

SEQ ID NO: 16867 - protein, 30 aa, Artificial Sequence
  Description of Artificial Sequence: Synthetic polypeptide
DEEEIRTTNPVATEQYGSVCSEGNLQNNNE

SEQ ID NO: 16868 - protein, 29 aa, Artificial Sequence
  Description of Artificial Sequence: Synthetic peptide
DENEIRTTNPVATEGYGSVSNPNLQRGTW

SEQ ID NO: 16869 - protein, 31 aa, Artificial Sequence
  Description of Artificial Sequence: Synthetic polypeptide
CEEEISTTNPVATEQYGSVCSTNLQRMSNRP

SEQ ID NO: 16870 - protein, 31 aa, Artificial Sequence
  Description of Artificial Sequence: Synthetic polypeptide
AEEEIRTTNPVATEQYGSVSSVTNLQNIGND

SEQ ID NO: 16871 - protein, 31 aa, Artificial Sequence
  Description of Artificial Sequence: Synthetic polypeptide
DEDEIRTTNPVATEQYGEVSTNLQNGDGNMR

SEQ ID NO: 16872 - protein, 31 aa, Artificial Sequence
  Description of Artificial Sequence: Synthetic polypeptide
AEEEIRTTNPVATEQYGSVSSVTNLQDGNDG

SEQ ID NO: 16873 - protein, 28 aa, Artificial Sequence
  Description of Artificial Sequence: Synthetic peptide
DENEIRTTNPVATECYGSVSNNLQHGDY

SEQ ID NO: 16874 - protein, 31 aa, Artificial Sequence
  Description of Artificial Sequence: Synthetic polypeptide
DEEEIRTTNPVATEAWGKVSTNLSQERVGNR

SEQ ID NO: 16875 - protein, 28 aa, Artificial Sequence
  Description of Artificial Sequence: Synthetic peptide
DENEIRTTNPVATECYGSVSNNLQAGEA

SEQ ID NO: 16876 - protein, 32 aa, Artificial Sequence
  Description of Artificial Sequence: Synthetic polypeptide
DEEEIRTTNPVATEQYGSVCSETNLQQGENPE

SEQ ID NO: 16877 - protein, 30 aa, Artificial Sequence
  Description of Artificial Sequence: Synthetic polypeptide
DEEEIRTTNPVATEQYGSVCSGNEQDGGDR

SEQ ID NO: 16878 - protein, 30 aa, Artificial Sequence
  Description of Artificial Sequence: Synthetic polypeptide
YEYEIRTTNPVATEQYGSCSDTNLNQRDNR

SEQ ID NO: 16879 - protein, 31 aa, Artificial Sequence
  Description of Artificial Sequence: Synthetic polypeptide
DEEEIRTTNPVATEQYGSVSDTNNQIVGNEV

SEQ ID NO: 16880 - protein, 31 aa, Artificial Sequence
  Description of Artificial Sequence: Synthetic polypeptide
DEDEIRTTNPVATEQYGEVSTNLQMDGNGQR

SEQ ID NO: 16881 - protein, 31 aa, Artificial Sequence
  Description of Artificial Sequence: Synthetic polypeptide
DEEEIRTTNPVATEQYGSVSTTLQQRVGEQN

SEQ ID NO: 16882 - protein, 33 aa, Artificial Sequence
  Description of Artificial Sequence: Synthetic polypeptide
DEEEIRTTNPVATEQYGSVCSDTNLQRGSNGQP

SEQ ID NO: 16883 - protein, 28 aa, Artificial Sequence
  Description of Artificial Sequence: Synthetic peptide
SESEIRCTNPIATEQYGSVSENLMRGNR

SEQ ID NO: 16884 - protein, 30 aa, Artificial Sequence
  Description of Artificial Sequence: Synthetic polypeptide
YGEEIRTTNPVATEQYGSVSTNGQRAGNVD

SEQ ID NO: 16885 - protein, 33 aa, Artificial Sequence
  Description of Artificial Sequence: Synthetic polypeptide
DEEEIRTTNPVATEQYGSYTSMTENLSQRTGNR

SEQ ID NO: 16886 - protein, 28 aa, Artificial Sequence
  Description of Artificial Sequence: Synthetic peptide
DENEIRTTNPVATEIYGSVSLLLQRGTF

SEQ ID NO: 16887 - protein, 28 aa, Artificial Sequence
  Description of Artificial Sequence: Synthetic peptide
DENEIRTTNPVATEIYGSVSGNTQRGTV

SEQ ID NO: 16888 - protein, 29 aa, Artificial Sequence
  Description of Artificial Sequence: Synthetic peptide
DEECIETVNPVATEGYGSVSSTNLERGNR

SEQ ID NO: 16889 - protein, 33 aa, Artificial Sequence
  Description of Artificial Sequence: Synthetic polypeptide
DEEEIRTTNPVATEQYGSVCSCTNALSGQGGNR

SEQ ID NO: 16890 - protein, 32 aa, Artificial Sequence
  Description of Artificial Sequence: Synthetic polypeptide
DEEEIRTTNPVATEQYGSVSTTLNLQTEGNNL

SEQ ID NO: 16891 - protein, 31 aa, Artificial Sequence
  Description of Artificial Sequence: Synthetic polypeptide
DEEEIRTTNPVATEGYGSVSTDNLQEGENIQ

SEQ ID NO: 16892 - protein, 31 aa, Artificial Sequence
  Description of Artificial Sequence: Synthetic polypeptide
DEEEIRTTNPVATEGYGSVSTDNLQNGGNIQ

SEQ ID NO: 16893 - protein, 28 aa, Artificial Sequence
  Description of Artificial Sequence: Synthetic peptide
DENEIRTTNPVATEIYGSVHNNLQRGTC

SEQ ID NO: 16894 - protein, 30 aa, Artificial Sequence
  Description of Artificial Sequence: Synthetic polypeptide
DEEEIRTTNPVATEQYGSVSDTNPGQRTEL

SEQ ID NO: 16895 - protein, 29 aa, Artificial Sequence
  Description of Artificial Sequence: Synthetic peptide
DENEIRTTNPVATEIYGSVCSSNLQRGDL

SEQ ID NO: 16896 - protein, 32 aa, Artificial Sequence
  Description of Artificial Sequence: Synthetic polypeptide
DEEEIRTTNPVATEQYGSVCSCTNLSTQVGSR

SEQ ID NO: 16897 - protein, 30 aa, Artificial Sequence
  Description of Artificial Sequence: Synthetic polypeptide
DEEEIRTTNPVATEQYGSVSTTLQDGMDED

SEQ ID NO: 16898 - protein, 31 aa, Artificial Sequence
  Description of Artificial Sequence: Synthetic polypeptide
DEEEIRTTNPVATEGYGSVSTDNLQVGNIQN

SEQ ID NO: 16899 - protein, 32 aa, Artificial Sequence
  Description of Artificial Sequence: Synthetic polypeptide
DEEEIRTTNPVATEQYGCVCSTMLNQRGSNRL

SEQ ID NO: 16900 - protein, 32 aa, Artificial Sequence
  Description of Artificial Sequence: Synthetic polypeptide
DEEEIRTTNPVATEQYGSVSLTNLQRMGELLQ

SEQ ID NO: 16901 - protein, 28 aa, Artificial Sequence
  Description of Artificial Sequence: Synthetic peptide
DENEIRTTNPVATEIYGDVSNNLQRGTG

SEQ ID NO: 16902 - protein, 31 aa, Artificial Sequence
  Description of Artificial Sequence: Synthetic polypeptide
DEDEIRTTNPVATEQYGETVSTNLSQRGDNS

SEQ ID NO: 16903 - protein, 28 aa, Artificial Sequence
  Description of Artificial Sequence: Synthetic peptide
DENEIRTTNPVATEIYGCVSWNLQRGED

SEQ ID NO: 16904 - protein, 31 aa, Artificial Sequence
  Description of Artificial Sequence: Synthetic polypeptide
DEEEIRTTNPVATEQYGSVCSDNLQTGLVRD

SEQ ID NO: 16905 - protein, 33 aa, Artificial Sequence
  Description of Artificial Sequence: Synthetic polypeptide
DEEEIRTTNPVATEQYGSVSNTNLQREGPNEEM

SEQ ID NO: 16906 - protein, 31 aa, Artificial Sequence
  Description of Artificial Sequence: Synthetic polypeptide
DEEEIRTTNPVATEQYGSWSWPNTLEQRDNR

SEQ ID NO: 16907 - protein, 32 aa, Artificial Sequence
  Description of Artificial Sequence: Synthetic polypeptide
DEEEIRTTNPVATEQYGSVSNTNLQQNEGGNG

SEQ ID NO: 16908 - protein, 28 aa, Artificial Sequence
  Description of Artificial Sequence: Synthetic peptide
DENEIRTTNPVATEIYGSVSNDLQRGTH

SEQ ID NO: 16909 - protein, 30 aa, Artificial Sequence
  Description of Artificial Sequence: Synthetic polypeptide
DEEEIRTTNPVATEQYGSVSTTLQRIMQLE

SEQ ID NO: 16910 - protein, 30 aa, Artificial Sequence
  Description of Artificial Sequence: Synthetic polypeptide
DEEEIRTTNPVATEQYGSVCSIELQSGSNQ

SEQ ID NO: 16911 - protein, 32 aa, Artificial Sequence
  Description of Artificial Sequence: Synthetic polypeptide
CEEEVRTTNPVATEQYGSVSTMNLDQERIGNR

SEQ ID NO: 16912 - protein, 31 aa, Artificial Sequence
  Description of Artificial Sequence: Synthetic polypeptide
CEEEVRTTNPVATEQYGSVSTVNLDQRIGNQ

SEQ ID NO: 16913 - protein, 32 aa, Artificial Sequence
  Description of Artificial Sequence: Synthetic polypeptide
CEEEVRTTNPVATEQYGSVSTWNELDQRIGNR

SEQ ID NO: 16914 - protein, 29 aa, Artificial Sequence
  Description of Artificial Sequence: Synthetic peptide
DENEIRTTNPVATEAYGSVSNNMLQRGTM

SEQ ID NO: 16915 - protein, 29 aa, Artificial Sequence
  Description of Artificial Sequence: Synthetic peptide
DENEIRTTNPVATEAYGSVSNNLQRGTDV

SEQ ID NO: 16916 - protein, 32 aa, Artificial Sequence
  Description of Artificial Sequence: Synthetic polypeptide
YETEIRTTNPVATEQYGSVYSPTNLQRNGSNR

SEQ ID NO: 16917 - protein, 32 aa, Artificial Sequence
  Description of Artificial Sequence: Synthetic polypeptide
YETEIRTTNPVATEQYGSVWSPTNLQRQGMNR

SEQ ID NO: 16918 - protein, 30 aa, Artificial Sequence
  Description of Artificial Sequence: Synthetic polypeptide
YETEIRTTNPVATEQYGSVSTWLERMGNRD

SEQ ID NO: 16919 - protein, 28 aa, Artificial Sequence
  Description of Artificial Sequence: Synthetic peptide
DENEIRTTNPVATEAYGSVSNNLQHGEM

SEQ ID NO: 16920 - protein, 29 aa, Artificial Sequence
  Description of Artificial Sequence: Synthetic peptide
DENEIRTTNPVATEAYGSVSNNALQRGSW

SEQ ID NO: 16921 - protein, 31 aa, Artificial Sequence
  Description of Artificial Sequence: Synthetic polypeptide
CEEEVRTTNPVATEQYGSVSTGNLDQNIGNR

SEQ ID NO: 16922 - protein, 32 aa, Artificial Sequence
  Description of Artificial Sequence: Synthetic polypeptide
DEEEIRTTNPVATEQYGSVSTTLSQSRLVNRG

SEQ ID NO: 16923 - protein, 29 aa, Artificial Sequence
  Description of Artificial Sequence: Synthetic peptide
AEEEIRTTNPVATEQYGSVSSTVLQVTND

SEQ ID NO: 16924 - protein, 30 aa, Artificial Sequence
  Description of Artificial Sequence: Synthetic polypeptide
DEEEIRTTNPVATEQYGSVSTTLTTRNNND

SEQ ID NO: 16925 - protein, 30 aa, Artificial Sequence
  Description of Artificial Sequence: Synthetic polypeptide
DEEEIRTTNPVATEQYGSVCSNNNDRGEND

SEQ ID NO: 16926 - protein, 30 aa, Artificial Sequence
  Description of Artificial Sequence: Synthetic polypeptide
YETEIRTTNPVATEQYGSVSTVELQRGTAR

SEQ ID NO: 16927 - protein, 29 aa, Artificial Sequence
  Description of Artificial Sequence: Synthetic peptide
YETEIRTTNPVATEQYGSVSTNLQRPTFF

SEQ ID NO: 16928 - protein, 28 aa, Artificial Sequence
  Description of Artificial Sequence: Synthetic peptide
DENEIRTTNPVATDQYGTVSTNLEFGNP

SEQ ID NO: 16929 - protein, 32 aa, Artificial Sequence
  Description of Artificial Sequence: Synthetic polypeptide
DEEEIRTTNPVATEAWGSTVSCTNLSQRPGNR

SEQ ID NO: 16930 - protein, 32 aa, Artificial Sequence
  Description of Artificial Sequence: Synthetic polypeptide
DEEEIRTTNPVATEQYGSVSDTNLVRNGHDRQ

SEQ ID NO: 16931 - protein, 29 aa, Artificial Sequence
  Description of Artificial Sequence: Synthetic peptide
DENEIRTTNPVATDQYGSVNTPQLQRGND

SEQ ID NO: 16932 - protein, 30 aa, Artificial Sequence
  Description of Artificial Sequence: Synthetic polypeptide
DEDEIRTTNPVATEQYGEVTSTNLQRGDST

SEQ ID NO: 16933 - protein, 29 aa, Artificial Sequence
  Description of Artificial Sequence: Synthetic peptide
DENEIRTTNPVATEAYGSVSINLQRGGTM

SEQ ID NO: 16934 - protein, 32 aa, Artificial Sequence
  Description of Artificial Sequence: Synthetic polypeptide
DEEEIRTTNPVATEQYGSVSLTNLQRQLEERL

SEQ ID NO: 16935 - protein, 29 aa, Artificial Sequence
  Description of Artificial Sequence: Synthetic peptide
DENEIRTTNPVATEAYGSVSWNLQRGSDA

SEQ ID NO: 16936 - protein, 32 aa, Artificial Sequence
  Description of Artificial Sequence: Synthetic polypeptide
DEEEIRTTNPVATEQYGSVSDTNNDLQRLERN

SEQ ID NO: 16937 - protein, 29 aa, Artificial Sequence
  Description of Artificial Sequence: Synthetic peptide
YEYEIDTTNPVATEAYGSVSTPNQQRGNR

SEQ ID NO: 16938 - protein, 28 aa, Artificial Sequence
  Description of Artificial Sequence: Synthetic peptide
DEAEIATVNPVATEQYGSVSTNLTNGNH

SEQ ID NO: 16939 - protein, 30 aa, Artificial Sequence
  Description of Artificial Sequence: Synthetic polypeptide
YEVEIRTTNPVATEQYGSTVSTLLEPRGNR

SEQ ID NO: 16940 - protein, 30 aa, Artificial Sequence
  Description of Artificial Sequence: Synthetic polypeptide
DEEEIRTTNPVATEQYGSVCSINQLQEGDE

SEQ ID NO: 16941 - protein, 29 aa, Artificial Sequence
  Description of Artificial Sequence: Synthetic peptide
YEVEIRTTNPVATEQYGSASTMNLQPGNP

SEQ ID NO: 16942 - protein, 31 aa, Artificial Sequence
  Description of Artificial Sequence: Synthetic polypeptide
DEDEIRTTNPVATEQYGEVSTNNLSERGGNR

SEQ ID NO: 16943 - protein, 28 aa, Artificial Sequence
  Description of Artificial Sequence: Synthetic peptide
DENEIRTTNPVATECWGSVSENLERGNA

SEQ ID NO: 16944 - protein, 31 aa, Artificial Sequence
  Description of Artificial Sequence: Synthetic polypeptide
DEEEIRTTNPVATEQYGSVSTTLQTEMGGNE

SEQ ID NO: 16945 - protein, 31 aa, Artificial Sequence
  Description of Artificial Sequence: Synthetic polypeptide
DEEEIRTTNPVATEQYGSVNTNLQVGGDDRD

SEQ ID NO: 16946 - protein, 31 aa, Artificial Sequence
  Description of Artificial Sequence: Synthetic polypeptide
DEEEIRTTNPVATEQYGSVSTTLQVDGEDRE

SEQ ID NO: 16947 - protein, 30 aa, Artificial Sequence
  Description of Artificial Sequence: Synthetic polypeptide
DEDEIRTTNPVATEQYGEVSTNQQHDGDNR

SEQ ID NO: 16948 - protein, 30 aa, Artificial Sequence
  Description of Artificial Sequence: Synthetic polypeptide
DEEEIRTTNPVATEQYGSVSTTLQVGEQVD

SEQ ID NO: 16949 - protein, 30 aa, Artificial Sequence
  Description of Artificial Sequence: Synthetic polypeptide
DEEEIATTNPVAYEQYGNVSTNLQGGDGNR

SEQ ID NO: 16950 - protein, 31 aa, Artificial Sequence
  Description of Artificial Sequence: Synthetic polypeptide
DEEEIRTTNPVATEQYGSVCSLNLQRVDINN

SEQ ID NO: 16951 - protein, 32 aa, Artificial Sequence
  Description of Artificial Sequence: Synthetic polypeptide
DEEEIRTTNPVATEQYGSVSDTNNNLQVENRQ

SEQ ID NO: 16952 - protein, 30 aa, Artificial Sequence
  Description of Artificial Sequence: Synthetic polypeptide
DEEEIATTNPVAYEQYGEVSTNLQGTGGNR

SEQ ID NO: 16953 - protein, 28 aa, Artificial Sequence
  Description of Artificial Sequence: Synthetic peptide
SESEIRSTNPIATEQYGSVSENLMRGNR

SEQ ID NO: 16954 - protein, 28 aa, Artificial Sequence
  Description of Artificial Sequence: Synthetic peptide
CEEEIVCTNPIATEQYGSVSENLMRGNR

SEQ ID NO: 16955 - protein, 31 aa, Artificial Sequence
  Description of Artificial Sequence: Synthetic polypeptide
DEEEIRTTNPVATEQYGSVCSMTALQYGSNM

SEQ ID NO: 16956 - protein, 30 aa, Artificial Sequence
  Description of Artificial Sequence: Synthetic polypeptide
AEEEIRTTNPVATEQYGSVSSVNLQEGNNF

SEQ ID NO: 16957 - protein, 31 aa, Artificial Sequence
  Description of Artificial Sequence: Synthetic polypeptide
DEEEIRTTNPVATEQYGSYVSTNNQRNEERD

SEQ ID NO: 16958 - protein, 31 aa, Artificial Sequence
  Description of Artificial Sequence: Synthetic polypeptide
CEEELRTTNPVATEQYGSVSTMNLDQRIGNV

SEQ ID NO: 16959 - protein, 32 aa, Artificial Sequence
  Description of Artificial Sequence: Synthetic polypeptide
DEEEIRTTNPVATEQYGSVCSMTNLERFGSNQ

SEQ ID NO: 16960 - protein, 30 aa, Artificial Sequence
  Description of Artificial Sequence: Synthetic polypeptide
DEEEIRTTNPVATEGYGSVSTELQAFGSVR

SEQ ID NO: 16961 - protein, 31 aa, Artificial Sequence
  Description of Artificial Sequence: Synthetic polypeptide
DEAEIRTTNPVATEQYGTVSTNLQHMEGNER

SEQ ID NO: 16962 - protein, 30 aa, Artificial Sequence
  Description of Artificial Sequence: Synthetic polypeptide
AEEEIRTTNPVATEQYGSVSSTNLNQGGQE

SEQ ID NO: 16963 - protein, 30 aa, Artificial Sequence
  Description of Artificial Sequence: Synthetic polypeptide
DEEEIRTTNPVATEQYGSVYTTNLEGMENR

SEQ ID NO: 16964 - protein, 32 aa, Artificial Sequence
  Description of Artificial Sequence: Synthetic polypeptide
DEEEIRTTNPVATEQYGVTISTNELQRDGNDR

SEQ ID NO: 16965 - protein, 30 aa, Artificial Sequence
  Description of Artificial Sequence: Synthetic polypeptide
DEHEIRTTNPVAYECYGSVSTNLQDGNNQR

SEQ ID NO: 16966 - protein, 31 aa, Artificial Sequence
  Description of Artificial Sequence: Synthetic polypeptide
DEEEIRTTNPVATEQYGSVSTVLQNGEGGNT

SEQ ID NO: 16967 - protein, 29 aa, Artificial Sequence
  Description of Artificial Sequence: Synthetic peptide
DAPEIRTTNPVATEQYGSVSTNGLQHGMD

SEQ ID NO: 16968 - protein, 28 aa, Artificial Sequence
  Description of Artificial Sequence: Synthetic peptide
YEEGIMTTNPVATEQYGSVSMNSQRGNI

SEQ ID NO: 16969 - protein, 29 aa, Artificial Sequence
  Description of Artificial Sequence: Synthetic peptide
DAPEIRTTNPVATEQYGSVSVNTLQQGMR

SEQ ID NO: 16970 - protein, 31 aa, Artificial Sequence
  Description of Artificial Sequence: Synthetic polypeptide
DEEEIRTTNPVATEQYGSVSCTNHSMRDVNR

SEQ ID NO: 16971 - protein, 29 aa, Artificial Sequence
  Description of Artificial Sequence: Synthetic peptide
DEAEIRTTNPVATEQYGSVSYDLQNGERS

SEQ ID NO: 16972 - protein, 32 aa, Artificial Sequence
  Description of Artificial Sequence: Synthetic polypeptide
DEEEIRTTNPVATEQYGSVSNTNLQFNGGNGQ

SEQ ID NO: 16973 - protein, 28 aa, Artificial Sequence
  Description of Artificial Sequence: Synthetic peptide
YEEGIGTTNPVATEQYGSVSANSQRGNS

SEQ ID NO: 16974 - protein, 31 aa, Artificial Sequence
  Description of Artificial Sequence: Synthetic polypeptide
DEEEIRTTNPVATEQYGVTISTNELQAGMNR

SEQ ID NO: 16975 - protein, 29 aa, Artificial Sequence
  Description of Artificial Sequence: Synthetic peptide
AEEEIRTTNPVATEQYGSVSNNLQQGQDN

SEQ ID NO: 16976 - protein, 32 aa, Artificial Sequence
  Description of Artificial Sequence: Synthetic polypeptide
DEDEIRTTNPVATEQYGSVSTNGDQERGGNER

SEQ ID NO: 16977 - protein, 29 aa, Artificial Sequence
  Description of Artificial Sequence: Synthetic peptide
DEEEIRTTNPVATEQYGSVSMDLQNGEHV

SEQ ID NO: 16978 - protein, 31 aa, Artificial Sequence
  Description of Artificial Sequence: Synthetic polypeptide
DEEEIRTTNPVATEQYGVTTISTNELQQGNR

SEQ ID NO: 16979 - protein, 28 aa, Artificial Sequence
  Description of Artificial Sequence: Synthetic peptide
DEHEIRTTNPVAYDQYGSVNTALQRGND

SEQ ID NO: 16980 - protein, 33 aa, Artificial Sequence
  Description of Artificial Sequence: Synthetic polypeptide
DEEEIRTTNPVATEQYGVTVSTNELSQNRGNNR

SEQ ID NO: 16981 - protein, 32 aa, Artificial Sequence
  Description of Artificial Sequence: Synthetic polypeptide
DEDEIRTTNPVATEQYGSVSTNGGEQRDGTNR

SEQ ID NO: 16982 - protein, 30 aa, Artificial Sequence
  Description of Artificial Sequence: Synthetic polypeptide
DEDEIRTTNPVATEQYGSVSTNHQDGGDMR

SEQ ID NO: 16983 - protein, 29 aa, Artificial Sequence
  Description of Artificial Sequence: Synthetic peptide
DEEEIRTTNPVATEQYGVVAATDLQMGNA

SEQ ID NO: 16984 - protein, 29 aa, Artificial Sequence
  Description of Artificial Sequence: Synthetic peptide
DEHEIRTTNPVATQQYGCVSTNLERGNAP

SEQ ID NO: 16985 - protein, 31 aa, Artificial Sequence
  Description of Artificial Sequence: Synthetic polypeptide
DEEEIRTTNPVATEQYGSVSCTNHNQRGQFG

SEQ ID NO: 16986 - protein, 29 aa, Artificial Sequence
  Description of Artificial Sequence: Synthetic peptide
DEAEIATTNPVAYEHYGSVSTNLQRDGNS

SEQ ID NO: 16987 - protein, 31 aa, Artificial Sequence
  Description of Artificial Sequence: Synthetic polypeptide
DEEEIATTNPVATEQYGSVSTNLQREANNEQ

SEQ ID NO: 16988 - protein, 29 aa, Artificial Sequence
  Description of Artificial Sequence: Synthetic peptide
DEDEIRTTNPVATEQYGSVSTNGAGDGNA

SEQ ID NO: 16989 - protein, 30 aa, Artificial Sequence
  Description of Artificial Sequence: Synthetic polypeptide
DEEEIRTTNPVATEQYGVTISTGELQRGER

SEQ ID NO: 16990 - protein, 30 aa, Artificial Sequence
  Description of Artificial Sequence: Synthetic polypeptide
DEEEIRTTNPVATEGYGVVSTNLQSGGSNQ

SEQ ID NO: 16991 - protein, 29 aa, Artificial Sequence
  Description of Artificial Sequence: Synthetic peptide
DAGEIRTTNPVATEQYGSVSTNDDQTGMR

SEQ ID NO: 16992 - protein, 29 aa, Artificial Sequence
  Description of Artificial Sequence: Synthetic peptide
DAGEIRTTNPVATEQYGSVSTNDLQDGGA

SEQ ID NO: 16993 - protein, 29 aa, Artificial Sequence
  Description of Artificial Sequence: Synthetic peptide
DAGEIRTTNPVATEQYGSVSTNDLQNNMR

SEQ ID NO: 16994 - protein, 30 aa, Artificial Sequence
  Description of Artificial Sequence: Synthetic polypeptide
DEEEIRTTNPVATEAYGSVCNTNLTLGGNR

SEQ ID NO: 16995 - protein, 31 aa, Artificial Sequence
  Description of Artificial Sequence: Synthetic polypeptide
DEEEIRTTNPVATEAYGSVCSCTNLSTSGNR

SEQ ID NO: 16996 - protein, 32 aa, Artificial Sequence
  Description of Artificial Sequence: Synthetic polypeptide
DEEEIRTTNPVATEAYGSVCSTNDLQNGSNRF

SEQ ID NO: 16997 - protein, 30 aa, Artificial Sequence
  Description of Artificial Sequence: Synthetic polypeptide
DAGEIRTTNPVATEQYGSVSTNMLSQTGMR

SEQ ID NO: 16998 - protein, 29 aa, Artificial Sequence
  Description of Artificial Sequence: Synthetic peptide
DAGEIRTTNPVATEQYGSVSTNNDQEGQR

SEQ ID NO: 16999 - protein, 30 aa, Artificial Sequence
  Description of Artificial Sequence: Synthetic polypeptide
DEEEIATTNPVATEQYGSVSTNLSDGGGNQ

SEQ ID NO: 17000 - protein, 30 aa, Artificial Sequence
  Description of Artificial Sequence: Synthetic polypeptide
AEEEIRTTNPVATEQYGSVSNNNGQTGNQR

SEQ ID NO: 17001 - protein, 29 aa, Artificial Sequence
  Description of Artificial Sequence: Synthetic peptide
DAGEIRTTNPVATEQYGSVSTNPLQDGMA

SEQ ID NO: 17002 - protein, 30 aa, Artificial Sequence
  Description of Artificial Sequence: Synthetic polypeptide
DAGEIRTTNPVATEQYGSVSTNPLQLGDQR

SEQ ID NO: 17003 - protein, 29 aa, Artificial Sequence
  Description of Artificial Sequence: Synthetic peptide
DAGEIRTTNPVATEQYGSVSTNPLQLNER

SEQ ID NO: 17004 - protein, 31 aa, Artificial Sequence
  Description of Artificial Sequence: Synthetic polypeptide
DEEEIRTTNPVATEQYGSVSTVLQNDGNEND

SEQ ID NO: 17005 - protein, 31 aa, Artificial Sequence
  Description of Artificial Sequence: Synthetic polypeptide
DEEEIRTTNPVATEAYGSVCSTNLQRFQSNT

SEQ ID NO: 17006 - protein, 30 aa, Artificial Sequence
  Description of Artificial Sequence: Synthetic polypeptide
AEEEIRTTNPVATEQYGSVSNNNLQGSNLR

SEQ ID NO: 17007 - protein, 30 aa, Artificial Sequence
  Description of Artificial Sequence: Synthetic polypeptide
DEEEIRTTNPVATEHFGGVSTANLPQRGNQ

SEQ ID NO: 17008 - protein, 32 aa, Artificial Sequence
  Description of Artificial Sequence: Synthetic polypeptide
DEEEIRTTNPVATEQYGSVSNTNLQFTEGNNV

SEQ ID NO: 17009 - protein, 28 aa, Artificial Sequence
  Description of Artificial Sequence: Synthetic peptide
YEEGISTTNPVATEQYGSVSMNHQRGNS

SEQ ID NO: 17010 - protein, 30 aa, Artificial Sequence
  Description of Artificial Sequence: Synthetic polypeptide
DEEEIRTTNPVATEQYGVTCSTNENQRGNQ

SEQ ID NO: 17011 - protein, 31 aa, Artificial Sequence
  Description of Artificial Sequence: Synthetic polypeptide
DEEEIATTNPVATEQYGSVSTNLQSGGENET

SEQ ID NO: 17012 - protein, 30 aa, Artificial Sequence
  Description of Artificial Sequence: Synthetic polypeptide
DAGEIRTTNPVATEQYGSVSTNPLQGGGMR

SEQ ID NO: 17013 - protein, 31 aa, Artificial Sequence
  Description of Artificial Sequence: Synthetic polypeptide
DEEEIRTTNPVATEQYGSVSTVLQNVGGNEG

SEQ ID NO: 17014 - protein, 31 aa, Artificial Sequence
  Description of Artificial Sequence: Synthetic polypeptide
DEEEIRTTNPVATEQYGVVCGTNLQRNSNFR

SEQ ID NO: 17015 - protein, 30 aa, Artificial Sequence
  Description of Artificial Sequence: Synthetic polypeptide
DEHEIRTTNPVATEWYGSVSTNLQGEGGSR

SEQ ID NO: 17016 - protein, 31 aa, Artificial Sequence
  Description of Artificial Sequence: Synthetic polypeptide
DEEEIRTTNPVATEAYGSVNTNLSQPGGNNR

SEQ ID NO: 17017 - protein, 31 aa, Artificial Sequence
  Description of Artificial Sequence: Synthetic polypeptide
DEEEIRTTNPVATEQYGSVSNTSLQFGSNQP

SEQ ID NO: 17018 - protein, 29 aa, Artificial Sequence
  Description of Artificial Sequence: Synthetic peptide
DATEIRTTNPVATEQYGSVSINNLQLGQR

SEQ ID NO: 17019 - protein, 31 aa, Artificial Sequence
  Description of Artificial Sequence: Synthetic polypeptide
DEEEIATTNPVATEQYGSVSTNLQQGDGDMR

SEQ ID NO: 17020 - protein, 29 aa, Artificial Sequence
  Description of Artificial Sequence: Synthetic peptide
DEHEIRTTNPVATESYGSVSTNNGGDGNR

SEQ ID NO: 17021 - protein, 30 aa, Artificial Sequence
  Description of Artificial Sequence: Synthetic polypeptide
DEHEIRTTNPVATESYGSVSTNLQRGGDDG

SEQ ID NO: 17022 - protein, 32 aa, Artificial Sequence
  Description of Artificial Sequence: Synthetic polypeptide
DEEEIRTTNPVATEQYGSVNSTNLQMNGENGD

SEQ ID NO: 17023 - protein, 32 aa, Artificial Sequence
  Description of Artificial Sequence: Synthetic polypeptide
DEEEIRTTNPVATEQYGSVNSTNLQFTFGNEA

SEQ ID NO: 17024 - protein, 32 aa, Artificial Sequence
  Description of Artificial Sequence: Synthetic polypeptide
DEEEIRTTNPVATEQYGSVPSCTNLSGQGTNR

SEQ ID NO: 17025 - protein, 29 aa, Artificial Sequence
  Description of Artificial Sequence: Synthetic peptide
AEEEIRTTNPVATEQYGSVSNENNQDGNN

SEQ ID NO: 17026 - protein, 29 aa, Artificial Sequence
  Description of Artificial Sequence: Synthetic peptide
AEEEIRTTNPVATEQYGSVSNNEQAGNLG

SEQ ID NO: 17027 - protein, 30 aa, Artificial Sequence
  Description of Artificial Sequence: Synthetic polypeptide
DEHEIRTTNPVATERYGSVSTNLQEGEGNG

SEQ ID NO: 17028 - protein, 31 aa, Artificial Sequence
  Description of Artificial Sequence: Synthetic polypeptide
DEEEIRTTNPVATEGYGQCVSTNLQRGSNQS

SEQ ID NO: 17029 - protein, 31 aa, Artificial Sequence
  Description of Artificial Sequence: Synthetic polypeptide
DEEEIATTNPVATEQYGSVSTNLQQAGGDNG

SEQ ID NO: 17030 - protein, 28 aa, Artificial Sequence
  Description of Artificial Sequence: Synthetic peptide
DCAEIRTTNPVATEQYGCCSTDLQHGNR

SEQ ID NO: 17031 - protein, 30 aa, Artificial Sequence
  Description of Artificial Sequence: Synthetic polypeptide
DEEEIRTTNPVATEQYGSVSCTNGTQDGGF

SEQ ID NO: 17032 - protein, 31 aa, Artificial Sequence
  Description of Artificial Sequence: Synthetic polypeptide
DEEEIRTTNPVATEQYGVVCSNTNLQRGDQT

SEQ ID NO: 17033 - protein, 29 aa, Artificial Sequence
  Description of Artificial Sequence: Synthetic peptide
DEHEIRTTNPVATEQYGVVSTTLQRPNDH

SEQ ID NO: 17034 - protein, 33 aa, Artificial Sequence
  Description of Artificial Sequence: Synthetic polypeptide
DEEEIRTTNPVATEQYGSVNSTNLNQRSGEERI

SEQ ID NO: 17035 - protein, 29 aa, Artificial Sequence
  Description of Artificial Sequence: Synthetic peptide
DEHEIRTTNPVATEQYGVVSTNNQGGMNE

SEQ ID NO: 17036 - protein, 30 aa, Artificial Sequence
  Description of Artificial Sequence: Synthetic polypeptide
DEHEIRTTNPVATEQYGVVSTNLQVGDNDD

SEQ ID NO: 17037 - protein, 32 aa, Artificial Sequence
  Description of Artificial Sequence: Synthetic polypeptide
DEEEIRTTNPVATEQYGSVSTVLQRVNEEERA

SEQ ID NO: 17038 - protein, 30 aa, Artificial Sequence
  Description of Artificial Sequence: Synthetic polypeptide
DEHEIRTTNPVATERYGSVSTNDQEDGNDR

SEQ ID NO: 17039 - protein, 29 aa, Artificial Sequence
  Description of Artificial Sequence: Synthetic peptide
AEEEIRTTNPVATEQYGSVSNNLEEEGNS

SEQ ID NO: 17040 - protein, 31 aa, Artificial Sequence
  Description of Artificial Sequence: Synthetic polypeptide
DEEEIRTTNPVATEQYGSVSTVLQRENTEVS

SEQ ID NO: 17041 - protein, 30 aa, Artificial Sequence
  Description of Artificial Sequence: Synthetic polypeptide
AEEEIRTTNPVATEQYGSVSNNLGQEGNSE

SEQ ID NO: 17042 - protein, 28 aa, Artificial Sequence
  Description of Artificial Sequence: Synthetic peptide
YEEGICTTNPVATEQYGSVSSNSQRGNL

SEQ ID NO: 17043 - protein, 30 aa, Artificial Sequence
  Description of Artificial Sequence: Synthetic polypeptide
AEEEIRTTNPVATEQYGSVSNNLQGGTNNV

SEQ ID NO: 17044 - protein, 30 aa, Artificial Sequence
  Description of Artificial Sequence: Synthetic polypeptide
DEEEIRTTNPVATEQYGSVSTVLQPGPEDD

SEQ ID NO: 17045 - protein, 30 aa, Artificial Sequence
  Description of Artificial Sequence: Synthetic polypeptide
DEEEIATTNPVATEQYGSVSTNLQREADMV

SEQ ID NO: 17046 - protein, 30 aa, Artificial Sequence
  Description of Artificial Sequence: Synthetic polypeptide
AEEEIRTTNPVATEQYGSVSNNLLQQQGNS

SEQ ID NO: 17047 - protein, 31 aa, Artificial Sequence
  Description of Artificial Sequence: Synthetic polypeptide
DEEEIRTTNPVATEQYGSVSTVLQQGDGNEE

SEQ ID NO: 17048 - protein, 32 aa, Artificial Sequence
  Description of Artificial Sequence: Synthetic polypeptide
DEEEIRTTNPVATEHWGSVSCTNNLSQRGTNR

SEQ ID NO: 17049 - protein, 30 aa, Artificial Sequence
  Description of Artificial Sequence: Synthetic polypeptide
DASEIRTTNPVATEQYGSVSTNALSQLGMR

SEQ ID NO: 17050 - protein, 31 aa, Artificial Sequence
  Description of Artificial Sequence: Synthetic polypeptide
DEHEIRTTNPVATEVYGSVSTNLQDNGGNTR

SEQ ID NO: 17051 - protein, 30 aa, Artificial Sequence
  Description of Artificial Sequence: Synthetic polypeptide
DEEEIRTTNPVATEQYGSVYTNLQREVAIF

SEQ ID NO: 17052 - protein, 30 aa, Artificial Sequence
  Description of Artificial Sequence: Synthetic polypeptide
DEHEIRTTNPVATETYGSVSTNLQTGGNTD

SEQ ID NO: 17053 - protein, 30 aa, Artificial Sequence
  Description of Artificial Sequence: Synthetic polypeptide
DEDEIRTTNPVATEQYGSVSTNLDAGNGNA

SEQ ID NO: 17054 - protein, 30 aa, Artificial Sequence
  Description of Artificial Sequence: Synthetic polypeptide
AEEEIRTTNPVATEQYGSVSNNLGQVEGNG

SEQ ID NO: 17055 - protein, 30 aa, Artificial Sequence
  Description of Artificial Sequence: Synthetic polypeptide
DEDEIRTTNPVATEQYGSVSTNLDGQGNDG

SEQ ID NO: 17056 - protein, 29 aa, Artificial Sequence
  Description of Artificial Sequence: Synthetic peptide
DEHEIRTTNPVATETYGSVSTNLQNGDFK

SEQ ID NO: 17057 - protein, 32 aa, Artificial Sequence
  Description of Artificial Sequence: Synthetic polypeptide
DEEEIATTNPVATEQYGSVSTNLQRDGGNDTH

SEQ ID NO: 17058 - protein, 30 aa, Artificial Sequence
  Description of Artificial Sequence: Synthetic polypeptide
DEHEIRTTNPVATETYGSVSTNLQGDLGNA

SEQ ID NO: 17059 - protein, 32 aa, Artificial Sequence
  Description of Artificial Sequence: Synthetic polypeptide
DEEEIRTTNPVATEHWGSVSTNMLSQRGGNRQ

SEQ ID NO: 17060 - protein, 29 aa, Artificial Sequence
  Description of Artificial Sequence: Synthetic peptide
DEHEIRTTNPVATETYGSVSTNLQDGDDA

SEQ ID NO: 17061 - protein, 32 aa, Artificial Sequence
  Description of Artificial Sequence: Synthetic polypeptide
DEEEIRTTNPVATEQYGSVNSTNLQMNIGNAM

SEQ ID NO: 17062 - protein, 30 aa, Artificial Sequence
  Description of Artificial Sequence: Synthetic polypeptide
DEDEIRTTNPVATEQYGSVSTNLDGSGGNA

SEQ ID NO: 17063 - protein, 30 aa, Artificial Sequence
  Description of Artificial Sequence: Synthetic polypeptide
DEHEIRTTNPVATETYGSVATNLQEGGNTR

SEQ ID NO: 17064 - protein, 30 aa, Artificial Sequence
  Description of Artificial Sequence: Synthetic polypeptide
DEHEIRTTNPVATETYGCVSTNLQDGGNTR

SEQ ID NO: 17065 - protein, 31 aa, Artificial Sequence
  Description of Artificial Sequence: Synthetic polypeptide
DEEEIRTTNPVATEAYGSVCFTNLTRGGNER

SEQ ID NO: 17066 - protein, 30 aa, Artificial Sequence
  Description of Artificial Sequence: Synthetic polypeptide
DAGEIRTTNPVATEQYGSVSTINDLQLGER

SEQ ID NO: 17067 - protein, 30 aa, Artificial Sequence
  Description of Artificial Sequence: Synthetic polypeptide
DAGEIRTTNPVATEQYGSVSTGNQLQDGMR

SEQ ID NO: 17068 - protein, 31 aa, Artificial Sequence
  Description of Artificial Sequence: Synthetic polypeptide
DEEEIRTTNPVATEQYGSVSSLNNQLQNDNR

SEQ ID NO: 17069 - protein, 31 aa, Artificial Sequence
  Description of Artificial Sequence: Synthetic polypeptide
DEEEIRTTNPVATEAYGSTVSTGNLSTPGNR

SEQ ID NO: 17070 - protein, 30 aa, Artificial Sequence
  Description of Artificial Sequence: Synthetic polypeptide
DAEEIRSTNPVATEQYGSVSTNLQHDTGQR

SEQ ID NO: 17071 - protein, 30 aa, Artificial Sequence
  Description of Artificial Sequence: Synthetic polypeptide
DEDEIRTTNPVATEQYGSVSTGDALQLGNA

SEQ ID NO: 17072 - protein, 30 aa, Artificial Sequence
  Description of Artificial Sequence: Synthetic polypeptide
DAEEIRSTNPVATEQYGSVSTNLQSDNGQR

SEQ ID NO: 17073 - protein, 32 aa, Artificial Sequence
  Description of Artificial Sequence: Synthetic polypeptide
DEEEIRTTNPVATEQYGSVSCTNHSQTGGNGR

SEQ ID NO: 17074 - protein, 31 aa, Artificial Sequence
  Description of Artificial Sequence: Synthetic polypeptide
DEEEIRTTNPVATEQYGSVSTVLPDRGDNID

SEQ ID NO: 17075 - protein, 30 aa, Artificial Sequence
  Description of Artificial Sequence: Synthetic polypeptide
DAEEIRSTNPVATEQYGSVVSTNLQNGTRV

SEQ ID NO: 17076 - protein, 32 aa, Artificial Sequence
  Description of Artificial Sequence: Synthetic polypeptide
DEEEIRTTNPVATEQYGSVSNTNLQGGSGNED

SEQ ID NO: 17077 - protein, 29 aa, Artificial Sequence
  Description of Artificial Sequence: Synthetic peptide
DAEEIRTTNPCATEGYGSVSANLQRENRY

SEQ ID NO: 17078 - protein, 29 aa, Artificial Sequence
  Description of Artificial Sequence: Synthetic peptide
DAEEIRTTNPCATEPYGSVSANLQRENGR

SEQ ID NO: 17079 - protein, 31 aa, Artificial Sequence
  Description of Artificial Sequence: Synthetic polypeptide
DAEEIRSTNPVATEQYGSVSTNLQERNGQDR

SEQ ID NO: 17080 - protein, 31 aa, Artificial Sequence
  Description of Artificial Sequence: Synthetic polypeptide
DEEEIRTTNPVATEQYGSVYTNLQRVGELVI

SEQ ID NO: 17081 - protein, 28 aa, Artificial Sequence
  Description of Artificial Sequence: Synthetic peptide
SEYEIRCTNPIATEQYGSVSENLMRGNR

SEQ ID NO: 17082 - protein, 31 aa, Artificial Sequence
  Description of Artificial Sequence: Synthetic polypeptide
DEEEIRTTNPVATEAYGSTVSTNELSQSGNE

SEQ ID NO: 17083 - protein, 33 aa, Artificial Sequence
  Description of Artificial Sequence: Synthetic polypeptide
DEEEIRTTNPVATEAYGSTVSTNLSQNRTGNPR

SEQ ID NO: 17084 - protein, 30 aa, Artificial Sequence
  Description of Artificial Sequence: Synthetic polypeptide
DEEEIATTNPVATEQYGSVSTNSSQDGGNE

SEQ ID NO: 17085 - protein, 30 aa, Artificial Sequence
  Description of Artificial Sequence: Synthetic polypeptide
DEDEIRTTNPVATEQYGSVSTGDDFQRGNA

SEQ ID NO: 17086 - protein, 31 aa, Artificial Sequence
  Description of Artificial Sequence: Synthetic polypeptide
DEEEIATTNPVATEQYGSVSTNSLSQDRGEF

SEQ ID NO: 17087 - protein, 31 aa, Artificial Sequence
  Description of Artificial Sequence: Synthetic polypeptide
DEEEIATTNPVATEQYGSVSTNSLNQVRGEF

SEQ ID NO: 17088 - protein, 33 aa, Artificial Sequence
  Description of Artificial Sequence: Synthetic polypeptide
DEEEIRTTNPVATEAYGSTVSTNMLPQRGGNNR

SEQ ID NO: 17089 - protein, 33 aa, Artificial Sequence
  Description of Artificial Sequence: Synthetic polypeptide
DEEEIRTTNPVATEAYGSTVSTQNLSQRGGNYR

SEQ ID NO: 17090 - protein, 30 aa, Artificial Sequence
  Description of Artificial Sequence: Synthetic polypeptide
DEDEIRTTNPVATEQYGSVSTGDGNQRGNA

SEQ ID NO: 17091 - protein, 31 aa, Artificial Sequence
  Description of Artificial Sequence: Synthetic polypeptide
DEEEIRTTNPVATEQYGSVCSTNLAGGSNET

SEQ ID NO: 17092 - protein, 30 aa, Artificial Sequence
  Description of Artificial Sequence: Synthetic polypeptide
AEEEIRTTNPVATEQYGSVSNTNIQGVGNQ

SEQ ID NO: 17093 - protein, 30 aa, Artificial Sequence
  Description of Artificial Sequence: Synthetic polypeptide
DAEEIRSTNPVATEQYGSVSTNLQDHNGQR

SEQ ID NO: 17094 - protein, 30 aa, Artificial Sequence
  Description of Artificial Sequence: Synthetic polypeptide
DEEEIRTTNPVATEQYGTYSTNNPLQRENN

SEQ ID NO: 17095 - protein, 28 aa, Artificial Sequence
  Description of Artificial Sequence: Synthetic peptide
DAEEIRSTNPVATEQWGSSSTNHQRGNN

SEQ ID NO: 17096 - protein, 30 aa, Artificial Sequence
  Description of Artificial Sequence: Synthetic polypeptide
DAEEIRSTNPVATEQWGSVSTNLQARGGER

SEQ ID NO: 17097 - protein, 29 aa, Artificial Sequence
  Description of Artificial Sequence: Synthetic peptide
DEDEIRTTNPVATEQYGSVSTDLTGRGEG

SEQ ID NO: 17098 - protein, 28 aa, Artificial Sequence
  Description of Artificial Sequence: Synthetic peptide
DAEEIRSTNPVATEQYGSISTNMQDGNN

SEQ ID NO: 17099 - protein, 28 aa, Artificial Sequence
  Description of Artificial Sequence: Synthetic peptide
DAEEIRSTNPVATEQYGSSSTNPQNGNN

SEQ ID NO: 17100 - protein, 29 aa, Artificial Sequence
  Description of Artificial Sequence: Synthetic peptide
DAEEIRSTNPVATEQYGSTSTNQQRGDNN

SEQ ID NO: 17101 - protein, 31 aa, Artificial Sequence
  Description of Artificial Sequence: Synthetic polypeptide
DEEEIRTTNPVATEQYGSVCSTNIQRFNEDT

SEQ ID NO: 17102 - protein, 31 aa, Artificial Sequence
  Description of Artificial Sequence: Synthetic polypeptide
DAEEIRSTNPVATEQYGSVSDTNLQARNGGR

SEQ ID NO: 17103 - protein, 31 aa, Artificial Sequence
  Description of Artificial Sequence: Synthetic polypeptide
YEEQISTTNPVATEQYGSVVSITNLQGRGNR

SEQ ID NO: 17104 - protein, 32 aa, Artificial Sequence
  Description of Artificial Sequence: Synthetic polypeptide
DEEEIRTTNPVATEQYGSVSCTNISTRVGNPR

SEQ ID NO: 17105 - protein, 31 aa, Artificial Sequence
  Description of Artificial Sequence: Synthetic polypeptide
AEEEIRTTNPVATEQYGSVSNTNLGQTAGNN

SEQ ID NO: 17106 - protein, 32 aa, Artificial Sequence
  Description of Artificial Sequence: Synthetic polypeptide
DEEEIATTNPVATEQYGSVSTPNLQERENHRL

SEQ ID NO: 17107 - protein, 31 aa, Artificial Sequence
  Description of Artificial Sequence: Synthetic polypeptide
AEEEIRTTNPVATEQYGSVSNTNLAQTDANR

SEQ ID NO: 17108 - protein, 30 aa, Artificial Sequence
  Description of Artificial Sequence: Synthetic polypeptide
DEEEIRTTNPVATEQYGTYSTMNGLQRENN

SEQ ID NO: 17109 - protein, 30 aa, Artificial Sequence
  Description of Artificial Sequence: Synthetic polypeptide
DEEEIATTNPVATEQYGSVSTPLQRDPERD

SEQ ID NO: 17110 - protein, 30 aa, Artificial Sequence
  Description of Artificial Sequence: Synthetic polypeptide
DAEEIRSTNPVATEQYGSVSTELQAREGQR

SEQ ID NO: 17111 - protein, 31 aa, Artificial Sequence
  Description of Artificial Sequence: Synthetic polypeptide
DAEEIRSTNPVATEQYGSVSTGNLQARNGHR

SEQ ID NO: 17112 - protein, 31 aa, Artificial Sequence
  Description of Artificial Sequence: Synthetic polypeptide
DEEEIRTTNPVATEQYGSVSCTNIGQRGKVV

SEQ ID NO: 17113 - protein, 30 aa, Artificial Sequence
  Description of Artificial Sequence: Synthetic polypeptide
DAEEIRSTNPVATEQYGSVSTNLQAREEQR

SEQ ID NO: 17114 - protein, 30 aa, Artificial Sequence
  Description of Artificial Sequence: Synthetic polypeptide
DAEEIRSTNPVATEQYGSVSTNLQARFGQV

SEQ ID NO: 17115 - protein, 31 aa, Artificial Sequence
  Description of Artificial Sequence: Synthetic polypeptide
DAEEIRSTNPVATEQYGSVSTNLQARNGEER

SEQ ID NO: 17116 - protein, 31 aa, Artificial Sequence
  Description of Artificial Sequence: Synthetic polypeptide
DAEEIRSTNPVATEQYGSVSTNLQARNGPER

SEQ ID NO: 17117 - protein, 31 aa, Artificial Sequence
  Description of Artificial Sequence: Synthetic polypeptide
DAEEIRSTNPVATEQYGSVSTNLQARTGEQR

SEQ ID NO: 17118 - protein, 28 aa, Artificial Sequence
  Description of Artificial Sequence: Synthetic peptide
SEYEIRCTNPVATEQYGSVETNLQGGNQ

SEQ ID NO: 17119 - protein, 28 aa, Artificial Sequence
  Description of Artificial Sequence: Synthetic peptide
DEAEICTTNPVATEQYGSVSTVLMDGNT

SEQ ID NO: 17120 - protein, 31 aa, Artificial Sequence
  Description of Artificial Sequence: Synthetic polypeptide
DEEEIATTNPVATEQYGSVSTNSLFQVRGMF

SEQ ID NO: 17121 - protein, 31 aa, Artificial Sequence
  Description of Artificial Sequence: Synthetic polypeptide
DEEEIATTNPVATEQYGSVSTNSLFQNRGEQ

SEQ ID NO: 17122 - protein, 31 aa, Artificial Sequence
  Description of Artificial Sequence: Synthetic polypeptide
DEEEIRTTNPVATEQYGSVSNTNLQGGGDQV

SEQ ID NO: 17123 - protein, 31 aa, Artificial Sequence
  Description of Artificial Sequence: Synthetic polypeptide
DEEEIRTTNPVATEGYGSVCFTANLTRQGNR

SEQ ID NO: 17124 - protein, 30 aa, Artificial Sequence
  Description of Artificial Sequence: Synthetic polypeptide
DEDEIRTTNPVATEQYGSVSTNAGHGDENR

SEQ ID NO: 17125 - protein, 30 aa, Artificial Sequence
  Description of Artificial Sequence: Synthetic polypeptide
DEEEIATTNPVATEQYGSVSTNMEQQGNMI

SEQ ID NO: 17126 - protein, 31 aa, Artificial Sequence
  Description of Artificial Sequence: Synthetic polypeptide
DEEEIRTTNPVATEQYGVSVSTNHQFFGNQI

SEQ ID NO: 17127 - protein, 30 aa, Artificial Sequence
  Description of Artificial Sequence: Synthetic polypeptide
DEDEIRTTNPVATEQYGSVSTNAQDGGMDR

SEQ ID NO: 17128 - protein, 30 aa, Artificial Sequence
  Description of Artificial Sequence: Synthetic polypeptide
DEEEIATTNPVATEQYGSVSTNLTDQGNPD

SEQ ID NO: 17129 - protein, 31 aa, Artificial Sequence
  Description of Artificial Sequence: Synthetic polypeptide
DEEEIRTTNPVATEQYGSVSTVLQLFEGING

SEQ ID NO: 17130 - protein, 28 aa, Artificial Sequence
  Description of Artificial Sequence: Synthetic peptide
YEEIIHTTNPVATEQYGSVSMNEQRGNS

SEQ ID NO: 17131 - protein, 29 aa, Artificial Sequence
  Description of Artificial Sequence: Synthetic peptide
DEHEIRTTNPVAYEHYGSVSTNLQDGNNE

SEQ ID NO: 17132 - protein, 31 aa, Artificial Sequence
  Description of Artificial Sequence: Synthetic polypeptide
DEEEIATTNPVATEQYGSVSTNMLSGGGGNR

SEQ ID NO: 17133 - protein, 31 aa, Artificial Sequence
  Description of Artificial Sequence: Synthetic polypeptide
DEEEIRTTNPVATEAYGSVAVTNLSQRVGER

SEQ ID NO: 17134 - protein, 31 aa, Artificial Sequence
  Description of Artificial Sequence: Synthetic polypeptide
DEEEIRTTNPVATEQYGSVSTVLQLIGINDD

SEQ ID NO: 17135 - protein, 32 aa, Artificial Sequence
  Description of Artificial Sequence: Synthetic polypeptide
DEEEIATTNPVATEQYGSVSTNLSQNGINNRK

SEQ ID NO: 17136 - protein, 30 aa, Artificial Sequence
  Description of Artificial Sequence: Synthetic polypeptide
DEDEIRTTNPVATEQYGSVSTNAQGDNNDR

SEQ ID NO: 17137 - protein, 31 aa, Artificial Sequence
  Description of Artificial Sequence: Synthetic polypeptide
DEEEIRTTNPVATEQYGSVSTVLQLMNGIND

SEQ ID NO: 17138 - protein, 30 aa, Artificial Sequence
  Description of Artificial Sequence: Synthetic polypeptide
DAGEIRTTNPVATEQYGSMVSTNPLQGGER

SEQ ID NO: 17139 - protein, 30 aa, Artificial Sequence
  Description of Artificial Sequence: Synthetic polypeptide
DAGEIRTTNPVATEQYGSVSATNPLQLGPR

SEQ ID NO: 17140 - protein, 30 aa, Artificial Sequence
  Description of Artificial Sequence: Synthetic polypeptide
DAGEIRTTNPVATEQYGSVSCTNELQLGDR

SEQ ID NO: 17141 - protein, 30 aa, Artificial Sequence
  Description of Artificial Sequence: Synthetic polypeptide
DAGEIRTTNPVATEQYGSVSETNFLQLGER

SEQ ID NO: 17142 - protein, 29 aa, Artificial Sequence
  Description of Artificial Sequence: Synthetic peptide
DAGEIRTTNPVATEQYGSVSINNLQIGMR

SEQ ID NO: 17143 - protein, 29 aa, Artificial Sequence
  Description of Artificial Sequence: Synthetic peptide
DAGEIRTTNPVATEQYGSVSTEPLQNGPR

SEQ ID NO: 17144 - protein, 30 aa, Artificial Sequence
  Description of Artificial Sequence: Synthetic polypeptide
DEEEIRTTNPVATEQYGSVSTVLQLGGDQD

SEQ ID NO: 17145 - protein, 32 aa, Artificial Sequence
  Description of Artificial Sequence: Synthetic polypeptide
DEEEIRTTNPVATEQYGSVCSTNLDNSGSNRG

SEQ ID NO: 17146 - protein, 31 aa, Artificial Sequence
  Description of Artificial Sequence: Synthetic polypeptide
DEEEIRTTNPVATEQYGSVSTVLQGMEGGNV

SEQ ID NO: 17147 - protein, 31 aa, Artificial Sequence
  Description of Artificial Sequence: Synthetic polypeptide
DEEEIATTNPVATEQYGSVSTNNLDQQRGEF

SEQ ID NO: 17148 - protein, 28 aa, Artificial Sequence
  Description of Artificial Sequence: Synthetic peptide
DAEEIRTTNPVGTEQWGTVSTNLQRGDD

SEQ ID NO: 17149 - protein, 31 aa, Artificial Sequence
  Description of Artificial Sequence: Synthetic polypeptide
DEEEIRTTNPVATEQYGSVSTVLQDEGINST

SEQ ID NO: 17150 - protein, 31 aa, Artificial Sequence
  Description of Artificial Sequence: Synthetic polypeptide
DEEEIRTTNPVATEQYGSVSTVLQDGNGGNQ

SEQ ID NO: 17151 - protein, 31 aa, Artificial Sequence
  Description of Artificial Sequence: Synthetic polypeptide
DEEEIRTTNPVATEGYGSVCFTNLTRFGGNR

SEQ ID NO: 17152 - protein, 28 aa, Artificial Sequence
  Description of Artificial Sequence: Synthetic peptide
DAENIRTTNPVATEQYGKVSTNHQRVNL

SEQ ID NO: 17153 - protein, 31 aa, Artificial Sequence
  Description of Artificial Sequence: Synthetic polypeptide
DEEEIATTNPVATEQYGSVSTNQQHNGNDGR

SEQ ID NO: 17154 - protein, 31 aa, Artificial Sequence
  Description of Artificial Sequence: Synthetic polypeptide
DEEEIATTNPVATEQYGSVSTNQQERGNPDA

SEQ ID NO: 17155 - protein, 31 aa, Artificial Sequence
  Description of Artificial Sequence: Synthetic polypeptide
AEEEIRTTNPVATEQYGSVSNNTNLQSGNDE

SEQ ID NO: 17156 - protein, 29 aa, Artificial Sequence
  Description of Artificial Sequence: Synthetic peptide
SEYEIRCTNPVATEQYGSVSETNLQHGNQ

SEQ ID NO: 17157 - protein, 28 aa, Artificial Sequence
  Description of Artificial Sequence: Synthetic peptide
DEEEIAQTNPVATEQYGSVSTGLENGNL

SEQ ID NO: 17158 - protein, 31 aa, Artificial Sequence
  Description of Artificial Sequence: Synthetic polypeptide
DEEEIATTNPVATEQYGSVSTNPQPHGDNGR

SEQ ID NO: 17159 - protein, 31 aa, Artificial Sequence
  Description of Artificial Sequence: Synthetic polypeptide
DEDEIRTTNPVATEQYGSVSTGNSQEGNNDR

SEQ ID NO: 17160 - protein, 31 aa, Artificial Sequence
  Description of Artificial Sequence: Synthetic polypeptide
DEEEIRTTNPVATEQYGSVSCTNHSQRTGKG

SEQ ID NO: 17161 - protein, 31 aa, Artificial Sequence
  Description of Artificial Sequence: Synthetic polypeptide
DEEEIRTTNPVATEQYGSVSTVLQGGGIDRI

SEQ ID NO: 17162 - protein, 30 aa, Artificial Sequence
  Description of Artificial Sequence: Synthetic polypeptide
DEEEIATTNPVATEQYGSVSTNPQHNSNRS

SEQ ID NO: 17163 - protein, 29 aa, Artificial Sequence
  Description of Artificial Sequence: Synthetic peptide
DEEEIATTNPVATEQYGSVSTNPQDGEFV

SEQ ID NO: 17164 - protein, 31 aa, Artificial Sequence
  Description of Artificial Sequence: Synthetic polypeptide
DEEEIRTTNPVATEQYGSVSTVLQGGIDDNQ

SEQ ID NO: 17165 - protein, 31 aa, Artificial Sequence
  Description of Artificial Sequence: Synthetic polypeptide
DEEEIATTNPVATEQYGSVSTNNQTGDGNQR

SEQ ID NO: 17166 - protein, 33 aa, Artificial Sequence
  Description of Artificial Sequence: Synthetic polypeptide
DEEEIRTTNPVATEQYGVSIVPSTNLSQSGNNR

SEQ ID NO: 17167 - protein, 30 aa, Artificial Sequence
  Description of Artificial Sequence: Synthetic polypeptide
DEEEIATTNPVATEQYGSVSTNNQMNGNNG

SEQ ID NO: 17168 - protein, 31 aa, Artificial Sequence
  Description of Artificial Sequence: Synthetic polypeptide
DEEEIRTTNPVATEQYGSVSTVLQGIGGNTN

SEQ ID NO: 17169 - protein, 32 aa, Artificial Sequence
  Description of Artificial Sequence: Synthetic polypeptide
DEEEIRTTNPVATEQYGSVSCTNHSQPTGNNR

SEQ ID NO: 17170 - protein, 31 aa, Artificial Sequence
  Description of Artificial Sequence: Synthetic polypeptide
DEEEIATTNPVATEQYGSVSTNNLGQVRGEQ

SEQ ID NO: 17171 - protein, 28 aa, Artificial Sequence
  Description of Artificial Sequence: Synthetic peptide
YEEPICTTNPVATEQYGSVSMNSQRGNY

SEQ ID NO: 17172 - protein, 28 aa, Artificial Sequence
  Description of Artificial Sequence: Synthetic peptide
DAEEIRSTNPVATEQWGSASTNMQRGNN

SEQ ID NO: 17173 - protein, 32 aa, Artificial Sequence
  Description of Artificial Sequence: Synthetic polypeptide
DEEEIRTTNPVATEQYGSVSCTNGSQRTGSNQ

SEQ ID NO: 17174 - protein, 32 aa, Artificial Sequence
  Description of Artificial Sequence: Synthetic polypeptide
DEEEIRTTNPVATEQYGSVNSTNLLQVIGNPD

SEQ ID NO: 17175 - protein, 32 aa, Artificial Sequence
  Description of Artificial Sequence: Synthetic polypeptide
DEEEIRTTNPVATEQYGVVCSTNLQRFGDPRT

SEQ ID NO: 17176 - protein, 28 aa, Artificial Sequence
  Description of Artificial Sequence: Synthetic peptide
SNEEIRCTNPIATEQYGSVSENLMRGNR

SEQ ID NO: 17177 - protein, 31 aa, Artificial Sequence
  Description of Artificial Sequence: Synthetic polypeptide
DEEEIRTTNPVATEAYGSVPNTGLSQRGGNR

SEQ ID NO: 17178 - protein, 32 aa, Artificial Sequence
  Description of Artificial Sequence: Synthetic polypeptide
DEEEIRTTNPVATEQYGSVSNTNLQAGFGSNQ

SEQ ID NO: 17179 - protein, 30 aa, Artificial Sequence
  Description of Artificial Sequence: Synthetic polypeptide
DEEEIRTTNPVATEQYGSVNSTNHQEGQDE

SEQ ID NO: 17180 - protein, 32 aa, Artificial Sequence
  Description of Artificial Sequence: Synthetic polypeptide
DEDEIRTTNPVATEQYGSVSTNLGSQEGGENR

SEQ ID NO: 17181 - protein, 31 aa, Artificial Sequence
  Description of Artificial Sequence: Synthetic polypeptide
AEEEIRTTNPVATEQYGSVSATTNLQLGNDN

SEQ ID NO: 17182 - protein, 31 aa, Artificial Sequence
  Description of Artificial Sequence: Synthetic polypeptide
DEEEIRTTNPVATEQYGVVCSTNLQYLSNRD

SEQ ID NO: 17183 - protein, 31 aa, Artificial Sequence
  Description of Artificial Sequence: Synthetic polypeptide
DEEEIATTNPVATEQYGSVSTNLQENNSNRS

SEQ ID NO: 17184 - protein, 32 aa, Artificial Sequence
  Description of Artificial Sequence: Synthetic polypeptide
DEHEIRTTNPVATEQYGSVSTTANDLQDGNQR

SEQ ID NO: 17185 - protein, 31 aa, Artificial Sequence
  Description of Artificial Sequence: Synthetic polypeptide
DCEEIRTTNPVATEQYGSVSTNLNRVGNDDG

SEQ ID NO: 17186 - protein, 32 aa, Artificial Sequence
  Description of Artificial Sequence: Synthetic polypeptide
DEEEIRTTNPVATEQYGSVSTVNLQGSGQNEF

SEQ ID NO: 17187 - protein, 31 aa, Artificial Sequence
  Description of Artificial Sequence: Synthetic polypeptide
DEEEIRTTNPVATEQYGSVSTVNLQHRDTDD

SEQ ID NO: 17188 - protein, 30 aa, Artificial Sequence
  Description of Artificial Sequence: Synthetic polypeptide
AEEEIRTTNPVATEQYGSVSATNQQQAGNQ

SEQ ID NO: 17189 - protein, 30 aa, Artificial Sequence
  Description of Artificial Sequence: Synthetic polypeptide
DEHEIRTTNPVATEQYGSVSTQLGQDEGNN

SEQ ID NO: 17190 - protein, 30 aa, Artificial Sequence
  Description of Artificial Sequence: Synthetic polypeptide
DEHEIRTTNPVATEQYGSVSTQGDQRGGNS

SEQ ID NO: 17191 - protein, 32 aa, Artificial Sequence
  Description of Artificial Sequence: Synthetic polypeptide
DEEEIRTTNPVATEQYGSVSTVNLQIGVGNSN

SEQ ID NO: 17192 - protein, 29 aa, Artificial Sequence
  Description of Artificial Sequence: Synthetic peptide
DCEEIRTTNPVAYEQWGSVTSTPLQRGTR

SEQ ID NO: 17193 - protein, 31 aa, Artificial Sequence
  Description of Artificial Sequence: Synthetic polypeptide
DEHEIRTTNPVATEQYGSVSTPNLQGDGMNL

SEQ ID NO: 17194 - protein, 31 aa, Artificial Sequence
  Description of Artificial Sequence: Synthetic polypeptide
DEHEIRTTNPVATEQYGSVSTPNLQDGNNLD

SEQ ID NO: 17195 - protein, 30 aa, Artificial Sequence
  Description of Artificial Sequence: Synthetic polypeptide
AEEEIRTTNPVATEQYGSVSATNQNNVGNR

SEQ ID NO: 17196 - protein, 30 aa, Artificial Sequence
  Description of Artificial Sequence: Synthetic polypeptide
DCEEIRVTNPVATEQYGSSVSTNLQPNGTR

SEQ ID NO: 17197 - protein, 30 aa, Artificial Sequence
  Description of Artificial Sequence: Synthetic polypeptide
DEHEIRTTNPVATEQYGSVSTQLQGEGNEN

SEQ ID NO: 17198 - protein, 28 aa, Artificial Sequence
  Description of Artificial Sequence: Synthetic peptide
DEDEIRTTNPVSTEQWGQVSENLQRGNH

SEQ ID NO: 17199 - protein, 29 aa, Artificial Sequence
  Description of Artificial Sequence: Synthetic peptide
DEEEIRTTNPVATEQYGSVYTNLIRTVEV

SEQ ID NO: 17200 - protein, 31 aa, Artificial Sequence
  Description of Artificial Sequence: Synthetic polypeptide
DEEEIATTNPVATEQYGSVSTNLQGDAGGRE

SEQ ID NO: 17201 - protein, 30 aa, Artificial Sequence
  Description of Artificial Sequence: Synthetic polypeptide
DCEEIRTTNPVATEQWGSVTSTDLQRGGTR

SEQ ID NO: 17202 - protein, 30 aa, Artificial Sequence
  Description of Artificial Sequence: Synthetic polypeptide
DEHEIRTTNPVATEQYGSVSTTNGDVGNER

SEQ ID NO: 17203 - protein, 32 aa, Artificial Sequence
  Description of Artificial Sequence: Synthetic polypeptide
DEEEIRTTNPVATEQYGVVCSTNLQEYFGNRL

SEQ ID NO: 17204 - protein, 31 aa, Artificial Sequence
  Description of Artificial Sequence: Synthetic polypeptide
DEHEIRTTNPVATEQYGSVSTTNGDQAGNER

SEQ ID NO: 17205 - protein, 32 aa, Artificial Sequence
  Description of Artificial Sequence: Synthetic polypeptide
DEEEIRTTNPVATEQYGSVSTVNLQFGGGNGQ

SEQ ID NO: 17206 - protein, 31 aa, Artificial Sequence
  Description of Artificial Sequence: Synthetic polypeptide
DEHEIRTTNPVATEQYGSVSTTNDQGEGNER

SEQ ID NO: 17207 - protein, 31 aa, Artificial Sequence
  Description of Artificial Sequence: Synthetic polypeptide
DEHEIRTTNPVATEQYGSVSTTNDQDNGNER

SEQ ID NO: 17208 - protein, 31 aa, Artificial Sequence
  Description of Artificial Sequence: Synthetic polypeptide
DEHEIRTTNPVATEQYGSVSTTNAQDGNERT

SEQ ID NO: 17209 - protein, 31 aa, Artificial Sequence
  Description of Artificial Sequence: Synthetic polypeptide
DEEEIRTTNPVATEQYGSVSTVNLQFNENND

SEQ ID NO: 17210 - protein, 32 aa, Artificial Sequence
  Description of Artificial Sequence: Synthetic polypeptide
DEEEIRTTNPVATEQYGVVCSTNLQGSGSNRG

SEQ ID NO: 17211 - protein, 30 aa, Artificial Sequence
  Description of Artificial Sequence: Synthetic polypeptide
DEEEIATTNPVATEQYGSVSTNLQGAGGAN

SEQ ID NO: 17212 - protein, 31 aa, Artificial Sequence
  Description of Artificial Sequence: Synthetic polypeptide
DEEEIATTNPVATEQYGSVSTNLQGDVGDNE

SEQ ID NO: 17213 - protein, 31 aa, Artificial Sequence
  Description of Artificial Sequence: Synthetic polypeptide
DEEEIRTTNPVATEQYGVVCSTNLQHFGDER

SEQ ID NO: 17214 - protein, 30 aa, Artificial Sequence
  Description of Artificial Sequence: Synthetic polypeptide
DEHEIRTTNPVATEQYGSVSTTLQQDGNTG

SEQ ID NO: 17215 - protein, 31 aa, Artificial Sequence
  Description of Artificial Sequence: Synthetic polypeptide
DEEEIATTNPVATEQYGSVSTNLQGDVGDMR

SEQ ID NO: 17216 - protein, 32 aa, Artificial Sequence
  Description of Artificial Sequence: Synthetic polypeptide
DEEEIRTTNPVATEQYGSVSTVNLQGGNGNIP

SEQ ID NO: 17217 - protein, 28 aa, Artificial Sequence
  Description of Artificial Sequence: Synthetic peptide
DEDEISTTNPVATEMWGSISENLQRGNR

SEQ ID NO: 17218 - protein, 32 aa, Artificial Sequence
  Description of Artificial Sequence: Synthetic polypeptide
DEEEIATTNPVATEQYGSVSTNLQGDHGNNRE

SEQ ID NO: 17219 - protein, 31 aa, Artificial Sequence
  Description of Artificial Sequence: Synthetic polypeptide
DEEEIRTTNPVATEQYGSVNSTNHQGGSNFN

SEQ ID NO: 17220 - protein, 31 aa, Artificial Sequence
  Description of Artificial Sequence: Synthetic polypeptide
DEEEIATTNPVATEQYGSVSTNLQGDGNMQE

SEQ ID NO: 17221 - protein, 31 aa, Artificial Sequence
  Description of Artificial Sequence: Synthetic polypeptide
DEEEIATTNPVATEQYGSVSTNLQGDGDNAE

SEQ ID NO: 17222 - protein, 30 aa, Artificial Sequence
  Description of Artificial Sequence: Synthetic polypeptide
DEAEIRTTNPVATEQYGSVSVSNLFRNMNR

SEQ ID NO: 17223 - protein, 31 aa, Artificial Sequence
  Description of Artificial Sequence: Synthetic polypeptide
DEEEIRTTNPVATEQYGSVNSTNHQRISNQT

SEQ ID NO: 17224 - protein, 31 aa, Artificial Sequence
  Description of Artificial Sequence: Synthetic polypeptide
DEEEIATTNPVATEQYGSVSTNLQEGGGMER

SEQ ID NO: 17225 - protein, 31 aa, Artificial Sequence
  Description of Artificial Sequence: Synthetic polypeptide
DEHEIRTTNPVATEQYGSVSTPNGQDAGNNR

SEQ ID NO: 17226 - protein, 30 aa, Artificial Sequence
  Description of Artificial Sequence: Synthetic polypeptide
DEHEIRTTNPVATEQYGSVSTPLQGGGNNA

SEQ ID NO: 17227 - protein, 31 aa, Artificial Sequence
  Description of Artificial Sequence: Synthetic polypeptide
AEEEIRTTNPVATEQYGSVSATNLQQGNNDE

SEQ ID NO: 17228 - protein, 31 aa, Artificial Sequence
  Description of Artificial Sequence: Synthetic polypeptide
AEEEIRTTNPVATEQYGSVSATNLQQGENVT

SEQ ID NO: 17229 - protein, 32 aa, Artificial Sequence
  Description of Artificial Sequence: Synthetic polypeptide
DEEEIRTTNPVATEQYGSVYTNLDQEVGEDNR

SEQ ID NO: 17230 - protein, 31 aa, Artificial Sequence
  Description of Artificial Sequence: Synthetic polypeptide
DEHEIRTTNPVATEQYGSVSTNLQVGNDGMQ

SEQ ID NO: 17231 - protein, 31 aa, Artificial Sequence
  Description of Artificial Sequence: Synthetic polypeptide
DEHEIRTTNPVATEQYGSVSTNLQVGGNNMQ

SEQ ID NO: 17232 - protein, 31 aa, Artificial Sequence
  Description of Artificial Sequence: Synthetic polypeptide
DEEEIRTTNPVATEQYGVVDSTNVLQRGSDV

SEQ ID NO: 17233 - protein, 30 aa, Artificial Sequence
  Description of Artificial Sequence: Synthetic polypeptide
DEEEIRTTNPVATEQYGSVSNTSNVQVLVR

SEQ ID NO: 17234 - protein, 31 aa, Artificial Sequence
  Description of Artificial Sequence: Synthetic polypeptide
AEEEIRTTNPVATEQYGSVSATNLQQGANAG

SEQ ID NO: 17235 - protein, 32 aa, Artificial Sequence
  Description of Artificial Sequence: Synthetic polypeptide
DEHEIRTTNPVATEQYGSVSTNLQRGGDDQRE

SEQ ID NO: 17236 - protein, 32 aa, Artificial Sequence
  Description of Artificial Sequence: Synthetic polypeptide
DEEEIRTTNPVATEQYGSVYTNILVQRIGQER

SEQ ID NO: 17237 - protein, 32 aa, Artificial Sequence
  Description of Artificial Sequence: Synthetic polypeptide
DEDEIRTTNPVATEQYGSVSTNLNQGNAGNER

SEQ ID NO: 17238 - protein, 31 aa, Artificial Sequence
  Description of Artificial Sequence: Synthetic polypeptide
AEEEIRTTNPVATEQYGSVSATNLQNGTNMI

SEQ ID NO: 17239 - protein, 31 aa, Artificial Sequence
  Description of Artificial Sequence: Synthetic polypeptide
AEEEIRTTNPVATEQYGSVSATNLQLGANDT

SEQ ID NO: 17240 - protein, 32 aa, Artificial Sequence
  Description of Artificial Sequence: Synthetic polypeptide
DEHEIRTTNPVATEQYGSVSTNLQREGDNNQP

SEQ ID NO: 17241 - protein, 31 aa, Artificial Sequence
  Description of Artificial Sequence: Synthetic polypeptide
DEHEIRTTNPVATEQYGSVSTNLQRDGDQGL

SEQ ID NO: 17242 - protein, 31 aa, Artificial Sequence
  Description of Artificial Sequence: Synthetic polypeptide
DEHEIRTTNPVATEQYGSVSTNLQRDGDGTA

SEQ ID NO: 17243 - protein, 32 aa, Artificial Sequence
  Description of Artificial Sequence: Synthetic polypeptide
DEEEIRTTNPVATEQYGSVSNTNLPQQGGNGE

SEQ ID NO: 17244 - protein, 34 aa, Artificial Sequence
  Description of Artificial Sequence: Synthetic polypeptide
DEEEIRTTNPVATEQYGSVPSCTVNELSQRTGNR

SEQ ID NO: 17245 - protein, 32 aa, Artificial Sequence
  Description of Artificial Sequence: Synthetic polypeptide
DEHEIRTTNPVATEQYGSVSTNLQRDGDDGRN

SEQ ID NO: 17246 - protein, 31 aa, Artificial Sequence
  Description of Artificial Sequence: Synthetic polypeptide
AEEEIRTTNPVATEQYGSVSATNLQEGENNA

SEQ ID NO: 17247 - protein, 32 aa, Artificial Sequence
  Description of Artificial Sequence: Synthetic polypeptide
DEEEIRTTNPVATEQYGSVSTVNLQPQGGNEP

SEQ ID NO: 17248 - protein, 28 aa, Artificial Sequence
  Description of Artificial Sequence: Synthetic peptide
DEAEIATTNPVATEQYGTASTNLQSGND

SEQ ID NO: 17249 - protein, 31 aa, Artificial Sequence
  Description of Artificial Sequence: Synthetic polypeptide
AEEEIRTTNPVATEQYGSVSATNLQLGGNND

SEQ ID NO: 17250 - protein, 31 aa, Artificial Sequence
  Description of Artificial Sequence: Synthetic polypeptide
AEEEIRTTNPVATEQYGSVSATNLQQGQNNQ

SEQ ID NO: 17251 - protein, 31 aa, Artificial Sequence
  Description of Artificial Sequence: Synthetic polypeptide
DEDEIRTTNPVATEQYGSVSTNLNQDGGDER

SEQ ID NO: 17252 - protein, 29 aa, Artificial Sequence
  Description of Artificial Sequence: Synthetic peptide
DEAEIATTNPVATEQYGTVSTNLQRSNDV

SEQ ID NO: 17253 - protein, 31 aa, Artificial Sequence
  Description of Artificial Sequence: Synthetic polypeptide
DEDEIRTTNPVATEQYGSVSTNLNGETGENR

SEQ ID NO: 17254 - protein, 28 aa, Artificial Sequence
  Description of Artificial Sequence: Synthetic peptide
DCEEISTTNPVATTQYGSVCTNDNRGNR

SEQ ID NO: 17255 - protein, 29 aa, Artificial Sequence
  Description of Artificial Sequence: Synthetic peptide
DCEEISTTNPVATTQYGSVSTNDMREGNR

SEQ ID NO: 17256 - protein, 31 aa, Artificial Sequence
  Description of Artificial Sequence: Synthetic polypeptide
DEEEIRTTNPVATEQYGSVYTNLIQRTLNDG

SEQ ID NO: 17257 - protein, 31 aa, Artificial Sequence
  Description of Artificial Sequence: Synthetic polypeptide
DEEEIRTTNPVATEQYGVVCSTPLQNFGNRE

SEQ ID NO: 17258 - protein, 30 aa, Artificial Sequence
  Description of Artificial Sequence: Synthetic polypeptide
DEEEIRTTNPVATEQYGSVYTNLEVRGGEQ

SEQ ID NO: 17259 - protein, 29 aa, Artificial Sequence
  Description of Artificial Sequence: Synthetic peptide
DCEEISTTNPVATTQYGSVSTNPDMRGNR

SEQ ID NO: 17260 - protein, 32 aa, Artificial Sequence
  Description of Artificial Sequence: Synthetic polypeptide
DEEEIRTTNPVATEQYGSVSTVNLQMEMGNQT

SEQ ID NO: 17261 - protein, 31 aa, Artificial Sequence
  Description of Artificial Sequence: Synthetic polypeptide
DEHEIRTTNPVATEQYGSVSTNQDQPGGENR

SEQ ID NO: 17262 - protein, 31 aa, Artificial Sequence
  Description of Artificial Sequence: Synthetic polypeptide
DEEEIRTTNPVATEQYGSVYTNLEQSGDNDS

SEQ ID NO: 17263 - protein, 31 aa, Artificial Sequence
  Description of Artificial Sequence: Synthetic polypeptide
DEHEIRTTNPVATEQYGSVSTNQDQEAGSNR

SEQ ID NO: 17264 - protein, 30 aa, Artificial Sequence
  Description of Artificial Sequence: Synthetic polypeptide
DEHEIRTTNPVATEQYGSVSTNNQGQGEND

SEQ ID NO: 17265 - protein, 31 aa, Artificial Sequence
  Description of Artificial Sequence: Synthetic polypeptide
AEEEIRTTNPVATEQYGSVSATNLQQQTGNE

SEQ ID NO: 17266 - protein, 30 aa, Artificial Sequence
  Description of Artificial Sequence: Synthetic polypeptide
DEHEIRTTNPVATEQYGSVSTNNQDGGNFN

SEQ ID NO: 17267 - protein, 30 aa, Artificial Sequence
  Description of Artificial Sequence: Synthetic polypeptide
DEHEIRTTNPVATEQYGSVSTNNQAGGNHN

SEQ ID NO: 17268 - protein, 31 aa, Artificial Sequence
  Description of Artificial Sequence: Synthetic polypeptide
DEEEIATTNPVATEQYGSVSTNLQDHNGGNV

SEQ ID NO: 17269 - protein, 30 aa, Artificial Sequence
  Description of Artificial Sequence: Synthetic polypeptide
DEEEIATTNPVATEQYGSVSTNLQDGGVEN

SEQ ID NO: 17270 - protein, 33 aa, Artificial Sequence
  Description of Artificial Sequence: Synthetic polypeptide
DEEEIRTTNPVATEHYGSTVSCTNLSQRGGNRQ

SEQ ID NO: 17271 - protein, 29 aa, Artificial Sequence
  Description of Artificial Sequence: Synthetic peptide
DCGEIRTTNPVATEQYGSVSTNKLELGDR

SEQ ID NO: 17272 - protein, 30 aa, Artificial Sequence
  Description of Artificial Sequence: Synthetic polypeptide
DEAEIRTTNPVATEQYGSVSVNLQNQMGNM

SEQ ID NO: 17273 - protein, 31 aa, Artificial Sequence
  Description of Artificial Sequence: Synthetic polypeptide
DEEEIRTTNPVATEQYGSVSTVNLQNNNPQL

SEQ ID NO: 17274 - protein, 32 aa, Artificial Sequence
  Description of Artificial Sequence: Synthetic polypeptide
DEEEIRTTNPVATEQYGSVSTVNLQNQGGNIP

SEQ ID NO: 17275 - protein, 30 aa, Artificial Sequence
  Description of Artificial Sequence: Synthetic polypeptide
DEHEIRTTNPVATEQYGSVSTNNGQDEGSR

SEQ ID NO: 17276 - protein, 29 aa, Artificial Sequence
  Description of Artificial Sequence: Synthetic peptide
DCEEIRTTNPVATEQWGSVPSTLQQRGTR

SEQ ID NO: 17277 - protein, 29 aa, Artificial Sequence
  Description of Artificial Sequence: Synthetic peptide
DCEEIRTTNPVATEQWGSVPSTLLQSGTR

SEQ ID NO: 17278 - protein, 31 aa, Artificial Sequence
  Description of Artificial Sequence: Synthetic polypeptide
DEEEIATTNPVATEQYGSVSTNLQGGNGNTG

SEQ ID NO: 17279 - protein, 30 aa, Artificial Sequence
  Description of Artificial Sequence: Synthetic polypeptide
DEEEIRTTNPVATEQYGSVYTNLQADGDQG

SEQ ID NO: 17280 - protein, 30 aa, Artificial Sequence
  Description of Artificial Sequence: Synthetic polypeptide
AEEEIRTTNPVATEQYGSVSITNNQGNGNE

SEQ ID NO: 17281 - protein, 30 aa, Artificial Sequence
  Description of Artificial Sequence: Synthetic polypeptide
DEHEIRTTNPVATEQYGSVVTNLQGGGNDE

SEQ ID NO: 17282 - protein, 29 aa, Artificial Sequence
  Description of Artificial Sequence: Synthetic peptide
DEHEIRTTNPVATEQYGSVVTNGGAGDNR

SEQ ID NO: 17283 - protein, 31 aa, Artificial Sequence
  Description of Artificial Sequence: Synthetic polypeptide
DEEEIATTNPVATEQYGSVSTNLQHNGGNPT

SEQ ID NO: 17284 - protein, 33 aa, Artificial Sequence
  Description of Artificial Sequence: Synthetic polypeptide
DEEEIRTTNPVATEHYGISVVSCTNLQRVGNYR

SEQ ID NO: 17285 - protein, 30 aa, Artificial Sequence
  Description of Artificial Sequence: Synthetic polypeptide
DEHEIRTTNPVATEQYGSVVSTNQQGGEDR

SEQ ID NO: 17286 - protein, 32 aa, Artificial Sequence
  Description of Artificial Sequence: Synthetic polypeptide
DEHEIRTTNPVATEQYGSVVSTNQLQGDGENR

SEQ ID NO: 17287 - protein, 31 aa, Artificial Sequence
  Description of Artificial Sequence: Synthetic polypeptide
DEHEIRTTNPVATEQYGSVVSTNLQQAGNSS

SEQ ID NO: 17288 - protein, 31 aa, Artificial Sequence
  Description of Artificial Sequence: Synthetic polypeptide
DEHEIRTTNPVATEQYGSVVSTNLQEDGNKD

SEQ ID NO: 17289 - protein, 30 aa, Artificial Sequence
  Description of Artificial Sequence: Synthetic polypeptide
AEEEIRTTNPVATEQYGSVSITNDQGNGNC

SEQ ID NO: 17290 - protein, 30 aa, Artificial Sequence
  Description of Artificial Sequence: Synthetic polypeptide
AEEEIRTTNPVATEQYGSVSITNQQQNGNQ

SEQ ID NO: 17291 - protein, 31 aa, Artificial Sequence
  Description of Artificial Sequence: Synthetic polypeptide
DEEEIATTNPVATEQYGSVSTNLQHNGGDDR

SEQ ID NO: 17292 - protein, 29 aa, Artificial Sequence
  Description of Artificial Sequence: Synthetic peptide
DEHEIRTTNPVATEQYGSVVSTNDQGPNE

SEQ ID NO: 17293 - protein, 30 aa, Artificial Sequence
  Description of Artificial Sequence: Synthetic polypeptide
DEEEIRTTNPVATEQYGSVYTNLQNMGSMD

SEQ ID NO: 17294 - protein, 32 aa, Artificial Sequence
  Description of Artificial Sequence: Synthetic polypeptide
DEEEIRTTNPVATEQYGSVNSTNLDQNDNNER

SEQ ID NO: 17295 - protein, 30 aa, Artificial Sequence
  Description of Artificial Sequence: Synthetic polypeptide
DEEEIATTNPVATEQYGSVSTNLQHNGDGV

SEQ ID NO: 17296 - protein, 30 aa, Artificial Sequence
  Description of Artificial Sequence: Synthetic polypeptide
DEEEIATTNPVATEQYGSVSTNLQHGGDDK

SEQ ID NO: 17297 - protein, 31 aa, Artificial Sequence
  Description of Artificial Sequence: Synthetic polypeptide
DEEEIATTNPVATEQYGSVSTNLQHEGGNQT

SEQ ID NO: 17298 - protein, 32 aa, Artificial Sequence
  Description of Artificial Sequence: Synthetic polypeptide
DEEEIATTNPVATEQYGSVSTNLQHDQGNNDR

SEQ ID NO: 17299 - protein, 30 aa, Artificial Sequence
  Description of Artificial Sequence: Synthetic polypeptide
DEEEIRTTNPVATEQYGSVSCTNGPQREIF

SEQ ID NO: 17300 - protein, 31 aa, Artificial Sequence
  Description of Artificial Sequence: Synthetic polypeptide
DEEEIRTTNPVATEQYGYTISANELQRGNRI

SEQ ID NO: 17301 - protein, 31 aa, Artificial Sequence
  Description of Artificial Sequence: Synthetic polypeptide
DEEEIRTTNPVATEQYGSVNSTNLDQGNEEQ

SEQ ID NO: 17302 - protein, 30 aa, Artificial Sequence
  Description of Artificial Sequence: Synthetic polypeptide
DEEEIRTTNPVATEQYGSVYTNLQNTGSVD

SEQ ID NO: 17303 - protein, 31 aa, Artificial Sequence
  Description of Artificial Sequence: Synthetic polypeptide
DEDEIRTTNPVATEQYGSVSTNLGGTDGNTR

SEQ ID NO: 17304 - protein, 31 aa, Artificial Sequence
  Description of Artificial Sequence: Synthetic polypeptide
DEDEIRTTNPVATEQYGSVSTNLGDEHGENR

SEQ ID NO: 17305 - protein, 30 aa, Artificial Sequence
  Description of Artificial Sequence: Synthetic polypeptide
DEEEIRTTNPVATEQYGSVSCTNGSGRGSF

SEQ ID NO: 17306 - protein, 30 aa, Artificial Sequence
  Description of Artificial Sequence: Synthetic polypeptide
DEDEISTTNPVATEQYGSVATNLQRVNMRD

SEQ ID NO: 17307 - protein, 28 aa, Artificial Sequence
  Description of Artificial Sequence: Synthetic peptide
YEEGICTTNPVATEQYGSVSMNQQRGNT

SEQ ID NO: 17308 - protein, 30 aa, Artificial Sequence
  Description of Artificial Sequence: Synthetic polypeptide
DEEEIRTTNPVATEQYGSVYTNLQQSNQVA

SEQ ID NO: 17309 - protein, 29 aa, Artificial Sequence
  Description of Artificial Sequence: Synthetic peptide
DEDEISTTNPVATEQYGSVATNLQRDGDH

SEQ ID NO: 17310 - protein, 31 aa, Artificial Sequence
  Description of Artificial Sequence: Synthetic polypeptide
DEEEIRTTNPVATEQYGSVSTVLQSNNGNGQ

SEQ ID NO: 17311 - protein, 32 aa, Artificial Sequence
  Description of Artificial Sequence: Synthetic polypeptide
DEEEIRTTNPVATEQYGSVNSTNLFQGIGNPD

SEQ ID NO: 17312 - protein, 29 aa, Artificial Sequence
  Description of Artificial Sequence: Synthetic peptide
DEEEIRTTNPVATEQYGSVSTVLQSTEQD

SEQ ID NO: 17313 - protein, 30 aa, Artificial Sequence
  Description of Artificial Sequence: Synthetic polypeptide
DEHEIRTTNPVATEQYGVVSTNLQGDGNMN

SEQ ID NO: 17314 - protein, 30 aa, Artificial Sequence
  Description of Artificial Sequence: Synthetic polypeptide
DEDEISTTNPVATEQYGSVATNLQGGNSRD

SEQ ID NO: 17315 - protein, 30 aa, Artificial Sequence
  Description of Artificial Sequence: Synthetic polypeptide
DEHEIRTTNPVATEQYGVVSTNLQFQGNPN

SEQ ID NO: 17316 - protein, 30 aa, Artificial Sequence
  Description of Artificial Sequence: Synthetic polypeptide
DEHEIRTTNPVATEQYGVVSTNLQFGGNNN

SEQ ID NO: 17317 - protein, 31 aa, Artificial Sequence
  Description of Artificial Sequence: Synthetic polypeptide
DEEEIRTTNPVATEQYGSVSTVLQTMGINVS

SEQ ID NO: 17318 - protein, 28 aa, Artificial Sequence
  Description of Artificial Sequence: Synthetic peptide
DCEEIRATNPVATEQWGSCSTNMQRGNN

SEQ ID NO: 17319 - protein, 28 aa, Artificial Sequence
  Description of Artificial Sequence: Synthetic peptide
DCEEIRATNPVATEQWGSSSTNDQRGNA

SEQ ID NO: 17320 - protein, 30 aa, Artificial Sequence
  Description of Artificial Sequence: Synthetic polypeptide
DEEEIATTNPVATEQYGSVSTNLQNGGDSD

SEQ ID NO: 17321 - protein, 31 aa, Artificial Sequence
  Description of Artificial Sequence: Synthetic polypeptide
DEEEIRTTNPVATEQYGSVSTVLQTNNGNTD

SEQ ID NO: 17322 - protein, 30 aa, Artificial Sequence
  Description of Artificial Sequence: Synthetic polypeptide
DEDEISTTNPVATEQYGSVATNLQEGNSRE

SEQ ID NO: 17323 - protein, 31 aa, Artificial Sequence
  Description of Artificial Sequence: Synthetic polypeptide
DEEEIATTNPVATEQYGSVSTNLQIGDGNSE

SEQ ID NO: 17324 - protein, 30 aa, Artificial Sequence
  Description of Artificial Sequence: Synthetic polypeptide
AEEEIRTTNPVATEQYGSVSMTELQGGSNF

SEQ ID NO: 17325 - protein, 31 aa, Artificial Sequence
  Description of Artificial Sequence: Synthetic polypeptide
DEHEIRTTNPVATEQYGTVSTNLQNGDGNNR

SEQ ID NO: 17326 - protein, 30 aa, Artificial Sequence
  Description of Artificial Sequence: Synthetic polypeptide
DEHEIRTTNPVATEQYGTVSTNLQHQGNNN

SEQ ID NO: 17327 - protein, 28 aa, Artificial Sequence
  Description of Artificial Sequence: Synthetic peptide
SLEEIRCTNPIATEQYGSVSENLMRGNR

SEQ ID NO: 17328 - protein, 32 aa, Artificial Sequence
  Description of Artificial Sequence: Synthetic polypeptide
DEEEIRTTNPVATEQYGSVSCTNGSQRGGKNV

SEQ ID NO: 17329 - protein, 32 aa, Artificial Sequence
  Description of Artificial Sequence: Synthetic polypeptide
DEEEIRTTNPVATEQYGSVNSTNLDQGIGNDD

SEQ ID NO: 17330 - protein, 30 aa, Artificial Sequence
  Description of Artificial Sequence: Synthetic polypeptide
DEHEIRTTNPVATEQYGVVSTNLQHPGDNS

SEQ ID NO: 17331 - protein, 30 aa, Artificial Sequence
  Description of Artificial Sequence: Synthetic polypeptide
DEEEIRTTNPVATEQYGSVYTNLQLVTNNQ

SEQ ID NO: 17332 - protein, 31 aa, Artificial Sequence
  Description of Artificial Sequence: Synthetic polypeptide
DEDEIRTTNPVATEQYGSVSTNLGHGDDDNR

SEQ ID NO: 17333 - protein, 31 aa, Artificial Sequence
  Description of Artificial Sequence: Synthetic polypeptide
DEDEIRTTNPVATEQYGSVSTNLGSDNGENR

SEQ ID NO: 17334 - protein, 31 aa, Artificial Sequence
  Description of Artificial Sequence: Synthetic polypeptide
DEHEIRTTNPVATEQYGSVSTTPDQRGNNDR

SEQ ID NO: 17335 - protein, 31 aa, Artificial Sequence
  Description of Artificial Sequence: Synthetic polypeptide
DEHEIRTTNPVATEQYGSVSTTPDQRGENER

SEQ ID NO: 17336 - protein, 28 aa, Artificial Sequence
  Description of Artificial Sequence: Synthetic peptide
DEDEISTTNPVATEPYGSVSNNLQHGNS

SEQ ID NO: 17337 - protein, 29 aa, Artificial Sequence
  Description of Artificial Sequence: Synthetic peptide
DEEEIRTTNPVATEQYGSVYTNLQINDTE

SEQ ID NO: 17338 - protein, 31 aa, Artificial Sequence
  Description of Artificial Sequence: Synthetic polypeptide
DEHEIRTTNPVATEQYGSVSTTNSQDGENER

SEQ ID NO: 17339 - protein, 32 aa, Artificial Sequence
  Description of Artificial Sequence: Synthetic polypeptide
DEEEIRTTNPVATEQYGSVSTVNLIQEIGNTQ

SEQ ID NO: 17340 - protein, 30 aa, Artificial Sequence
  Description of Artificial Sequence: Synthetic polypeptide
DEEEIRTTNPVATEQYGSVYTNLQIMVNTE

SEQ ID NO: 17341 - protein, 31 aa, Artificial Sequence
  Description of Artificial Sequence: Synthetic polypeptide
DEEEIATTNPVATEQYGSVSTNLQGPDGNTN

SEQ ID NO: 17342 - protein, 29 aa, Artificial Sequence
  Description of Artificial Sequence: Synthetic peptide
AEEEIRTTNPVATEQYGSVSENNGQDGNN

SEQ ID NO: 17343 - protein, 32 aa, Artificial Sequence
  Description of Artificial Sequence: Synthetic polypeptide
DEEEIATTNPVATEQYGSVSTNLQGPGQDNQR

SEQ ID NO: 17344 - protein, 30 aa, Artificial Sequence
  Description of Artificial Sequence: Synthetic polypeptide
DEEEIATTNPVATEQYGSVSTNLQGNSNFS

SEQ ID NO: 17345 - protein, 31 aa, Artificial Sequence
  Description of Artificial Sequence: Synthetic polypeptide
DEEEIRTTNPVATEQYGSVNSTNHQRLVNDT

SEQ ID NO: 17346 - protein, 31 aa, Artificial Sequence
  Description of Artificial Sequence: Synthetic polypeptide
DEHEIRTTNPVATEQYGSVSTTNLQDGSNGL

SEQ ID NO: 17347 - protein, 29 aa, Artificial Sequence
  Description of Artificial Sequence: Synthetic peptide
DEAEIATTNPVATEVYGSVSTNLQHDGNI

SEQ ID NO: 17348 - protein, 31 aa, Artificial Sequence
  Description of Artificial Sequence: Synthetic polypeptide
DEHEIRTTNPVATEQYGSVSTTNGQMDGNER

SEQ ID NO: 17349 - protein, 28 aa, Artificial Sequence
  Description of Artificial Sequence: Synthetic peptide
DEAEIATTNPVATEVYGSVSTNLQGGDV

SEQ ID NO: 17350 - protein, 30 aa, Artificial Sequence
  Description of Artificial Sequence: Synthetic polypeptide
DEEEIRTTNPVATEQYGSVYTNLQGSNNIA

SEQ ID NO: 17351 - protein, 31 aa, Artificial Sequence
  Description of Artificial Sequence: Synthetic polypeptide
DEHEIRTTNPVATEQYGSVSTTNGMQDGNAR

SEQ ID NO: 17352 - protein, 31 aa, Artificial Sequence
  Description of Artificial Sequence: Synthetic polypeptide
DEEEIRTTNPVATEQYGSVSCTNGGQRGSKT

SEQ ID NO: 17353 - protein, 31 aa, Artificial Sequence
  Description of Artificial Sequence: Synthetic polypeptide
DEDEIRTTNPVATEQYGSVSTNLGSEGGENR

SEQ ID NO: 17354 - protein, 30 aa, Artificial Sequence
  Description of Artificial Sequence: Synthetic polypeptide
AEEEIRTTNPVATEQYGSVSENGQQRGEER

SEQ ID NO: 17355 - protein, 30 aa, Artificial Sequence
  Description of Artificial Sequence: Synthetic polypeptide
DEAEIATTNPVATEVYGSVSTNLQRDGNEA

SEQ ID NO: 17356 - protein, 32 aa, Artificial Sequence
  Description of Artificial Sequence: Synthetic polypeptide
DEEEIRTTNPVATEQYGVVCSTNDLQNGGNRL

SEQ ID NO: 17357 - protein, 30 aa, Artificial Sequence
  Description of Artificial Sequence: Synthetic polypeptide
DEEEIATTNPVATEQYGSVSTNLQGQGGEN

SEQ ID NO: 17358 - protein, 28 aa, Artificial Sequence
  Description of Artificial Sequence: Synthetic peptide
YEEGICTTNPVATEQYGSVSCNDQRGNS

SEQ ID NO: 17359 - protein, 29 aa, Artificial Sequence
  Description of Artificial Sequence: Synthetic peptide
AEEEIRTTNPVATEQYGSVSGNNQDGTNN

SEQ ID NO: 17360 - protein, 30 aa, Artificial Sequence
  Description of Artificial Sequence: Synthetic polypeptide
DEDEISTTNPVATEQYGSVATNLQDPGNRM

SEQ ID NO: 17361 - protein, 29 aa, Artificial Sequence
  Description of Artificial Sequence: Synthetic peptide
DEHEIRTTNPVATEQYGSVSVNDQGGNVD

SEQ ID NO: 17362 - protein, 31 aa, Artificial Sequence
  Description of Artificial Sequence: Synthetic polypeptide
DEHEIRTTNPVATEQYGSVSTVMNGQDMGNR

SEQ ID NO: 17363 - protein, 30 aa, Artificial Sequence
  Description of Artificial Sequence: Synthetic polypeptide
DEHEIRTTNPVATEQYGSVSTVMGQNGDNR

SEQ ID NO: 17364 - protein, 31 aa, Artificial Sequence
  Description of Artificial Sequence: Synthetic polypeptide
DEHEIRTTNPVATEQYGSVSTVMGNDQNGNR

SEQ ID NO: 17365 - protein, 28 aa, Artificial Sequence
  Description of Artificial Sequence: Synthetic peptide
DEDEISTTNPVATEQYGSVATNDQDGND

SEQ ID NO: 17366 - protein, 29 aa, Artificial Sequence
  Description of Artificial Sequence: Synthetic peptide
DEEEIASTNPVATEQYGSVSTNLESGNDQ

SEQ ID NO: 17367 - protein, 29 aa, Artificial Sequence
  Description of Artificial Sequence: Synthetic peptide
DEEEIRTTNPVATEQYGSVYTNLQIVPDE

SEQ ID NO: 17368 - protein, 29 aa, Artificial Sequence
  Description of Artificial Sequence: Synthetic peptide
DEDEISTTNPVATEQYGSVAANLQEGNRP

SEQ ID NO: 17369 - protein, 30 aa, Artificial Sequence
  Description of Artificial Sequence: Synthetic polypeptide
DEHEIRTTNPVATEQYGSVSTTQQGGNNQR

SEQ ID NO: 17370 - protein, 28 aa, Artificial Sequence
  Description of Artificial Sequence: Synthetic peptide
SMEEIRCTNPIATEQYGSVSENLMRGNR

SEQ ID NO: 17371 - protein, 29 aa, Artificial Sequence
  Description of Artificial Sequence: Synthetic peptide
DCEEIRSTNPVATEQYGSISTNMQRGVNN

SEQ ID NO: 17372 - protein, 31 aa, Artificial Sequence
  Description of Artificial Sequence: Synthetic polypeptide
DEEEIRTTNPVATEQYGSVSTVNLDGVGNST

SEQ ID NO: 17373 - protein, 31 aa, Artificial Sequence
  Description of Artificial Sequence: Synthetic polypeptide
DEEEIATTNPVATEQYGSVSTNLQGQGMGND

SEQ ID NO: 17374 - protein, 29 aa, Artificial Sequence
  Description of Artificial Sequence: Synthetic peptide
DEAEICTTNPVATETYGSVSTNLQDGNEN

SEQ ID NO: 17375 - protein, 30 aa, Artificial Sequence
  Description of Artificial Sequence: Synthetic polypeptide
DEHEIRTTNPVATEQYGSVSTTQQEGDNDR

SEQ ID NO: 17376 - protein, 31 aa, Artificial Sequence
  Description of Artificial Sequence: Synthetic polypeptide
DCEEIRSTNPVATEQYGSVSTNELQARTGQR

SEQ ID NO: 17377 - protein, 30 aa, Artificial Sequence
  Description of Artificial Sequence: Synthetic polypeptide
DCEEIRSTNPVATEQYGSVSTNHQARNGQR

SEQ ID NO: 17378 - protein, 32 aa, Artificial Sequence
  Description of Artificial Sequence: Synthetic polypeptide
DEEEIRTTNPVATEQYGSVSNTNLQETNEERN

SEQ ID NO: 17379 - protein, 29 aa, Artificial Sequence
  Description of Artificial Sequence: Synthetic peptide
DEAEIATTNPVATQQYGMVSTALQRGGNR

SEQ ID NO: 17380 - protein, 31 aa, Artificial Sequence
  Description of Artificial Sequence: Synthetic polypeptide
DCEEIRSTNPVATEQYGSVSTNLQADNGQNR

SEQ ID NO: 17381 - protein, 30 aa, Artificial Sequence
  Description of Artificial Sequence: Synthetic polypeptide
DEEEIRTTNPVATEQYGSVYTNLQITLNDP

SEQ ID NO: 17382 - protein, 30 aa, Artificial Sequence
  Description of Artificial Sequence: Synthetic polypeptide
DEHEIRTTNPVATEQYGSVSWNLARSNSNR

SEQ ID NO: 17383 - protein, 31 aa, Artificial Sequence
  Description of Artificial Sequence: Synthetic polypeptide
DEHEIRTTNPVATEQYGSVSTNLQQGMGDGR

SEQ ID NO: 17384 - protein, 30 aa, Artificial Sequence
  Description of Artificial Sequence: Synthetic polypeptide
AEEEIRTTNPVATEQYGSVSNTNLNLGGNM

SEQ ID NO: 17385 - protein, 32 aa, Artificial Sequence
  Description of Artificial Sequence: Synthetic polypeptide
DEEEIRTTNPVATEQYGSVSNTNLQGNSGNQP

SEQ ID NO: 17386 - protein, 30 aa, Artificial Sequence
  Description of Artificial Sequence: Synthetic polypeptide
DEEEIRTTNPVATEQYGSVYTTDQRDNERG

SEQ ID NO: 17387 - protein, 30 aa, Artificial Sequence
  Description of Artificial Sequence: Synthetic polypeptide
DEEEIRTTNPVATEGYGSVITANDQPGGNR

SEQ ID NO: 17388 - protein, 30 aa, Artificial Sequence
  Description of Artificial Sequence: Synthetic polypeptide
DEEEIATTNPVATEQYGVVSTNLQGDGNHE

SEQ ID NO: 17389 - protein, 30 aa, Artificial Sequence
  Description of Artificial Sequence: Synthetic polypeptide
DEEEIRTTNPVATEQYGSVSTTQEDGNSRQ

SEQ ID NO: 17390 - protein, 30 aa, Artificial Sequence
  Description of Artificial Sequence: Synthetic polypeptide
DEMEIRTTNPVATEQYGCVSTELFQNGSNR

SEQ ID NO: 17391 - protein, 31 aa, Artificial Sequence
  Description of Artificial Sequence: Synthetic polypeptide
DEEEIRTTNPVATEGYGSVSTSTLQRMGNNA

SEQ ID NO: 17392 - protein, 31 aa, Artificial Sequence
  Description of Artificial Sequence: Synthetic polypeptide
DEEEIRTTNPVATEQYGTVSTNLQGTAGNET

SEQ ID NO: 17393 - protein, 31 aa, Artificial Sequence
  Description of Artificial Sequence: Synthetic polypeptide
DEEEIRTTNPVATEQYGSVSTTQLLQNNQNR

SEQ ID NO: 17394 - protein, 30 aa, Artificial Sequence
  Description of Artificial Sequence: Synthetic polypeptide
DEEEIATTNPVATEQYGVVSTNLQDHGNAS

SEQ ID NO: 17395 - protein, 28 aa, Artificial Sequence
  Description of Artificial Sequence: Synthetic peptide
DEMEIRTTNPVATEQYGCVSTEDQRPND

SEQ ID NO: 17396 - protein, 31 aa, Artificial Sequence
  Description of Artificial Sequence: Synthetic polypeptide
DEEEIRTTNPVATEQYGTVSTNLQGDGFNET

SEQ ID NO: 17397 - protein, 29 aa, Artificial Sequence
  Description of Artificial Sequence: Synthetic peptide
DEMEIRTTNPVATEQYGCVSSNLQRSGEN

SEQ ID NO: 17398 - protein, 31 aa, Artificial Sequence
  Description of Artificial Sequence: Synthetic polypeptide
DEEEIRTTNPVATEQYGSVCSTNDLNRNGQE

SEQ ID NO: 17399 - protein, 30 aa, Artificial Sequence
  Description of Artificial Sequence: Synthetic polypeptide
AEEEIRTTNPVATEQYGSVSSTENQQEGNS

SEQ ID NO: 17400 - protein, 30 aa, Artificial Sequence
  Description of Artificial Sequence: Synthetic polypeptide
DEEEIRTTNPVATEQYGTVSTNLQNGGDDS

SEQ ID NO: 17401 - protein, 31 aa, Artificial Sequence
  Description of Artificial Sequence: Synthetic polypeptide
AEEEIRTTNPVATEQYGSVSSTENNQEGNNR

SEQ ID NO: 17402 - protein, 31 aa, Artificial Sequence
  Description of Artificial Sequence: Synthetic polypeptide
DEEEIRTTNPVATEQYGSVSSNLNQGGSERS

SEQ ID NO: 17403 - protein, 28 aa, Artificial Sequence
  Description of Artificial Sequence: Synthetic peptide
DEEEIATTNPVATEQYGVVSENLQFGDH

SEQ ID NO: 17404 - protein, 29 aa, Artificial Sequence
  Description of Artificial Sequence: Synthetic peptide
DEEEIATTNPVATEQYGVVSATNLQHGEQ

SEQ ID NO: 17405 - protein, 28 aa, Artificial Sequence
  Description of Artificial Sequence: Synthetic peptide
DEMEIRTTNPVATEQYGCTSTNLQSGDS

SEQ ID NO: 17406 - protein, 32 aa, Artificial Sequence
  Description of Artificial Sequence: Synthetic polypeptide
DEEEIRTTNPVATEQYGSVSLTSNLQRGVDVF

SEQ ID NO: 17407 - protein, 30 aa, Artificial Sequence
  Description of Artificial Sequence: Synthetic polypeptide
DEEEIRTTNPVATEQYGSVSSNLIIRDNED

SEQ ID NO: 17408 - protein, 31 aa, Artificial Sequence
  Description of Artificial Sequence: Synthetic polypeptide
DEEEIRTTNPVATEQYGSVSCTYLDQARNNE

SEQ ID NO: 17409 - protein, 33 aa, Artificial Sequence
  Description of Artificial Sequence: Synthetic polypeptide
DEEEIRTTNPVATEQYGSVSCTTLSQRGGNPRA

SEQ ID NO: 17410 - protein, 30 aa, Artificial Sequence
  Description of Artificial Sequence: Synthetic polypeptide
DEEEIATTNPVATEQYGVVSTNLQMDGNAQ

SEQ ID NO: 17411 - protein, 30 aa, Artificial Sequence
  Description of Artificial Sequence: Synthetic polypeptide
DEEEIATTNPVATEQYGVVSTNLQVGDNDQ

SEQ ID NO: 17412 - protein, 31 aa, Artificial Sequence
  Description of Artificial Sequence: Synthetic polypeptide
DEEEIRTTNPVATEQYGSVCSTNDIQQMMNR

SEQ ID NO: 17413 - protein, 32 aa, Artificial Sequence
  Description of Artificial Sequence: Synthetic polypeptide
DEEEIRTTNPVATEQYGSVSNTNLQIEGGNGE

SEQ ID NO: 17414 - protein, 31 aa, Artificial Sequence
  Description of Artificial Sequence: Synthetic polypeptide
DEEEIRTTNPVATEQYGSVSDDLQQRSVNER

SEQ ID NO: 17415 - protein, 31 aa, Artificial Sequence
  Description of Artificial Sequence: Synthetic polypeptide
DEEEIATTNPVATERYGSVVSTNLSQRGNNS

SEQ ID NO: 17416 - protein, 30 aa, Artificial Sequence
  Description of Artificial Sequence: Synthetic polypeptide
DEEEIRTTNPVATEQYGSVSSNLQEGIIDG

SEQ ID NO: 17417 - protein, 31 aa, Artificial Sequence
  Description of Artificial Sequence: Synthetic polypeptide
DEEEIRTTNPVATEQYGTVSTNLQAGGNTDD

SEQ ID NO: 17418 - protein, 29 aa, Artificial Sequence
  Description of Artificial Sequence: Synthetic peptide
DAEEIATTNPVATAQYGSVSTNPDRGNMR

SEQ ID NO: 17419 - protein, 30 aa, Artificial Sequence
  Description of Artificial Sequence: Synthetic polypeptide
DEEEIATTNPVATERYGSVATNLQSGGNNR

SEQ ID NO: 17420 - protein, 31 aa, Artificial Sequence
  Description of Artificial Sequence: Synthetic polypeptide
DEEEIRTTNPVATEGYGSVSTNLVGQGGGNQ

SEQ ID NO: 17421 - protein, 30 aa, Artificial Sequence
  Description of Artificial Sequence: Synthetic polypeptide
DEEEIATTNPVATERYGSVATNLQDGQNQR

SEQ ID NO: 17422 - protein, 34 aa, Artificial Sequence
  Description of Artificial Sequence: Synthetic polypeptide
DEEEIRTTNPVATEQYGSVSTTPNMLQRGDNVRI

SEQ ID NO: 17423 - protein, 29 aa, Artificial Sequence
  Description of Artificial Sequence: Synthetic peptide
DAEEIATTNPVATEPYGSVATNLQQGNDR

SEQ ID NO: 17424 - protein, 31 aa, Artificial Sequence
  Description of Artificial Sequence: Synthetic polypeptide
DEEEIATTNPVATERYGSTVSTNELSQRGNP

SEQ ID NO: 17425 - protein, 31 aa, Artificial Sequence
  Description of Artificial Sequence: Synthetic polypeptide
DEEEIRTTNPVATEQYGSVCSTNDLERNNDP

SEQ ID NO: 17426 - protein, 31 aa, Artificial Sequence
  Description of Artificial Sequence: Synthetic polypeptide
DEEEIRTTNPVATEQYGSVSTTPLQRGVVVD

SEQ ID NO: 17427 - protein, 31 aa, Artificial Sequence
  Description of Artificial Sequence: Synthetic polypeptide
AEEEIRTTNPVATEQYGSVSSTNANQDGGNR

SEQ ID NO: 17428 - protein, 31 aa, Artificial Sequence
  Description of Artificial Sequence: Synthetic polypeptide
DEEEIRTTNPVATEQYGTVSTNLQEAFGNQS

SEQ ID NO: 17429 - protein, 31 aa, Artificial Sequence
  Description of Artificial Sequence: Synthetic polypeptide
DEEEIRTTNPVATEQYGSVCSTNDLNRFENV

SEQ ID NO: 17430 - protein, 31 aa, Artificial Sequence
  Description of Artificial Sequence: Synthetic polypeptide
DEEEIRTTNPVATEGYGSVSTPNLQIGENGE

SEQ ID NO: 17431 - protein, 31 aa, Artificial Sequence
  Description of Artificial Sequence: Synthetic polypeptide
DEEEIRTTNPVATEGYGSVSTQNLQAGENDG

SEQ ID NO: 17432 - protein, 31 aa, Artificial Sequence
  Description of Artificial Sequence: Synthetic polypeptide
AEEEIRTTNPVATEQYGSVSSTNAEQRGENI

SEQ ID NO: 17433 - protein, 31 aa, Artificial Sequence
  Description of Artificial Sequence: Synthetic polypeptide
DEEEIRTTNPVATEQYGSVSDANLERDENRD

SEQ ID NO: 17434 - protein, 31 aa, Artificial Sequence
  Description of Artificial Sequence: Synthetic polypeptide
AEEEIRTTNPVATEQYGSVSSTNANQQGENR

SEQ ID NO: 17435 - protein, 31 aa, Artificial Sequence
  Description of Artificial Sequence: Synthetic polypeptide
DEEEIRTTNPVATEQYGSVCSTNDLQNGSFD

SEQ ID NO: 17436 - protein, 31 aa, Artificial Sequence
  Description of Artificial Sequence: Synthetic polypeptide
DEEEIRTTNPVATEQYGSVSCTQLQRIGDQE

SEQ ID NO: 17437 - protein, 30 aa, Artificial Sequence
  Description of Artificial Sequence: Synthetic polypeptide
YELEISTTNPVATEQYGSSVSTNSLQAGNR

SEQ ID NO: 17438 - protein, 32 aa, Artificial Sequence
  Description of Artificial Sequence: Synthetic polypeptide
DEEEIRTTNPVATEQYGSVSCTNTSGRTVGNR

SEQ ID NO: 17439 - protein, 29 aa, Artificial Sequence
  Description of Artificial Sequence: Synthetic peptide
AEEEIRTTNPVATEQYGSVSSNNQQGNQN

SEQ ID NO: 17440 - protein, 30 aa, Artificial Sequence
  Description of Artificial Sequence: Synthetic polypeptide
DEEEIRTTNPVATEQYGSVCSTNDQNGSDI

SEQ ID NO: 17441 - protein, 29 aa, Artificial Sequence
  Description of Artificial Sequence: Synthetic peptide
DEMEIRTTNPVATCQYGSVNTELQRGNDM

SEQ ID NO: 17442 - protein, 28 aa, Artificial Sequence
  Description of Artificial Sequence: Synthetic peptide
DEMEIRTTNPVATCQYGSVNTALQRGDD

SEQ ID NO: 17443 - protein, 28 aa, Artificial Sequence
  Description of Artificial Sequence: Synthetic peptide
DEEEIRTTNPVATEAYGQYSTNEQRENF

SEQ ID NO: 17444 - protein, 28 aa, Artificial Sequence
  Description of Artificial Sequence: Synthetic peptide
DEMEIRTTNPVATCQYGQVSTNLEEGNP

SEQ ID NO: 17445 - protein, 30 aa, Artificial Sequence
  Description of Artificial Sequence: Synthetic polypeptide
DEEEIRTTNPVATEQYGSVSSNGNVRGNEL

SEQ ID NO: 17446 - protein, 29 aa, Artificial Sequence
  Description of Artificial Sequence: Synthetic peptide
DEMEIRTTNPVATCQYGCVSTNLERGMNE

SEQ ID NO: 17447 - protein, 31 aa, Artificial Sequence
  Description of Artificial Sequence: Synthetic polypeptide
DEEEIRTTNPVATEQYGSVCSTNDQRFNNQA

SEQ ID NO: 17448 - protein, 32 aa, Artificial Sequence
  Description of Artificial Sequence: Synthetic polypeptide
DEEEIRTTNPVATEQYGTVSTNMLPMRTGNNR

SEQ ID NO: 17449 - protein, 30 aa, Artificial Sequence
  Description of Artificial Sequence: Synthetic polypeptide
YEHEIRTTNPVATEQYGSAVSAPNLQRGNT

SEQ ID NO: 17450 - protein, 29 aa, Artificial Sequence
  Description of Artificial Sequence: Synthetic peptide
DEEEIACTNPVATEQYGSVATNLQQGNLE

SEQ ID NO: 17451 - protein, 31 aa, Artificial Sequence
  Description of Artificial Sequence: Synthetic polypeptide
DEEEIRTTNPVATEQYGSVSCTNNGQRGEAF

SEQ ID NO: 17452 - protein, 31 aa, Artificial Sequence
  Description of Artificial Sequence: Synthetic polypeptide
DEEEIRTTNPVATEQYGSVSCTNNGQRGAFM

SEQ ID NO: 17453 - protein, 32 aa, Artificial Sequence
  Description of Artificial Sequence: Synthetic polypeptide
DEEEIRTTNPVATEQYGSVSCTNMLTPGGNNR

SEQ ID NO: 17454 - protein, 28 aa, Artificial Sequence
  Description of Artificial Sequence: Synthetic peptide
YEGEITTTNPVATEQYGSVSTNLKRVER

SEQ ID NO: 17455 - protein, 30 aa, Artificial Sequence
  Description of Artificial Sequence: Synthetic polypeptide
YEGEISTTNPVATEQYGSVNNETNLQRGNR

SEQ ID NO: 17456 - protein, 32 aa, Artificial Sequence
  Description of Artificial Sequence: Synthetic polypeptide
DEEEIRTTNPVATEQYGSVCSTNGIQFCGSNR

SEQ ID NO: 17457 - protein, 32 aa, Artificial Sequence
  Description of Artificial Sequence: Synthetic polypeptide
DEEEIRTTNPVATEQYGSVNSTTLQRGEAQRE

SEQ ID NO: 17458 - protein, 31 aa, Artificial Sequence
  Description of Artificial Sequence: Synthetic polypeptide
DEEEIRTTNPVATEQYGSVCSTNGLQNGDQP

SEQ ID NO: 17459 - protein, 32 aa, Artificial Sequence
  Description of Artificial Sequence: Synthetic polypeptide
DEEEIRTTNPVATEQYGSVCSTNGLQVGQDRD

SEQ ID NO: 17460 - protein, 31 aa, Artificial Sequence
  Description of Artificial Sequence: Synthetic polypeptide
DEEEIRTTNPVATEQYGTVSTNQSQRTVTNR

SEQ ID NO: 17461 - protein, 29 aa, Artificial Sequence
  Description of Artificial Sequence: Synthetic peptide
DEMEIRTTNPVATDQYGCVSTNLERGNFD

SEQ ID NO: 17462 - protein, 28 aa, Artificial Sequence
  Description of Artificial Sequence: Synthetic peptide
DEMEIRTTNPVATDQYGCVSTNLERINT

SEQ ID NO: 17463 - protein, 30 aa, Artificial Sequence
  Description of Artificial Sequence: Synthetic polypeptide
DEEEIRTTNPVATEQYGSVCSTNDQHGDQP

SEQ ID NO: 17464 - protein, 31 aa, Artificial Sequence
  Description of Artificial Sequence: Synthetic polypeptide
DEDEIRTTNPVATEQYGSVSANDQRGPNTRD

SEQ ID NO: 17465 - protein, 32 aa, Artificial Sequence
  Description of Artificial Sequence: Synthetic polypeptide
DEEEIRTTNPVATEQYGSVCSTNDLTRNGNVG

SEQ ID NO: 17466 - protein, 31 aa, Artificial Sequence
  Description of Artificial Sequence: Synthetic polypeptide
DEEEIRTTNPVATEQYGCVCSTGELFQGGNR

SEQ ID NO: 17467 - protein, 30 aa, Artificial Sequence
  Description of Artificial Sequence: Synthetic polypeptide
DEMEIRTTNPVATEQYGCISTNTQRFGDNR

SEQ ID NO: 17468 - protein, 31 aa, Artificial Sequence
  Description of Artificial Sequence: Synthetic polypeptide
DEEEIRTTNPVATEQYGSVSTTTLEGGNEER

SEQ ID NO: 17469 - protein, 29 aa, Artificial Sequence
  Description of Artificial Sequence: Synthetic peptide
DEEEIATTNPVATEQYGTVSTNNQGDGNA

SEQ ID NO: 17470 - protein, 29 aa, Artificial Sequence
  Description of Artificial Sequence: Synthetic peptide
DEEEIRTTNPVATEQYGSVSTTTLEGIER

SEQ ID NO: 17471 - protein, 29 aa, Artificial Sequence
  Description of Artificial Sequence: Synthetic peptide
DEDEIRTTNPVATEQYGSVSANLQNNGPE

SEQ ID NO: 17472 - protein, 32 aa, Artificial Sequence
  Description of Artificial Sequence: Synthetic polypeptide
DEEEIRTTNPVATEQYGSVSNTNLQIAGNGED

SEQ ID NO: 17473 - protein, 31 aa, Artificial Sequence
  Description of Artificial Sequence: Synthetic polypeptide
DEEEIRTTNPVATEQYGTVSTNLQTSGNEEF

SEQ ID NO: 17474 - protein, 31 aa, Artificial Sequence
  Description of Artificial Sequence: Synthetic polypeptide
DEEEIRTTNPVATEQYGTVSTNLQVGGGNDG

SEQ ID NO: 17475 - protein, 29 aa, Artificial Sequence
  Description of Artificial Sequence: Synthetic peptide
DEEEIATTNPVATEQYGTVSTNLQGGEHD

SEQ ID NO: 17476 - protein, 29 aa, Artificial Sequence
  Description of Artificial Sequence: Synthetic peptide
DEEEIRTTNPVATEQYGSVSSNLEGNQEQ

SEQ ID NO: 17477 - protein, 28 aa, Artificial Sequence
  Description of Artificial Sequence: Synthetic peptide
DEMEIRTTNPVATDQYGVVSTNAERGNP

SEQ ID NO: 17478 - protein, 28 aa, Artificial Sequence
  Description of Artificial Sequence: Synthetic peptide
DEMEIRTTNPVATDQYGSVNTVLQIGND

SEQ ID NO: 17479 - protein, 32 aa, Artificial Sequence
  Description of Artificial Sequence: Synthetic polypeptide
DEEEIRTTNPVATEQYGSVSLTVNVLDQRGEN

SEQ ID NO: 17480 - protein, 28 aa, Artificial Sequence
  Description of Artificial Sequence: Synthetic peptide
DEMEIRTTNPVATDQYGSVNTELQRGDQ

SEQ ID NO: 17481 - protein, 31 aa, Artificial Sequence
  Description of Artificial Sequence: Synthetic polypeptide
DEEEIATTNPVATEQYGTVSATNLNRGMNER

SEQ ID NO: 17482 - protein, 29 aa, Artificial Sequence
  Description of Artificial Sequence: Synthetic peptide
AEEEIRTTNPVATEQYGSVSSQNDVVGNR

SEQ ID NO: 17483 - protein, 32 aa, Artificial Sequence
  Description of Artificial Sequence: Synthetic polypeptide
DEEEIRTTNPVATEAYGQSVSTNELSQSGNNR

SEQ ID NO: 17484 - protein, 32 aa, Artificial Sequence
  Description of Artificial Sequence: Synthetic polypeptide
AEEEIRTTNPVATEQYGSVSSNTNTLQRGNSA

SEQ ID NO: 17485 - protein, 32 aa, Artificial Sequence
  Description of Artificial Sequence: Synthetic polypeptide
DEEEIRTTNPVATEAYGQSVVSTNALSQRGNM

SEQ ID NO: 17486 - protein, 31 aa, Artificial Sequence
  Description of Artificial Sequence: Synthetic polypeptide
DEEEIRTTNPVATEQYGSVCSTNDQHFGNFF

SEQ ID NO: 17487 - protein, 31 aa, Artificial Sequence
  Description of Artificial Sequence: Synthetic polypeptide
DEMEIRTTNPVATEQYGCVSTVLQRGNDQRQ

SEQ ID NO: 17488 - protein, 32 aa, Artificial Sequence
  Description of Artificial Sequence: Synthetic polypeptide
DEEEIRTTNPVATEQYGSVCSTNDIQKTGNER

SEQ ID NO: 17489 - protein, 33 aa, Artificial Sequence
  Description of Artificial Sequence: Synthetic polypeptide
DEEEIRTTNPVATEQYGSVSLTQNGLQRGVLTR

SEQ ID NO: 17490 - protein, 31 aa, Artificial Sequence
  Description of Artificial Sequence: Synthetic polypeptide
DEEEIRTTNPVATEQYGSVSDDNLDDRGERD

SEQ ID NO: 17491 - protein, 29 aa, Artificial Sequence
  Description of Artificial Sequence: Synthetic peptide
DEMEIRTTNPVATEQYGSVNSTNDQEGDE

SEQ ID NO: 17492 - protein, 29 aa, Artificial Sequence
  Description of Artificial Sequence: Synthetic peptide
DEEEIACTNPVATEQYGSVATNLQSGDRH

SEQ ID NO: 17493 - protein, 30 aa, Artificial Sequence
  Description of Artificial Sequence: Synthetic polypeptide
DEEEIATTNPVATESYGSVSTNLQPPGGNQ

SEQ ID NO: 17494 - protein, 30 aa, Artificial Sequence
  Description of Artificial Sequence: Synthetic polypeptide
AEEEIRTTNPVATEQYGSVSSTNLNMGNQA

SEQ ID NO: 17495 - protein, 30 aa, Artificial Sequence
  Description of Artificial Sequence: Synthetic polypeptide
AEEEIRTTNPVATEQYGSVSSTNLLQQNND

SEQ ID NO: 17496 - protein, 31 aa, Artificial Sequence
  Description of Artificial Sequence: Synthetic polypeptide
AEEEIRTTNPVATEQYGSVSSTNLLQNGNIG

SEQ ID NO: 17497 - protein, 30 aa, Artificial Sequence
  Description of Artificial Sequence: Synthetic polypeptide
DEMEIRTTNPVATEQYGSVCSTNPQNGSNI

SEQ ID NO: 17498 - protein, 31 aa, Artificial Sequence
  Description of Artificial Sequence: Synthetic polypeptide
DEEEIRTTNPVATEQYGTVSSTNLNQGGNDN

SEQ ID NO: 17499 - protein, 31 aa, Artificial Sequence
  Description of Artificial Sequence: Synthetic polypeptide
AEEEIRTTNPVATEQYGSVSSTNLLQNGNEG

SEQ ID NO: 17500 - protein, 30 aa, Artificial Sequence
  Description of Artificial Sequence: Synthetic polypeptide
DEEEIATTNPVATESYGSVSTNLQMDGNEQ

SEQ ID NO: 17501 - protein, 31 aa, Artificial Sequence
  Description of Artificial Sequence: Synthetic polypeptide
DEEEIRTTNPVATEQYGTVSSTINNLQRENN

SEQ ID NO: 17502 - protein, 31 aa, Artificial Sequence
  Description of Artificial Sequence: Synthetic polypeptide
DEMEIRTTNPVATEQYGSVCSTNDLERNGNE

SEQ ID NO: 17503 - protein, 30 aa, Artificial Sequence
  Description of Artificial Sequence: Synthetic polypeptide
AEEEIRTTNPVATEQYGSVSSTNLIAGNSI

SEQ ID NO: 17504 - protein, 31 aa, Artificial Sequence
  Description of Artificial Sequence: Synthetic polypeptide
DEEEIRTTNPVATEQYGSVSSNLQRGLQEIE

SEQ ID NO: 17505 - protein, 31 aa, Artificial Sequence
  Description of Artificial Sequence: Synthetic polypeptide
DEEEIRTTNPVATEQYGSVSDNLQRFGSDQY

SEQ ID NO: 17506 - protein, 30 aa, Artificial Sequence
  Description of Artificial Sequence: Synthetic polypeptide
DEEEIATTNPVATESYGSVSTNLQHDGDNQ

SEQ ID NO: 17507 - protein, 32 aa, Artificial Sequence
  Description of Artificial Sequence: Synthetic polypeptide
YENEIRTTNPVATEQYGSVLSTGNLQQRGNRE

SEQ ID NO: 17508 - protein, 30 aa, Artificial Sequence
  Description of Artificial Sequence: Synthetic polypeptide
DEEEIATTNPVATESYGSVSTNLQGTGNQG

SEQ ID NO: 17509 - protein, 32 aa, Artificial Sequence
  Description of Artificial Sequence: Synthetic polypeptide
DEEEIRTTNPVATEQYGSVSTTNNLQITGNGD

SEQ ID NO: 17510 - protein, 30 aa, Artificial Sequence
  Description of Artificial Sequence: Synthetic polypeptide
DEMEIRTTNPVATEQYGSVCSEGLMREGNR

SEQ ID NO: 17511 - protein, 32 aa, Artificial Sequence
  Description of Artificial Sequence: Synthetic polypeptide
DEEEIRTTNPVATEQYGSVSTTNNLQNGNEEE

SEQ ID NO: 17512 - protein, 30 aa, Artificial Sequence
  Description of Artificial Sequence: Synthetic polypeptide
DEEEIATTNPVATESYGSVSTNLQGMGNDQ

SEQ ID NO: 17513 - protein, 31 aa, Artificial Sequence
  Description of Artificial Sequence: Synthetic polypeptide
AEEEIRTTNPVATEQYGSVSSTNLLNQQGNY

SEQ ID NO: 17514 - protein, 31 aa, Artificial Sequence
  Description of Artificial Sequence: Synthetic polypeptide
YENEIRTTNPVATEQYGSVSETNLQNRPGTR

SEQ ID NO: 17515 - protein, 29 aa, Artificial Sequence
  Description of Artificial Sequence: Synthetic peptide
DEMEIRTTNPVATEQYGSVNSTNEQMGEM

SEQ ID NO: 17516 - protein, 31 aa, Artificial Sequence
  Description of Artificial Sequence: Synthetic polypeptide
DEEEIATTNPVATESYGSVSTNLQRGDGNQS

SEQ ID NO: 17517 - protein, 31 aa, Artificial Sequence
  Description of Artificial Sequence: Synthetic polypeptide
AEEEIRTTNPVATEQYGSVSSTNLNQGGNQD

SEQ ID NO: 17518 - protein, 31 aa, Artificial Sequence
  Description of Artificial Sequence: Synthetic polypeptide
AEEEIRTTNPVATEQYGSVSSTNLNQGGNNQ

SEQ ID NO: 17519 - protein, 30 aa, Artificial Sequence
  Description of Artificial Sequence: Synthetic polypeptide
DEEEIRTTNPVATEQYGSVNTDLDQGRDER

SEQ ID NO: 17520 - protein, 33 aa, Artificial Sequence
  Description of Artificial Sequence: Synthetic polypeptide
DEEEIRTTNPVATEQYGSVCSTNALQYFGSNTR

SEQ ID NO: 17521 - protein, 29 aa, Artificial Sequence
  Description of Artificial Sequence: Synthetic peptide
DEMEIRTTNPVATEQYGSVSENLQNSGEN

SEQ ID NO: 17522 - protein, 33 aa, Artificial Sequence
  Description of Artificial Sequence: Synthetic polypeptide
DEEEIRTTNPVATEQYGSVCSTNALQYSGSNRG

SEQ ID NO: 17523 - protein, 30 aa, Artificial Sequence
  Description of Artificial Sequence: Synthetic polypeptide
DEAEIRTTNPVATEQYGTVSTNLQGDHGNQ

SEQ ID NO: 17524 - protein, 31 aa, Artificial Sequence
  Description of Artificial Sequence: Synthetic polypeptide
DEAEIRTTNPVATEQYGTVSCTNLSQRVGNA

SEQ ID NO: 17525 - protein, 31 aa, Artificial Sequence
  Description of Artificial Sequence: Synthetic polypeptide
DEEEIRTTNPVATEQYGSVSSNLQRSGSDTQ

SEQ ID NO: 17526 - protein, 30 aa, Artificial Sequence
  Description of Artificial Sequence: Synthetic polypeptide
DEEEIRTTNPVATEQYGSVYTTNLEAGNFD

SEQ ID NO: 17527 - protein, 30 aa, Artificial Sequence
  Description of Artificial Sequence: Synthetic polypeptide
DEMEIRTTNPVATEQYGSVSDNNQRVENRD

SEQ ID NO: 17528 - protein, 29 aa, Artificial Sequence
  Description of Artificial Sequence: Synthetic peptide
DEEEIRTTNPVATEQYGSVNSYNDQRSEG

SEQ ID NO: 17529 - protein, 31 aa, Artificial Sequence
  Description of Artificial Sequence: Synthetic polypeptide
DEEEIRTTNPVATEQYGSVYTTNGQQEDGNR

SEQ ID NO: 17530 - protein, 31 aa, Artificial Sequence
  Description of Artificial Sequence: Synthetic polypeptide
AEEEIRTTNPVATEQYGSVSSTNLNQGEGNM

SEQ ID NO: 17531 - protein, 31 aa, Artificial Sequence
  Description of Artificial Sequence: Synthetic polypeptide
DEEEIRTTNPVATEQYGSVPSANHSQNGGNR

SEQ ID NO: 17532 - protein, 31 aa, Artificial Sequence
  Description of Artificial Sequence: Synthetic polypeptide
AEEEIRTTNPVATEQYGSVSSTNLNQEGGNY

SEQ ID NO: 17533 - protein, 29 aa, Artificial Sequence
  Description of Artificial Sequence: Synthetic peptide
DEEEIRTTNPVATEAYGKHSTNQQRVGNF

SEQ ID NO: 17534 - protein, 30 aa, Artificial Sequence
  Description of Artificial Sequence: Synthetic polypeptide
DEEEIATTNPVATESYGSVSTNLQVGMGNA

SEQ ID NO: 17535 - protein, 32 aa, Artificial Sequence
  Description of Artificial Sequence: Synthetic polypeptide
DEEEIRTTNPVATEQYGSVNSTYNNQREGNEV

SEQ ID NO: 17536 - protein, 30 aa, Artificial Sequence
  Description of Artificial Sequence: Synthetic polypeptide
DEEEIATTNPVATESYGSVSTNLQVGGNEA

SEQ ID NO: 17537 - protein, 28 aa, Artificial Sequence
  Description of Artificial Sequence: Synthetic peptide
DEEEIRTTNPVATEAYGKISTNEQRVNV

SEQ ID NO: 17538 - protein, 30 aa, Artificial Sequence
  Description of Artificial Sequence: Synthetic polypeptide
DEEEIRTTNPVATEQYGSVSTTNMQSMGVE

SEQ ID NO: 17539 - protein, 30 aa, Artificial Sequence
  Description of Artificial Sequence: Synthetic polypeptide
DEEEIATTNPVATESYGSVSTNLQVDGNQD

SEQ ID NO: 17540 - protein, 32 aa, Artificial Sequence
  Description of Artificial Sequence: Synthetic polypeptide
DEEEIRTTNPVATEQYGSVSTTNNLQTDGNND

SEQ ID NO: 17541 - protein, 31 aa, Artificial Sequence
  Description of Artificial Sequence: Synthetic polypeptide
DEEEIRTTNPVATEQYGSVSTTVLQGGTNND

SEQ ID NO: 17542 - protein, 30 aa, Artificial Sequence
  Description of Artificial Sequence: Synthetic polypeptide
DEEEIRTTNPVATEQYGSVYTTNGGQRGVF

SEQ ID NO: 17543 - protein, 30 aa, Artificial Sequence
  Description of Artificial Sequence: Synthetic polypeptide
AEEEIRTTNPVATEQYGSVSSTNLGDEGNG

SEQ ID NO: 17544 - protein, 30 aa, Artificial Sequence
  Description of Artificial Sequence: Synthetic polypeptide
DEEEIRTTNPVATEGYGSVSTNLQFNSNAY

SEQ ID NO: 17545 - protein, 30 aa, Artificial Sequence
  Description of Artificial Sequence: Synthetic polypeptide
AEEEIRTTNPVATEQYGSVSSTNIQIGNNM

SEQ ID NO: 17546 - protein, 31 aa, Artificial Sequence
  Description of Artificial Sequence: Synthetic polypeptide
DEEEIRTTNPVATEQYGTVSTNDLQEPGNSG

SEQ ID NO: 17547 - protein, 29 aa, Artificial Sequence
  Description of Artificial Sequence: Synthetic peptide
DEEEIRTTNPVATEQYGSVSSNLQGDELQ

SEQ ID NO: 17548 - protein, 28 aa, Artificial Sequence
  Description of Artificial Sequence: Synthetic peptide
DEEEIRTTNPVATEAYGKYSTNEQRTNF

SEQ ID NO: 17549 - protein, 30 aa, Artificial Sequence
  Description of Artificial Sequence: Synthetic polypeptide
AEEEIRTTNPVATEQYGSVSSTNEQSGDNL

SEQ ID NO: 17550 - protein, 30 aa, Artificial Sequence
  Description of Artificial Sequence: Synthetic polypeptide
AEEEIRTTNPVATEQYGSVSSTNEQQGQNY

SEQ ID NO: 17551 - protein, 31 aa, Artificial Sequence
  Description of Artificial Sequence: Synthetic polypeptide
DEEEIRTTNPVATEQYGTVSTNEQRFGSNVA

SEQ ID NO: 17552 - protein, 31 aa, Artificial Sequence
  Description of Artificial Sequence: Synthetic polypeptide
DEEEIRTTNPVATEQYGSVSTTNWLERGQID

SEQ ID NO: 17553 - protein, 31 aa, Artificial Sequence
  Description of Artificial Sequence: Synthetic polypeptide
DEEEIRTTNPVATEQYGSVSTTNYERGNQED

SEQ ID NO: 17554 - protein, 32 aa, Artificial Sequence
  Description of Artificial Sequence: Synthetic polypeptide
DEEEIRTTNPVATEAYGKVSCTENLSQRGNNR

SEQ ID NO: 17555 - protein, 29 aa, Artificial Sequence
  Description of Artificial Sequence: Synthetic peptide
DEEEIRTTNPVATEQYGTVSTNGQNGTGE

SEQ ID NO: 17556 - protein, 32 aa, Artificial Sequence
  Description of Artificial Sequence: Synthetic polypeptide
DEEEIRTTNPVATEQYGSVCSTNDIQDNGNSR

SEQ ID NO: 17557 - protein, 30 aa, Artificial Sequence
  Description of Artificial Sequence: Synthetic polypeptide
DEMEIRTTNPVATEQYGSCSANLHRGNEDR

SEQ ID NO: 17558 - protein, 30 aa, Artificial Sequence
  Description of Artificial Sequence: Synthetic polypeptide
AEEEIRTTNPVATEQYGSVSSTNDQSGQNE

SEQ ID NO: 17559 - protein, 31 aa, Artificial Sequence
  Description of Artificial Sequence: Synthetic polypeptide
DEEEIRTTNPVATEQYGTVSTNHQNFGSNVR

SEQ ID NO: 17560 - protein, 30 aa, Artificial Sequence
  Description of Artificial Sequence: Synthetic polypeptide
DEEEIRTTNPVATEQYGSVSSNLQFMSNDA

SEQ ID NO: 17561 - protein, 30 aa, Artificial Sequence
  Description of Artificial Sequence: Synthetic polypeptide
DEEEIRTTNPVATEQYGTVSTNHQRNSERT

SEQ ID NO: 17562 - protein, 31 aa, Artificial Sequence
  Description of Artificial Sequence: Synthetic polypeptide
DEEEIRTTNPVATEQYGSVSDDPLIQRGNEM

SEQ ID NO: 17563 - protein, 30 aa, Artificial Sequence
  Description of Artificial Sequence: Synthetic polypeptide
DEEEIATTNPVATESWGSVSTNLQHDGNQR

SEQ ID NO: 17564 - protein, 30 aa, Artificial Sequence
  Description of Artificial Sequence: Synthetic polypeptide
DEEEIRTTNPVATEQYGSVSDDNLDDRSSR

SEQ ID NO: 17565 - protein, 30 aa, Artificial Sequence
  Description of Artificial Sequence: Synthetic polypeptide
DEMEIRTTNPVATEQYGCVSTYLQNGSNRM

SEQ ID NO: 17566 - protein, 30 aa, Artificial Sequence
  Description of Artificial Sequence: Synthetic polypeptide
AEEEIRTTNPVATEQYGSVSSTNEQEGNIN

SEQ ID NO: 17567 - protein, 31 aa, Artificial Sequence
  Description of Artificial Sequence: Synthetic polypeptide
DEEEIRTTNPVATEQYGTVSTLNLDQTFGNQ

SEQ ID NO: 17568 - protein, 30 aa, Artificial Sequence
  Description of Artificial Sequence: Synthetic polypeptide
DEEEIACTNPVATEQYGSVATNLQREGGRQ

SEQ ID NO: 17569 - protein, 31 aa, Artificial Sequence
  Description of Artificial Sequence: Synthetic polypeptide
DEEEIRTTNPVATEQYGSVSTTNQIQTGGNL

SEQ ID NO: 17570 - protein, 30 aa, Artificial Sequence
  Description of Artificial Sequence: Synthetic polypeptide
DEEEIATTNPVATESYGSVSTNLQGDAGNQ

SEQ ID NO: 17571 - protein, 31 aa, Artificial Sequence
  Description of Artificial Sequence: Synthetic polypeptide
DEEEIRTTNPVATEQYGTVSSTNLQSGGNDN

SEQ ID NO: 17572 - protein, 31 aa, Artificial Sequence
  Description of Artificial Sequence: Synthetic polypeptide
DEEEIRTTNPVATEQYGTVSSTNLQTNGNDN

SEQ ID NO: 17573 - protein, 31 aa, Artificial Sequence
  Description of Artificial Sequence: Synthetic polypeptide
DEEEIRTTNPVATEQYGSVYTTNDLQNFGNI

SEQ ID NO: 17574 - protein, 30 aa, Artificial Sequence
  Description of Artificial Sequence: Synthetic polypeptide
DAAEIRTTNPVATEQYGSVSTNPLQLMGMR

SEQ ID NO: 17575 - protein, 30 aa, Artificial Sequence
  Description of Artificial Sequence: Synthetic polypeptide
DEEEIATTNPVATESYGSVSTNLQEGGNAQ

SEQ ID NO: 17576 - protein, 31 aa, Artificial Sequence
  Description of Artificial Sequence: Synthetic polypeptide
DEEEIRTTNPVATEQYGSVNSTVLQRTGEQF

SEQ ID NO: 17577 - protein, 29 aa, Artificial Sequence
  Description of Artificial Sequence: Synthetic peptide
YENEIRTTNPVATEMYGSVSTNEQRGNGG

SEQ ID NO: 17578 - protein, 30 aa, Artificial Sequence
  Description of Artificial Sequence: Synthetic polypeptide
DADEIRTTNPVATEQYGSVSTDNNLQHGMR

SEQ ID NO: 17579 - protein, 31 aa, Artificial Sequence
  Description of Artificial Sequence: Synthetic polypeptide
DEEEIRTTNPVATEQYGTVSTENLQCGGNQQ

SEQ ID NO: 17580 - protein, 30 aa, Artificial Sequence
  Description of Artificial Sequence: Synthetic polypeptide
DEEEIATTNPVATESYGSVSTNLQAGGMNQ

SEQ ID NO: 17581 - protein, 29 aa, Artificial Sequence
  Description of Artificial Sequence: Synthetic peptide
DEMEIRTTNPVATEQYGSRSTNDQGEGLR

SEQ ID NO: 17582 - protein, 32 aa, Artificial Sequence
  Description of Artificial Sequence: Synthetic polypeptide
DEEEIRTTNPVATEQYGSVSTTNNQRGENELN

SEQ ID NO: 17583 - protein, 32 aa, Artificial Sequence
  Description of Artificial Sequence: Synthetic polypeptide
DEEEIRTTNPVATEQYGTVSTENLQFGSNNRE

SEQ ID NO: 17584 - protein, 30 aa, Artificial Sequence
  Description of Artificial Sequence: Synthetic polypeptide
DEEEIACTNPVATEQYGSVATNLQRNNDRH

SEQ ID NO: 17585 - protein, 31 aa, Artificial Sequence
  Description of Artificial Sequence: Synthetic polypeptide
DEEEIRTTNPVATEQYGTVSTGNLQGGNNSN

SEQ ID NO: 17586 - protein, 30 aa, Artificial Sequence
  Description of Artificial Sequence: Synthetic polypeptide
DEMEIRTTNPVATEQYGSISTNTQRFGDRG

SEQ ID NO: 17587 - protein, 30 aa, Artificial Sequence
  Description of Artificial Sequence: Synthetic polypeptide
DEMEIRTTNPVATEQYGSISTNTQREGSGR

SEQ ID NO: 17588 - protein, 29 aa, Artificial Sequence
  Description of Artificial Sequence: Synthetic peptide
DEAEICTTNPVATEQYGSVSTDLNDGENR

SEQ ID NO: 17589 - protein, 30 aa, Artificial Sequence
  Description of Artificial Sequence: Synthetic polypeptide
DEEEIRTTNPVATEQYGSVSTTNPLQVEDI

SEQ ID NO: 17590 - protein, 31 aa, Artificial Sequence
  Description of Artificial Sequence: Synthetic polypeptide
DEEEIRTTNPVATEGYGSVSTNLQEFGNGQG

SEQ ID NO: 17591 - protein, 31 aa, Artificial Sequence
  Description of Artificial Sequence: Synthetic polypeptide
AEEEIRTTNPVATEQYGSVSSTNLEQGGNTE

SEQ ID NO: 17592 - protein, 30 aa, Artificial Sequence
  Description of Artificial Sequence: Synthetic polypeptide
DEEEIATTNPVATESYGSVSTNLDQHGGNQ

SEQ ID NO: 17593 - protein, 31 aa, Artificial Sequence
  Description of Artificial Sequence: Synthetic polypeptide
DEEEIRTTNPVATEQYGSVSTTNNNQNGNTQ

SEQ ID NO: 17594 - protein, 31 aa, Artificial Sequence
  Description of Artificial Sequence: Synthetic polypeptide
AEEEIRTTNPVATEQYGSVSNTNLNNGVGNR

SEQ ID NO: 17595 - protein, 29 aa, Artificial Sequence
  Description of Artificial Sequence: Synthetic peptide
AEEEIRTTNPVATEQYGSVSSNLQNGDGE

SEQ ID NO: 17596 - protein, 31 aa, Artificial Sequence
  Description of Artificial Sequence: Synthetic polypeptide
DEEEIRTTNPVATEQYGTVSTSNLQRGTEFG

SEQ ID NO: 17597 - protein, 31 aa, Artificial Sequence
  Description of Artificial Sequence: Synthetic polypeptide
DEEEIRTTNPVATEQYGSVNSTNPQRSGDDG

SEQ ID NO: 17598 - protein, 29 aa, Artificial Sequence
  Description of Artificial Sequence: Synthetic peptide
DEEEIRTTNPVATEQYGSVSTVDNDMGNF

SEQ ID NO: 17599 - protein, 28 aa, Artificial Sequence
  Description of Artificial Sequence: Synthetic peptide
SEYEIRATNPVATEQYGSVETNLQVGNE

SEQ ID NO: 17600 - protein, 29 aa, Artificial Sequence
  Description of Artificial Sequence: Synthetic peptide
DEHEIRTTNPVAYEQYGSVSQNLNRVMNR

SEQ ID NO: 17601 - protein, 28 aa, Artificial Sequence
  Description of Artificial Sequence: Synthetic peptide
SEYEIRATNPVATEQYGSVITNLQHGNT

SEQ ID NO: 17602 - protein, 30 aa, Artificial Sequence
  Description of Artificial Sequence: Synthetic polypeptide
DEEEIRTTNPVATEQYGSVCSTNHQGQNFA

SEQ ID NO: 17603 - protein, 32 aa, Artificial Sequence
  Description of Artificial Sequence: Synthetic polypeptide
DEAEIRTTNPVATEQYGSVVSTDNLGERGNER

SEQ ID NO: 17604 - protein, 30 aa, Artificial Sequence
  Description of Artificial Sequence: Synthetic polypeptide
DEEEIRTTNPVATEQYGSVSTVDQGGIDRA

SEQ ID NO: 17605 - protein, 31 aa, Artificial Sequence
  Description of Artificial Sequence: Synthetic polypeptide
AEEEIRTTNPVATEQYGSVSNTNLQQGNGNQ

SEQ ID NO: 17606 - protein, 31 aa, Artificial Sequence
  Description of Artificial Sequence: Synthetic polypeptide
AEEEIRTTNPVATEQYGSVSNTNLQQGNEQA

SEQ ID NO: 17607 - protein, 29 aa, Artificial Sequence
  Description of Artificial Sequence: Synthetic peptide
DEHEIRTTNPVAYEQYGSVSTNDQPGNED

SEQ ID NO: 17608 - protein, 32 aa, Artificial Sequence
  Description of Artificial Sequence: Synthetic polypeptide
DEEEIRTTNPVATEQYGSVNSTNPQRGGDNDQ

SEQ ID NO: 17609 - protein, 29 aa, Artificial Sequence
  Description of Artificial Sequence: Synthetic peptide
DEHEIRTTNPVAYEQYGNVSTNLQNGNAS

SEQ ID NO: 17610 - protein, 32 aa, Artificial Sequence
  Description of Artificial Sequence: Synthetic polypeptide
DEEEIRTTNPVATEQYGSVNSTNNQRSGNDQN

SEQ ID NO: 17611 - protein, 31 aa, Artificial Sequence
  Description of Artificial Sequence: Synthetic polypeptide
DEEEIRTTNPVATEQYGSVNSTNNLESGEQR

SEQ ID NO: 17612 - protein, 31 aa, Artificial Sequence
  Description of Artificial Sequence: Synthetic polypeptide
AEEEIRTTNPVATEQYGSVSNTNLQQGENNE

SEQ ID NO: 17613 - protein, 30 aa, Artificial Sequence
  Description of Artificial Sequence: Synthetic polypeptide
DEEEIRTTNPVATEQYGSVCSTNHQNGDQP

SEQ ID NO: 17614 - protein, 32 aa, Artificial Sequence
  Description of Artificial Sequence: Synthetic polypeptide
DEEEIRTTNPVATEQYGSVCSTNHQNGSNPRL

SEQ ID NO: 17615 - protein, 31 aa, Artificial Sequence
  Description of Artificial Sequence: Synthetic polypeptide
DEEEIRTTNPVATEQYGTVVSTNLQHDGNAQ

SEQ ID NO: 17616 - protein, 32 aa, Artificial Sequence
  Description of Artificial Sequence: Synthetic polypeptide
DEEEIRTTNPVATEQYGTVVSTNLQHFGSNRY

SEQ ID NO: 17617 - protein, 31 aa, Artificial Sequence
  Description of Artificial Sequence: Synthetic polypeptide
AEEEIRTTNPVATEQYGSVSNTNLQQGENAD

SEQ ID NO: 17618 - protein, 32 aa, Artificial Sequence
  Description of Artificial Sequence: Synthetic polypeptide
DEEEIRTTNPVATEQYGSVSSLPNMLQRDNNR

SEQ ID NO: 17619 - protein, 31 aa, Artificial Sequence
  Description of Artificial Sequence: Synthetic polypeptide
DEEEIRTTNPVATEQYGSVCSTNHQHSGNFP

SEQ ID NO: 17620 - protein, 31 aa, Artificial Sequence
  Description of Artificial Sequence: Synthetic polypeptide
AEEEIRTTNPVATEQYGSVSNTNLQQGANLQ

SEQ ID NO: 17621 - protein, 30 aa, Artificial Sequence
  Description of Artificial Sequence: Synthetic polypeptide
DEEEIRTTNPVATEQYGSVSTVDLQQSTDR

SEQ ID NO: 17622 - protein, 30 aa, Artificial Sequence
  Description of Artificial Sequence: Synthetic polypeptide
DEHEIRTTNPVAYEQYGSVSTNLQGNMGDR

SEQ ID NO: 17623 - protein, 30 aa, Artificial Sequence
  Description of Artificial Sequence: Synthetic polypeptide
AEEEIRTTNPVATEQYGSVSNTNLQVGTEE

SEQ ID NO: 17624 - protein, 31 aa, Artificial Sequence
  Description of Artificial Sequence: Synthetic polypeptide
DEEEIRTTNPVATEQYGSVCSTNHQGIGNQA

SEQ ID NO: 17625 - protein, 31 aa, Artificial Sequence
  Description of Artificial Sequence: Synthetic polypeptide
AEEEIRTTNPVATEQYGSVSNTNLQVGNQTE

SEQ ID NO: 17626 - protein, 31 aa, Artificial Sequence
  Description of Artificial Sequence: Synthetic polypeptide
AEEEIRTTNPVATEQYGSVSNTNLQTGGNVN

SEQ ID NO: 17627 - protein, 28 aa, Artificial Sequence
  Description of Artificial Sequence: Synthetic peptide
YEETICTTNPVATEQYGSVSMNDQRGNG

SEQ ID NO: 17628 - protein, 31 aa, Artificial Sequence
  Description of Artificial Sequence: Synthetic polypeptide
AEEEIRTTNPVATEQYGSVSNTNLQSGENGA

SEQ ID NO: 17629 - protein, 30 aa, Artificial Sequence
  Description of Artificial Sequence: Synthetic polypeptide
DEEEIRTTNPVATEQYGSVYTNLYDSGNVE

SEQ ID NO: 17630 - protein, 31 aa, Artificial Sequence
  Description of Artificial Sequence: Synthetic polypeptide
AEEEIRTTNPVATEQYGSVSNTNLQQSGINV

SEQ ID NO: 17631 - protein, 30 aa, Artificial Sequence
  Description of Artificial Sequence: Synthetic polypeptide
DEHEIRTTNPVAYERYGSVSTNLQDGDNER

SEQ ID NO: 17632 - protein, 31 aa, Artificial Sequence
  Description of Artificial Sequence: Synthetic polypeptide
DEAEIRTTNPVATEQYGSVVSTNLQSGGNSE

SEQ ID NO: 17633 - protein, 30 aa, Artificial Sequence
  Description of Artificial Sequence: Synthetic polypeptide
DEHEIRTTNPVAYEQYGSVSTNLQESGDAR

SEQ ID NO: 17634 - protein, 32 aa, Artificial Sequence
  Description of Artificial Sequence: Synthetic polypeptide
DEEEIRTTNPVATEAYGSTVSTGNLSGRGDNR

SEQ ID NO: 17635 - protein, 30 aa, Artificial Sequence
  Description of Artificial Sequence: Synthetic polypeptide
DEEEIRTTNPVATEQYGSVSSNADQRVNQM

SEQ ID NO: 17636 - protein, 31 aa, Artificial Sequence
  Description of Artificial Sequence: Synthetic polypeptide
DEAEIRTTNPVATEQYGSVVSTNLQGGENAE

SEQ ID NO: 17637 - protein, 28 aa, Artificial Sequence
  Description of Artificial Sequence: Synthetic peptide
YEETICTTNPVATEQYGSVSLNFQRGNS

SEQ ID NO: 17638 - protein, 31 aa, Artificial Sequence
  Description of Artificial Sequence: Synthetic polypeptide
DEEEIATTNPVATEQYGSVSTVNGQENGNAR

SEQ ID NO: 17639 - protein, 31 aa, Artificial Sequence
  Description of Artificial Sequence: Synthetic polypeptide
DEEEIATTNPVATEQYGSVSTVNGDQMGNSR

SEQ ID NO: 17640 - protein, 31 aa, Artificial Sequence
  Description of Artificial Sequence: Synthetic polypeptide
DEAEICTTNPVATEQYGSVSTNLQFDEGNNR

SEQ ID NO: 17641 - protein, 31 aa, Artificial Sequence
  Description of Artificial Sequence: Synthetic polypeptide
DEEEIRTTNPVATEGYGSVCSTGNLQNGNAV

SEQ ID NO: 17642 - protein, 30 aa, Artificial Sequence
  Description of Artificial Sequence: Synthetic polypeptide
DEEEIATTNPVATEQYGSVSTVLEGGDNDR

SEQ ID NO: 17643 - protein, 30 aa, Artificial Sequence
  Description of Artificial Sequence: Synthetic polypeptide
DEAEIRTTNPVATEQYGSVVSTNLEGGNTE

SEQ ID NO: 17644 - protein, 32 aa, Artificial Sequence
  Description of Artificial Sequence: Synthetic polypeptide
DEAEIRTTNPVATEQYGSVVSTNLDDRDGENR

SEQ ID NO: 17645 - protein, 31 aa, Artificial Sequence
  Description of Artificial Sequence: Synthetic polypeptide
AEEEIRTTNPVATEQYGSVSNTNLQQQIGNV

SEQ ID NO: 17646 - protein, 30 aa, Artificial Sequence
  Description of Artificial Sequence: Synthetic polypeptide
DEEEIACTNPVATEQYGSVATNLQIDGNPR

SEQ ID NO: 17647 - protein, 30 aa, Artificial Sequence
  Description of Artificial Sequence: Synthetic polypeptide
DEEEIRTTNPVATEQYGSVSTVFLQRNEAN

SEQ ID NO: 17648 - protein, 31 aa, Artificial Sequence
  Description of Artificial Sequence: Synthetic polypeptide
DEEEIRTTNPVATEQYGTVWSTINNLQRINN

SEQ ID NO: 17649 - protein, 31 aa, Artificial Sequence
  Description of Artificial Sequence: Synthetic polypeptide
AEEEIRTTNPVATEQYGSVSNTNLQNIGNIN

SEQ ID NO: 17650 - protein, 30 aa, Artificial Sequence
  Description of Artificial Sequence: Synthetic polypeptide
AEEEIRTTNPVATEQYGSVSNTNLQNGQGE

SEQ ID NO: 17651 - protein, 29 aa, Artificial Sequence
  Description of Artificial Sequence: Synthetic peptide
DEEEIATTNPVATEQYGSVSTTDLGDGNI

SEQ ID NO: 17652 - protein, 31 aa, Artificial Sequence
  Description of Artificial Sequence: Synthetic polypeptide
AEEEIRTTNPVATEQYGSVSNTNLQNDGGNL

SEQ ID NO: 17653 - protein, 30 aa, Artificial Sequence
  Description of Artificial Sequence: Synthetic polypeptide
YEESISTTNPVATEQYGQSVSTNLQRGNGD

SEQ ID NO: 17654 - protein, 31 aa, Artificial Sequence
  Description of Artificial Sequence: Synthetic polypeptide
AEEEIRTTNPVATEQYGSVSNTNLQINGNES

SEQ ID NO: 17655 - protein, 31 aa, Artificial Sequence
  Description of Artificial Sequence: Synthetic polypeptide
AEEEIRTTNPVATEQYGSVSNTNLQIGSNEE

SEQ ID NO: 17656 - protein, 29 aa, Artificial Sequence
  Description of Artificial Sequence: Synthetic peptide
YEESIRTVNPVATEQYGSVSTNLEQRNNT

SEQ ID NO: 17657 - protein, 30 aa, Artificial Sequence
  Description of Artificial Sequence: Synthetic polypeptide
DEEEIRTTNPVATEQYGTWSTINQLQRENQ

SEQ ID NO: 17658 - protein, 31 aa, Artificial Sequence
  Description of Artificial Sequence: Synthetic polypeptide
DEEEIATTNPVATEQYGSVSTSNGQDNGNSR

SEQ ID NO: 17659 - protein, 31 aa, Artificial Sequence
  Description of Artificial Sequence: Synthetic polypeptide
DEEEIRTTNPVATEQYGSVCSTNHQSSGNFS

SEQ ID NO: 17660 - protein, 31 aa, Artificial Sequence
  Description of Artificial Sequence: Synthetic polypeptide
AEEEIRTTNPVATEQYGSVSNTNLQIGGNNE

SEQ ID NO: 17661 - protein, 31 aa, Artificial Sequence
  Description of Artificial Sequence: Synthetic polypeptide
AEEEIRTTNPVATEQYGSVSNTNLQGNGQNS

SEQ ID NO: 17662 - protein, 30 aa, Artificial Sequence
  Description of Artificial Sequence: Synthetic polypeptide
DEEEIATTNPVATEQYGSVSTSLGQGNNDR

SEQ ID NO: 17663 - protein, 29 aa, Artificial Sequence
  Description of Artificial Sequence: Synthetic peptide
DAEEIRATNPVATEQYGSVATNLQEAGNE

SEQ ID NO: 17664 - protein, 30 aa, Artificial Sequence
  Description of Artificial Sequence: Synthetic polypeptide
DAEEIRATNPVATEQYGSVSTNDQARGGQR

SEQ ID NO: 17665 - protein, 31 aa, Artificial Sequence
  Description of Artificial Sequence: Synthetic polypeptide
DAEEIRATNPVATEQYGSVSTNLQAGNGQNR

SEQ ID NO: 17666 - protein, 30 aa, Artificial Sequence
  Description of Artificial Sequence: Synthetic polypeptide
DEEEIRTTNPVATEQYGTWSTYNQLQRENN

SEQ ID NO: 17667 - protein, 29 aa, Artificial Sequence
  Description of Artificial Sequence: Synthetic peptide
DAEEIRATNPVATEQYGSVVATNLQDGGR

SEQ ID NO: 17668 - protein, 30 aa, Artificial Sequence
  Description of Artificial Sequence: Synthetic polypeptide
DAEEIRATNPVATEQYGSVVSTNLPQNGDR

SEQ ID NO: 17669 - protein, 29 aa, Artificial Sequence
  Description of Artificial Sequence: Synthetic peptide
DAEEIRATNPVATEQYGSVVSTNLQNGTH

SEQ ID NO: 17670 - protein, 31 aa, Artificial Sequence
  Description of Artificial Sequence: Synthetic polypeptide
AEEEIRTTNPVATEQYGSVSNTNLNQGGNMN

SEQ ID NO: 17671 - protein, 31 aa, Artificial Sequence
  Description of Artificial Sequence: Synthetic polypeptide
DEDEIRTTNPVATEQYGSVSTDDGQRPGNNR

SEQ ID NO: 17672 - protein, 29 aa, Artificial Sequence
  Description of Artificial Sequence: Synthetic peptide
DAEEIRATNPVATEQYGEVSTNLQNGNQV

SEQ ID NO: 17673 - protein, 31 aa, Artificial Sequence
  Description of Artificial Sequence: Synthetic polypeptide
DAEEIRATNPVATEQWGSVSTNLQARPGNQR

SEQ ID NO: 17674 - protein, 29 aa, Artificial Sequence
  Description of Artificial Sequence: Synthetic peptide
DAEEIRATNPVATEQWGSVASTNLQNGDR

SEQ ID NO: 17675 - protein, 31 aa, Artificial Sequence
  Description of Artificial Sequence: Synthetic polypeptide
DEAEICTTNPVATEQYGSVSTNLQRGENNEQ

SEQ ID NO: 17676 - protein, 32 aa, Artificial Sequence
  Description of Artificial Sequence: Synthetic polypeptide
DEEEIRTTNPVATEQYGSVNSTNMLQRSNEND

SEQ ID NO: 17677 - protein, 30 aa, Artificial Sequence
  Description of Artificial Sequence: Synthetic polypeptide
DEAEICTTNPVATEQYGSVSTNLQRVNTED

SEQ ID NO: 17678 - protein, 31 aa, Artificial Sequence
  Description of Artificial Sequence: Synthetic polypeptide
DEEEIRTTNPVATEGYGSVCSTALQRGSNAA

SEQ ID NO: 17679 - protein, 30 aa, Artificial Sequence
  Description of Artificial Sequence: Synthetic polypeptide
DEEEIRTTNPVATEGYGSWSPPNDLQRDNR

SEQ ID NO: 17680 - protein, 30 aa, Artificial Sequence
  Description of Artificial Sequence: Synthetic polypeptide
DEEEIRTTNPVATEQYGTWSTGNDLQRENQ

SEQ ID NO: 17681 - protein, 30 aa, Artificial Sequence
  Description of Artificial Sequence: Synthetic polypeptide
DEEEIRTTNPVATEQYGSVCSTNHQNNNIM

SEQ ID NO: 17682 - protein, 30 aa, Artificial Sequence
  Description of Artificial Sequence: Synthetic polypeptide
DEEEIRTTNPVATEQYGTWSTGNPLQRENA

SEQ ID NO: 17683 - protein, 30 aa, Artificial Sequence
  Description of Artificial Sequence: Synthetic polypeptide
DEEEIRTTNPVATEQYGTWSTINGLQRENQ

SEQ ID NO: 17684 - protein, 33 aa, Artificial Sequence
  Description of Artificial Sequence: Synthetic polypeptide
DEEEIRTTNPVATEQYGSVPSCTNELSQEGNTR

SEQ ID NO: 17685 - protein, 31 aa, Artificial Sequence
  Description of Artificial Sequence: Synthetic polypeptide
DEEEIATTNPVATEQYGSVSTTNLQDGSNPQ

SEQ ID NO: 17686 - protein, 30 aa, Artificial Sequence
  Description of Artificial Sequence: Synthetic polypeptide
DEEEIRTTNPVATEQYGTWSTINNLQRSNN

SEQ ID NO: 17687 - protein, 31 aa, Artificial Sequence
  Description of Artificial Sequence: Synthetic polypeptide
DEEEIATTNPVATEQYGSVSTTNLGDGGLNR

SEQ ID NO: 17688 - protein, 31 aa, Artificial Sequence
  Description of Artificial Sequence: Synthetic polypeptide
DEEEIRTTNPVATEQYGSVPSCTNGSQRGSS

SEQ ID NO: 17689 - protein, 32 aa, Artificial Sequence
  Description of Artificial Sequence: Synthetic polypeptide
DEAEIRTTNPVATEQYGSVVPSTNLSTRGTNR

SEQ ID NO: 17690 - protein, 30 aa, Artificial Sequence
  Description of Artificial Sequence: Synthetic polypeptide
DEEEIRTTNPVATEGYGSVCITNLTRGGDR

SEQ ID NO: 17691 - protein, 30 aa, Artificial Sequence
  Description of Artificial Sequence: Synthetic polypeptide
DEEEIRTTNPVATEQYGSVNSTNLQTSEQQ

SEQ ID NO: 17692 - protein, 31 aa, Artificial Sequence
  Description of Artificial Sequence: Synthetic polypeptide
DEEEIATTNPVATEQYGSVSTTNGGQNGNSR

SEQ ID NO: 17693 - protein, 30 aa, Artificial Sequence
  Description of Artificial Sequence: Synthetic polypeptide
DAEEICSTNPVATEQYGSVSTNLQARPGQR

SEQ ID NO: 17694 - protein, 31 aa, Artificial Sequence
  Description of Artificial Sequence: Synthetic polypeptide
AEEEIRTTNPVATEQYGSVSNTNLQNVGNDT

SEQ ID NO: 17695 - protein, 31 aa, Artificial Sequence
  Description of Artificial Sequence: Synthetic polypeptide
DEEEIRTTNPVATEQYGSVSTVGDQRGGNDM

SEQ ID NO: 17696 - protein, 31 aa, Artificial Sequence
  Description of Artificial Sequence: Synthetic polypeptide
AEEEIRTTNPVATEQYGSVSNTNLQNNNANR

SEQ ID NO: 17697 - protein, 31 aa, Artificial Sequence
  Description of Artificial Sequence: Synthetic polypeptide
AEEEIRTTNPVATEQYGSVSNTNLQNNGVNQ

SEQ ID NO: 17698 - protein, 32 aa, Artificial Sequence
  Description of Artificial Sequence: Synthetic polypeptide
DEEEIRTTNPVATEQYGSVSNTNLQGSGFNTE

SEQ ID NO: 17699 - protein, 30 aa, Artificial Sequence
  Description of Artificial Sequence: Synthetic polypeptide
AEEEIRTTNPVATEQYGSVSNTNLTTGNNG

SEQ ID NO: 17700 - protein, 30 aa, Artificial Sequence
  Description of Artificial Sequence: Synthetic polypeptide
DEHEISTTNPVATEQYGSVSTNLQHDGGNT

SEQ ID NO: 17701 - protein, 30 aa, Artificial Sequence
  Description of Artificial Sequence: Synthetic polypeptide
DEEEIRTTNPVATEQYGSVYTNMQSVQGNQ

SEQ ID NO: 17702 - protein, 32 aa, Artificial Sequence
  Description of Artificial Sequence: Synthetic polypeptide
DEEEIRTTNPVATEQYGTVSVSTNLLQYGNEG

SEQ ID NO: 17703 - protein, 30 aa, Artificial Sequence
  Description of Artificial Sequence: Synthetic polypeptide
DEEEIRTTNPVATEQYGTVSVTNLNMGQNP

SEQ ID NO: 17704 - protein, 32 aa, Artificial Sequence
  Description of Artificial Sequence: Synthetic polypeptide
DEEEIRTTNPVATEQYGSVSCTNLSTRGGNLS

SEQ ID NO: 17705 - protein, 29 aa, Artificial Sequence
  Description of Artificial Sequence: Synthetic peptide
DEMEIATTNPVATCQYGCVSTALQRGNRI

SEQ ID NO: 17706 - protein, 32 aa, Artificial Sequence
  Description of Artificial Sequence: Synthetic polypeptide
DEEEIATTNPVATEQYGSVVSTNLQRGGDDER

SEQ ID NO: 17707 - protein, 30 aa, Artificial Sequence
  Description of Artificial Sequence: Synthetic polypeptide
DEEEIRTTNPVATEAYGSTSLPNMLQRVNR

SEQ ID NO: 17708 - protein, 30 aa, Artificial Sequence
  Description of Artificial Sequence: Synthetic polypeptide
DEEEIRTTNPVATEQYGSVYTNNLQRNVEN

SEQ ID NO: 17709 - protein, 31 aa, Artificial Sequence
  Description of Artificial Sequence: Synthetic polypeptide
DEDEIRTTNPVATEQYGSVSGTNNQRGNEDS

SEQ ID NO: 17710 - protein, 30 aa, Artificial Sequence
  Description of Artificial Sequence: Synthetic polypeptide
AEEEIRTTNPVATEQYGSVSPTNLQNGDTE

SEQ ID NO: 17711 - protein, 33 aa, Artificial Sequence
  Description of Artificial Sequence: Synthetic polypeptide
DEEEIRTTNPVATEQYGSVSCTNLSQSTGNNRG

SEQ ID NO: 17712 - protein, 31 aa, Artificial Sequence
  Description of Artificial Sequence: Synthetic polypeptide
DEEEIATTNPVATEQYGSVVSTNLSVGGGNR

SEQ ID NO: 17713 - protein, 29 aa, Artificial Sequence
  Description of Artificial Sequence: Synthetic peptide
DEMAIRTTNPVATEQYGSFSTNLIYGNRE

SEQ ID NO: 17714 - protein, 32 aa, Artificial Sequence
  Description of Artificial Sequence: Synthetic polypeptide
DEEEIRTTNPVATEQYGSVSCTNLSQRTGGKE

SEQ ID NO: 17715 - protein, 28 aa, Artificial Sequence
  Description of Artificial Sequence: Synthetic peptide
DEMAIRTTNPLATEQFGSVSFNLQSGNR

SEQ ID NO: 17716 - protein, 29 aa, Artificial Sequence
  Description of Artificial Sequence: Synthetic peptide
DEEEIRTTNPVATEQYGSVSSNDQRNESQ

SEQ ID NO: 17717 - protein, 30 aa, Artificial Sequence
  Description of Artificial Sequence: Synthetic polypeptide
SETEIRTTNPVATEQYGSVSTNQLQQGNNI

SEQ ID NO: 17718 - protein, 31 aa, Artificial Sequence
  Description of Artificial Sequence: Synthetic polypeptide
DEEEIRTTNPVATEQYGTVSWGNLNRFGSNR

SEQ ID NO: 17719 - protein, 29 aa, Artificial Sequence
  Description of Artificial Sequence: Synthetic peptide
AEEEIRTTNPVATEQYGSVSNVNLVEGNT

SEQ ID NO: 17720 - protein, 33 aa, Artificial Sequence
  Description of Artificial Sequence: Synthetic polypeptide
DEEEIRTTNPVATEQYGSVPSCTNALSQRGNHS

SEQ ID NO: 17721 - protein, 33 aa, Artificial Sequence
  Description of Artificial Sequence: Synthetic polypeptide
DEEEIRTTNPVATEQYGSVPSCTNAQGRTGNNR

SEQ ID NO: 17722 - protein, 32 aa, Artificial Sequence
  Description of Artificial Sequence: Synthetic polypeptide
DEEEIRTTNPVATEQYGSVSCTNLSQRGGSMC

SEQ ID NO: 17723 - protein, 33 aa, Artificial Sequence
  Description of Artificial Sequence: Synthetic polypeptide
DEEEIRTTNPVATEQYGSVPSCTNELPQNTGNR

SEQ ID NO: 17724 - protein, 28 aa, Artificial Sequence
  Description of Artificial Sequence: Synthetic peptide
DEMAIRTTNPVATEQYGSFSTELIGGNR

SEQ ID NO: 17725 - protein, 33 aa, Artificial Sequence
  Description of Artificial Sequence: Synthetic polypeptide
DEEEIATTNPVATEQYGSVVSTNMLSQRPGNNR

SEQ ID NO: 17726 - protein, 29 aa, Artificial Sequence
  Description of Artificial Sequence: Synthetic peptide
DEDEIRTTNPVATEQYGSVSGGLFRNINR

SEQ ID NO: 17727 - protein, 31 aa, Artificial Sequence
  Description of Artificial Sequence: Synthetic polypeptide
DEEEIRTTNPVATEQYGSVCSTNHFQSGNQL

SEQ ID NO: 17728 - protein, 32 aa, Artificial Sequence
  Description of Artificial Sequence: Synthetic polypeptide
DEEEIRTTNPVATEQYGTVSTSNLQRGTNEGQ

SEQ ID NO: 17729 - protein, 33 aa, Artificial Sequence
  Description of Artificial Sequence: Synthetic polypeptide
DEEEIRTTNPVATEQYGSVSCTNMLQHGGNNRH

SEQ ID NO: 17730 - protein, 32 aa, Artificial Sequence
  Description of Artificial Sequence: Synthetic polypeptide
DEEEIRTTNPVATEQYGSVNSTTLQRGEAMRD

SEQ ID NO: 17731 - protein, 32 aa, Artificial Sequence
  Description of Artificial Sequence: Synthetic polypeptide
DEEEIRTTNPVATEQYGSVNSTTDMLQERGNV

SEQ ID NO: 17732 - protein, 32 aa, Artificial Sequence
  Description of Artificial Sequence: Synthetic polypeptide
DEEEIRTTNPVATEQYGSVSNTPNLQRFENVA

SEQ ID NO: 17733 - protein, 29 aa, Artificial Sequence
  Description of Artificial Sequence: Synthetic peptide
AEEEIRTTNPVATEQYGSVSSNLGQVGIQ

SEQ ID NO: 17734 - protein, 29 aa, Artificial Sequence
  Description of Artificial Sequence: Synthetic peptide
YEGEISPTNPVATEQYGSIVSTNLQRGNS

SEQ ID NO: 17735 - protein, 29 aa, Artificial Sequence
  Description of Artificial Sequence: Synthetic peptide
DEEEIRTTNPVATEQYGSVSSNDQRNHQI

SEQ ID NO: 17736 - protein, 32 aa, Artificial Sequence
  Description of Artificial Sequence: Synthetic polypeptide
DEEEIRTTNPVATEQYGSVSNTPNLQTNGNNF

SEQ ID NO: 17737 - protein, 31 aa, Artificial Sequence
  Description of Artificial Sequence: Synthetic polypeptide
DEEEIRTTNPVATEQYGSVYTNVLDRGQDIR

SEQ ID NO: 17738 - protein, 29 aa, Artificial Sequence
  Description of Artificial Sequence: Synthetic peptide
AEEEIRTTNPVATEQYGSVSSNEQAGNQV

SEQ ID NO: 17739 - protein, 30 aa, Artificial Sequence
  Description of Artificial Sequence: Synthetic polypeptide
DEMEIRCTNPVATEQYGSVSTDNPVERGNR

SEQ ID NO: 17740 - protein, 28 aa, Artificial Sequence
  Description of Artificial Sequence: Synthetic peptide
DEEEIRTTNPVATEQYGSVYTNQESENE

SEQ ID NO: 17741 - protein, 31 aa, Artificial Sequence
  Description of Artificial Sequence: Synthetic polypeptide
DEEEIRTTNPVATEQYGTVSTVNLDQGFGNQ

SEQ ID NO: 17742 - protein, 30 aa, Artificial Sequence
  Description of Artificial Sequence: Synthetic polypeptide
DEEEIRTTNPVATEQYGSVSCTNMGQEGEF

SEQ ID NO: 17743 - protein, 30 aa, Artificial Sequence
  Description of Artificial Sequence: Synthetic polypeptide
DEDEIRTTNPVATEQYGSVSFTNDQGGNTD

SEQ ID NO: 17744 - protein, 30 aa, Artificial Sequence
  Description of Artificial Sequence: Synthetic polypeptide
AEEEIRTTNPVATEQYGSVSSGNLNQGGNP

SEQ ID NO: 17745 - protein, 29 aa, Artificial Sequence
  Description of Artificial Sequence: Synthetic peptide
DEMEIRCTNPVATEQYGSVCSEGLMRGNR

SEQ ID NO: 17746 - protein, 31 aa, Artificial Sequence
  Description of Artificial Sequence: Synthetic polypeptide
DEEEIRTTNPVATEQYGSVNSTSLDQQRGEV

SEQ ID NO: 17747 - protein, 31 aa, Artificial Sequence
  Description of Artificial Sequence: Synthetic polypeptide
DEEEIRTTNPVATEQYGTVSTYNLQNMGNGT

SEQ ID NO: 17748 - protein, 30 aa, Artificial Sequence
  Description of Artificial Sequence: Synthetic polypeptide
DEEEIATTNPVATEQYGSVVTGGLQGNGNR

SEQ ID NO: 17749 - protein, 31 aa, Artificial Sequence
  Description of Artificial Sequence: Synthetic polypeptide
DEEEIRTTNPVATEQYGSVYTNNQNRGETER

SEQ ID NO: 17750 - protein, 28 aa, Artificial Sequence
  Description of Artificial Sequence: Synthetic peptide
SETEIRPTNPVATEQYGSVTTNLQHGNQ

SEQ ID NO: 17751 - protein, 32 aa, Artificial Sequence
  Description of Artificial Sequence: Synthetic polypeptide
DEEEIRTTNPVATEAYGSTVCSINMLSQRGNR

SEQ ID NO: 17752 - protein, 30 aa, Artificial Sequence
  Description of Artificial Sequence: Synthetic polypeptide
DEAEICTTNPVATEQYGSVSTGNEQDEGNR

SEQ ID NO: 17753 - protein, 31 aa, Artificial Sequence
  Description of Artificial Sequence: Synthetic polypeptide
DEEEIRTTNPVATEQYGTVSWTNLDNAGMNR

SEQ ID NO: 17754 - protein, 31 aa, Artificial Sequence
  Description of Artificial Sequence: Synthetic polypeptide
DEEEIRTTNPVATEQYGSVSTVADQRGENFS

SEQ ID NO: 17755 - protein, 31 aa, Artificial Sequence
  Description of Artificial Sequence: Synthetic polypeptide
AEEEIRTTNPVATEQYGSVSNTNQLQNGGND

SEQ ID NO: 17756 - protein, 30 aa, Artificial Sequence
  Description of Artificial Sequence: Synthetic polypeptide
DEEEIRTTNPVATEQYGSVYTNNGQNGNNE

SEQ ID NO: 17757 - protein, 31 aa, Artificial Sequence
  Description of Artificial Sequence: Synthetic polypeptide
DEEEIRTTNPVATEQYGTVTSVTNNLQRENN

SEQ ID NO: 17758 - protein, 29 aa, Artificial Sequence
  Description of Artificial Sequence: Synthetic peptide
DEEEIRTTNPVATEQYGSVNSTNTQPNDE

SEQ ID NO: 17759 - protein, 32 aa, Artificial Sequence
  Description of Artificial Sequence: Synthetic polypeptide
DEEEIRTTNPVATEQYGSVSNTNLQGTAGNVF

SEQ ID NO: 17760 - protein, 28 aa, Artificial Sequence
  Description of Artificial Sequence: Synthetic peptide
DEIEICTVNPVATEQYGSVSTNLVEGNF

SEQ ID NO: 17761 - protein, 30 aa, Artificial Sequence
  Description of Artificial Sequence: Synthetic polypeptide
DEEEIRTTNPVATEQYGSVSTVDHDVGENR

SEQ ID NO: 17762 - protein, 31 aa, Artificial Sequence
  Description of Artificial Sequence: Synthetic polypeptide
DEAEIRTTNPVATEQYGSVVTTNLQRIGNFG

SEQ ID NO: 17763 - protein, 31 aa, Artificial Sequence
  Description of Artificial Sequence: Synthetic polypeptide
AEEEIRTTNPVATEQYGSVSNTNNLQSGNIM

SEQ ID NO: 17764 - protein, 30 aa, Artificial Sequence
  Description of Artificial Sequence: Synthetic polypeptide
DEAEIRTTNPVATEQYGSVVTNLQHGNDEE

SEQ ID NO: 17765 - protein, 31 aa, Artificial Sequence
  Description of Artificial Sequence: Synthetic polypeptide
DEEEIRTTNPVATEGYGSVCSTNLQYLSNRS

SEQ ID NO: 17766 - protein, 29 aa, Artificial Sequence
  Description of Artificial Sequence: Synthetic peptide
DEEEIATTNPVATEQYGSVTTNLQHGEQH

SEQ ID NO: 17767 - protein, 28 aa, Artificial Sequence
  Description of Artificial Sequence: Synthetic peptide
SEYEIRATNPVATEQYGSVDTNLQLGNQ

SEQ ID NO: 17768 - protein, 31 aa, Artificial Sequence
  Description of Artificial Sequence: Synthetic polypeptide
DEEEIRTTNPVATEQYGSVCSTNHQERFNDT

SEQ ID NO: 17769 - protein, 32 aa, Artificial Sequence
  Description of Artificial Sequence: Synthetic polypeptide
DEEEIRTTNPVATEGYGSVCSTNLQFFGSDNR

SEQ ID NO: 17770 - protein, 28 aa, Artificial Sequence
  Description of Artificial Sequence: Synthetic peptide
DEIAIQTTNPVATEQYGSASTNLIIGNR

SEQ ID NO: 17771 - protein, 29 aa, Artificial Sequence
  Description of Artificial Sequence: Synthetic peptide
DEAEIRTTNPVATEQYGSVVTNLQDGGEA

SEQ ID NO: 17772 - protein, 31 aa, Artificial Sequence
  Description of Artificial Sequence: Synthetic polypeptide
DEEEIRTTNPVATEQYGSVCSTNHQEYGNFV

SEQ ID NO: 17773 - protein, 33 aa, Artificial Sequence
  Description of Artificial Sequence: Synthetic polypeptide
DEEEIRTTNPVATEQYGSVSCTNLSQNRGGNQQ

SEQ ID NO: 17774 - protein, 30 aa, Artificial Sequence
  Description of Artificial Sequence: Synthetic polypeptide
DEAEIRTTNPVATEQYGSVVTANQQGAGNR

SEQ ID NO: 17775 - protein, 32 aa, Artificial Sequence
  Description of Artificial Sequence: Synthetic polypeptide
DEEEIRTTNPVATEAYGSTVSCTNLSQRGNNA

SEQ ID NO: 17776 - protein, 30 aa, Artificial Sequence
  Description of Artificial Sequence: Synthetic polypeptide
DEEEIRTTNPVATEQYGSVSMAEALQNGER

SEQ ID NO: 17777 - protein, 30 aa, Artificial Sequence
  Description of Artificial Sequence: Synthetic polypeptide
DEEEIATTNPVATEQYGSVTTNHGQEDGNR

SEQ ID NO: 17778 - protein, 31 aa, Artificial Sequence
  Description of Artificial Sequence: Synthetic polypeptide
DEEEIRTTNPVATEQYGSVYTNNLEQRGEEM

SEQ ID NO: 17779 - protein, 30 aa, Artificial Sequence
  Description of Artificial Sequence: Synthetic polypeptide
AEEEIRTTNPVATEQYGSVSNTNQQVGNQA

SEQ ID NO: 17780 - protein, 32 aa, Artificial Sequence
  Description of Artificial Sequence: Synthetic polypeptide
DEEEIRTTNPVATEQYGSVNSTNVQMRYQGDR

SEQ ID NO: 17781 - protein, 30 aa, Artificial Sequence
  Description of Artificial Sequence: Synthetic polypeptide
DEEEIRTTNPVATEQYGSVSTVADQRGETS

SEQ ID NO: 17782 - protein, 30 aa, Artificial Sequence
  Description of Artificial Sequence: Synthetic polypeptide
AEEEIRTTNPVATEQYGSVSNVNEQNGNRG

SEQ ID NO: 17783 - protein, 30 aa, Artificial Sequence
  Description of Artificial Sequence: Synthetic polypeptide
DEDEIRTTNPVATEQYGSVSNNLQFGNMNN

SEQ ID NO: 17784 - protein, 31 aa, Artificial Sequence
  Description of Artificial Sequence: Synthetic polypeptide
DEDEIRTTNPVATEQYGSVSNNLQGAGENER

SEQ ID NO: 17785 - protein, 29 aa, Artificial Sequence
  Description of Artificial Sequence: Synthetic peptide
DELEIATTNPVATWQYGEVSTELQRGNRI

SEQ ID NO: 17786 - protein, 29 aa, Artificial Sequence
  Description of Artificial Sequence: Synthetic peptide
DELAIRTTNPVATEQYGSTSTNLVIGINR

SEQ ID NO: 17787 - protein, 30 aa, Artificial Sequence
  Description of Artificial Sequence: Synthetic polypeptide
DEEEIRTTNPVATEQYGSVSTVDGADMGNR

SEQ ID NO: 17788 - protein, 30 aa, Artificial Sequence
  Description of Artificial Sequence: Synthetic polypeptide
DEEEIATTNPVATEQYGSVVSTDEQMGSNR

SEQ ID NO: 17789 - protein, 29 aa, Artificial Sequence
  Description of Artificial Sequence: Synthetic peptide
DEAEICTTNPVATEQYGSVSTNLGNGMDR

SEQ ID NO: 17790 - protein, 32 aa, Artificial Sequence
  Description of Artificial Sequence: Synthetic polypeptide
DEEEIRTTNPVATEAYGSTVPSTEALSQRGNR

SEQ ID NO: 17791 - protein, 29 aa, Artificial Sequence
  Description of Artificial Sequence: Synthetic peptide
DEAEICTTNPVATEQYGSVSTNLMTGNTM

SEQ ID NO: 17792 - protein, 31 aa, Artificial Sequence
  Description of Artificial Sequence: Synthetic polypeptide
AEEEIRTTNPVATEQYGSVSNTTNLQAGNVS

SEQ ID NO: 17793 - protein, 31 aa, Artificial Sequence
  Description of Artificial Sequence: Synthetic polypeptide
DEEEIRTTNPVATEQYGTVTISTNELQSGNF

SEQ ID NO: 17794 - protein, 31 aa, Artificial Sequence
  Description of Artificial Sequence: Synthetic polypeptide
AEEEIRTTNPVATEQYGSVSNTTNLQAGNDN

SEQ ID NO: 17795 - protein, 28 aa, Artificial Sequence
  Description of Artificial Sequence: Synthetic peptide
YEEYICTTNPVATEQYGSVSVNDQRGNS

SEQ ID NO: 17796 - protein, 32 aa, Artificial Sequence
  Description of Artificial Sequence: Synthetic polypeptide
DEEEIRTTNPVATEQYGSVSCTNLSQPVENNR

SEQ ID NO: 17797 - protein, 32 aa, Artificial Sequence
  Description of Artificial Sequence: Synthetic polypeptide
DEEEIATTNPVATEQYGSVVSCTNLSGRGGNR

SEQ ID NO: 17798 - protein, 28 aa, Artificial Sequence
  Description of Artificial Sequence: Synthetic peptide
DEISIRTTNPLATEQWGSVSENLQSGNR

SEQ ID NO: 17799 - protein, 28 aa, Artificial Sequence
  Description of Artificial Sequence: Synthetic peptide
SEVEIRCTNPIATEQYGSVSENLMRGNR

SEQ ID NO: 17800 - protein, 31 aa, Artificial Sequence
  Description of Artificial Sequence: Synthetic polypeptide
AEEEIRTTNPVATEQYGSVSNTSNLQNQGNN

SEQ ID NO: 17801 - protein, 28 aa, Artificial Sequence
  Description of Artificial Sequence: Synthetic peptide
SEWEIRCTNPIATEQYGSVSENLMRGNR

SEQ ID NO: 17802 - protein, 30 aa, Artificial Sequence
  Description of Artificial Sequence: Synthetic polypeptide
DEIEIRTTNPVATEQYGSVSTPNLQCLGQD

SEQ ID NO: 17803 - protein, 30 aa, Artificial Sequence
  Description of Artificial Sequence: Synthetic polypeptide
AEEEIRTTNPVATEQYGSVSNTNTNLVGNR

SEQ ID NO: 17804 - protein, 29 aa, Artificial Sequence
  Description of Artificial Sequence: Synthetic peptide
DEEEIRTTNPVATEQYGCVCSTETQRNQR

SEQ ID NO: 17805 - protein, 30 aa, Artificial Sequence
  Description of Artificial Sequence: Synthetic polypeptide
AEEEIRTTNPVATEIYGSVSVTNNLQEGNM

SEQ ID NO: 17806 - protein, 29 aa, Artificial Sequence
  Description of Artificial Sequence: Synthetic peptide
AEEEIRTTNPVATEEYGCTSINLQRGNRM

SEQ ID NO: 17807 - protein, 30 aa, Artificial Sequence
  Description of Artificial Sequence: Synthetic polypeptide
DEEEIRTTNPVATEQYGYTISEPELQRGNR

SEQ ID NO: 17808 - protein, 31 aa, Artificial Sequence
  Description of Artificial Sequence: Synthetic polypeptide
DEEEIRTTNPVATEQYGSVSYTNDSQAGGNS

SEQ ID NO: 17809 - protein, 29 aa, Artificial Sequence
  Description of Artificial Sequence: Synthetic peptide
DEAEIRTTNPVATEQYGQCVSTNHQSGNQ

SEQ ID NO: 17810 - protein, 32 aa, Artificial Sequence
  Description of Artificial Sequence: Synthetic polypeptide
DEEEIRTTNPVATEQYGSVSYTNEFSQRVGNE

SEQ ID NO: 17811 - protein, 29 aa, Artificial Sequence
  Description of Artificial Sequence: Synthetic peptide
DEEEIRTTNPVSYEHYGSVSQPNLQRGNL

SEQ ID NO: 17812 - protein, 30 aa, Artificial Sequence
  Description of Artificial Sequence: Synthetic polypeptide
DEEEIRTTNPVATEQYGSVQTYLQESGSND

SEQ ID NO: 17813 - protein, 30 aa, Artificial Sequence
  Description of Artificial Sequence: Synthetic polypeptide
DEEEIRTTNPVATEQYGSVSNNLQFFENNE

SEQ ID NO: 17814 - protein, 30 aa, Artificial Sequence
  Description of Artificial Sequence: Synthetic polypeptide
DEEEIRTTNPVSTETYGSVSVMPNLQRGNL

SEQ ID NO: 17815 - protein, 30 aa, Artificial Sequence
  Description of Artificial Sequence: Synthetic polypeptide
DEEEIRTTNPVATEQYGSVQTWNLQTVLAR

SEQ ID NO: 17816 - protein, 30 aa, Artificial Sequence
  Description of Artificial Sequence: Synthetic polypeptide
DEAEIRTTNPVATECYGSVSTNLQNGDNNP

SEQ ID NO: 17817 - protein, 28 aa, Artificial Sequence
  Description of Artificial Sequence: Synthetic peptide
DEEEIATTNPVATEQYGSVAMNLQDVNQ

SEQ ID NO: 17818 - protein, 32 aa, Artificial Sequence
  Description of Artificial Sequence: Synthetic polypeptide
DEEEIRTTNPVATEQWGSVSCTPNQQRGGNNR

SEQ ID NO: 17819 - protein, 29 aa, Artificial Sequence
  Description of Artificial Sequence: Synthetic peptide
DEEEIATTNPVATEQYGSVAMNLQDGNDH

SEQ ID NO: 17820 - protein, 30 aa, Artificial Sequence
  Description of Artificial Sequence: Synthetic polypeptide
DEEEIRTTNPVATEQYGSVSPTNHDNGERD

SEQ ID NO: 17821 - protein, 28 aa, Artificial Sequence
  Description of Artificial Sequence: Synthetic peptide
DEEEIRTTNPVSTEQYGSVVQNLQGGQT

SEQ ID NO: 17822 - protein, 29 aa, Artificial Sequence
  Description of Artificial Sequence: Synthetic peptide
TEEGIRTTNPVATEQYGSVSTNLDGMMNR

SEQ ID NO: 17823 - protein, 29 aa, Artificial Sequence
  Description of Artificial Sequence: Synthetic peptide
DEAEIRTTNPVATECYGSVSTVLQDGNDM

SEQ ID NO: 17824 - protein, 31 aa, Artificial Sequence
  Description of Artificial Sequence: Synthetic polypeptide
DEEEIRTTNPVATEQYGSVSYTNLDGTENER

SEQ ID NO: 17825 - protein, 31 aa, Artificial Sequence
  Description of Artificial Sequence: Synthetic polypeptide
DEEEIRTTNPVATEQYGSVGPTNLQIGENQT

SEQ ID NO: 17826 - protein, 28 aa, Artificial Sequence
  Description of Artificial Sequence: Synthetic peptide
DEEEIRTTNPVSTEQYGSVVFNLQGGQV

SEQ ID NO: 17827 - protein, 28 aa, Artificial Sequence
  Description of Artificial Sequence: Synthetic peptide
DEEEIRTTNPVSTEQYGSVTYNLQGGFT

SEQ ID NO: 17828 - protein, 30 aa, Artificial Sequence
  Description of Artificial Sequence: Synthetic polypeptide
DEEEIRTTNPVAYEAYGSVSWNLSQQVGNR

SEQ ID NO: 17829 - protein, 28 aa, Artificial Sequence
  Description of Artificial Sequence: Synthetic peptide
DEEEIRTTNPVSTEQYGSVTWNLQGGDT

SEQ ID NO: 17830 - protein, 31 aa, Artificial Sequence
  Description of Artificial Sequence: Synthetic polypeptide
DEEEIRTTNPVATEQYGSVSYTNGGQRGGTF

SEQ ID NO: 17831 - protein, 28 aa, Artificial Sequence
  Description of Artificial Sequence: Synthetic peptide
YEEEIACTNPVATEQYGVVSENLQSGNR

SEQ ID NO: 17832 - protein, 31 aa, Artificial Sequence
  Description of Artificial Sequence: Synthetic polypeptide
DEEEIRTTNPVSYEQYGSVSTNELSQRGGNQ

SEQ ID NO: 17833 - protein, 29 aa, Artificial Sequence
  Description of Artificial Sequence: Synthetic peptide
AEEEIATTNPVATEQYGEVATNLQRGDNQ

SEQ ID NO: 17834 - protein, 29 aa, Artificial Sequence
  Description of Artificial Sequence: Synthetic peptide
DEEEIRTTNPVATEQYGSVQTYMLVNGER

SEQ ID NO: 17835 - protein, 31 aa, Artificial Sequence
  Description of Artificial Sequence: Synthetic polypeptide
DEEEIRTTNPVATEQYGSVSPTNIERNGERM

SEQ ID NO: 17836 - protein, 29 aa, Artificial Sequence
  Description of Artificial Sequence: Synthetic peptide
DEEEIRTTNPVATEQWGSVSENLMNRGDA

SEQ ID NO: 17837 - protein, 31 aa, Artificial Sequence
  Description of Artificial Sequence: Synthetic polypeptide
DEAEIRTTNPVATECYGSVSTNLQGDEGNNR

SEQ ID NO: 17838 - protein, 31 aa, Artificial Sequence
  Description of Artificial Sequence: Synthetic polypeptide
DEEEIRTTNPVATEQYGSVSPTNIERNGDND

SEQ ID NO: 17839 - protein, 28 aa, Artificial Sequence
  Description of Artificial Sequence: Synthetic peptide
DEEEIRTTNPWATEEYGSVATNHGRGNA

SEQ ID NO: 17840 - protein, 31 aa, Artificial Sequence
  Description of Artificial Sequence: Synthetic polypeptide
DEAEIRTTNPVATECYGSVSTNLQGDTGDNR

SEQ ID NO: 17841 - protein, 30 aa, Artificial Sequence
  Description of Artificial Sequence: Synthetic polypeptide
DEEEIRTTNPVATEQYGSVSPTNIEGNGQR

SEQ ID NO: 17842 - protein, 30 aa, Artificial Sequence
  Description of Artificial Sequence: Synthetic polypeptide
DEEEIRTTNPVATECWGSVSENEQDRGENR

SEQ ID NO: 17843 - protein, 31 aa, Artificial Sequence
  Description of Artificial Sequence: Synthetic polypeptide
DEEEIRTTNPVATEQYGSVSPTNIDRNGDGR

SEQ ID NO: 17844 - protein, 32 aa, Artificial Sequence
  Description of Artificial Sequence: Synthetic polypeptide
DEEEIRTTNPVATEQYGSVGNTNLVQRGNVES

SEQ ID NO: 17845 - protein, 33 aa, Artificial Sequence
  Description of Artificial Sequence: Synthetic polypeptide
DEEEIRTTNPVATEQYGSVSPTNHQRMGEENRC

SEQ ID NO: 17846 - protein, 28 aa, Artificial Sequence
  Description of Artificial Sequence: Synthetic peptide
DEEEIRTTNPVATEQWGSVSENLMAENA

SEQ ID NO: 17847 - protein, 30 aa, Artificial Sequence
  Description of Artificial Sequence: Synthetic polypeptide
DEAEIRTTNPVATECYGSVSTNLQHQGNND

SEQ ID NO: 17848 - protein, 31 aa, Artificial Sequence
  Description of Artificial Sequence: Synthetic polypeptide
DEEEIRTTNPVATEQYGSVSPTNHQQGEEPR

SEQ ID NO: 17849 - protein, 29 aa, Artificial Sequence
  Description of Artificial Sequence: Synthetic peptide
TEEGIRTTNPVATEQYGSVSCTNLHMLNR

SEQ ID NO: 17850 - protein, 31 aa, Artificial Sequence
  Description of Artificial Sequence: Synthetic polypeptide
DEEEIRTTNPVAYEAYGSVSTQNLSERGGNR

SEQ ID NO: 17851 - protein, 29 aa, Artificial Sequence
  Description of Artificial Sequence: Synthetic peptide
DEEEIRTTNPVATEQWGSVSENDQTGERQ

SEQ ID NO: 17852 - protein, 31 aa, Artificial Sequence
  Description of Artificial Sequence: Synthetic polypeptide
DEEEIRTTNPVATEQWGSVSDTWLAQRSDNR

SEQ ID NO: 17853 - protein, 28 aa, Artificial Sequence
  Description of Artificial Sequence: Synthetic peptide
TEEGIRTTNPVATEQYGSVSTDLEMENR

SEQ ID NO: 17854 - protein, 28 aa, Artificial Sequence
  Description of Artificial Sequence: Synthetic peptide
TEEGIRTTNPVATEQYGSVSTGLGMMNR

SEQ ID NO: 17855 - protein, 30 aa, Artificial Sequence
  Description of Artificial Sequence: Synthetic polypeptide
DEAEIRTTNPVATECYGSVSTNLQMGDNET

SEQ ID NO: 17856 - protein, 30 aa, Artificial Sequence
  Description of Artificial Sequence: Synthetic polypeptide
DEEEIRTTNPVAYEAYGSVSTNSQTRDNTR

SEQ ID NO: 17857 - protein, 28 aa, Artificial Sequence
  Description of Artificial Sequence: Synthetic peptide
DEEEIRTTNPVSTEQYGSVTVNLQTGVT

SEQ ID NO: 17858 - protein, 31 aa, Artificial Sequence
  Description of Artificial Sequence: Synthetic polypeptide
DEEEIRTTNPVAYEAYGSVVSCTHELQRGNR

SEQ ID NO: 17859 - protein, 28 aa, Artificial Sequence
  Description of Artificial Sequence: Synthetic peptide
DEEEIRTTNPVSTEQYGSVTVNLQGGQS

SEQ ID NO: 17860 - protein, 32 aa, Artificial Sequence
  Description of Artificial Sequence: Synthetic polypeptide
DEEEIRTTNPVATEQYGSVSYTVQLEQRDGNE

SEQ ID NO: 17861 - protein, 30 aa, Artificial Sequence
  Description of Artificial Sequence: Synthetic polypeptide
DEEEIRTTNPVSTEQYGSVTFTNLQGGNQT

SEQ ID NO: 17862 - protein, 28 aa, Artificial Sequence
  Description of Artificial Sequence: Synthetic peptide
DEEEIRTTNPVSTEQYGSVTFNLQGGVE

SEQ ID NO: 17863 - protein, 31 aa, Artificial Sequence
  Description of Artificial Sequence: Synthetic polypeptide
DEEEIRTTNPVATEQYGSVSYVLLDQQGDNR

SEQ ID NO: 17864 - protein, 29 aa, Artificial Sequence
  Description of Artificial Sequence: Synthetic peptide
TEEGIRTTNPVATEQYGSVSTNLSGPNNR

SEQ ID NO: 17865 - protein, 31 aa, Artificial Sequence
  Description of Artificial Sequence: Synthetic polypeptide
DEEEIRTTNPVATEQYGSVSYVTLQDGNNRQ

SEQ ID NO: 17866 - protein, 28 aa, Artificial Sequence
  Description of Artificial Sequence: Synthetic peptide
DEEEIRTTNPVSTEQYGSVTFNLQGGDL

SEQ ID NO: 17867 - protein, 28 aa, Artificial Sequence
  Description of Artificial Sequence: Synthetic peptide
DEEEIRTTNPVSTEQYGSVTFNLQEGQK

SEQ ID NO: 17868 - protein, 29 aa, Artificial Sequence
  Description of Artificial Sequence: Synthetic peptide
DEEEIACTNPVATEHYGVVSTNLQRGNSQ

SEQ ID NO: 17869 - protein, 30 aa, Artificial Sequence
  Description of Artificial Sequence: Synthetic polypeptide
DEEEIRTTNPVATEQYGSVTCTELQRGLQG

SEQ ID NO: 17870 - protein, 32 aa, Artificial Sequence
  Description of Artificial Sequence: Synthetic polypeptide
DEEEIRTTNPVATEQYGSVSYTTNLQTGNLVF

SEQ ID NO: 17871 - protein, 29 aa, Artificial Sequence
  Description of Artificial Sequence: Synthetic peptide
TEEGIRTTNPVATEQYGSVSTNLSMTPNR

SEQ ID NO: 17872 - protein, 31 aa, Artificial Sequence
  Description of Artificial Sequence: Synthetic polypeptide
DEEEIRTTNPVATEQYGSVQTTNLQRNVEVR

SEQ ID NO: 17873 - protein, 32 aa, Artificial Sequence
  Description of Artificial Sequence: Synthetic polypeptide
DEEEIRTTNPVATEQYGSVGSGTNLQISGNQN

SEQ ID NO: 17874 - protein, 28 aa, Artificial Sequence
  Description of Artificial Sequence: Synthetic peptide
TEEGIRTTNPVATEQYGSVSTNLSMVNQ

SEQ ID NO: 17875 - protein, 30 aa, Artificial Sequence
  Description of Artificial Sequence: Synthetic polypeptide
DEEEIRTTNPVATEQYGSVSPNLTQGGVEE

SEQ ID NO: 17876 - protein, 28 aa, Artificial Sequence
  Description of Artificial Sequence: Synthetic peptide
DEEEIRTTNPVSTEQYGSVTENLQNGQE

SEQ ID NO: 17877 - protein, 31 aa, Artificial Sequence
  Description of Artificial Sequence: Synthetic polypeptide
DEEEIRTTNPVATEQFGTSVSTNYLLRGNES

SEQ ID NO: 17878 - protein, 28 aa, Artificial Sequence
  Description of Artificial Sequence: Synthetic peptide
DEEEIRTTNPVSTEQYGSVTENLQGGQS

SEQ ID NO: 17879 - protein, 28 aa, Artificial Sequence
  Description of Artificial Sequence: Synthetic peptide
DEEEIRTTNPVSTEQYGSVTDNLQGGQQ

SEQ ID NO: 17880 - protein, 28 aa, Artificial Sequence
  Description of Artificial Sequence: Synthetic peptide
DEEEIRTTNPVSTEQYGSVTDNLQGGMT

SEQ ID NO: 17881 - protein, 29 aa, Artificial Sequence
  Description of Artificial Sequence: Synthetic peptide
TEEGIRTTNPVATEQYGSVSTNLSNVLNR

SEQ ID NO: 17882 - protein, 28 aa, Artificial Sequence
  Description of Artificial Sequence: Synthetic peptide
DEEEIATTNPVATEQYGSVAGNDQQGNH

SEQ ID NO: 17883 - protein, 30 aa, Artificial Sequence
  Description of Artificial Sequence: Synthetic polypeptide
DEEEIRTTNPVATEQYGSVSPNLQTEQNSE

SEQ ID NO: 17884 - protein, 30 aa, Artificial Sequence
  Description of Artificial Sequence: Synthetic polypeptide
DEEEIRTTNPVAYEAYGSVWQNLSQRVGNR

SEQ ID NO: 17885 - protein, 31 aa, Artificial Sequence
  Description of Artificial Sequence: Synthetic polypeptide
DEEEIRTTNPVATEQFGTSVSTNYLLARGNS

SEQ ID NO: 17886 - protein, 31 aa, Artificial Sequence
  Description of Artificial Sequence: Synthetic polypeptide
DEEEIRTTNPVATEQFGTSVSTNYDLDRGNQ

SEQ ID NO: 17887 - protein, 30 aa, Artificial Sequence
  Description of Artificial Sequence: Synthetic polypeptide
DEAEIRTTNPVATEEYGSVSTNLQHGGIND

SEQ ID NO: 17888 - protein, 31 aa, Artificial Sequence
  Description of Artificial Sequence: Synthetic polypeptide
DEEEIRTTNPVAYEAYGSVVSTNALQRGGNA

SEQ ID NO: 17889 - protein, 31 aa, Artificial Sequence
  Description of Artificial Sequence: Synthetic polypeptide
DEEEIRTTNPVATEQYGSVSYTNLQRAVTED

SEQ ID NO: 17890 - protein, 28 aa, Artificial Sequence
  Description of Artificial Sequence: Synthetic peptide
DEEEIRTTNPVSTEQYGSVTSNLQTGQT

SEQ ID NO: 17891 - protein, 29 aa, Artificial Sequence
  Description of Artificial Sequence: Synthetic peptide
TEEGIRTTNPVATEQYGSVSTNLPGMENR

SEQ ID NO: 17892 - protein, 28 aa, Artificial Sequence
  Description of Artificial Sequence: Synthetic peptide
AEEEIATTNPVATEQYGEASENLQRGGR

SEQ ID NO: 17893 - protein, 31 aa, Artificial Sequence
  Description of Artificial Sequence: Synthetic polypeptide
DEEEIRTTNPVATEQYGSVGPTNLQRGMILN

SEQ ID NO: 17894 - protein, 28 aa, Artificial Sequence
  Description of Artificial Sequence: Synthetic peptide
AEEEIATTNPVATEQYGEASENLQRGER

SEQ ID NO: 17895 - protein, 31 aa, Artificial Sequence
  Description of Artificial Sequence: Synthetic polypeptide
DEEEIRTTNPVATEQYGSVSPTNGQNVNNVR

SEQ ID NO: 17896 - protein, 30 aa, Artificial Sequence
  Description of Artificial Sequence: Synthetic polypeptide
DEEEIRTTNPVATEQYGSVGPTTLQVGDQR

SEQ ID NO: 17897 - protein, 32 aa, Artificial Sequence
  Description of Artificial Sequence: Synthetic polypeptide
DEEEIRTTNPVATEQYGSVSYTNNQRGENENE

SEQ ID NO: 17898 - protein, 31 aa, Artificial Sequence
  Description of Artificial Sequence: Synthetic polypeptide
DEEEIRTTNPVATEQYGSVSYTNSSQRVGSQ

SEQ ID NO: 17899 - protein, 30 aa, Artificial Sequence
  Description of Artificial Sequence: Synthetic polypeptide
DEEEIATTNPVATEQYGSVAITNLQGGNPQ

SEQ ID NO: 17900 - protein, 30 aa, Artificial Sequence
  Description of Artificial Sequence: Synthetic polypeptide
DEEEIRTTNPVATEQYGSVSPTNGQNELNV

SEQ ID NO: 17901 - protein, 32 aa, Artificial Sequence
  Description of Artificial Sequence: Synthetic polypeptide
DEEEIRTTNPVATEQYGSVSPTNGQARGMNQE

SEQ ID NO: 17902 - protein, 28 aa, Artificial Sequence
  Description of Artificial Sequence: Synthetic peptide
DEEEIRTTNPVSTEQYGSVTNNLQGGGI

SEQ ID NO: 17903 - protein, 28 aa, Artificial Sequence
  Description of Artificial Sequence: Synthetic peptide
DEEEIRTTNPVSTEQYGSVTHNLQVGQN

SEQ ID NO: 17904 - protein, 30 aa, Artificial Sequence
  Description of Artificial Sequence: Synthetic polypeptide
DEAEIRTTNPVATEEYGSVSTNLQMGDNNM

SEQ ID NO: 17905 - protein, 31 aa, Artificial Sequence
  Description of Artificial Sequence: Synthetic polypeptide
DEEEIRTTNPVAYEAYGSVVSTNLSQNTGNR

SEQ ID NO: 17906 - protein, 30 aa, Artificial Sequence
  Description of Artificial Sequence: Synthetic polypeptide
DEEEIRTTNPVATEQYGSVSNNLQPPAIER

SEQ ID NO: 17907 - protein, 30 aa, Artificial Sequence
  Description of Artificial Sequence: Synthetic polypeptide
DEEEIRTTNPVATEQYGSVITTNNQRGEDV

SEQ ID NO: 17908 - protein, 30 aa, Artificial Sequence
  Description of Artificial Sequence: Synthetic polypeptide
DEEEIRTTNPVATEQYGSVQTTNLQTPLAR

SEQ ID NO: 17909 - protein, 28 aa, Artificial Sequence
  Description of Artificial Sequence: Synthetic peptide
DEEEIRTTNPYATEQYGSVHTPDIRGNP

SEQ ID NO: 17910 - protein, 29 aa, Artificial Sequence
  Description of Artificial Sequence: Synthetic peptide
DEEEIACTNPVATEMYGSVSAEVLQRGNR

SEQ ID NO: 17911 - protein, 28 aa, Artificial Sequence
  Description of Artificial Sequence: Synthetic peptide
TEEGIRTTNPTATEQYGSVSTNLEMLNR

SEQ ID NO: 17912 - protein, 30 aa, Artificial Sequence
  Description of Artificial Sequence: Synthetic polypeptide
DEEEIRTTNPVATEQWGSVSENLQAGNDVI

SEQ ID NO: 17913 - protein, 29 aa, Artificial Sequence
  Description of Artificial Sequence: Synthetic peptide
DEEEIRTVNPVATEQYGSVSTSELQRNQE

SEQ ID NO: 17914 - protein, 31 aa, Artificial Sequence
  Description of Artificial Sequence: Synthetic polypeptide
DEEEIRTVNPVATEQYGSVSTRLSQRNGQNE

SEQ ID NO: 17915 - protein, 29 aa, Artificial Sequence
  Description of Artificial Sequence: Synthetic peptide
DEEEIRTVNPVATEQYGSVSTRLQQVGQE

SEQ ID NO: 17916 - protein, 28 aa, Artificial Sequence
  Description of Artificial Sequence: Synthetic peptide
DEEEIRTVNPVATEQYGSVSTRLQKNQE

SEQ ID NO: 17917 - protein, 29 aa, Artificial Sequence
  Description of Artificial Sequence: Synthetic peptide
DEEEIACTNPIATEQYGNVSENLQRVGNR

SEQ ID NO: 17918 - protein, 30 aa, Artificial Sequence
  Description of Artificial Sequence: Synthetic polypeptide
DEEEIRTVNPVATEQYGSVSTPLQRNQNQG

SEQ ID NO: 17919 - protein, 31 aa, Artificial Sequence
  Description of Artificial Sequence: Synthetic polypeptide
DEEEIRTTNPVATEQWGSVSTDNLQRDGPDT

SEQ ID NO: 17920 - protein, 30 aa, Artificial Sequence
  Description of Artificial Sequence: Synthetic polypeptide
DEEAIRTTNPVATEGYGSVSTNLQNGSNQN

SEQ ID NO: 17921 - protein, 32 aa, Artificial Sequence
  Description of Artificial Sequence: Synthetic polypeptide
DEEEIRTTNPVATEQYGSVSPTNLDQRSENQH

SEQ ID NO: 17922 - protein, 30 aa, Artificial Sequence
  Description of Artificial Sequence: Synthetic polypeptide
DEEEIRTTNPVATEQFGTSVSITYLLRGND

SEQ ID NO: 17923 - protein, 31 aa, Artificial Sequence
  Description of Artificial Sequence: Synthetic polypeptide
DEDEIRTTNPVAYEHYGSVSTNLSQRGGNNR

SEQ ID NO: 17924 - protein, 31 aa, Artificial Sequence
  Description of Artificial Sequence: Synthetic polypeptide
DEAEIRTTNPVATECYGSVSATGNDQRGNER

SEQ ID NO: 17925 - protein, 31 aa, Artificial Sequence
  Description of Artificial Sequence: Synthetic polypeptide
DEEEIRTTNPVAYEAYGSVSCTNMLQRGGNA

SEQ ID NO: 17926 - protein, 34 aa, Artificial Sequence
  Description of Artificial Sequence: Synthetic polypeptide
DEEEIRTTNPVATEQYGSVSPTNLDQRPGVNERP

SEQ ID NO: 17927 - protein, 34 aa, Artificial Sequence
  Description of Artificial Sequence: Synthetic polypeptide
DEEEIRTTNPVATEQYGSVSPTNLDQRMGLANRP

SEQ ID NO: 17928 - protein, 29 aa, Artificial Sequence
  Description of Artificial Sequence: Synthetic peptide
DEEEIRTVNPVATEQYGSVSTLLQRNQAT

SEQ ID NO: 17929 - protein, 31 aa, Artificial Sequence
  Description of Artificial Sequence: Synthetic polypeptide
DEEEIRTTNPVATEQWGSVSQGNLSQKGGNR

SEQ ID NO: 17930 - protein, 31 aa, Artificial Sequence
  Description of Artificial Sequence: Synthetic polypeptide
DEEEIRTTNPVATEQWGSVSPPNLQREGPNE

SEQ ID NO: 17931 - protein, 30 aa, Artificial Sequence
  Description of Artificial Sequence: Synthetic polypeptide
DEEEIRTTNPVATEQYGSVSYSFNLQDVNS

SEQ ID NO: 17932 - protein, 28 aa, Artificial Sequence
  Description of Artificial Sequence: Synthetic peptide
DEAEIRTTNPVATECYGSVSTNDQSGDD

SEQ ID NO: 17933 - protein, 31 aa, Artificial Sequence
  Description of Artificial Sequence: Synthetic polypeptide
DEEEIRTTNPVATEQYGSVSNNLLQQRDNLE

SEQ ID NO: 17934 - protein, 29 aa, Artificial Sequence
  Description of Artificial Sequence: Synthetic peptide
DEEEIACTNPIATEQYGSVSATDLMRGNR

SEQ ID NO: 17935 - protein, 30 aa, Artificial Sequence
  Description of Artificial Sequence: Synthetic polypeptide
DEEEIATTNPVATEQWGEVSTNLQTDGQNR

SEQ ID NO: 17936 - protein, 29 aa, Artificial Sequence
  Description of Artificial Sequence: Synthetic peptide
DEEEIRTVNPVATEQYGSVSTDLQQANQE

SEQ ID NO: 17937 - protein, 30 aa, Artificial Sequence
  Description of Artificial Sequence: Synthetic polypeptide
DEEEIRTTNPVATEQFGSVSTNLQENGDPG

SEQ ID NO: 17938 - protein, 30 aa, Artificial Sequence
  Description of Artificial Sequence: Synthetic polypeptide
DEEEIRTTNPVAYEAYGSVPTNLSQRGNNS

SEQ ID NO: 17939 - protein, 31 aa, Artificial Sequence
  Description of Artificial Sequence: Synthetic polypeptide
DEEEIRTTNPVATEQYGSVSPTNLEMGENVE

SEQ ID NO: 17940 - protein, 32 aa, Artificial Sequence
  Description of Artificial Sequence: Synthetic polypeptide
DEEEIRTTNPVATEQYGSVSPTNLEIGEENRM

SEQ ID NO: 17941 - protein, 30 aa, Artificial Sequence
  Description of Artificial Sequence: Synthetic polypeptide
AEEEIATTNPVATEQYGSVATNLQRGDNNP

SEQ ID NO: 17942 - protein, 31 aa, Artificial Sequence
  Description of Artificial Sequence: Synthetic polypeptide
DEEEIATTNPVATEQYGSVATGNLQDSGNRN

SEQ ID NO: 17943 - protein, 31 aa, Artificial Sequence
  Description of Artificial Sequence: Synthetic polypeptide
DEEEIRTTNPVATEQYGSVSPTNLEDRTENQ

SEQ ID NO: 17944 - protein, 30 aa, Artificial Sequence
  Description of Artificial Sequence: Synthetic polypeptide
DEEEIRTTNPVATEQYGSVSYNMQRVANND

SEQ ID NO: 17945 - protein, 29 aa, Artificial Sequence
  Description of Artificial Sequence: Synthetic peptide
DEEEIRTVNPVATEQYGSVTSTELQRNQF

SEQ ID NO: 17946 - protein, 32 aa, Artificial Sequence
  Description of Artificial Sequence: Synthetic polypeptide
DEEEIRTTNPVATEQYGSVVSTNLQRFQSNDL

SEQ ID NO: 17947 - protein, 32 aa, Artificial Sequence
  Description of Artificial Sequence: Synthetic polypeptide
DEEEIRTTNPVATEQYGSVVSTNLQNGGNGDE

SEQ ID NO: 17948 - protein, 29 aa, Artificial Sequence
  Description of Artificial Sequence: Synthetic peptide
DEEEIRTVNPVATEQYGSVSTVLQSDNQE

SEQ ID NO: 17949 - protein, 31 aa, Artificial Sequence
  Description of Artificial Sequence: Synthetic polypeptide
DEEEIRTTNPVATEQYGSVSPNLQQGMVELR

SEQ ID NO: 17950 - protein, 30 aa, Artificial Sequence
  Description of Artificial Sequence: Synthetic polypeptide
DEEEIRTTNPVATEQFGQSVSTYLLRGNDG

SEQ ID NO: 17951 - protein, 29 aa, Artificial Sequence
  Description of Artificial Sequence: Synthetic peptide
DEEEIRTTNPVATEQWGSVSTELQNSGDN

SEQ ID NO: 17952 - protein, 32 aa, Artificial Sequence
  Description of Artificial Sequence: Synthetic polypeptide
DEEEIRTTNPVATEQYGSVVSTNLQNDGDNGD

SEQ ID NO: 17953 - protein, 30 aa, Artificial Sequence
  Description of Artificial Sequence: Synthetic polypeptide
DEEEIRTTNPVATEQYGSVSYNQDQGGNNE

SEQ ID NO: 17954 - protein, 31 aa, Artificial Sequence
  Description of Artificial Sequence: Synthetic polypeptide
DEEEIRTVNPVATEQYGSVSTVLQDRGNQEE

SEQ ID NO: 17955 - protein, 29 aa, Artificial Sequence
  Description of Artificial Sequence: Synthetic peptide
DEEEIRTTNPVATEQYGSVSNNLLITETR

SEQ ID NO: 17956 - protein, 30 aa, Artificial Sequence
  Description of Artificial Sequence: Synthetic polypeptide
DEEEIRTVNPVATEQYGSVSTTLQRSNSQQ

SEQ ID NO: 17957 - protein, 29 aa, Artificial Sequence
  Description of Artificial Sequence: Synthetic peptide
DEEEIRTVNPVATEQYGSVSTTLQRNQTE

SEQ ID NO: 17958 - protein, 30 aa, Artificial Sequence
  Description of Artificial Sequence: Synthetic polypeptide
DEEEIATTNPVATEQYGSVATEDQRGNNDR

SEQ ID NO: 17959 - protein, 32 aa, Artificial Sequence
  Description of Artificial Sequence: Synthetic polypeptide
DEEEIRTTNPVATEQYGSVSPTNLDQTGVENE

SEQ ID NO: 17960 - protein, 32 aa, Artificial Sequence
  Description of Artificial Sequence: Synthetic polypeptide
DEEEIRTTNPVATEQYGSVLPTNLQLGENERT

SEQ ID NO: 17961 - protein, 30 aa, Artificial Sequence
  Description of Artificial Sequence: Synthetic polypeptide
DEEEIRTVNPVATEQYGSVSTVLQRNGQEE

SEQ ID NO: 17962 - protein, 30 aa, Artificial Sequence
  Description of Artificial Sequence: Synthetic polypeptide
DEEEIATTNPVATEQYGSVAPTNLQDGNPF

SEQ ID NO: 17963 - protein, 28 aa, Artificial Sequence
  Description of Artificial Sequence: Synthetic peptide
DEEEIRTVNPVATEQYGSVSTDLQHDAE

SEQ ID NO: 17964 - protein, 29 aa, Artificial Sequence
  Description of Artificial Sequence: Synthetic peptide
DEEEIRTVNPVATEQYGSVSTDLQERNAE

SEQ ID NO: 17965 - protein, 31 aa, Artificial Sequence
  Description of Artificial Sequence: Synthetic polypeptide
DEEEIRTTNPVATEQYGSVGNTNLQGTSGNQ

SEQ ID NO: 17966 - protein, 29 aa, Artificial Sequence
  Description of Artificial Sequence: Synthetic peptide
DEEEIRTTNPVATEQFGTSVSTALEYGNS

SEQ ID NO: 17967 - protein, 32 aa, Artificial Sequence
  Description of Artificial Sequence: Synthetic polypeptide
DEEEIRTTNPVATEQYGSVSYTNALSQRVTNP

SEQ ID NO: 17968 - protein, 30 aa, Artificial Sequence
  Description of Artificial Sequence: Synthetic polypeptide
DEEEIRTTNPVATEQYGSVQVLLDQRGNML

SEQ ID NO: 17969 - protein, 28 aa, Artificial Sequence
  Description of Artificial Sequence: Synthetic peptide
DEEEIRTVNPVATEQWGSSSTDPQRGNS

SEQ ID NO: 17970 - protein, 32 aa, Artificial Sequence
  Description of Artificial Sequence: Synthetic polypeptide
DEEEIRTTNPVATEQYGSVIYNQLQRGLENRS

SEQ ID NO: 17971 - protein, 30 aa, Artificial Sequence
  Description of Artificial Sequence: Synthetic polypeptide
DEEEIRTTNPVATEQWGSVSENLQQNGNVD

SEQ ID NO: 17972 - protein, 28 aa, Artificial Sequence
  Description of Artificial Sequence: Synthetic peptide
DEEEIRTVNPVATECYGSVSTDLQNGES

SEQ ID NO: 17973 - protein, 29 aa, Artificial Sequence
  Description of Artificial Sequence: Synthetic peptide
DEEEIRTTNPVATEQYGSVQNNLDGRSER

SEQ ID NO: 17974 - protein, 29 aa, Artificial Sequence
  Description of Artificial Sequence: Synthetic peptide
DEDEIRTTNPVAYEPYGSVATNLQRGNLM

SEQ ID NO: 17975 - protein, 31 aa, Artificial Sequence
  Description of Artificial Sequence: Synthetic polypeptide
DEEEIRTTNPVATEQYGSVGNTNLQGIGQNP

SEQ ID NO: 17976 - protein, 28 aa, Artificial Sequence
  Description of Artificial Sequence: Synthetic peptide
TEEGICTTNPVATEQYGSVSCNSQRGNE

SEQ ID NO: 17977 - protein, 30 aa, Artificial Sequence
  Description of Artificial Sequence: Synthetic polypeptide
DEEEIRTTNPVATEQWGSVSENLQHGENNS

SEQ ID NO: 17978 - protein, 30 aa, Artificial Sequence
  Description of Artificial Sequence: Synthetic polypeptide
DEEEIRTTNPVAYEAYGSVSTNLQQGNNGG

SEQ ID NO: 17979 - protein, 29 aa, Artificial Sequence
  Description of Artificial Sequence: Synthetic peptide
DEEEIRTTNPVAYEAYGSVSTNLSGNVNR

SEQ ID NO: 17980 - protein, 30 aa, Artificial Sequence
  Description of Artificial Sequence: Synthetic polypeptide
DEEEIRTTNPVATEQWGSVSENLQAGPNHD

SEQ ID NO: 17981 - protein, 31 aa, Artificial Sequence
  Description of Artificial Sequence: Synthetic polypeptide
DEEEIRTTNPVAYEAYGSVSTNLSMRPGVNR

SEQ ID NO: 17982 - protein, 31 aa, Artificial Sequence
  Description of Artificial Sequence: Synthetic polypeptide
DEEEIRTTNPVAYEAYGSVSTNLSNREGENR

SEQ ID NO: 17983 - protein, 31 aa, Artificial Sequence
  Description of Artificial Sequence: Synthetic polypeptide
DEEEIRTTNPVAYEAYGSVSTNLSQERVTNR

SEQ ID NO: 17984 - protein, 31 aa, Artificial Sequence
  Description of Artificial Sequence: Synthetic polypeptide
DEEEIRTTNPVATECWGSVSCTNHSQRGGNR

SEQ ID NO: 17985 - protein, 28 aa, Artificial Sequence
  Description of Artificial Sequence: Synthetic peptide
TEEGICTTNPVATEQYGSVSTNLEELNR

SEQ ID NO: 17986 - protein, 29 aa, Artificial Sequence
  Description of Artificial Sequence: Synthetic peptide
DEAEIRTTNPVATECYGSVSTNLQDGPDS

SEQ ID NO: 17987 - protein, 31 aa, Artificial Sequence
  Description of Artificial Sequence: Synthetic polypeptide
DEEEIRTTNPVAYEAYGSVSTNLDQRGGNNG

SEQ ID NO: 17988 - protein, 29 aa, Artificial Sequence
  Description of Artificial Sequence: Synthetic peptide
AEEEIATTNPVATEQYGSVATNDQDRGNA

SEQ ID NO: 17989 - protein, 34 aa, Artificial Sequence
  Description of Artificial Sequence: Synthetic polypeptide
DEEEIRTTNPVATEQYGSVSYTNALSQNRTGENR

SEQ ID NO: 17990 - protein, 29 aa, Artificial Sequence
  Description of Artificial Sequence: Synthetic peptide
AEEEIATTNPVATEQYGSVATNDQRDSNR

SEQ ID NO: 17991 - protein, 30 aa, Artificial Sequence
  Description of Artificial Sequence: Synthetic polypeptide
AEEEIATTNPVATEQYGSVATNLQDGNNRM

SEQ ID NO: 17992 - protein, 29 aa, Artificial Sequence
  Description of Artificial Sequence: Synthetic peptide
DEEEIRTVNPVATEQYGSVSTALQRNQTG

SEQ ID NO: 17993 - protein, 29 aa, Artificial Sequence
  Description of Artificial Sequence: Synthetic peptide
DEEEIRTVNPVATEQYGSVSTALQREEQE

SEQ ID NO: 17994 - protein, 32 aa, Artificial Sequence
  Description of Artificial Sequence: Synthetic polypeptide
DEEEIRTTNPVATEQYGSVSPTNLDENGNDRF

SEQ ID NO: 17995 - protein, 28 aa, Artificial Sequence
  Description of Artificial Sequence: Synthetic peptide
DEEEIRTVNPVATEQYGSVSTALNGNQE

SEQ ID NO: 17996 - protein, 32 aa, Artificial Sequence
  Description of Artificial Sequence: Synthetic polypeptide
DEEEIRTTNPVATEQYGSVSPNLQRILEANRI

SEQ ID NO: 17997 - protein, 28 aa, Artificial Sequence
  Description of Artificial Sequence: Synthetic peptide
DEEEIRTVNPVATEQYGSVSTALERNTE

SEQ ID NO: 17998 - protein, 29 aa, Artificial Sequence
  Description of Artificial Sequence: Synthetic peptide
DEEEIRTVNPVATEQYGSVSTAALQRNQA

SEQ ID NO: 17999 - protein, 31 aa, Artificial Sequence
  Description of Artificial Sequence: Synthetic polypeptide
DEEEIRTTNPVATEQYGSVGMTNLGRTGERQ

SEQ ID NO: 18000 - protein, 31 aa, Artificial Sequence
  Description of Artificial Sequence: Synthetic polypeptide
DEEEIRTTNPVATEQYGSVGNTFNLDGRGTR

SEQ ID NO: 18001 - protein, 31 aa, Artificial Sequence
  Description of Artificial Sequence: Synthetic polypeptide
DEEEIRTTNPVATEQYGSVSPTNLDEGNNEG

SEQ ID NO: 18002 - protein, 29 aa, Artificial Sequence
  Description of Artificial Sequence: Synthetic peptide
DEEEIACTNPIATEQYGSVSENLMRVGNR

SEQ ID NO: 18003 - protein, 29 aa, Artificial Sequence
  Description of Artificial Sequence: Synthetic peptide
DEEEIRTVNPVATEQYGSVSLTLLQRNQN

SEQ ID NO: 18004 - protein, 31 aa, Artificial Sequence
  Description of Artificial Sequence: Synthetic polypeptide
DEEEIRTTNPVATEQYGSVQLTNLQRGEELT

SEQ ID NO: 18005 - protein, 32 aa, Artificial Sequence
  Description of Artificial Sequence: Synthetic polypeptide
DEEEIRTTNPVATEQYGSVSYTGNELSDSGNR

SEQ ID NO: 18006 - protein, 31 aa, Artificial Sequence
  Description of Artificial Sequence: Synthetic polypeptide
DEEEIRTTNPVATEQWGSVSIVNHSQRTGNR

SEQ ID NO: 18007 - protein, 31 aa, Artificial Sequence
  Description of Artificial Sequence: Synthetic polypeptide
DEEEIRTTNPVATEQYGSVIYTTNLEQRGEE

SEQ ID NO: 18008 - protein, 31 aa, Artificial Sequence
  Description of Artificial Sequence: Synthetic polypeptide
DEEEIRTTNPVATEQYGSVSPTNLANTGEQR

SEQ ID NO: 18009 - protein, 28 aa, Artificial Sequence
  Description of Artificial Sequence: Synthetic peptide
DEEEIRTTNPVATECWGSVATNLMRLND

SEQ ID NO: 18010 - protein, 30 aa, Artificial Sequence
  Description of Artificial Sequence: Synthetic polypeptide
DEEEIRTTNPVAYEAYGSVSTGNLSTEGNR

SEQ ID NO: 18011 - protein, 30 aa, Artificial Sequence
  Description of Artificial Sequence: Synthetic polypeptide
DEEEIRTTNPVATEQYGSVQVTMLQRGQQN

SEQ ID NO: 18012 - protein, 30 aa, Artificial Sequence
  Description of Artificial Sequence: Synthetic polypeptide
DEEEIATTNPVATEQYGSVANNLQDMGNER

SEQ ID NO: 18013 - protein, 31 aa, Artificial Sequence
  Description of Artificial Sequence: Synthetic polypeptide
DEEEIRTTNPVATEQYGSVSPTNIQRGEEEY

SEQ ID NO: 18014 - protein, 30 aa, Artificial Sequence
  Description of Artificial Sequence: Synthetic polypeptide
DEEEIRTTNPVATEQYGSVSNNLQDEGVEE

SEQ ID NO: 18015 - protein, 33 aa, Artificial Sequence
  Description of Artificial Sequence: Synthetic polypeptide
DEEEIRTTNPVATEQYGSVVSTNLAQRTGGNNE

SEQ ID NO: 18016 - protein, 31 aa, Artificial Sequence
  Description of Artificial Sequence: Synthetic polypeptide
DEEEIRTTNPVATEQYGSVQTTNLQRGLDDI

SEQ ID NO: 18017 - protein, 28 aa, Artificial Sequence
  Description of Artificial Sequence: Synthetic peptide
DEEEIRTTNPVATECYGAHSTNEQRTNS

SEQ ID NO: 18018 - protein, 28 aa, Artificial Sequence
  Description of Artificial Sequence: Synthetic peptide
DEEEIRTTNPVATECYGCHSTNEQRNNF

SEQ ID NO: 18019 - protein, 28 aa, Artificial Sequence
  Description of Artificial Sequence: Synthetic peptide
DEEEIRTTNPVATECYGCHSTNEQRRNS

SEQ ID NO: 18020 - protein, 29 aa, Artificial Sequence
  Description of Artificial Sequence: Synthetic peptide
TEEVIRTTNPVATEQYGSVSTNLSMLNDR

SEQ ID NO: 18021 - protein, 29 aa, Artificial Sequence
  Description of Artificial Sequence: Synthetic peptide
DEEEIRTTNPVATEQYGSVITPTEQRINN

SEQ ID NO: 18022 - protein, 28 aa, Artificial Sequence
  Description of Artificial Sequence: Synthetic peptide
TEEVIRTTNPVATEQYGSVSTNLSMMNM

SEQ ID NO: 18023 - protein, 29 aa, Artificial Sequence
  Description of Artificial Sequence: Synthetic peptide
TEEVIRTTNPVATEQYGSVSTPNLTMLNR

SEQ ID NO: 18024 - protein, 31 aa, Artificial Sequence
  Description of Artificial Sequence: Synthetic polypeptide
DEEEIRTTNPVATEQYGSVSPTNDQRNQERI

SEQ ID NO: 18025 - protein, 28 aa, Artificial Sequence
  Description of Artificial Sequence: Synthetic peptide
DEEEIRTTNPVATECYGCMSTNEQRRNF

SEQ ID NO: 18026 - protein, 32 aa, Artificial Sequence
  Description of Artificial Sequence: Synthetic polypeptide
DEEEIRTTNPVATEQYGSVSPTNDQNSGNVRS

SEQ ID NO: 18027 - protein, 28 aa, Artificial Sequence
  Description of Artificial Sequence: Synthetic peptide
TEEVIRTTNPVAYEQYGSVSTNLSMLNR

SEQ ID NO: 18028 - protein, 28 aa, Artificial Sequence
  Description of Artificial Sequence: Synthetic peptide
TEEVIRCTNPVATEQYGSVSTNLSMVNR

SEQ ID NO: 18029 - protein, 31 aa, Artificial Sequence
  Description of Artificial Sequence: Synthetic polypeptide
DEEEIRTTNPVATEQYGSVSPTNDQIINERM

SEQ ID NO: 18030 - protein, 31 aa, Artificial Sequence
  Description of Artificial Sequence: Synthetic polypeptide
DEEEIRTTNPVATEQYGSVQTNVQRLGINPE

SEQ ID NO: 18031 - protein, 28 aa, Artificial Sequence
  Description of Artificial Sequence: Synthetic peptide
TEGAIRTTNPVATEQYGSFSTNLVIGNR

SEQ ID NO: 18032 - protein, 32 aa, Artificial Sequence
  Description of Artificial Sequence: Synthetic polypeptide
DEEEIRTTNPVATEQYGSVGSNTNLTNIGNER

SEQ ID NO: 18033 - protein, 30 aa, Artificial Sequence
  Description of Artificial Sequence: Synthetic polypeptide
DEEEIRTTNPVATEQFGTSVSTYLLPRGNV

SEQ ID NO: 18034 - protein, 28 aa, Artificial Sequence
  Description of Artificial Sequence: Synthetic peptide
DEEEIRTTNPVATECYGCYSTNEQRRNF

SEQ ID NO: 18035 - protein, 30 aa, Artificial Sequence
  Description of Artificial Sequence: Synthetic polypeptide
DEEEIRTTNPVGTETYGSVSMVNLQRGNEL

SEQ ID NO: 18036 - protein, 29 aa, Artificial Sequence
  Description of Artificial Sequence: Synthetic peptide
DEEEIRTTNPVGTESYGSVSTNFLGRGEP

SEQ ID NO: 18037 - protein, 31 aa, Artificial Sequence
  Description of Artificial Sequence: Synthetic polypeptide
DEAEIRTTNPVATEQYGEVATNLQREGNERG

SEQ ID NO: 18038 - protein, 28 aa, Artificial Sequence
  Description of Artificial Sequence: Synthetic peptide
DEEEIRTTNPVATECYGDASTNEQRTNF

SEQ ID NO: 18039 - protein, 33 aa, Artificial Sequence
  Description of Artificial Sequence: Synthetic polypeptide
DEEEIRTTNPVATEQYGSVSPTNDMLQRGDNDV

SEQ ID NO: 18040 - protein, 29 aa, Artificial Sequence
  Description of Artificial Sequence: Synthetic peptide
YEDEITTTNPVATEQYGSVSMNLPQGGNR

SEQ ID NO: 18041 - protein, 28 aa, Artificial Sequence
  Description of Artificial Sequence: Synthetic peptide
YEDEISTTNPVATEQYGSVFTILERGNR

SEQ ID NO: 18042 - protein, 30 aa, Artificial Sequence
  Description of Artificial Sequence: Synthetic polypeptide
DEEEIRTTNPVSTEAYGSVSNPNLQRGNDL

SEQ ID NO: 18043 - protein, 29 aa, Artificial Sequence
  Description of Artificial Sequence: Synthetic peptide
DEEEIRTTNPVATEQFGTSVSTYLAHGNI

SEQ ID NO: 18044 - protein, 31 aa, Artificial Sequence
  Description of Artificial Sequence: Synthetic polypeptide
DEAEIRTTNPVATEQYGEVSTNLQRGEGNDE

SEQ ID NO: 18045 - protein, 29 aa, Artificial Sequence
  Description of Artificial Sequence: Synthetic peptide
DEEEIATTNPVATEQYGSVAANDQDRGNQ

SEQ ID NO: 18046 - protein, 32 aa, Artificial Sequence
  Description of Artificial Sequence: Synthetic polypeptide
DEEEIRTTNPVATEQYGSVVSTNDDERGENRQ

SEQ ID NO: 18047 - protein, 30 aa, Artificial Sequence
  Description of Artificial Sequence: Synthetic polypeptide
DEAEIRTTNPVATEQYGEVSTNLQMGGDAR

SEQ ID NO: 18048 - protein, 32 aa, Artificial Sequence
  Description of Artificial Sequence: Synthetic polypeptide
DEEEIRTTNPVATEQWGSVSCTGELSQRGNNR

SEQ ID NO: 18049 - protein, 30 aa, Artificial Sequence
  Description of Artificial Sequence: Synthetic polypeptide
DEEEIRTTNPVATEQWGSVSCSQNLQRVNI

SEQ ID NO: 18050 - protein, 30 aa, Artificial Sequence
  Description of Artificial Sequence: Synthetic polypeptide
DEEEIRTTNPVATEQYGSVQTPLQNFGERP

SEQ ID NO: 18051 - protein, 32 aa, Artificial Sequence
  Description of Artificial Sequence: Synthetic polypeptide
DEEEIRTTNPVATEQYGSVVSTNAISQNIGNR

SEQ ID NO: 18052 - protein, 32 aa, Artificial Sequence
  Description of Artificial Sequence: Synthetic polypeptide
DEEEIRTTNPVAYEHYGSVPSQTNLSQRTGNR

SEQ ID NO: 18053 - protein, 29 aa, Artificial Sequence
  Description of Artificial Sequence: Synthetic peptide
YEEAIQTTNPVATEQYGSVSTMNLQYLNR

SEQ ID NO: 18054 - protein, 29 aa, Artificial Sequence
  Description of Artificial Sequence: Synthetic peptide
DEEEIRTTNPVSTECYGSVDTELQVNGNR

SEQ ID NO: 18055 - protein, 30 aa, Artificial Sequence
  Description of Artificial Sequence: Synthetic polypeptide
DEEEIRTTNPVATEQYGSVQTPLQENGSNQ

SEQ ID NO: 18056 - protein, 31 aa, Artificial Sequence
  Description of Artificial Sequence: Synthetic polypeptide
DEAEIRTTNPVATEQYGEVSTNLQGNEGNER

SEQ ID NO: 18057 - protein, 29 aa, Artificial Sequence
  Description of Artificial Sequence: Synthetic peptide
DEEEIRTTNPVSTEPYGTVSEDLQMRGNR

SEQ ID NO: 18058 - protein, 30 aa, Artificial Sequence
  Description of Artificial Sequence: Synthetic polypeptide
DEEEIRTTNPVSTEPYGSVSMPNLQRGTNL

SEQ ID NO: 18059 - protein, 31 aa, Artificial Sequence
  Description of Artificial Sequence: Synthetic polypeptide
DEEEIATTNPVATEQYGSTVSTNLSQHGNPY

SEQ ID NO: 18060 - protein, 30 aa, Artificial Sequence
  Description of Artificial Sequence: Synthetic polypeptide
DEEEIRTTNPVATEQYGSVSPTNEQDTNDQ

SEQ ID NO: 18061 - protein, 32 aa, Artificial Sequence
  Description of Artificial Sequence: Synthetic polypeptide
DEEEIATTNPVATEQYGSTVPSCTNLSTRGNR

SEQ ID NO: 18062 - protein, 32 aa, Artificial Sequence
  Description of Artificial Sequence: Synthetic polypeptide
DEEEIATTNPVATEQYGSTVFCTNLSQRGNQR

SEQ ID NO: 18063 - protein, 29 aa, Artificial Sequence
  Description of Artificial Sequence: Synthetic peptide
DEEEIRTTNPVATEQYGSVSPNNIDRDNL

SEQ ID NO: 18064 - protein, 29 aa, Artificial Sequence
  Description of Artificial Sequence: Synthetic peptide
DEAEIRTTNPVATEQYGEVSTNLQGGGEA

SEQ ID NO: 18065 - protein, 31 aa, Artificial Sequence
  Description of Artificial Sequence: Synthetic polypeptide
DEEEIRTTNPVAYEHYGSVSTNLSQQEGNNR

SEQ ID NO: 18066 - protein, 31 aa, Artificial Sequence
  Description of Artificial Sequence: Synthetic polypeptide
DEEEIATTNPVATEQYGSTVSTNSSQNVGNR

SEQ ID NO: 18067 - protein, 28 aa, Artificial Sequence
  Description of Artificial Sequence: Synthetic peptide
DEAEIRTTNPVATEQYGETSTNHQRGDI

SEQ ID NO: 18068 - protein, 30 aa, Artificial Sequence
  Description of Artificial Sequence: Synthetic polypeptide
DEEEIRTTNPVATEQYGSVTNTNLERDDVR

SEQ ID NO: 18069 - protein, 31 aa, Artificial Sequence
  Description of Artificial Sequence: Synthetic polypeptide
DEEEIRTTNPVATEQYGSVGSTDLQTGGGNG

SEQ ID NO: 18070 - protein, 28 aa, Artificial Sequence
  Description of Artificial Sequence: Synthetic peptide
DEAEIRTTNPVATEQYGECSTPLQRGDS

SEQ ID NO: 18071 - protein, 32 aa, Artificial Sequence
  Description of Artificial Sequence: Synthetic polypeptide
DEEEIRTTNPVATEQYGSVSPTNDLQAGENTD

SEQ ID NO: 18072 - protein, 30 aa, Artificial Sequence
  Description of Artificial Sequence: Synthetic polypeptide
YEDEIGTTNPVATEQYGSVMSTNLERGNFR

SEQ ID NO: 18073 - protein, 29 aa, Artificial Sequence
  Description of Artificial Sequence: Synthetic peptide
DEEAIRTTNPVATEIYGVVTTNLQDGSNR

SEQ ID NO: 18074 - protein, 30 aa, Artificial Sequence
  Description of Artificial Sequence: Synthetic polypeptide
DEEEIRTTNPVGTEQYGSVSTNGLGRGEDP

SEQ ID NO: 18075 - protein, 30 aa, Artificial Sequence
  Description of Artificial Sequence: Synthetic polypeptide
DEEEIRTTNPVGTEQYGSVSTNGLGREGEP

SEQ ID NO: 18076 - protein, 30 aa, Artificial Sequence
  Description of Artificial Sequence: Synthetic polypeptide
DEEEIRTTNPVAYEPYGNVSTNLSQRGGSR

SEQ ID NO: 18077 - protein, 31 aa, Artificial Sequence
  Description of Artificial Sequence: Synthetic polypeptide
DEEEIRTTNPVGTEQYGSVSTNGLGQRGETP

SEQ ID NO: 18078 - protein, 29 aa, Artificial Sequence
  Description of Artificial Sequence: Synthetic peptide
DEEEIRTTNPVGTEQYGSVSTNGLGGGTP

SEQ ID NO: 18079 - protein, 28 aa, Artificial Sequence
  Description of Artificial Sequence: Synthetic peptide
DEEEIRTTNPVATECYGEQSTNEQRENF

SEQ ID NO: 18080 - protein, 30 aa, Artificial Sequence
  Description of Artificial Sequence: Synthetic polypeptide
AEEEIATTNPVATEQWGSVSTNLQSGNTRQ

SEQ ID NO: 18081 - protein, 30 aa, Artificial Sequence
  Description of Artificial Sequence: Synthetic polypeptide
DEAEIRTTNPVATEQYGDVSTNLQEGGNNA

SEQ ID NO: 18082 - protein, 30 aa, Artificial Sequence
  Description of Artificial Sequence: Synthetic polypeptide
DEEEIRTTNPVGTEQYGSVSTNGLGEGFND

SEQ ID NO: 18083 - protein, 28 aa, Artificial Sequence
  Description of Artificial Sequence: Synthetic peptide
DEEEIATTNPVATEQWGSVATNDQRSND

SEQ ID NO: 18084 - protein, 31 aa, Artificial Sequence
  Description of Artificial Sequence: Synthetic polypeptide
DEAEIRTTNPVATEGYGSVSTNLGEERGNSR

SEQ ID NO: 18085 - protein, 33 aa, Artificial Sequence
  Description of Artificial Sequence: Synthetic polypeptide
DEEEIATTNPVATEQYGSIVSTNSLSQRNGNNR

SEQ ID NO: 18086 - protein, 29 aa, Artificial Sequence
  Description of Artificial Sequence: Synthetic peptide
DEEEIRTTNPVGTEQYGSVSTNFQGMGEP

SEQ ID NO: 18087 - protein, 31 aa, Artificial Sequence
  Description of Artificial Sequence: Synthetic polypeptide
DEEEIRTTNPVAYEPYGSTVSTGNLQDGGNR

SEQ ID NO: 18088 - protein, 32 aa, Artificial Sequence
  Description of Artificial Sequence: Synthetic polypeptide
DEEEIRTTNPVATEQYGSVVSTDPLQNDGQNR

SEQ ID NO: 18089 - protein, 33 aa, Artificial Sequence
  Description of Artificial Sequence: Synthetic polypeptide
DEEEIRTTNPVATEQWGSVPSVTNLSQRTEGNR

SEQ ID NO: 18090 - protein, 31 aa, Artificial Sequence
  Description of Artificial Sequence: Synthetic polypeptide
DEEEIRTTNPVAYEPYGSTVSTNASQRGNNR

SEQ ID NO: 18091 - protein, 28 aa, Artificial Sequence
  Description of Artificial Sequence: Synthetic peptide
DEEEIRTTNPVATECYGETSTNEQRQNV

SEQ ID NO: 18092 - protein, 32 aa, Artificial Sequence
  Description of Artificial Sequence: Synthetic polypeptide
DEEEIRTTNPVATEQYGSVGSTDNLQTGGNEF

SEQ ID NO: 18093 - protein, 30 aa, Artificial Sequence
  Description of Artificial Sequence: Synthetic polypeptide
DEEEIRTTNPVGTEQYGSVSTNLLGRGQQA

SEQ ID NO: 18094 - protein, 32 aa, Artificial Sequence
  Description of Artificial Sequence: Synthetic polypeptide
TEHEIRTTNPVATEQYGSVVSCTNALSQRGNR

SEQ ID NO: 18095 - protein, 32 aa, Artificial Sequence
  Description of Artificial Sequence: Synthetic polypeptide
DEEEIRTTNPVATEQYGSVSPTNDLTRGLLRE

SEQ ID NO: 18096 - protein, 29 aa, Artificial Sequence
  Description of Artificial Sequence: Synthetic peptide
DEEEIRTTNPVGTEQYGSVSTWDLGRGDP

SEQ ID NO: 18097 - protein, 31 aa, Artificial Sequence
  Description of Artificial Sequence: Synthetic polypeptide
YEDEIRTTNPVCTEQYGSVASTNLQRSGNRG

SEQ ID NO: 18098 - protein, 29 aa, Artificial Sequence
  Description of Artificial Sequence: Synthetic peptide
DEEEIRTTNPVATEQYGSVTPDLQNFGER

SEQ ID NO: 18099 - protein, 30 aa, Artificial Sequence
  Description of Artificial Sequence: Synthetic polypeptide
DEEEIRTTNPVGTEQYGSVSTTNFLGRGVP

SEQ ID NO: 18100 - protein, 31 aa, Artificial Sequence
  Description of Artificial Sequence: Synthetic polypeptide
TEGEIRTTNPVATEQYGSVSCTNMLSQFGNR

SEQ ID NO: 18101 - protein, 29 aa, Artificial Sequence
  Description of Artificial Sequence: Synthetic peptide
DEEEIRTTNPVGTEQYGSVSTNTQGGGGP

SEQ ID NO: 18102 - protein, 31 aa, Artificial Sequence
  Description of Artificial Sequence: Synthetic polypeptide
DEEEIRTTNPVATEQYGSVVSTGNHSQRVDR

SEQ ID NO: 18103 - protein, 29 aa, Artificial Sequence
  Description of Artificial Sequence: Synthetic peptide
DEEEIRTTNPVGTEQYGSVSTNTLGEGTP

SEQ ID NO: 18104 - protein, 33 aa, Artificial Sequence
  Description of Artificial Sequence: Synthetic polypeptide
DEEEIRTTNPVATEQYGSVVSTGELSQRGGNRC

SEQ ID NO: 18105 - protein, 29 aa, Artificial Sequence
  Description of Artificial Sequence: Synthetic peptide
DEEAIRTTNPVATEIYGQVGTNLQRGSNQ

SEQ ID NO: 18106 - protein, 29 aa, Artificial Sequence
  Description of Artificial Sequence: Synthetic peptide
DEEEIRTTNPVGTEQYGSVSTNQDGNGIP

SEQ ID NO: 18107 - protein, 29 aa, Artificial Sequence
  Description of Artificial Sequence: Synthetic peptide
DEEEIRTTNPVGTEQYGSVSTNPLGTGAG

SEQ ID NO: 18108 - protein, 29 aa, Artificial Sequence
  Description of Artificial Sequence: Synthetic peptide
DEEEIRTTNPVGTEQYGSVSTNPLGSGDQ

SEQ ID NO: 18109 - protein, 30 aa, Artificial Sequence
  Description of Artificial Sequence: Synthetic polypeptide
DEEEIRTTNPVGTEQYGSVSTNPLGRGSFA

SEQ ID NO: 18110 - protein, 28 aa, Artificial Sequence
  Description of Artificial Sequence: Synthetic peptide
TEHEIRTTNPVATDQYGSVNTRLQRGND

SEQ ID NO: 18111 - protein, 30 aa, Artificial Sequence
  Description of Artificial Sequence: Synthetic polypeptide
TEHEIRTTNPVATEAYGSVATNMLDQRGNR

SEQ ID NO: 18112 - protein, 29 aa, Artificial Sequence
  Description of Artificial Sequence: Synthetic peptide
DEEEIRTTNPVGTEQYGSVSTNPLGAGGN

SEQ ID NO: 18113 - protein, 29 aa, Artificial Sequence
  Description of Artificial Sequence: Synthetic peptide
DEEEIRTTNPVGTEQYGSVSTNNLGNGFI

SEQ ID NO: 18114 - protein, 29 aa, Artificial Sequence
  Description of Artificial Sequence: Synthetic peptide
DEEEIRTTNPVGTEQYGSVSTNNLGEGGV

SEQ ID NO: 18115 - protein, 29 aa, Artificial Sequence
  Description of Artificial Sequence: Synthetic peptide
DEEEIRTTNPVGTEQYGSVSTNNLGDGFP

SEQ ID NO: 18116 - protein, 28 aa, Artificial Sequence
  Description of Artificial Sequence: Synthetic peptide
DEEEIRTTNPVATEQYGSVQTNVQPTAQ

SEQ ID NO: 18117 - protein, 32 aa, Artificial Sequence
  Description of Artificial Sequence: Synthetic polypeptide
TEHEIRTTNPVATEQYGSVCSCTNELSQRGNR

SEQ ID NO: 18118 - protein, 31 aa, Artificial Sequence
  Description of Artificial Sequence: Synthetic polypeptide
DEEEIRTTNPVATEQYGSVITNLSQESEGIR

SEQ ID NO: 18119 - protein, 29 aa, Artificial Sequence
  Description of Artificial Sequence: Synthetic peptide
DEEEIATTNPVATEQYGSVAANLQDGNHV

SEQ ID NO: 18120 - protein, 29 aa, Artificial Sequence
  Description of Artificial Sequence: Synthetic peptide
DEEEIATTNPVATEQYGSVAANLQDQNRD

SEQ ID NO: 18121 - protein, 31 aa, Artificial Sequence
  Description of Artificial Sequence: Synthetic polypeptide
DEAEIRTTNPVATEQYGEVSTNLQRGGDNGE

SEQ ID NO: 18122 - protein, 29 aa, Artificial Sequence
  Description of Artificial Sequence: Synthetic peptide
DEEEIATTNPVATEQYGSVAANLQEVNRN

SEQ ID NO: 18123 - protein, 30 aa, Artificial Sequence
  Description of Artificial Sequence: Synthetic polypeptide
DEEAIRTTNPVATEQYGSVCSTNHQGGNFV

SEQ ID NO: 18124 - protein, 30 aa, Artificial Sequence
  Description of Artificial Sequence: Synthetic polypeptide
DEEEIRTTNPVATEQYGSVITTLQQDGNLY

SEQ ID NO: 18125 - protein, 31 aa, Artificial Sequence
  Description of Artificial Sequence: Synthetic polypeptide
DEAEIRTTNPVATEQYGNVSTNLQGDGNNTR

SEQ ID NO: 18126 - protein, 31 aa, Artificial Sequence
  Description of Artificial Sequence: Synthetic polypeptide
DEEAIRTTNPVATEQYGSVCSTMNLQGGSND

SEQ ID NO: 18127 - protein, 30 aa, Artificial Sequence
  Description of Artificial Sequence: Synthetic polypeptide
DEAEIRTTNPVATEQYGNVSTNLQGDGNEA

SEQ ID NO: 18128 - protein, 30 aa, Artificial Sequence
  Description of Artificial Sequence: Synthetic polypeptide
DEEEIRTTNPVSTEQYGSVSTNFLGVRGFE

SEQ ID NO: 18129 - protein, 29 aa, Artificial Sequence
  Description of Artificial Sequence: Synthetic peptide
DEEEIRTTNPVATEQYGSVITTLQQDGII

SEQ ID NO: 18130 - protein, 31 aa, Artificial Sequence
  Description of Artificial Sequence: Synthetic polypeptide
DEAEIRTTNPVATEQYGNVSTNLQGDAGNDR

SEQ ID NO: 18131 - protein, 29 aa, Artificial Sequence
  Description of Artificial Sequence: Synthetic peptide
DEEEIRTTNPVSTEQYGSVSTNDLTRTFE

SEQ ID NO: 18132 - protein, 30 aa, Artificial Sequence
  Description of Artificial Sequence: Synthetic polypeptide
DEEEIRTTNPVSTEQYGSVSTNDLGRGSEP

SEQ ID NO: 18133 - protein, 32 aa, Artificial Sequence
  Description of Artificial Sequence: Synthetic polypeptide
DEEEIRTTNPVATEQYGSVVSTNHQDGNNDRG

SEQ ID NO: 18134 - protein, 32 aa, Artificial Sequence
  Description of Artificial Sequence: Synthetic polypeptide
DEEEIRTTNPVAYEEYGSTVSTGNLQRGGNNR

SEQ ID NO: 18135 - protein, 29 aa, Artificial Sequence
  Description of Artificial Sequence: Synthetic peptide
DEEEIRTTNPVSTEQYGSVSTNDHGRGFE

SEQ ID NO: 18136 - protein, 30 aa, Artificial Sequence
  Description of Artificial Sequence: Synthetic polypeptide
DEEEIRTTNPVSTEQYGSVSTMNDLGRGPP

SEQ ID NO: 18137 - protein, 30 aa, Artificial Sequence
  Description of Artificial Sequence: Synthetic polypeptide
DEEEIRTTNPVATEQYGSVQTTNLQQINGD

SEQ ID NO: 18138 - protein, 30 aa, Artificial Sequence
  Description of Artificial Sequence: Synthetic polypeptide
DEEEIRTTNPVAYEEYGSVATNLSQRGTNQ

SEQ ID NO: 18139 - protein, 30 aa, Artificial Sequence
  Description of Artificial Sequence: Synthetic polypeptide
DEEEIRTTNPVSTEQYGSVSTENDLGRGTP

SEQ ID NO: 18140 - protein, 30 aa, Artificial Sequence
  Description of Artificial Sequence: Synthetic polypeptide
DEAEIRTTNPVATEQYGNVSTNLNGDGNMR

SEQ ID NO: 18141 - protein, 31 aa, Artificial Sequence
  Description of Artificial Sequence: Synthetic polypeptide
DEEEIRTTNPVAYEEYGSVPSINLQRGGNNR

SEQ ID NO: 18142 - protein, 31 aa, Artificial Sequence
  Description of Artificial Sequence: Synthetic polypeptide
DEEEIRTTNPVAYEEYGSVPSTNLSQRVTNR

SEQ ID NO: 18143 - protein, 31 aa, Artificial Sequence
  Description of Artificial Sequence: Synthetic polypeptide
DEAEIRTTNPVATEQYGMVSTMNLQRSGSNQ

SEQ ID NO: 18144 - protein, 30 aa, Artificial Sequence
  Description of Artificial Sequence: Synthetic polypeptide
DEEEIRTTNPVSTEQYGSVSTDNLQGGSQT

SEQ ID NO: 18145 - protein, 30 aa, Artificial Sequence
  Description of Artificial Sequence: Synthetic polypeptide
YEEEEIRTTNPVATEQYGSVSWNMQGGVNR

SEQ ID NO: 18146 - protein, 30 aa, Artificial Sequence
  Description of Artificial Sequence: Synthetic polypeptide
DEEEIRTTNPVSTEQYGSVSTNLNLQGGET

SEQ ID NO: 18147 - protein, 32 aa, Artificial Sequence
  Description of Artificial Sequence: Synthetic polypeptide
DEEEIRTTNPVAYECYGSTVPSTGNLQRGGNR

SEQ ID NO: 18148 - protein, 29 aa, Artificial Sequence
  Description of Artificial Sequence: Synthetic peptide
TEEGIRTTNPVATEQYGVVSTNLSMVGNR

SEQ ID NO: 18149 - protein, 28 aa, Artificial Sequence
  Description of Artificial Sequence: Synthetic peptide
DEEEIRTTNPVSTEQYGSVTANLQQGQT

SEQ ID NO: 18150 - protein, 28 aa, Artificial Sequence
  Description of Artificial Sequence: Synthetic peptide
DEEEIRTTNPVSTEQYGSVTANLQQGQA

SEQ ID NO: 18151 - protein, 28 aa, Artificial Sequence
  Description of Artificial Sequence: Synthetic peptide
DEEEIRTTNPVSTEQYGSVTANLQGGQD

SEQ ID NO: 18152 - protein, 31 aa, Artificial Sequence
  Description of Artificial Sequence: Synthetic polypeptide
DEAEIRTTNPVATEQYGNVVSTNLQSDGNAR

SEQ ID NO: 18153 - protein, 32 aa, Artificial Sequence
  Description of Artificial Sequence: Synthetic polypeptide
DEEEIRTTNPVATEQYGSVSPTNGIQPRGNND

SEQ ID NO: 18154 - protein, 29 aa, Artificial Sequence
  Description of Artificial Sequence: Synthetic peptide
TEEGIRTTNPVATEQYGSVSTNLSVHLNR

SEQ ID NO: 18155 - protein, 31 aa, Artificial Sequence
  Description of Artificial Sequence: Synthetic polypeptide
DEAEIRTTNPVATEQYGNVSTNLQLNDGNER

SEQ ID NO: 18156 - protein, 29 aa, Artificial Sequence
  Description of Artificial Sequence: Synthetic peptide
TEEGIRTTNPVATEQYGSVSTNNLAMLNR

SEQ ID NO: 18157 - protein, 30 aa, Artificial Sequence
  Description of Artificial Sequence: Synthetic polypeptide
DEAEIRTTNPVATEQYGNVSTNLQIGGNEN

SEQ ID NO: 18158 - protein, 30 aa, Artificial Sequence
  Description of Artificial Sequence: Synthetic polypeptide
DEEEIRTTNPVSTEQYGSVSTTLNLQQGQT

SEQ ID NO: 18159 - protein, 28 aa, Artificial Sequence
  Description of Artificial Sequence: Synthetic peptide
TEEGIRTTNPVATEQYGSVSTNNSGENR

SEQ ID NO: 18160 - protein, 28 aa, Artificial Sequence
  Description of Artificial Sequence: Synthetic peptide
TEEGIRTTNPVATEQYGSVSTNQSMINR

SEQ ID NO: 18161 - protein, 31 aa, Artificial Sequence
  Description of Artificial Sequence: Synthetic polypeptide
DEEEIRTTNPVATEQYGSVITTNLQRAENDI

SEQ ID NO: 18162 - protein, 31 aa, Artificial Sequence
  Description of Artificial Sequence: Synthetic polypeptide
DEAEIRTTNPVATEQYGNVSTNLQGTGDNNR

SEQ ID NO: 18163 - protein, 31 aa, Artificial Sequence
  Description of Artificial Sequence: Synthetic polypeptide
DEEEIATTNPVATEQYGSVAATNLQDRGENM

SEQ ID NO: 18164 - protein, 29 aa, Artificial Sequence
  Description of Artificial Sequence: Synthetic peptide
DEEEIRTTNPVSTEQYGSVSTNNNQGGQS

SEQ ID NO: 18165 - protein, 31 aa, Artificial Sequence
  Description of Artificial Sequence: Synthetic polypeptide
DEAEIRTTNPVATEQYGNVSTNLQGMGDNER

SEQ ID NO: 18166 - protein, 30 aa, Artificial Sequence
  Description of Artificial Sequence: Synthetic polypeptide
DEEAIRTTNPVATEQYGSVCSTNLQYNNQM

SEQ ID NO: 18167 - protein, 31 aa, Artificial Sequence
  Description of Artificial Sequence: Synthetic polypeptide
DEEEIRTTNPVATEQWGSVSCTNLSQDVENR

SEQ ID NO: 18168 - protein, 31 aa, Artificial Sequence
  Description of Artificial Sequence: Synthetic polypeptide
DEEEIRTTNPVATEQYGSVITTNLLRGVGRE

SEQ ID NO: 18169 - protein, 30 aa, Artificial Sequence
  Description of Artificial Sequence: Synthetic polypeptide
DEAEIRTTNPVATEFYGSVSTENLDQQGNE

SEQ ID NO: 18170 - protein, 32 aa, Artificial Sequence
  Description of Artificial Sequence: Synthetic polypeptide
DEEEIRTTNPVATEQWGSVSCTNLEQRGGHQR

SEQ ID NO: 18171 - protein, 33 aa, Artificial Sequence
  Description of Artificial Sequence: Synthetic polypeptide
DEEEIRTTNPVATEQYGSVVSTNILDQRGETRI

SEQ ID NO: 18172 - protein, 30 aa, Artificial Sequence
  Description of Artificial Sequence: Synthetic polypeptide
DEEEIATTNPVATEQYGSVAATNLERGMDR

SEQ ID NO: 18173 - protein, 31 aa, Artificial Sequence
  Description of Artificial Sequence: Synthetic polypeptide
DEEEIRTTNPVATEQYGSVGGTNLIQNGGNE

SEQ ID NO: 18174 - protein, 29 aa, Artificial Sequence
  Description of Artificial Sequence: Synthetic peptide
TEENIRTTNPVATEQYGSVSTNDSGGLNR

SEQ ID NO: 18175 - protein, 30 aa, Artificial Sequence
  Description of Artificial Sequence: Synthetic polypeptide
DEEEIRTTNPVATEQYGSVQTTNLQQINEI

SEQ ID NO: 18176 - protein, 32 aa, Artificial Sequence
  Description of Artificial Sequence: Synthetic polypeptide
DEEEIRTTNPVATEQWGSVSCTGNLERGGNNR

SEQ ID NO: 18177 - protein, 30 aa, Artificial Sequence
  Description of Artificial Sequence: Synthetic polypeptide
DEEEIRTTNPVSTEQYGSVATNLQRDNTDD

SEQ ID NO: 18178 - protein, 30 aa, Artificial Sequence
  Description of Artificial Sequence: Synthetic polypeptide
DEEEIRTTNPVSTEQYGSVATNLQDGNDAD

SEQ ID NO: 18179 - protein, 30 aa, Artificial Sequence
  Description of Artificial Sequence: Synthetic polypeptide
DEAEIRTTNPVATEQYGHVSWTELNRGENR

SEQ ID NO: 18180 - protein, 28 aa, Artificial Sequence
  Description of Artificial Sequence: Synthetic peptide
TEEQIRTTNPVATEQYGSVSTHQLRGNT

SEQ ID NO: 18181 - protein, 30 aa, Artificial Sequence
  Description of Artificial Sequence: Synthetic polypeptide
DEEEIRTTNPVATEQYGSVQTTLQRGAQDN

SEQ ID NO: 18182 - protein, 30 aa, Artificial Sequence
  Description of Artificial Sequence: Synthetic polypeptide
DEEEIRTTNPVATEQYGSVQTTLQGGEERS

SEQ ID NO: 18183 - protein, 29 aa, Artificial Sequence
  Description of Artificial Sequence: Synthetic peptide
DEEEIATTNPVATEQYGSVAANNLQAGNE

SEQ ID NO: 18184 - protein, 30 aa, Artificial Sequence
  Description of Artificial Sequence: Synthetic polypeptide
DEEAIRTTNPVATEIYGCVETNLQRFGSNR

SEQ ID NO: 18185 - protein, 32 aa, Artificial Sequence
  Description of Artificial Sequence: Synthetic polypeptide
DEEEIRTTNPVAYEHYGISVVSTGNLQRGGNR

SEQ ID NO: 18186 - protein, 30 aa, Artificial Sequence
  Description of Artificial Sequence: Synthetic polypeptide
DEEEIRTTNPVSTEQYGSVATNLQRQNDQD

SEQ ID NO: 18187 - protein, 32 aa, Artificial Sequence
  Description of Artificial Sequence: Synthetic polypeptide
DEEEIRTTNPVATEQYGSVVSTNDMQNGNDRV

SEQ ID NO: 18188 - protein, 31 aa, Artificial Sequence
  Description of Artificial Sequence: Synthetic polypeptide
DEEEIRTTNPVATEQYGSVTMTNEQRGEELR

SEQ ID NO: 18189 - protein, 30 aa, Artificial Sequence
  Description of Artificial Sequence: Synthetic polypeptide
DEEEIRTTNPVATEQYGSVTMTNEQRGQLN

SEQ ID NO: 18190 - protein, 28 aa, Artificial Sequence
  Description of Artificial Sequence: Synthetic peptide
DEEEIRTTNPVSTEQYGSVAFNLQGGDT

SEQ ID NO: 18191 - protein, 29 aa, Artificial Sequence
  Description of Artificial Sequence: Synthetic peptide
DEEEIATTNPVATEQYGSVAANNLDDGNR

SEQ ID NO: 18192 - protein, 30 aa, Artificial Sequence
  Description of Artificial Sequence: Synthetic polypeptide
DEEEIRTTNPVATEQYGSVQTPSLQRGVQN

SEQ ID NO: 18193 - protein, 28 aa, Artificial Sequence
  Description of Artificial Sequence: Synthetic peptide
DEEEIRTTNPVSTEQYGSVAANLQDGQT

SEQ ID NO: 18194 - protein, 32 aa, Artificial Sequence
  Description of Artificial Sequence: Synthetic polypeptide
DEEEIRTTNPVATEQWGSVSCTGNETQRGGNR

SEQ ID NO: 18195 - protein, 32 aa, Artificial Sequence
  Description of Artificial Sequence: Synthetic polypeptide
DEEEIRTTNPVATEQWGSVSCTGLSQREGNNR

SEQ ID NO: 18196 - protein, 29 aa, Artificial Sequence
  Description of Artificial Sequence: Synthetic peptide
DEEEIATTNPVATEQYGSVAANLQQVDNR

SEQ ID NO: 18197 - protein, 32 aa, Artificial Sequence
  Description of Artificial Sequence: Synthetic polypeptide
DEEEIRTTNPVATEQYGSVVSTNDEQNGDNRI

SEQ ID NO: 18198 - protein, 28 aa, Artificial Sequence
  Description of Artificial Sequence: Synthetic peptide
DEEEIRTTNPVSTEQYGSVAINLQGGQN

SEQ ID NO: 18199 - protein, 29 aa, Artificial Sequence
  Description of Artificial Sequence: Synthetic peptide
DEEEIRTTNPVSTEQYGSVATNLQRTDTQ

SEQ ID NO: 18200 - protein, 29 aa, Artificial Sequence
  Description of Artificial Sequence: Synthetic peptide
AEEEIATTNPVATEQYGCVSTNLQVGDND

SEQ ID NO: 18201 - protein, 32 aa, Artificial Sequence
  Description of Artificial Sequence: Synthetic polypeptide
DEEEIRTTNPVATEQYGSVVSTNEIQDEGGNR

SEQ ID NO: 18202 - protein, 32 aa, Artificial Sequence
  Description of Artificial Sequence: Synthetic polypeptide
DEEEIRTTNPVATEQYGSVSPTNFIQPRGERD

SEQ ID NO: 18203 - protein, 28 aa, Artificial Sequence
  Description of Artificial Sequence: Synthetic peptide
DEEEIRTTNPVSTEQYGSVQCNLQGGQT

SEQ ID NO: 18204 - protein, 28 aa, Artificial Sequence
  Description of Artificial Sequence: Synthetic peptide
DEEEIRTTNPVSTEQYGSVPMNLQVGQT

SEQ ID NO: 18205 - protein, 31 aa, Artificial Sequence
  Description of Artificial Sequence: Synthetic polypeptide
DEEEIRTTNPVAYEEYGSVSTGNLSLRGGNR

SEQ ID NO: 18206 - protein, 31 aa, Artificial Sequence
  Description of Artificial Sequence: Synthetic polypeptide
DEEEIRTTNPVATEQYGSVITTDLQRGNEDM

SEQ ID NO: 18207 - protein, 30 aa, Artificial Sequence
  Description of Artificial Sequence: Synthetic polypeptide
DEAEIRTTNPVATEQYGIVSTNLQQGDNNM

SEQ ID NO: 18208 - protein, 34 aa, Artificial Sequence
  Description of Artificial Sequence: Synthetic polypeptide
DEEEIRTTNPVATEQYGSVVSTNELSQRHGGNPR

SEQ ID NO: 18209 - protein, 28 aa, Artificial Sequence
  Description of Artificial Sequence: Synthetic peptide
DEEEIRTTNPVSTEQYGSVNFNLQGGQG

SEQ ID NO: 18210 - protein, 32 aa, Artificial Sequence
  Description of Artificial Sequence: Synthetic polypeptide
DEEEIRTTNPVAYEFYGSTVSTGNLQRTGGNR

SEQ ID NO: 18211 - protein, 31 aa, Artificial Sequence
  Description of Artificial Sequence: Synthetic polypeptide
DEEEIRTTNPVATEQYGSVTINLQRMMNPRD

SEQ ID NO: 18212 - protein, 32 aa, Artificial Sequence
  Description of Artificial Sequence: Synthetic polypeptide
DEEEIRTTNPVATEQYGSVVSTNEISQQEGNR

SEQ ID NO: 18213 - protein, 28 aa, Artificial Sequence
  Description of Artificial Sequence: Synthetic peptide
DEEEIRTTNPVSTEQYGSVMQNLQGGQT

SEQ ID NO: 18214 - protein, 28 aa, Artificial Sequence
  Description of Artificial Sequence: Synthetic peptide
YEECICTTNPVATEQYGSVSMNSQRGND

SEQ ID NO: 18215 - protein, 28 aa, Artificial Sequence
  Description of Artificial Sequence: Synthetic peptide
DEEEIRTTNPVSTEQYGSVMENLQGGQT

SEQ ID NO: 18216 - protein, 29 aa, Artificial Sequence
  Description of Artificial Sequence: Synthetic peptide
DEEEIRTTNPVATEQFGTSVSTTLLTGNT

SEQ ID NO: 18217 - protein, 32 aa, Artificial Sequence
  Description of Artificial Sequence: Synthetic polypeptide
DEEEIRTTNPVATEQYGSVGSNTGNLQNGNEG

SEQ ID NO: 18218 - protein, 28 aa, Artificial Sequence
  Description of Artificial Sequence: Synthetic peptide
DEEEIRTTNPVSTEQYGSVHFNLQMGQT

SEQ ID NO: 18219 - protein, 29 aa, Artificial Sequence
  Description of Artificial Sequence: Synthetic peptide
DEEEIRTTNPVSTEQYGSVGSNLQGGNQT

SEQ ID NO: 18220 - protein, 28 aa, Artificial Sequence
  Description of Artificial Sequence: Synthetic peptide
DEEEIRTTNPVSTEQYGSVFANLQGGQT

SEQ ID NO: 18221 - protein, 32 aa, Artificial Sequence
  Description of Artificial Sequence: Synthetic polypeptide
DEEEIRTTNPVATEQYGSVTISTNLQDGGGNG

SEQ ID NO: 18222 - protein, 28 aa, Artificial Sequence
  Description of Artificial Sequence: Synthetic peptide
DEEEIRTTNPVSTEQYGSVEFNLQGGQN

SEQ ID NO: 18223 - protein, 31 aa, Artificial Sequence
  Description of Artificial Sequence: Synthetic polypeptide
DEEEIRTTNPVATEQYGSVSPTNEQVMNDRE

SEQ ID NO: 18224 - protein, 32 aa, Artificial Sequence
  Description of Artificial Sequence: Synthetic polypeptide
DEEEIRTTNPVATEQYGSVTISTNLQGGGGNE

SEQ ID NO: 18225 - protein, 28 aa, Artificial Sequence
  Description of Artificial Sequence: Synthetic peptide
YEECISTTNPVATEQYGSVSMNSQRGNS

SEQ ID NO: 18226 - protein, 30 aa, Artificial Sequence
  Description of Artificial Sequence: Synthetic polypeptide
DEAEIRTTNPVATEQYGSCSTDNLQRGEPQ

SEQ ID NO: 18227 - protein, 31 aa, Artificial Sequence
  Description of Artificial Sequence: Synthetic polypeptide
DEEEIRTTNPVAYEAYGSVPSCTNLSQHGNR

SEQ ID NO: 18228 - protein, 30 aa, Artificial Sequence
  Description of Artificial Sequence: Synthetic polypeptide
DEEEIRTTNPVATEQYGSVSNTDQDRGNNE

SEQ ID NO: 18229 - protein, 31 aa, Artificial Sequence
  Description of Artificial Sequence: Synthetic polypeptide
DEEEIRTTNPVATEQYGSVFTTNLQRGLLEI

SEQ ID NO: 18230 - protein, 30 aa, Artificial Sequence
  Description of Artificial Sequence: Synthetic polypeptide
DEEEIRTTNPVATEPYGSVYVTNLTEGGNR

SEQ ID NO: 18231 - protein, 30 aa, Artificial Sequence
  Description of Artificial Sequence: Synthetic polypeptide
DEEEIATTNPVATEQYGSVATNLQVNNNRA

SEQ ID NO: 18232 - protein, 29 aa, Artificial Sequence
  Description of Artificial Sequence: Synthetic peptide
DEEEIATTNPVATEQYGSVATNLQVNNEE

SEQ ID NO: 18233 - protein, 29 aa, Artificial Sequence
  Description of Artificial Sequence: Synthetic peptide
DEEEIRTTNPVATEQYGSVSWNDDQFNNE

SEQ ID NO: 18234 - protein, 31 aa, Artificial Sequence
  Description of Artificial Sequence: Synthetic polypeptide
DEEEIATTNPVATEQYGSVATNLQTVGNDRE

SEQ ID NO: 18235 - protein, 33 aa, Artificial Sequence
  Description of Artificial Sequence: Synthetic polypeptide
DEEEIRTTNPVATEQYGSVSPTNLQEGGEENRM

SEQ ID NO: 18236 - protein, 30 aa, Artificial Sequence
  Description of Artificial Sequence: Synthetic polypeptide
DEEEIRTTNPVATEFYGSVSSTNLEPGNSG

SEQ ID NO: 18237 - protein, 29 aa, Artificial Sequence
  Description of Artificial Sequence: Synthetic peptide
DEEEIATTNPVATEQYGSVATNLQTRPGL

SEQ ID NO: 18238 - protein, 32 aa, Artificial Sequence
  Description of Artificial Sequence: Synthetic polypeptide
TEEEIRTTNPVAYEQYGSVSCTNLSQRPGDNR

SEQ ID NO: 18239 - protein, 31 aa, Artificial Sequence
  Description of Artificial Sequence: Synthetic polypeptide
DEEEIRTTNPVATEQYGSVFTTNLERMGPAR

SEQ ID NO: 18240 - protein, 30 aa, Artificial Sequence
  Description of Artificial Sequence: Synthetic polypeptide
DEEEIATTNPVATEQYGSVATNLQRVGEMN

SEQ ID NO: 18241 - protein, 30 aa, Artificial Sequence
  Description of Artificial Sequence: Synthetic polypeptide
DEEEISTTNPVATEQYGSVCSTNLTSGERV

SEQ ID NO: 18242 - protein, 31 aa, Artificial Sequence
  Description of Artificial Sequence: Synthetic polypeptide
DEEEIATTNPVATEQYGSVATNLQRPQENPR

SEQ ID NO: 18243 - protein, 30 aa, Artificial Sequence
  Description of Artificial Sequence: Synthetic polypeptide
DEEEISTTNPVATEQYGSVCSTNLQSGEAI

SEQ ID NO: 18244 - protein, 31 aa, Artificial Sequence
  Description of Artificial Sequence: Synthetic polypeptide
DEEEIATTNPVATEQYGSVATNLQRPGEQRE

SEQ ID NO: 18245 - protein, 33 aa, Artificial Sequence
  Description of Artificial Sequence: Synthetic polypeptide
DEEEIRTTNPVATEQYGSVSPTNLQEARGQLRD

SEQ ID NO: 18246 - protein, 30 aa, Artificial Sequence
  Description of Artificial Sequence: Synthetic polypeptide
DEEEIRTTNPVATEQYGSVSWNHQNTSNRN

SEQ ID NO: 18247 - protein, 30 aa, Artificial Sequence
  Description of Artificial Sequence: Synthetic polypeptide
DEEEIATTNPVATEQYGSVATNLQRNNMDS

SEQ ID NO: 18248 - protein, 32 aa, Artificial Sequence
  Description of Artificial Sequence: Synthetic polypeptide
DEEEISTTNPVATEQYGSVCSTNALQRLGSNQ

SEQ ID NO: 18249 - protein, 30 aa, Artificial Sequence
  Description of Artificial Sequence: Synthetic polypeptide
DEEEIRTTNPVATEQYGSVSPTNLQDNLMS

SEQ ID NO: 18250 - protein, 31 aa, Artificial Sequence
  Description of Artificial Sequence: Synthetic polypeptide
DEEEIRTTNPVATEQYGSVSPTNLQDNGMTG

SEQ ID NO: 18251 - protein, 32 aa, Artificial Sequence
  Description of Artificial Sequence: Synthetic polypeptide
DEEEIATTNPVATEQYGSVATNLQRVGEENRE

SEQ ID NO: 18252 - protein, 30 aa, Artificial Sequence
  Description of Artificial Sequence: Synthetic polypeptide
DEEEIRTTNPVATEPYGTVCATNLTRGGNR

SEQ ID NO: 18253 - protein, 31 aa, Artificial Sequence
  Description of Artificial Sequence: Synthetic polypeptide
DEEEIRTTNPVATEQYGSVSPTNLQGGSMED

SEQ ID NO: 18254 - protein, 32 aa, Artificial Sequence
  Description of Artificial Sequence: Synthetic polypeptide
DEEEIRTTNPVATEQYGSVSPTNLQHGQNQGM

SEQ ID NO: 18255 - protein, 33 aa, Artificial Sequence
  Description of Artificial Sequence: Synthetic polypeptide
DEEEIRTTNPVATEQYGSVVSTQNELSQRGGNG

SEQ ID NO: 18256 - protein, 30 aa, Artificial Sequence
  Description of Artificial Sequence: Synthetic polypeptide
DEEEISTTNPVATEQYGSVSNTNLQNFGEQ

SEQ ID NO: 18257 - protein, 31 aa, Artificial Sequence
  Description of Artificial Sequence: Synthetic polypeptide
DEEEISTTNPVATEQYGSVSNTELQSIGSNR

SEQ ID NO: 18258 - protein, 28 aa, Artificial Sequence
  Description of Artificial Sequence: Synthetic peptide
DEEEIRTTNPVATEQYGSVSPNDQGDEE

SEQ ID NO: 18259 - protein, 31 aa, Artificial Sequence
  Description of Artificial Sequence: Synthetic polypeptide
DEEEIRTTNPVATEQYGSVVSTPNVHQRGLL

SEQ ID NO: 18260 - protein, 31 aa, Artificial Sequence
  Description of Artificial Sequence: Synthetic polypeptide
DEEEIRTTNPVAWEQYGCVSTGNLQRGSDRG

SEQ ID NO: 18261 - protein, 32 aa, Artificial Sequence
  Description of Artificial Sequence: Synthetic polypeptide
DEEEISTTNPVATEQYGSVSMTNLQRFGSNLL

SEQ ID NO: 18262 - protein, 29 aa, Artificial Sequence
  Description of Artificial Sequence: Synthetic peptide
DEEEIRTTNPVATEQWGSVSTVNHERGEQ

SEQ ID NO: 18263 - protein, 31 aa, Artificial Sequence
  Description of Artificial Sequence: Synthetic polypeptide
DEEEISTTNPVATEQYGSVSMTNLQGFGNQV

SEQ ID NO: 18264 - protein, 31 aa, Artificial Sequence
  Description of Artificial Sequence: Synthetic polypeptide
DEEEISTTNPVATEQYGSVSMSNLQNGSNRT

SEQ ID NO: 18265 - protein, 30 aa, Artificial Sequence
  Description of Artificial Sequence: Synthetic polypeptide
DEEEIRTTNPVATEQYGSVFTNLSQSDVNA

SEQ ID NO: 18266 - protein, 30 aa, Artificial Sequence
  Description of Artificial Sequence: Synthetic polypeptide
DEEEISTTNPVATEQYGSVSLSFNLQRVNI

SEQ ID NO: 18267 - protein, 32 aa, Artificial Sequence
  Description of Artificial Sequence: Synthetic polypeptide
TEEEIRTTNPVAYEQYGSVPSTNMLQRVGNRA

SEQ ID NO: 18268 - protein, 30 aa, Artificial Sequence
  Description of Artificial Sequence: Synthetic polypeptide
DEEEIRTTNPVATEQWGSVSTPDQRGNTDD

SEQ ID NO: 18269 - protein, 32 aa, Artificial Sequence
  Description of Artificial Sequence: Synthetic polypeptide
DEEEIRTTNPVATEQYGSVSPTNLQIGVTENT

SEQ ID NO: 18270 - protein, 31 aa, Artificial Sequence
  Description of Artificial Sequence: Synthetic polypeptide
DEEEISTTNPVATEQYGSVSCTNLQHGSNDD

SEQ ID NO: 18271 - protein, 31 aa, Artificial Sequence
  Description of Artificial Sequence: Synthetic polypeptide
DEEEIRTTNPVATEFYGSVSTDNLQVEMGNA

SEQ ID NO: 18272 - protein, 31 aa, Artificial Sequence
  Description of Artificial Sequence: Synthetic polypeptide
DEEEIRTTNPVATEFYGSVSTDNLQEGNETE

SEQ ID NO: 18273 - protein, 30 aa, Artificial Sequence
  Description of Artificial Sequence: Synthetic polypeptide
DEEEISTTNPVATEQYGSVPTNHEQRGDRN

SEQ ID NO: 18274 - protein, 31 aa, Artificial Sequence
  Description of Artificial Sequence: Synthetic polypeptide
DEEEIRTTNPVATEPYGSVWQNLSQRGGNNR

SEQ ID NO: 18275 - protein, 30 aa, Artificial Sequence
  Description of Artificial Sequence: Synthetic polypeptide
DEEEIRTTNPVATEQYGSVSWMNLQTGVIQ

SEQ ID NO: 18276 - protein, 31 aa, Artificial Sequence
  Description of Artificial Sequence: Synthetic polypeptide
DEEEIRTTNPVATEQYGSVSPTNLQIAFAGN

SEQ ID NO: 18277 - protein, 32 aa, Artificial Sequence
  Description of Artificial Sequence: Synthetic polypeptide
DEEEISTTNPVATEQYGSVSITNDLQRFGSNQ

SEQ ID NO: 18278 - protein, 31 aa, Artificial Sequence
  Description of Artificial Sequence: Synthetic polypeptide
TEEEIRTTNPVAYEQYGSVSCTVELQRGNNR

SEQ ID NO: 18279 - protein, 31 aa, Artificial Sequence
  Description of Artificial Sequence: Synthetic polypeptide
DEEEIATTNPVATEQYGSVATNLQREGDTRY

SEQ ID NO: 18280 - protein, 31 aa, Artificial Sequence
  Description of Artificial Sequence: Synthetic polypeptide
DEEEIRTTNPVATEQYGSVSPTNLQDGLPIL

SEQ ID NO: 18281 - protein, 32 aa, Artificial Sequence
  Description of Artificial Sequence: Synthetic polypeptide
DEEEISTTNPVATEQYGSQVCSTNDQRGSNRD

SEQ ID NO: 18282 - protein, 30 aa, Artificial Sequence
  Description of Artificial Sequence: Synthetic polypeptide
TEEEIRTTNPVAYEQYGSVSTNLSQRTPNV

SEQ ID NO: 18283 - protein, 28 aa, Artificial Sequence
  Description of Artificial Sequence: Synthetic peptide
DEEAIRTTNPVATEQYGSVSTHELRGQE

SEQ ID NO: 18284 - protein, 30 aa, Artificial Sequence
  Description of Artificial Sequence: Synthetic polypeptide
DEEEISTTNPVATEQYGSAVSTNPQRPSNM

SEQ ID NO: 18285 - protein, 32 aa, Artificial Sequence
  Description of Artificial Sequence: Synthetic polypeptide
DEEEISTTNPVATEQYGQSVSTNLQSGSNTRF

SEQ ID NO: 18286 - protein, 31 aa, Artificial Sequence
  Description of Artificial Sequence: Synthetic polypeptide
DEEEISTTNPVATEQYGQSVSTNLQRISETR

SEQ ID NO: 18287 - protein, 31 aa, Artificial Sequence
  Description of Artificial Sequence: Synthetic polypeptide
TEEEIRTTNPVAYEQYGSVSTNMAQRGTNNR

SEQ ID NO: 18288 - protein, 31 aa, Artificial Sequence
  Description of Artificial Sequence: Synthetic polypeptide
DEEEISTTNPVATEQYGQSVSTNLQAGSNQD

SEQ ID NO: 18289 - protein, 32 aa, Artificial Sequence
  Description of Artificial Sequence: Synthetic polypeptide
DEEEISTTNPVATEQYGQSVSTNLQAGSNNRS

SEQ ID NO: 18290 - protein, 32 aa, Artificial Sequence
  Description of Artificial Sequence: Synthetic polypeptide
DEEEISTTNPVATEQYGQSVSTMNLQRGSDRT

SEQ ID NO: 18291 - protein, 29 aa, Artificial Sequence
  Description of Artificial Sequence: Synthetic peptide
DEEEISTTNPVATEQYGSVATNLQAPNEN

SEQ ID NO: 18292 - protein, 32 aa, Artificial Sequence
  Description of Artificial Sequence: Synthetic polypeptide
DEEEISTTNPVATEQYGQSVSTMNLQGGSNRF

SEQ ID NO: 18293 - protein, 31 aa, Artificial Sequence
  Description of Artificial Sequence: Synthetic polypeptide
DEEEIRTTNPVATEQYGSVSWNLQEREGSPQ

SEQ ID NO: 18294 - protein, 29 aa, Artificial Sequence
  Description of Artificial Sequence: Synthetic peptide
DEEEIRTTNPVAWEQYGSVWTNLQHFDDR

SEQ ID NO: 18295 - protein, 31 aa, Artificial Sequence
  Description of Artificial Sequence: Synthetic polypeptide
DEEEISTTNPVATEQYGQSVCSWNLQRGSNA

SEQ ID NO: 18296 - protein, 31 aa, Artificial Sequence
  Description of Artificial Sequence: Synthetic polypeptide
DEEEIRTTNPVATEQYGSVSWNLQFFGNNDS

SEQ ID NO: 18297 - protein, 29 aa, Artificial Sequence
  Description of Artificial Sequence: Synthetic peptide
DEEEIRTTNPVATEQYGSVSWNLQGEELE

SEQ ID NO: 18298 - protein, 29 aa, Artificial Sequence
  Description of Artificial Sequence: Synthetic peptide
DEEEIRTTNPVAWEQYGSVWTNLQHTDSR

SEQ ID NO: 18299 - protein, 32 aa, Artificial Sequence
  Description of Artificial Sequence: Synthetic polypeptide
DEEEIRTTNPVATEPYGVSVSTFNLQDRIKNR

SEQ ID NO: 18300 - protein, 31 aa, Artificial Sequence
  Description of Artificial Sequence: Synthetic polypeptide
DEEEIATTNPVATEQYGSVATNLQQGPNQRD

SEQ ID NO: 18301 - protein, 31 aa, Artificial Sequence
  Description of Artificial Sequence: Synthetic polypeptide
DEEEIRTTNPVATEQYGSVSWNLQQGPNPDQ

SEQ ID NO: 18302 - protein, 30 aa, Artificial Sequence
  Description of Artificial Sequence: Synthetic polypeptide
DEEEIRTTNPVATEQYGSVSWNLQQGPVAD

SEQ ID NO: 18303 - protein, 30 aa, Artificial Sequence
  Description of Artificial Sequence: Synthetic polypeptide
DEEEIRTTNPVATEFYGSVSNGNLQQQGNV

SEQ ID NO: 18304 - protein, 31 aa, Artificial Sequence
  Description of Artificial Sequence: Synthetic polypeptide
DEEEISTTNPVATEQYGSVATNLQFGENDRE

SEQ ID NO: 18305 - protein, 31 aa, Artificial Sequence
  Description of Artificial Sequence: Synthetic polypeptide
DEEAIRTTNPVATEQYGSVSTMNHQRGSNQF

SEQ ID NO: 18306 - protein, 32 aa, Artificial Sequence
  Description of Artificial Sequence: Synthetic polypeptide
TEEEIRTTNPVAYEQYGSVSTNLSQIRVGNRD

SEQ ID NO: 18307 - protein, 30 aa, Artificial Sequence
  Description of Artificial Sequence: Synthetic polypeptide
DEEEIATTNPVATEQYGSVATNLQRDSNEQ

SEQ ID NO: 18308 - protein, 32 aa, Artificial Sequence
  Description of Artificial Sequence: Synthetic polypeptide
DEEEISTTNPVATEQYGSVCSTEPLQRGGNRS

SEQ ID NO: 18309 - protein, 31 aa, Artificial Sequence
  Description of Artificial Sequence: Synthetic polypeptide
DEEEIRTTNPVATEQYGSVSPNGQRNGNVID

SEQ ID NO: 18310 - protein, 32 aa, Artificial Sequence
  Description of Artificial Sequence: Synthetic polypeptide
DEEEIRTTNPVATEQWGSVSTNLSQRPGGNEN

SEQ ID NO: 18311 - protein, 31 aa, Artificial Sequence
  Description of Artificial Sequence: Synthetic polypeptide
DEEEISTTNPVATEQYGSVCSTELQRFGSNF

SEQ ID NO: 18312 - protein, 31 aa, Artificial Sequence
  Description of Artificial Sequence: Synthetic polypeptide
DEEEIRTTNPVATEQYGSVSPTNLQDDQNGE

SEQ ID NO: 18313 - protein, 30 aa, Artificial Sequence
  Description of Artificial Sequence: Synthetic polypeptide
DEEEIATTNPVATEQYGSVATNLQRDGQEE

SEQ ID NO: 18314 - protein, 32 aa, Artificial Sequence
  Description of Artificial Sequence: Synthetic polypeptide
DEEEIRTTNPVATEQYGSVSPTNLQALGPERL

SEQ ID NO: 18315 - protein, 29 aa, Artificial Sequence
  Description of Artificial Sequence: Synthetic peptide
DEEEIRTTNPVATEQYGSVSWNLEGSEFR

SEQ ID NO: 18316 - protein, 31 aa, Artificial Sequence
  Description of Artificial Sequence: Synthetic polypeptide
DEEAIRTTNPVATEQYGSVSTMNLQNGSNDF

SEQ ID NO: 18317 - protein, 31 aa, Artificial Sequence
  Description of Artificial Sequence: Synthetic polypeptide
DEEEISTTNPVATEQYGSVCSSNLERGSNPR

SEQ ID NO: 18318 - protein, 32 aa, Artificial Sequence
  Description of Artificial Sequence: Synthetic polypeptide
DEEEIATTNPVATEQYGSVATNLQRAGPNPRE

SEQ ID NO: 18319 - protein, 28 aa, Artificial Sequence
  Description of Artificial Sequence: Synthetic peptide
DEEEIRTTNPVATEQYGSVSWNLESIDD

SEQ ID NO: 18320 - protein, 30 aa, Artificial Sequence
  Description of Artificial Sequence: Synthetic polypeptide
TEEEIRTTNPVAYEQYGSVSTNELQDGGNV

SEQ ID NO: 18321 - protein, 31 aa, Artificial Sequence
  Description of Artificial Sequence: Synthetic polypeptide
DEEEIATTNPVATEQYGSVATNLQRAGENSF

SEQ ID NO: 18322 - protein, 32 aa, Artificial Sequence
  Description of Artificial Sequence: Synthetic polypeptide
DEEEISTTNPVATEQYGSVCSMTMNDLQRGDR

SEQ ID NO: 18323 - protein, 31 aa, Artificial Sequence
  Description of Artificial Sequence: Synthetic polypeptide
DEEEISTTNPVATEQYGSVATNLQVGDNDRD

SEQ ID NO: 18324 - protein, 28 aa, Artificial Sequence
  Description of Artificial Sequence: Synthetic peptide
DDSEIRCTNPVSTEQYGSVSNNLQRGQR

SEQ ID NO: 18325 - protein, 29 aa, Artificial Sequence
  Description of Artificial Sequence: Synthetic peptide
TEEEIRTTNPVAYEQYGSVSTNHSQSGNG

SEQ ID NO: 18326 - protein, 30 aa, Artificial Sequence
  Description of Artificial Sequence: Synthetic polypeptide
DEEEIRTTNPVAWEQYGSVSTNNQHGSNSD

SEQ ID NO: 18327 - protein, 31 aa, Artificial Sequence
  Description of Artificial Sequence: Synthetic polypeptide
DEEEISTTNPVATEQYGSVATNLQRGDNTDD

SEQ ID NO: 18328 - protein, 30 aa, Artificial Sequence
  Description of Artificial Sequence: Synthetic polypeptide
TEEEIRTTNPVAYEQYGSVSTNLQRVANNS

SEQ ID NO: 18329 - protein, 29 aa, Artificial Sequence
  Description of Artificial Sequence: Synthetic peptide
TEEEIRTTNPVAYEQYGSVSTNLSQDENQ

SEQ ID NO: 18330 - protein, 30 aa, Artificial Sequence
  Description of Artificial Sequence: Synthetic polypeptide
DEEEIATTNPVATEQYGSVATNNLQRPEDR

SEQ ID NO: 18331 - protein, 30 aa, Artificial Sequence
  Description of Artificial Sequence: Synthetic polypeptide
DEEEISTTNPVATEQYGSVSNTNLQNGDQE

SEQ ID NO: 18332 - protein, 30 aa, Artificial Sequence
  Description of Artificial Sequence: Synthetic polypeptide
DEEEIRTTNPVATEQYGSVLTNNLQPMGVT

SEQ ID NO: 18333 - protein, 30 aa, Artificial Sequence
  Description of Artificial Sequence: Synthetic polypeptide
DEEEISTTNPVATEQYGSVSNTNLQQGSED

SEQ ID NO: 18334 - protein, 31 aa, Artificial Sequence
  Description of Artificial Sequence: Synthetic polypeptide
DEEEISTTNPVATEQYGSVSTNPLQNFGNND

SEQ ID NO: 18335 - protein, 31 aa, Artificial Sequence
  Description of Artificial Sequence: Synthetic polypeptide
DEEEISTTNPVATEQYGSVSTNLVQSGNEDE

SEQ ID NO: 18336 - protein, 31 aa, Artificial Sequence
  Description of Artificial Sequence: Synthetic polypeptide
DEEEIRTTNPVATEQYGSVSPTNLQQPDIRE

SEQ ID NO: 18337 - protein, 30 aa, Artificial Sequence
  Description of Artificial Sequence: Synthetic polypeptide
DEEEIRTTNPVATEQYGSVVSTTPLGRNNE

SEQ ID NO: 18338 - protein, 31 aa, Artificial Sequence
  Description of Artificial Sequence: Synthetic polypeptide
DEEEIRTTNPVATEQWGSVVSTTLSQSGNNR

SEQ ID NO: 18339 - protein, 32 aa, Artificial Sequence
  Description of Artificial Sequence: Synthetic polypeptide
DEEEISTTNPVATEQYGSVSTNLQVRSGSNQE

SEQ ID NO: 18340 - protein, 31 aa, Artificial Sequence
  Description of Artificial Sequence: Synthetic polypeptide
DEEEISTTNPVATEQYGSVSTNLQSSNSNRI

SEQ ID NO: 18341 - protein, 32 aa, Artificial Sequence
  Description of Artificial Sequence: Synthetic polypeptide
DEEEIRTTNPVATEQYGSVSPTNLQQMGNDPE

SEQ ID NO: 18342 - protein, 30 aa, Artificial Sequence
  Description of Artificial Sequence: Synthetic polypeptide
DEEEISTTNPVATEQYGSVSTNLQSGSEFF

SEQ ID NO: 18343 - protein, 30 aa, Artificial Sequence
  Description of Artificial Sequence: Synthetic polypeptide
DEEEISTTNPVATEQYGSVSTNLQSFSNPQ

SEQ ID NO: 18344 - protein, 29 aa, Artificial Sequence
  Description of Artificial Sequence: Synthetic peptide
DEEEISTTNPVATEQYGSVSTNPQHGDQE

SEQ ID NO: 18345 - protein, 32 aa, Artificial Sequence
  Description of Artificial Sequence: Synthetic polypeptide
DEEEIRTTNPVATEPYGSVVSCTNLVRGGNNR

SEQ ID NO: 18346 - protein, 29 aa, Artificial Sequence
  Description of Artificial Sequence: Synthetic peptide
DEEEIRTTNPVAVEQYGSVVTNLQVNTQR

SEQ ID NO: 18347 - protein, 31 aa, Artificial Sequence
  Description of Artificial Sequence: Synthetic polypeptide
DEEEISTTNPVATEQYGSVSTNLQRSGSEAQ

SEQ ID NO: 18348 - protein, 30 aa, Artificial Sequence
  Description of Artificial Sequence: Synthetic polypeptide
DEEEISTTNPVATEQYGSVSTNLQRPSDQG

SEQ ID NO: 18349 - protein, 31 aa, Artificial Sequence
  Description of Artificial Sequence: Synthetic polypeptide
DEEEIRTTNPVATEQWGSVVSTNMLQSGGNE

SEQ ID NO: 18350 - protein, 33 aa, Artificial Sequence
  Description of Artificial Sequence: Synthetic polypeptide
DEEEIRTTNPVATEQWGSVVSTNELPQRGLNNR

SEQ ID NO: 18351 - protein, 31 aa, Artificial Sequence
  Description of Artificial Sequence: Synthetic polypeptide
DEEEIRTTNPVATEQYGSVMCTNLQRGELVD

SEQ ID NO: 18352 - protein, 30 aa, Artificial Sequence
  Description of Artificial Sequence: Synthetic polypeptide
DEEEIRTTNPVATEQWGSVVSENLQHGNEI

SEQ ID NO: 18353 - protein, 31 aa, Artificial Sequence
  Description of Artificial Sequence: Synthetic polypeptide
DEEEIRTTNPVATEQYGSVSPTNLQQGLEIM

SEQ ID NO: 18354 - protein, 32 aa, Artificial Sequence
  Description of Artificial Sequence: Synthetic polypeptide
DEEEIRTTNPVATEQYGSVSPTNLQQEGSNEE

SEQ ID NO: 18355 - protein, 31 aa, Artificial Sequence
  Description of Artificial Sequence: Synthetic polypeptide
DEEEISTTNPVATEQYGSVSTNLQNFGSENT

SEQ ID NO: 18356 - protein, 28 aa, Artificial Sequence
  Description of Artificial Sequence: Synthetic peptide
DEEEIATTNPVATEQFGEVSELEQRGNR

SEQ ID NO: 18357 - protein, 28 aa, Artificial Sequence
  Description of Artificial Sequence: Synthetic peptide
DEECVRCTNPVATEQYGSVSWNIQRGND

SEQ ID NO: 18358 - protein, 28 aa, Artificial Sequence
  Description of Artificial Sequence: Synthetic peptide
DEEEIRTTNPVATEQWGSYSENLQQENA

SEQ ID NO: 18359 - protein, 32 aa, Artificial Sequence
  Description of Artificial Sequence: Synthetic polypeptide
DEEEIRTTNPVATEQYGSVVSTTVLQRVGEDR

SEQ ID NO: 18360 - protein, 31 aa, Artificial Sequence
  Description of Artificial Sequence: Synthetic polypeptide
DEEEISTTNPVATEQYGSVSWGNHQRGGNPR

SEQ ID NO: 18361 - protein, 29 aa, Artificial Sequence
  Description of Artificial Sequence: Synthetic peptide
DEEEIRTTNPVAVEQYGSVTTNLQDNDQR

SEQ ID NO: 18362 - protein, 31 aa, Artificial Sequence
  Description of Artificial Sequence: Synthetic polypeptide
DEEEISTTNPVATEQYGSVSTYLSQRFGSNA

SEQ ID NO: 18363 - protein, 32 aa, Artificial Sequence
  Description of Artificial Sequence: Synthetic polypeptide
DEEEIRTTNPVATEQYGSVSPTNLQRFPEFRL

SEQ ID NO: 18364 - protein, 31 aa, Artificial Sequence
  Description of Artificial Sequence: Synthetic polypeptide
DEEEIRTTNPVATEQYGSVQGPTNLERVNRY

SEQ ID NO: 18365 - protein, 31 aa, Artificial Sequence
  Description of Artificial Sequence: Synthetic polypeptide
DEEEIRTTNPVATEQYGSVSNTENLQNGDQS

SEQ ID NO: 18366 - protein, 29 aa, Artificial Sequence
  Description of Artificial Sequence: Synthetic peptide
DEEEIRTTNPVAVEQYGSVVTNLQENDTR

SEQ ID NO: 18367 - protein, 31 aa, Artificial Sequence
  Description of Artificial Sequence: Synthetic polypeptide
DEEEIRTTNPVATEQYGSVSPTNLQRELIQE

SEQ ID NO: 18368 - protein, 30 aa, Artificial Sequence
  Description of Artificial Sequence: Synthetic polypeptide
DEEEISTTNPVATEQYGSVSTVHQRMGSNG

SEQ ID NO: 18369 - protein, 32 aa, Artificial Sequence
  Description of Artificial Sequence: Synthetic polypeptide
DEEEIRTTNPVATEQYGSVSPTNLQREEEQNC

SEQ ID NO: 18370 - protein, 30 aa, Artificial Sequence
  Description of Artificial Sequence: Synthetic polypeptide
DEEEISTTNPVATEQYGSVSTPLQQFGSNQ

SEQ ID NO: 18371 - protein, 30 aa, Artificial Sequence
  Description of Artificial Sequence: Synthetic polypeptide
DEEEISTTNPVATEQYGSVSTPHQRFGNNQ

SEQ ID NO: 18372 - protein, 29 aa, Artificial Sequence
  Description of Artificial Sequence: Synthetic peptide
DEEEIRTTNPVATEQWGTNVSTALDRGNT

SEQ ID NO: 18373 - protein, 32 aa, Artificial Sequence
  Description of Artificial Sequence: Synthetic polypeptide
DEEEISTTNPVATEQYGSVSTNTQERSGSNRE

SEQ ID NO: 18374 - protein, 32 aa, Artificial Sequence
  Description of Artificial Sequence: Synthetic polypeptide
DEEEISTTNPVATEQYGSVSTNSLFQVRGENQ

SEQ ID NO: 18375 - protein, 31 aa, Artificial Sequence
  Description of Artificial Sequence: Synthetic polypeptide
DEEEIRTTNPVATEQYGSVSPTNLQRDPETE

SEQ ID NO: 18376 - protein, 32 aa, Artificial Sequence
  Description of Artificial Sequence: Synthetic polypeptide
DEEEIRTTNPVATEQYGSVVSTVDLQRFGERT

SEQ ID NO: 18377 - protein, 29 aa, Artificial Sequence
  Description of Artificial Sequence: Synthetic peptide
DEEEIATTNPVATEQYGSVATNPQENGNQ

SEQ ID NO: 18378 - protein, 29 aa, Artificial Sequence
  Description of Artificial Sequence: Synthetic peptide
DEEEIRTTNPVAVEQYGSVVTNLQLSDQR

SEQ ID NO: 18379 - protein, 31 aa, Artificial Sequence
  Description of Artificial Sequence: Synthetic polypeptide
DEEEISTTNPVATEQYGSVSTNSLEQVRGIF

SEQ ID NO: 18380 - protein, 31 aa, Artificial Sequence
  Description of Artificial Sequence: Synthetic polypeptide
DEEEISTTNPVATEQYGSVSTNQLQETEGNL

SEQ ID NO: 18381 - protein, 31 aa, Artificial Sequence
  Description of Artificial Sequence: Synthetic polypeptide
DEEEISTTNPVATEQYGSVSTNQLQEGMGNE

SEQ ID NO: 18382 - protein, 31 aa, Artificial Sequence
  Description of Artificial Sequence: Synthetic polypeptide
DEEEIRTTNPVATEQYGSVSVYNLQNTGNQQ

SEQ ID NO: 18383 - protein, 31 aa, Artificial Sequence
  Description of Artificial Sequence: Synthetic polypeptide
DEEEIRTTNPVATEQYGSVLVTNGLQTGNEN

SEQ ID NO: 18384 - protein, 32 aa, Artificial Sequence
  Description of Artificial Sequence: Synthetic polypeptide
TEEEIRTTNPVAYEQYGSVVSATNLSQRGGNR

SEQ ID NO: 18385 - protein, 32 aa, Artificial Sequence
  Description of Artificial Sequence: Synthetic polypeptide
DEEEIRTTNPVATEPYGSVVSTNELSGRGGNR

SEQ ID NO: 18386 - protein, 30 aa, Artificial Sequence
  Description of Artificial Sequence: Synthetic polypeptide
DEEEISTTNPVATEQYGSVSTNLQGSNNDE

SEQ ID NO: 18387 - protein, 32 aa, Artificial Sequence
  Description of Artificial Sequence: Synthetic polypeptide
DEEEIRTTNPVATEPYGSVVSTNLSQRPGGNI

SEQ ID NO: 18388 - protein, 31 aa, Artificial Sequence
  Description of Artificial Sequence: Synthetic polypeptide
DEEEISTTNPVATEQYGSVSTGNTLQDMGER

SEQ ID NO: 18389 - protein, 32 aa, Artificial Sequence
  Description of Artificial Sequence: Synthetic polypeptide
DEEEIRTTNPVATEPYGSVVSTPLSQRGGSNR

SEQ ID NO: 18390 - protein, 33 aa, Artificial Sequence
  Description of Artificial Sequence: Synthetic polypeptide
DEEEIRTTNPVATEQYGSVSPTNLQMREGNQEG

SEQ ID NO: 18391 - protein, 30 aa, Artificial Sequence
  Description of Artificial Sequence: Synthetic polypeptide
DEEEISTTNPVATEQYGSVSTELQSSNNRS

SEQ ID NO: 18392 - protein, 31 aa, Artificial Sequence
  Description of Artificial Sequence: Synthetic polypeptide
DEEEIRTTNPVATEQYGSVSWGLQQGVNQRI

SEQ ID NO: 18393 - protein, 29 aa, Artificial Sequence
  Description of Artificial Sequence: Synthetic peptide
DEEEIRTTNPVATEQYGSVSWGLQVGDVM

SEQ ID NO: 18394 - protein, 31 aa, Artificial Sequence
  Description of Artificial Sequence: Synthetic polypeptide
DEEEIRTTNPVATEQYGSVSWGNTQRGSERY

SEQ ID NO: 18395 - protein, 31 aa, Artificial Sequence
  Description of Artificial Sequence: Synthetic polypeptide
DEEEIRTTNPVATEQYGSVSWINLQRGLDVE

SEQ ID NO: 18396 - protein, 31 aa, Artificial Sequence
  Description of Artificial Sequence: Synthetic polypeptide
DEEEIRTTNPVATEQWGSVSVSGNLQRVGNQ

SEQ ID NO: 18397 - protein, 31 aa, Artificial Sequence
  Description of Artificial Sequence: Synthetic polypeptide
DEEEISTTNPVATEQYGSVSTMPLQHFGSNR

SEQ ID NO: 18398 - protein, 30 aa, Artificial Sequence
  Description of Artificial Sequence: Synthetic polypeptide
DEEEISTTNPVATEQYGSVSTEDLQRGSVQ

SEQ ID NO: 18399 - protein, 30 aa, Artificial Sequence
  Description of Artificial Sequence: Synthetic polypeptide
DEEEIRTTNPVATEQYGSVSPNADQQINER

SEQ ID NO: 18400 - protein, 31 aa, Artificial Sequence
  Description of Artificial Sequence: Synthetic polypeptide
DEEEISTTNPVATEQYGSVSTALQRMGSNAA

SEQ ID NO: 18401 - protein, 30 aa, Artificial Sequence
  Description of Artificial Sequence: Synthetic polypeptide
DEEEISTTNPVATEQYGSVSTALQERGSDQ

SEQ ID NO: 18402 - protein, 32 aa, Artificial Sequence
  Description of Artificial Sequence: Synthetic polypeptide
DEEEIRTTNPVATEQYGSVSNTENLQGGSNQS

SEQ ID NO: 18403 - protein, 28 aa, Artificial Sequence
  Description of Artificial Sequence: Synthetic peptide
DEEEIRTTNPVAVEVYGVCSTNLEMGNR

SEQ ID NO: 18404 - protein, 31 aa, Artificial Sequence
  Description of Artificial Sequence: Synthetic polypeptide
DEEEIRTTNPVATEQYGSVSALPLQRGVQND

SEQ ID NO: 18405 - protein, 30 aa, Artificial Sequence
  Description of Artificial Sequence: Synthetic polypeptide
DEEEISTTNPVATEQYGSVSSNLQYFGSDR

SEQ ID NO: 18406 - protein, 31 aa, Artificial Sequence
  Description of Artificial Sequence: Synthetic polypeptide
DEEEIRTTNPVAWEHYGSVCSTTNLQRGNED

SEQ ID NO: 18407 - protein, 29 aa, Artificial Sequence
  Description of Artificial Sequence: Synthetic peptide
DEEEIRTTNPVATEQYGSVSPNDQAREDE

SEQ ID NO: 18408 - protein, 31 aa, Artificial Sequence
  Description of Artificial Sequence: Synthetic polypeptide
DEEEIRTTNPVATEQYGSVSPTNLQLFLVRD

SEQ ID NO: 18409 - protein, 30 aa, Artificial Sequence
  Description of Artificial Sequence: Synthetic polypeptide
DEEEISTTNPVATEQYGSVSTDHQRMGSNA

SEQ ID NO: 18410 - protein, 32 aa, Artificial Sequence
  Description of Artificial Sequence: Synthetic polypeptide
DEEEIRTTNPVATEQWGSVSYTGNLSQRTENR

SEQ ID NO: 18411 - protein, 31 aa, Artificial Sequence
  Description of Artificial Sequence: Synthetic polypeptide
DEEEIRTTNPVATEQYGSVSWENLQNTSNRS

SEQ ID NO: 18412 - protein, 32 aa, Artificial Sequence
  Description of Artificial Sequence: Synthetic polypeptide
DEEEISTTNPVATEQYGSVSTNDLQRGGSEPR

SEQ ID NO: 18413 - protein, 28 aa, Artificial Sequence
  Description of Artificial Sequence: Synthetic peptide
DEECVRTTNPCAVEQYGTVSTNLQRGDR

SEQ ID NO: 18414 - protein, 32 aa, Artificial Sequence
  Description of Artificial Sequence: Synthetic polypeptide
DEEEISTTNPVATEQYGSVSTNLQFLGSNNRE

SEQ ID NO: 18415 - protein, 30 aa, Artificial Sequence
  Description of Artificial Sequence: Synthetic polypeptide
DEEEISTTNPVATEQYGSVSTNLQESGEQP

SEQ ID NO: 18416 - protein, 30 aa, Artificial Sequence
  Description of Artificial Sequence: Synthetic polypeptide
DEEEISTTNPVATEQYGSVSTNLQENSNQS

SEQ ID NO: 18417 - protein, 32 aa, Artificial Sequence
  Description of Artificial Sequence: Synthetic polypeptide
DEEEISTTNPVATEQYGSVSTNLQEHGSNTRM

SEQ ID NO: 18418 - protein, 30 aa, Artificial Sequence
  Description of Artificial Sequence: Synthetic polypeptide
DEEEISTTNPVATEQYGSVSTNLQAGGSDQ

SEQ ID NO: 18419 - protein, 33 aa, Artificial Sequence
  Description of Artificial Sequence: Synthetic polypeptide
DEEEIRTTNPVATEQYGSVSPTNLQNRSGLNIV

SEQ ID NO: 18420 - protein, 31 aa, Artificial Sequence
  Description of Artificial Sequence: Synthetic polypeptide
TEEEIRTTNPVAYEQYGSVATNLSQRGGNRE

SEQ ID NO: 18421 - protein, 30 aa, Artificial Sequence
  Description of Artificial Sequence: Synthetic polypeptide
DEEEIRTTNPVATEQYGSVLTVDLQRGEDM

SEQ ID NO: 18422 - protein, 33 aa, Artificial Sequence
  Description of Artificial Sequence: Synthetic polypeptide
DEEEIRTTNPVATEQYGSVSPTNLQNRGLNLVD

SEQ ID NO: 18423 - protein, 31 aa, Artificial Sequence
  Description of Artificial Sequence: Synthetic polypeptide
DEEEISTTNPVATEQYGSVSTNLFQHGSNIV

SEQ ID NO: 18424 - protein, 32 aa, Artificial Sequence
  Description of Artificial Sequence: Synthetic polypeptide
DEEEIRTTNPVATEQYGSVSPTNLQNRGLHEV

SEQ ID NO: 18425 - protein, 29 aa, Artificial Sequence
  Description of Artificial Sequence: Synthetic peptide
DEEEISTTNPVATEQYGSVSTNLENFGDQ

SEQ ID NO: 18426 - protein, 30 aa, Artificial Sequence
  Description of Artificial Sequence: Synthetic polypeptide
DEEEISTTNPVATEQYGSVSTNLARPSNDG

SEQ ID NO: 18427 - protein, 30 aa, Artificial Sequence
  Description of Artificial Sequence: Synthetic polypeptide
DEEEISTTNPVATEQYGSVSTNLAHGSNLS

SEQ ID NO: 18428 - protein, 29 aa, Artificial Sequence
  Description of Artificial Sequence: Synthetic peptide
DEEEISTTNPVATEQYGSVSTNHTRGEQG

SEQ ID NO: 18429 - protein, 32 aa, Artificial Sequence
  Description of Artificial Sequence: Synthetic polypeptide
DEEEIRTTNPVATEQYGSVSPTNLQNRFEQRQ

SEQ ID NO: 18430 - protein, 29 aa, Artificial Sequence
  Description of Artificial Sequence: Synthetic peptide
DEEEIRTTNPVAVEQYGSVWTNLQVEISR

SEQ ID NO: 18431 - protein, 30 aa, Artificial Sequence
  Description of Artificial Sequence: Synthetic polypeptide
DEEEIRTTNPVATEQYGSVSWELQEHGSNQ

SEQ ID NO: 18432 - protein, 30 aa, Artificial Sequence
  Description of Artificial Sequence: Synthetic polypeptide
DEEEISTTNPVATEQYGSVSTNGTQYGQRS

SEQ ID NO: 18433 - protein, 32 aa, Artificial Sequence
  Description of Artificial Sequence: Synthetic polypeptide
DEEEIRTTNPVATEQYGSVSPTNLQNGVNLTQ

SEQ ID NO: 18434 - protein, 31 aa, Artificial Sequence
  Description of Artificial Sequence: Synthetic polypeptide
DEEEIRTTNPVATEQYGSVSWELQRSGSNTQ

SEQ ID NO: 18435 - protein, 30 aa, Artificial Sequence
  Description of Artificial Sequence: Synthetic polypeptide
DEEEIRTTNPVATEQYGSVSWELQYGSNQA

SEQ ID NO: 18436 - protein, 29 aa, Artificial Sequence
  Description of Artificial Sequence: Synthetic peptide
AEEEICTTNPVATEQYGSVSTNLQHGETP

SEQ ID NO: 18437 - protein, 30 aa, Artificial Sequence
  Description of Artificial Sequence: Synthetic polypeptide
DEEEIRTTNPVGTEQYGSVSTNFLGRGDDP

SEQ ID NO: 18438 - protein, 31 aa, Artificial Sequence
  Description of Artificial Sequence: Synthetic polypeptide
DEEEIATTNPVATEQYGSVATNLQQGDNSRM

SEQ ID NO: 18439 - protein, 29 aa, Artificial Sequence
  Description of Artificial Sequence: Synthetic peptide
DEEEIRTTNPVAWEQYGSVWTNVQVGDSR

SEQ ID NO: 18440 - protein, 31 aa, Artificial Sequence
  Description of Artificial Sequence: Synthetic polypeptide
DEEEISTTNPVATEEYGSVSTNDLQNGSNRD

SEQ ID NO: 18441 - protein, 30 aa, Artificial Sequence
  Description of Artificial Sequence: Synthetic polypeptide
DEEEISTTNPVATEEYGQSVSTNLQGFGNQ

SEQ ID NO: 18442 - protein, 30 aa, Artificial Sequence
  Description of Artificial Sequence: Synthetic polypeptide
DEEEISTTNPVATECYGSVSTNLERGSNTP

SEQ ID NO: 18443 - protein, 30 aa, Artificial Sequence
  Description of Artificial Sequence: Synthetic polypeptide
DEEEIRTTNPVATEQFGDTSVSTQLTRGNS

SEQ ID NO: 18444 - protein, 32 aa, Artificial Sequence
  Description of Artificial Sequence: Synthetic polypeptide
DEEEIRTTNPVATEQYGSVSPTNLIQPPDPNR

SEQ ID NO: 18445 - protein, 33 aa, Artificial Sequence
  Description of Artificial Sequence: Synthetic polypeptide
DEEEIRTTNPVATEQYGSVVSTNLSQRGGNNQN

SEQ ID NO: 18446 - protein, 30 aa, Artificial Sequence
  Description of Artificial Sequence: Synthetic polypeptide
AEEEIATTNPVATEQYGSVSTNLQNGPNDN

SEQ ID NO: 18447 - protein, 30 aa, Artificial Sequence
  Description of Artificial Sequence: Synthetic polypeptide
AEEEIATTNPVATEQYGSVSTNLQMGDNES

SEQ ID NO: 18448 - protein, 29 aa, Artificial Sequence
  Description of Artificial Sequence: Synthetic peptide
DEEEIRTTNPVATEQYGSVSYGDQNGERV

SEQ ID NO: 18449 - protein, 32 aa, Artificial Sequence
  Description of Artificial Sequence: Synthetic polypeptide
DEEEIRTTNPVATEQYGSVSPTNLHQEGNEID

SEQ ID NO: 18450 - protein, 30 aa, Artificial Sequence
  Description of Artificial Sequence: Synthetic polypeptide
AEEEIATTNPVATEQYGSVSTNLQREGPMV

SEQ ID NO: 18451 - protein, 30 aa, Artificial Sequence
  Description of Artificial Sequence: Synthetic polypeptide
DEEEIATTNPVATEQYGSVATNLDQEAGND

SEQ ID NO: 18452 - protein, 31 aa, Artificial Sequence
  Description of Artificial Sequence: Synthetic polypeptide
AEEEIATTNPVATEQYGSVSTNLQGGGENNR

SEQ ID NO: 18453 - protein, 30 aa, Artificial Sequence
  Description of Artificial Sequence: Synthetic polypeptide
AEEEIATTNPVATEQYGSVSTNLQGGENDQ

SEQ ID NO: 18454 - protein, 30 aa, Artificial Sequence
  Description of Artificial Sequence: Synthetic polypeptide
AEEEIATTNPVATEQYGSVSTNLQGGEGNA

SEQ ID NO: 18455 - protein, 28 aa, Artificial Sequence
  Description of Artificial Sequence: Synthetic peptide
DEEEIATTNPVATEQYGSVATNLDPANE

SEQ ID NO: 18456 - protein, 29 aa, Artificial Sequence
  Description of Artificial Sequence: Synthetic peptide
AEEEIATTNPVATEQYGSVSTNLQEGGED

SEQ ID NO: 18457 - protein, 30 aa, Artificial Sequence
  Description of Artificial Sequence: Synthetic polypeptide
DEEEISCTNPVATEQYGSVSTNLQSGSNQG

SEQ ID NO: 18458 - protein, 32 aa, Artificial Sequence
  Description of Artificial Sequence: Synthetic polypeptide
DEEEIRTTNPVATEQYGSVSPTNLHERGGEDR

SEQ ID NO: 18459 - protein, 28 aa, Artificial Sequence
  Description of Artificial Sequence: Synthetic peptide
DEEEISATNPVATEQYGSVSTDDQRGDE

SEQ ID NO: 18460 - protein, 28 aa, Artificial Sequence
  Description of Artificial Sequence: Synthetic peptide
DEEEISATNPVATEQYGSVDTELQRGEF

SEQ ID NO: 18461 - protein, 29 aa, Artificial Sequence
  Description of Artificial Sequence: Synthetic peptide
DEEEIAATNPVATEQYGSVSTGNLEQGDR

SEQ ID NO: 18462 - protein, 30 aa, Artificial Sequence
  Description of Artificial Sequence: Synthetic polypeptide
AEEEIATTNPVATEQYGSVSTNLQGGNPEQ

SEQ ID NO: 18463 - protein, 30 aa, Artificial Sequence
  Description of Artificial Sequence: Synthetic polypeptide
DEEEIRYTNPVATEQYGSVSWNQDRGPNSR

SEQ ID NO: 18464 - protein, 31 aa, Artificial Sequence
  Description of Artificial Sequence: Synthetic polypeptide
DEEEIRTTNPVATEQYGSVSYENLQESEGER

SEQ ID NO: 18465 - protein, 29 aa, Artificial Sequence
  Description of Artificial Sequence: Synthetic peptide
AEEEIATTNPVATEQYGSVSTNLQSGEQP

SEQ ID NO: 18466 - protein, 30 aa, Artificial Sequence
  Description of Artificial Sequence: Synthetic polypeptide
DEEEIRTTNPVATEQWGSVSTNDSQGGGNS

SEQ ID NO: 18467 - protein, 29 aa, Artificial Sequence
  Description of Artificial Sequence: Synthetic peptide
DEEEIRTTNPVATEQYGSVSNNLEGENED

SEQ ID NO: 18468 - protein, 31 aa, Artificial Sequence
  Description of Artificial Sequence: Synthetic polypeptide
DEEEIRTTNPVATEQYGSVSWVLLQRGSNEE

SEQ ID NO: 18469 - protein, 32 aa, Artificial Sequence
  Description of Artificial Sequence: Synthetic polypeptide
DEEEIRTTNPVATEPYGYSVSTVNLQDRTVNR

SEQ ID NO: 18470 - protein, 29 aa, Artificial Sequence
  Description of Artificial Sequence: Synthetic peptide
DEEEIATTNPVATEQYGSVATNLERNGED

SEQ ID NO: 18471 - protein, 29 aa, Artificial Sequence
  Description of Artificial Sequence: Synthetic peptide
DEEEIATTNPVATEQYGSVATNLERGQGE

SEQ ID NO: 18472 - protein, 29 aa, Artificial Sequence
  Description of Artificial Sequence: Synthetic peptide
DEEEIATTNPVATEQYGSVATNLERGQDY

SEQ ID NO: 18473 - protein, 30 aa, Artificial Sequence
  Description of Artificial Sequence: Synthetic polypeptide
DEEEIATTNPVATEQYGSVATNLERGDNPL

SEQ ID NO: 18474 - protein, 34 aa, Artificial Sequence
  Description of Artificial Sequence: Synthetic polypeptide
DEEEIRTTNPVATEQYGSVVSTNMLSQREGGNNR

SEQ ID NO: 18475 - protein, 30 aa, Artificial Sequence
  Description of Artificial Sequence: Synthetic polypeptide
AEEEIATTNPVATEQYGSVVSTNLQNNGNQ

SEQ ID NO: 18476 - protein, 30 aa, Artificial Sequence
  Description of Artificial Sequence: Synthetic polypeptide
DEEEIATTNPVATEQYGSVATNLENPGENR

SEQ ID NO: 18477 - protein, 30 aa, Artificial Sequence
  Description of Artificial Sequence: Synthetic polypeptide
DEEEIRTTNPVAYEAYGKVVSCTNLQAGNR

SEQ ID NO: 18478 - protein, 28 aa, Artificial Sequence
  Description of Artificial Sequence: Synthetic peptide
DEEEIAATNPVATEQYGCVATNLDRGND

SEQ ID NO: 18479 - protein, 30 aa, Artificial Sequence
  Description of Artificial Sequence: Synthetic polypeptide
DEEEIRTTNPVATEQYGSVSYDLEQNGERI

SEQ ID NO: 18480 - protein, 30 aa, Artificial Sequence
  Description of Artificial Sequence: Synthetic polypeptide
DEEEIATTNPVATEQYGSVATNLERDENTR

SEQ ID NO: 18481 - protein, 30 aa, Artificial Sequence
  Description of Artificial Sequence: Synthetic polypeptide
AEEEIATTNPVATEQYGSVSVNLQDDGNRM

SEQ ID NO: 18482 - protein, 30 aa, Artificial Sequence
  Description of Artificial Sequence: Synthetic polypeptide
DEEEISTTNPVATEQYGAVSTPLQRFGSNF

SEQ ID NO: 18483 - protein, 29 aa, Artificial Sequence
  Description of Artificial Sequence: Synthetic peptide
DEEEIRTTNPVATEQFGASVSEYLSRGNS

SEQ ID NO: 18484 - protein, 31 aa, Artificial Sequence
  Description of Artificial Sequence: Synthetic polypeptide
DEEEIRTTNPVATEQYGSVSPTNLIRDDNQE

SEQ ID NO: 18485 - protein, 30 aa, Artificial Sequence
  Description of Artificial Sequence: Synthetic polypeptide
DEEEIRTTNPVATEQYGSVLSTNDQRQEEN

SEQ ID NO: 18486 - protein, 29 aa, Artificial Sequence
  Description of Artificial Sequence: Synthetic peptide
DEEEIRTTNPVATEQYGSVSYDLTNGERN

SEQ ID NO: 18487 - protein, 32 aa, Artificial Sequence
  Description of Artificial Sequence: Synthetic polypeptide
DEEEIRTTNPVATEQYGSVSPTNLIQRVDNTE

SEQ ID NO: 18488 - protein, 33 aa, Artificial Sequence
  Description of Artificial Sequence: Synthetic polypeptide
DEEEIRTTNPVATEQYGSVVSTNMLSQRAVNNR

SEQ ID NO: 18489 - protein, 31 aa, Artificial Sequence
  Description of Artificial Sequence: Synthetic polypeptide
DEEEIRYTNPVATEQYGSVSVNVQDRGLNSR

SEQ ID NO: 18490 - protein, 31 aa, Artificial Sequence
  Description of Artificial Sequence: Synthetic polypeptide
DEEEIRTTNPVATEQYGSVSYNDLQNGSNQE

SEQ ID NO: 18491 - protein, 30 aa, Artificial Sequence
  Description of Artificial Sequence: Synthetic polypeptide
DEEEIRYTNPVATEQYGSVSVNQERGTNSR

SEQ ID NO: 18492 - protein, 31 aa, Artificial Sequence
  Description of Artificial Sequence: Synthetic polypeptide
DEEEIRTTNPVAYEAYGSTVSTGNLQRGGNE

SEQ ID NO: 18493 - protein, 31 aa, Artificial Sequence
  Description of Artificial Sequence: Synthetic polypeptide
DEEEIRTTNPVAYEAYGSTVSTNEAQRGNNR

SEQ ID NO: 18494 - protein, 31 aa, Artificial Sequence
  Description of Artificial Sequence: Synthetic polypeptide
DEEEIRTTNPVATEQYGSVSNTDQQRGEDRC

SEQ ID NO: 18495 - protein, 30 aa, Artificial Sequence
  Description of Artificial Sequence: Synthetic polypeptide
DEEEIRTTNPVATEQYGSVLSINDIRGNEQ

SEQ ID NO: 18496 - protein, 31 aa, Artificial Sequence
  Description of Artificial Sequence: Synthetic polypeptide
DEEAIRTTNPVATEQYGSVSNTGNDQRGSNQ

SEQ ID NO: 18497 - protein, 30 aa, Artificial Sequence
  Description of Artificial Sequence: Synthetic polypeptide
DEEEIRVTNPVATEQYGSVSVNQDRGENGR

SEQ ID NO: 18498 - protein, 31 aa, Artificial Sequence
  Description of Artificial Sequence: Synthetic polypeptide
TEEEVRTTNPVATEAYGSVSTWNLSQRTGNR

SEQ ID NO: 18499 - protein, 31 aa, Artificial Sequence
  Description of Artificial Sequence: Synthetic polypeptide
DEEEIRTTNPVATEQYGSVSPTNLERSENDN

SEQ ID NO: 18500 - protein, 32 aa, Artificial Sequence
  Description of Artificial Sequence: Synthetic polypeptide
DEEEIRTTNPVATEQYGSVSPTNLERNGMDER

SEQ ID NO: 18501 - protein, 32 aa, Artificial Sequence
  Description of Artificial Sequence: Synthetic polypeptide
DEEEIRTTNPVATEQYGSVSPTNLERGSEDND

SEQ ID NO: 18502 - protein, 30 aa, Artificial Sequence
  Description of Artificial Sequence: Synthetic polypeptide
DEEEIRYTNPVATEQYGSVSANQDRGSNTR

SEQ ID NO: 18503 - protein, 30 aa, Artificial Sequence
  Description of Artificial Sequence: Synthetic polypeptide
DEEEIRTTNPVAYEAYGSVASTNLSQRVNP

SEQ ID NO: 18504 - protein, 30 aa, Artificial Sequence
  Description of Artificial Sequence: Synthetic polypeptide
DEEEIATTNPVATEQYGSVATNDQNQGNRM

SEQ ID NO: 18505 - protein, 29 aa, Artificial Sequence
  Description of Artificial Sequence: Synthetic peptide
DEAEIRTTNPVATEQYGSCSTNTQREGDL

SEQ ID NO: 18506 - protein, 29 aa, Artificial Sequence
  Description of Artificial Sequence: Synthetic peptide
DEEEIATTNPVATEQYGSVATNDQGGNPQ

SEQ ID NO: 18507 - protein, 30 aa, Artificial Sequence
  Description of Artificial Sequence: Synthetic polypeptide
DEAEIRTTNPVATEQYGSCSTNPQREGPQR

SEQ ID NO: 18508 - protein, 29 aa, Artificial Sequence
  Description of Artificial Sequence: Synthetic peptide
DEEEIRTVNPVCTEQYGVVSDNLPQRGNQ

SEQ ID NO: 18509 - protein, 32 aa, Artificial Sequence
  Description of Artificial Sequence: Synthetic polypeptide
TEEEVRTTNPVATEQYGSVPSTGNLSQRIGNR

SEQ ID NO: 18510 - protein, 30 aa, Artificial Sequence
  Description of Artificial Sequence: Synthetic polypeptide
DEEEIRTTNPVATEQFGQSVSTPLLRGNNS

SEQ ID NO: 18511 - protein, 28 aa, Artificial Sequence
  Description of Artificial Sequence: Synthetic peptide
DEEEIRTVNPVAYEQYGSVSTPLQRVQE

SEQ ID NO: 18512 - protein, 29 aa, Artificial Sequence
  Description of Artificial Sequence: Synthetic peptide
DEAEIRTTNPVATEQYGSCSTNDQREGLV

SEQ ID NO: 18513 - protein, 29 aa, Artificial Sequence
  Description of Artificial Sequence: Synthetic peptide
DEEEIATTNPVATEQYGSVATNDQDDGND

SEQ ID NO: 18514 - protein, 30 aa, Artificial Sequence
  Description of Artificial Sequence: Synthetic polypeptide
DEEEIRTTNPVAYEAYGSVATNLSQRGNNI

SEQ ID NO: 18515 - protein, 30 aa, Artificial Sequence
  Description of Artificial Sequence: Synthetic polypeptide
DEEEIRYTNPVATEQYGSVSDNQDRGSNLR

SEQ ID NO: 18516 - protein, 30 aa, Artificial Sequence
  Description of Artificial Sequence: Synthetic polypeptide
DEEEIATTNPVATEQYGSVATNDQRDPNRN

SEQ ID NO: 18517 - protein, 30 aa, Artificial Sequence
  Description of Artificial Sequence: Synthetic polypeptide
DEEEIRYTNPVATEQYGSVSINDDRGSNGR

SEQ ID NO: 18518 - protein, 31 aa, Artificial Sequence
  Description of Artificial Sequence: Synthetic polypeptide
DEEEIRTTNPVAYEAYGSLVSTGNLQSGGNR

SEQ ID NO: 18519 - protein, 28 aa, Artificial Sequence
  Description of Artificial Sequence: Synthetic peptide
DEEEIAATNPVATEQYGSVSTNLDNGDE

SEQ ID NO: 18520 - protein, 30 aa, Artificial Sequence
  Description of Artificial Sequence: Synthetic polypeptide
DEEEIRYTNPVATEQYGSVSVNQDRGTNDR

SEQ ID NO: 18521 - protein, 29 aa, Artificial Sequence
  Description of Artificial Sequence: Synthetic peptide
DEEEIRTTNPVATEQYGSVSYNLGRMEID

SEQ ID NO: 18522 - protein, 30 aa, Artificial Sequence
  Description of Artificial Sequence: Synthetic polypeptide
DEEEIRYTNPVATEQYGSVSVNQDRGNNVR

SEQ ID NO: 18523 - protein, 30 aa, Artificial Sequence
  Description of Artificial Sequence: Synthetic polypeptide
DEEEIRYTNPVATEQYGSVSVNQDRGGNSR

SEQ ID NO: 18524 - protein, 29 aa, Artificial Sequence
  Description of Artificial Sequence: Synthetic peptide
AEEEIATTNPVATEQYGSVSTGLQNGNTP

SEQ ID NO: 18525 - protein, 28 aa, Artificial Sequence
  Description of Artificial Sequence: Synthetic peptide
DEEEIAATNPVATEQYGSVSTNLQNDTE

SEQ ID NO: 18526 - protein, 32 aa, Artificial Sequence
  Description of Artificial Sequence: Synthetic polypeptide
DEEEIRTTNPVATEQYGSVSPTNLGHRQGEPR

SEQ ID NO: 18527 - protein, 30 aa, Artificial Sequence
  Description of Artificial Sequence: Synthetic polypeptide
DEEEIRYTNPVATEQYGSVSVNMDRGSNVR

SEQ ID NO: 18528 - protein, 30 aa, Artificial Sequence
  Description of Artificial Sequence: Synthetic polypeptide
DEEEIRYTNPVATEQYGSVSVNHDRGSNQR

SEQ ID NO: 18529 - protein, 28 aa, Artificial Sequence
  Description of Artificial Sequence: Synthetic peptide
DEEEIATTNPVATEQYGSVATNDTRGSE

SEQ ID NO: 18530 - protein, 30 aa, Artificial Sequence
  Description of Artificial Sequence: Synthetic polypeptide
DEEEIRYTNPVATEQYGSVSVNGDRGSNLR

SEQ ID NO: 18531 - protein, 28 aa, Artificial Sequence
  Description of Artificial Sequence: Synthetic peptide
DEEEIATTNPVATEQYGSVATNDSRDNE

SEQ ID NO: 18532 - protein, 30 aa, Artificial Sequence
  Description of Artificial Sequence: Synthetic polypeptide
DEEEIRTTNPVATEQYGSVSPNLQPPDQRV

SEQ ID NO: 18533 - protein, 30 aa, Artificial Sequence
  Description of Artificial Sequence: Synthetic polypeptide
DEEEIRTTNPVATEQFGMSVSTGLLRGNSS

SEQ ID NO: 18534 - protein, 29 aa, Artificial Sequence
  Description of Artificial Sequence: Synthetic peptide
AEEEIATTNPVATEQYGSVSENLQAGERF

SEQ ID NO: 18535 - protein, 29 aa, Artificial Sequence
  Description of Artificial Sequence: Synthetic peptide
AEEEIATTNPVATEQYGSVSDNLQDGNSV

SEQ ID NO: 18536 - protein, 31 aa, Artificial Sequence
  Description of Artificial Sequence: Synthetic polypeptide
AEEEIATTNPVATEQYGSVSATNLQSGENDR

SEQ ID NO: 18537 - protein, 31 aa, Artificial Sequence
  Description of Artificial Sequence: Synthetic polypeptide
DEEEIRTTNPVATEQYGSVSYNLQRFGSIQM

SEQ ID NO: 18538 - protein, 30 aa, Artificial Sequence
  Description of Artificial Sequence: Synthetic polypeptide
AEEEIATTNPVATEQYGSVSATNLQPGPND

SEQ ID NO: 18539 - protein, 29 aa, Artificial Sequence
  Description of Artificial Sequence: Synthetic peptide
DEEEIATTNPVATEQYGSVATNDQRGEHN

SEQ ID NO: 18540 - protein, 29 aa, Artificial Sequence
  Description of Artificial Sequence: Synthetic peptide
DEEEIRTTNPVATEQFGMSVSTYGDRGNS

SEQ ID NO: 18541 - protein, 32 aa, Artificial Sequence
  Description of Artificial Sequence: Synthetic polypeptide
DEEEIRTTNPVATEPYGYSVSTVNLQDRIDNR

SEQ ID NO: 18542 - protein, 30 aa, Artificial Sequence
  Description of Artificial Sequence: Synthetic polypeptide
AEEEIATTNPVATEQYGTVSTNLQDRGGNQ

SEQ ID NO: 18543 - protein, 31 aa, Artificial Sequence
  Description of Artificial Sequence: Synthetic polypeptide
DEEEIRTTNPVATEQYGSVSWTTLQQVFGGR

SEQ ID NO: 18544 - protein, 30 aa, Artificial Sequence
  Description of Artificial Sequence: Synthetic polypeptide
TEEEISTTNCVATEQYGSVNSTNDLQRGTR

SEQ ID NO: 18545 - protein, 30 aa, Artificial Sequence
  Description of Artificial Sequence: Synthetic polypeptide
DEAEIRTTNPVATEQYGSISTNTQREGGDR

SEQ ID NO: 18546 - protein, 29 aa, Artificial Sequence
  Description of Artificial Sequence: Synthetic peptide
DEEEIATTNPVATEQYGSVATNLQHNNTE

SEQ ID NO: 18547 - protein, 30 aa, Artificial Sequence
  Description of Artificial Sequence: Synthetic polypeptide
DEAEIRTTNPVATEQYGSISTNTQREGDFR

SEQ ID NO: 18548 - protein, 31 aa, Artificial Sequence
  Description of Artificial Sequence: Synthetic polypeptide
DEEEISTTNPVATEQYGCVSTGNLQRGNPDT

SEQ ID NO: 18549 - protein, 29 aa, Artificial Sequence
  Description of Artificial Sequence: Synthetic peptide
DEEEIATTNPVATEQYGSVATNLQHADNP

SEQ ID NO: 18550 - protein, 30 aa, Artificial Sequence
  Description of Artificial Sequence: Synthetic polypeptide
DEAEIRTTNPVATEQYGSISTNETQRTGLR

SEQ ID NO: 18551 - protein, 31 aa, Artificial Sequence
  Description of Artificial Sequence: Synthetic polypeptide
DEEEIRTTNPVATEQYGSVSAGNLGQGGENI

SEQ ID NO: 18552 - protein, 31 aa, Artificial Sequence
  Description of Artificial Sequence: Synthetic polypeptide
DEEEIRTTNPVATEQYGSVSWNLSGRINERT

SEQ ID NO: 18553 - protein, 29 aa, Artificial Sequence
  Description of Artificial Sequence: Synthetic peptide
DDSEIRTTNPVATEQYGSVSTNGLQQAMR

SEQ ID NO: 18554 - protein, 32 aa, Artificial Sequence
  Description of Artificial Sequence: Synthetic polypeptide
TEEEIRTTNPVAYEQYGSVVSYTNLQRPGGNR

SEQ ID NO: 18555 - protein, 30 aa, Artificial Sequence
  Description of Artificial Sequence: Synthetic polypeptide
DEEEIRTTNPVATEQYGSVSWNLQYFGDDG

SEQ ID NO: 18556 - protein, 31 aa, Artificial Sequence
  Description of Artificial Sequence: Synthetic polypeptide
DEEEIRTTNPVATEQYGSVSPTNLNRNENSM

SEQ ID NO: 18557 - protein, 28 aa, Artificial Sequence
  Description of Artificial Sequence: Synthetic peptide
YEEEIASVNPVATEQYGSVSTNLQSGNQ

SEQ ID NO: 18558 - protein, 32 aa, Artificial Sequence
  Description of Artificial Sequence: Synthetic polypeptide
DEEEIRTTNPVATEQYGSVSPTNLNRMEENRM

SEQ ID NO: 18559 - protein, 30 aa, Artificial Sequence
  Description of Artificial Sequence: Synthetic polypeptide
DEEEIRTTNPVAYEAWGSVSTNMLQRGGNE

SEQ ID NO: 18560 - protein, 29 aa, Artificial Sequence
  Description of Artificial Sequence: Synthetic peptide
DEEEIRTTNPVATEQYGSVSWNLVREEDD

SEQ ID NO: 18561 - protein, 31 aa, Artificial Sequence
  Description of Artificial Sequence: Synthetic polypeptide
DEEEIRTTNPVATEQYGSVSPTNLNRGEDEY

SEQ ID NO: 18562 - protein, 29 aa, Artificial Sequence
  Description of Artificial Sequence: Synthetic peptide
DEEEIATTNPVATEQYGSVATNLQGDDRN

SEQ ID NO: 18563 - protein, 30 aa, Artificial Sequence
  Description of Artificial Sequence: Synthetic polypeptide
DEEEIRTTNPVATEQYGSVSWNLVRFEGDQ

SEQ ID NO: 18564 - protein, 31 aa, Artificial Sequence
  Description of Artificial Sequence: Synthetic polypeptide
DEEEIRTTNPVATEQYGSVSWNLVRIENERT

SEQ ID NO: 18565 - protein, 31 aa, Artificial Sequence
  Description of Artificial Sequence: Synthetic polypeptide
DEEEIRTTNPVATEQYGSVSWNNLDTEGQNR

SEQ ID NO: 18566 - protein, 29 aa, Artificial Sequence
  Description of Artificial Sequence: Synthetic peptide
DEEEIATTNPVATEQYGSVATNLQEGTLQ

SEQ ID NO: 18567 - protein, 30 aa, Artificial Sequence
  Description of Artificial Sequence: Synthetic polypeptide
DEEEIRTTNPVATEQYGSVSWNLTQVDNQD

SEQ ID NO: 18568 - protein, 29 aa, Artificial Sequence
  Description of Artificial Sequence: Synthetic peptide
DEEEIATTNPVATEQYGSVATNLQNDDNE

SEQ ID NO: 18569 - protein, 31 aa, Artificial Sequence
  Description of Artificial Sequence: Synthetic polypeptide
DEEEIATTNPVATEQYGSVATNLQNDGNDRQ

SEQ ID NO: 18570 - protein, 31 aa, Artificial Sequence
  Description of Artificial Sequence: Synthetic polypeptide
DEEEISTTNPVATEQYGCVSTNLFQGGSNRS

SEQ ID NO: 18571 - protein, 32 aa, Artificial Sequence
  Description of Artificial Sequence: Synthetic polypeptide
DEEEIRTTNPVATEPYGVSVSTVNLQDGIGNR

SEQ ID NO: 18572 - protein, 30 aa, Artificial Sequence
  Description of Artificial Sequence: Synthetic polypeptide
DEEEISTTNPVATEQYGDVSTNHQGGNPRS

SEQ ID NO: 18573 - protein, 31 aa, Artificial Sequence
  Description of Artificial Sequence: Synthetic polypeptide
DEEEIRTTNPVATEQYGSVSWNLQRFGSDAP

SEQ ID NO: 18574 - protein, 32 aa, Artificial Sequence
  Description of Artificial Sequence: Synthetic polypeptide
DEEEISTTNPVATEQYGCVVSTNLSQRGGNNR

SEQ ID NO: 18575 - protein, 31 aa, Artificial Sequence
  Description of Artificial Sequence: Synthetic polypeptide
DEEEISTTNPVATEQYGCVVSTNLQRFGNDS

SEQ ID NO: 18576 - protein, 30 aa, Artificial Sequence
  Description of Artificial Sequence: Synthetic polypeptide
DEEEISTTNPVATEQYGCVSWPNLNRGSNR

SEQ ID NO: 18577 - protein, 31 aa, Artificial Sequence
  Description of Artificial Sequence: Synthetic polypeptide
DEEEIRTTNPVATEQYGSVSPNLNQRVENID

SEQ ID NO: 18578 - protein, 31 aa, Artificial Sequence
  Description of Artificial Sequence: Synthetic polypeptide
TEEEIRTTNPVAYEQYGSVVSTNELQSGNYR

SEQ ID NO: 18579 - protein, 30 aa, Artificial Sequence
  Description of Artificial Sequence: Synthetic polypeptide
TEEEIRTTNPVAYEQYGSVVSTNLTRGGDR

SEQ ID NO: 18580 - protein, 29 aa, Artificial Sequence
  Description of Artificial Sequence: Synthetic peptide
DEEEISTTNPVATEQYGCVSTYLQNFGNQ

SEQ ID NO: 18581 - protein, 31 aa, Artificial Sequence
  Description of Artificial Sequence: Synthetic polypeptide
DEEEIRTTNPVATEQYGSVLTNLGQRGEAIM

SEQ ID NO: 18582 - protein, 31 aa, Artificial Sequence
  Description of Artificial Sequence: Synthetic polypeptide
TEEEIRTTNPVAYEQYGSVVSVTNLTRTGNR

SEQ ID NO: 18583 - protein, 29 aa, Artificial Sequence
  Description of Artificial Sequence: Synthetic peptide
AEEEIATTNPVATEVYGTVSTNLQRGNID

SEQ ID NO: 18584 - protein, 29 aa, Artificial Sequence
  Description of Artificial Sequence: Synthetic peptide
DEEEIRTTNPVAYEAWGKVSTNLSQRGNS

SEQ ID NO: 18585 - protein, 28 aa, Artificial Sequence
  Description of Artificial Sequence: Synthetic peptide
DEEEIATTNPVATEQYGSVATNLQPDPE

SEQ ID NO: 18586 - protein, 31 aa, Artificial Sequence
  Description of Artificial Sequence: Synthetic polypeptide
DEEEIRTTNPVATEQYGSVSPTNLNRNQERD

SEQ ID NO: 18587 - protein, 31 aa, Artificial Sequence
  Description of Artificial Sequence: Synthetic polypeptide
DEEEISTTNPVATEQYGCVSTNNLQIGSNRP

SEQ ID NO: 18588 - protein, 29 aa, Artificial Sequence
  Description of Artificial Sequence: Synthetic peptide
DEEEIRTTNPVATEQYGSVSAGPLQSSER

SEQ ID NO: 18589 - protein, 28 aa, Artificial Sequence
  Description of Artificial Sequence: Synthetic peptide
DEECVRTTNPIAYEQYGEVFTNLQRGNR

SEQ ID NO: 18590 - protein, 30 aa, Artificial Sequence
  Description of Artificial Sequence: Synthetic polypeptide
DEEEISTTNPVATEQYGCVSTNLQNIGNQM

SEQ ID NO: 18591 - protein, 29 aa, Artificial Sequence
  Description of Artificial Sequence: Synthetic peptide
AEEEIATTNPVATEVYGSVSTNLERGNDQ

SEQ ID NO: 18592 - protein, 29 aa, Artificial Sequence
  Description of Artificial Sequence: Synthetic peptide
DEEEIATTNPVATEQYGSVATNLQNNANP

SEQ ID NO: 18593 - protein, 30 aa, Artificial Sequence
  Description of Artificial Sequence: Synthetic polypeptide
DEEEIRTTNPVATEQYGSVSWNLQVNDNVD

SEQ ID NO: 18594 - protein, 30 aa, Artificial Sequence
  Description of Artificial Sequence: Synthetic polypeptide
DEEEISTTNPVATEQYGCVSTEDQRDGSNR

SEQ ID NO: 18595 - protein, 30 aa, Artificial Sequence
  Description of Artificial Sequence: Synthetic polypeptide
DEEEIATTNPVATEQYGSVATNLQQENNRE

SEQ ID NO: 18596 - protein, 30 aa, Artificial Sequence
  Description of Artificial Sequence: Synthetic polypeptide
DEEDIRTTNPVATEQWGSVATNNLQEGTNR

SEQ ID NO: 18597 - protein, 30 aa, Artificial Sequence
  Description of Artificial Sequence: Synthetic polypeptide
DEEDIRTTNPVATEQWGSVNTNNLQLGVNR

SEQ ID NO: 18598 - protein, 29 aa, Artificial Sequence
  Description of Artificial Sequence: Synthetic peptide
AEEEIATTNPVATEQYGVVSENLQDGNRM

SEQ ID NO: 18599 - protein, 30 aa, Artificial Sequence
  Description of Artificial Sequence: Synthetic polypeptide
DEEEISTTNPVATEQYGCVCSTNLQERGEV

SEQ ID NO: 18600 - protein, 30 aa, Artificial Sequence
  Description of Artificial Sequence: Synthetic polypeptide
DEEEIATTNPVATEQYGSVATNLQDDDNRN

SEQ ID NO: 18601 - protein, 30 aa, Artificial Sequence
  Description of Artificial Sequence: Synthetic polypeptide
TEEEIRTTNPVAYESYGSVSTNLSQRVNRL

SEQ ID NO: 18602 - protein, 32 aa, Artificial Sequence
  Description of Artificial Sequence: Synthetic polypeptide
DEEEIRTTNPVATEQYGSVSPTNLLTGEENRY

SEQ ID NO: 18603 - protein, 31 aa, Artificial Sequence
  Description of Artificial Sequence: Synthetic polypeptide
DEEEIATTNPVATEQYGSVATNLQAGDNPRE

SEQ ID NO: 18604 - protein, 30 aa, Artificial Sequence
  Description of Artificial Sequence: Synthetic polypeptide
DEEEIRTTNPVATEQYGSVSWTNLERNQED

SEQ ID NO: 18605 - protein, 31 aa, Artificial Sequence
  Description of Artificial Sequence: Synthetic polypeptide
DEEEIRTTNPVATEQYGSVVSTNQEQRGDQS

SEQ ID NO: 18606 - protein, 33 aa, Artificial Sequence
  Description of Artificial Sequence: Synthetic polypeptide
DEEEIRTTNPVATEQYGSVSWTNLQIRQGVNDE

SEQ ID NO: 18607 - protein, 30 aa, Artificial Sequence
  Description of Artificial Sequence: Synthetic polypeptide
DEEEIRTTNPVATEPYGVVSTGNLSQRVNE

SEQ ID NO: 18608 - protein, 29 aa, Artificial Sequence
  Description of Artificial Sequence: Synthetic peptide
DEEEIATTNPVATEQYGSVATNLQDDPNN

SEQ ID NO: 18609 - protein, 32 aa, Artificial Sequence
  Description of Artificial Sequence: Synthetic polypeptide
DEEEIRTTNPVATEQYGSVSPTNLLQRDDNVE

SEQ ID NO: 18610 - protein, 30 aa, Artificial Sequence
  Description of Artificial Sequence: Synthetic polypeptide
DEEEIRTTNPVATEQWGSVSTNLDGVGNTD

SEQ ID NO: 18611 - protein, 31 aa, Artificial Sequence
  Description of Artificial Sequence: Synthetic polypeptide
DEEAIRTTNPVATEQYGSVSTGELQRGSNQF

SEQ ID NO: 18612 - protein, 31 aa, Artificial Sequence
  Description of Artificial Sequence: Synthetic polypeptide
TEEEIRTTNPVSTEQYGSVVSTNLSQRGGNQ

SEQ ID NO: 18613 - protein, 31 aa, Artificial Sequence
  Description of Artificial Sequence: Synthetic polypeptide
DEEEIRTTNPVATEQYGSVSNTELQGFGNTQ

SEQ ID NO: 18614 - protein, 29 aa, Artificial Sequence
  Description of Artificial Sequence: Synthetic peptide
DEEEIATTNPVATEQYGSVATNLQAAGEN

SEQ ID NO: 18615 - protein, 30 aa, Artificial Sequence
  Description of Artificial Sequence: Synthetic polypeptide
TEEEIRTVNPVATEQYGSVQDTENLQRGNE

SEQ ID NO: 18616 - protein, 30 aa, Artificial Sequence
  Description of Artificial Sequence: Synthetic polypeptide
DEEEIATTNPVATEQYGSVATNLPREGNND

SEQ ID NO: 18617 - protein, 29 aa, Artificial Sequence
  Description of Artificial Sequence: Synthetic peptide
DEEEIRTTNPVATEQYGSVGCINIQNGER

SEQ ID NO: 18618 - protein, 29 aa, Artificial Sequence
  Description of Artificial Sequence: Synthetic peptide
DEEEIRTTNPVATEQYGSVSWTPLQDTEQ

SEQ ID NO: 18619 - protein, 29 aa, Artificial Sequence
  Description of Artificial Sequence: Synthetic peptide
TEEEISTCNPVATEYYGSVSTNNLQHGNR

SEQ ID NO: 18620 - protein, 31 aa, Artificial Sequence
  Description of Artificial Sequence: Synthetic polypeptide
DEEEIRTTNPVATEQYGSVGATFNLYGRGTR

SEQ ID NO: 18621 - protein, 31 aa, Artificial Sequence
  Description of Artificial Sequence: Synthetic polypeptide
DEEEIRTTNPVATEQYGSVGANLQRNGNNEQ

SEQ ID NO: 18622 - protein, 30 aa, Artificial Sequence
  Description of Artificial Sequence: Synthetic polypeptide
AEEEIATTNPVATEQYGVVSTNLQRGPNDQ

SEQ ID NO: 18623 - protein, 31 aa, Artificial Sequence
  Description of Artificial Sequence: Synthetic polypeptide
DEEEIRTTNPVATEQYGSVSWTELQRGLEQT

SEQ ID NO: 18624 - protein, 31 aa, Artificial Sequence
  Description of Artificial Sequence: Synthetic polypeptide
DEEEIRTTNPVATEQYGSVSAENLMDRGEDR

SEQ ID NO: 18625 - protein, 29 aa, Artificial Sequence
  Description of Artificial Sequence: Synthetic peptide
DEEEIATTNPVATEQYGSVATNLQEDANQ

SEQ ID NO: 18626 - protein, 30 aa, Artificial Sequence
  Description of Artificial Sequence: Synthetic polypeptide
DEEEISTTNPVATEQYGCVSNTNLQQGSNL

SEQ ID NO: 18627 - protein, 30 aa, Artificial Sequence
  Description of Artificial Sequence: Synthetic polypeptide
DEEEIATTNPVATEQYGSVATNLQEAGNPQ

SEQ ID NO: 18628 - protein, 30 aa, Artificial Sequence
  Description of Artificial Sequence: Synthetic polypeptide
DEEEIATTNPVATEQYGSVATNLQEAGGNQ

SEQ ID NO: 18629 - protein, 30 aa, Artificial Sequence
  Description of Artificial Sequence: Synthetic polypeptide
DEEEISTTNPVATEQYGCVSCTNLQHGSNQ

SEQ ID NO: 18630 - protein, 31 aa, Artificial Sequence
  Description of Artificial Sequence: Synthetic polypeptide
DEEEIRTTNPVATEQYGSVSAENLEDRGEDR

SEQ ID NO: 18631 - protein, 30 aa, Artificial Sequence
  Description of Artificial Sequence: Synthetic polypeptide
DEEEIRTTNPVATEQYGSVSAEDLQSGEMR

SEQ ID NO: 18632 - protein, 31 aa, Artificial Sequence
  Description of Artificial Sequence: Synthetic polypeptide
DEEEIRTTNPVATEQYGSVSPNLQEGVNVDN

SEQ ID NO: 18633 - protein, 30 aa, Artificial Sequence
  Description of Artificial Sequence: Synthetic polypeptide
DEEEIATTNPVATEQYGSVATNLQDVGNNQ

SEQ ID NO: 18634 - protein, 29 aa, Artificial Sequence
  Description of Artificial Sequence: Synthetic peptide
DEEEIRTTNPVATEQYGSVSWPNQNGDNQ

SEQ ID NO: 18635 - protein, 30 aa, Artificial Sequence
  Description of Artificial Sequence: Synthetic polypeptide
TEEEIRTTNPVAYERYGSVSTNLSQRGNQV

SEQ ID NO: 18636 - protein, 29 aa, Artificial Sequence
  Description of Artificial Sequence: Synthetic peptide
DEEEIRTTNPVATEQYGSVSWPPQSGENE

SEQ ID NO: 18637 - protein, 30 aa, Artificial Sequence
  Description of Artificial Sequence: Synthetic polypeptide
DEEEIRTTNPVATEQYGSVSWSLVRFEDNR

SEQ ID NO: 18638 - protein, 32 aa, Artificial Sequence
  Description of Artificial Sequence: Synthetic polypeptide
DEEEISTTNPVATEQYGCVCSTTNGLQRGSNR

SEQ ID NO: 18639 - protein, 31 aa, Artificial Sequence
  Description of Artificial Sequence: Synthetic polypeptide
DEEEIRTTNPVATEQWGSVSTNLQHSGSNAP

SEQ ID NO: 18640 - protein, 32 aa, Artificial Sequence
  Description of Artificial Sequence: Synthetic polypeptide
DEEEIRTTNPVATEQYGSVSWTDLDGQRSQNR

SEQ ID NO: 18641 - protein, 30 aa, Artificial Sequence
  Description of Artificial Sequence: Synthetic polypeptide
DEEEIRTTNPVATEQYGSVSWTDLQRLQLM

SEQ ID NO: 18642 - protein, 28 aa, Artificial Sequence
  Description of Artificial Sequence: Synthetic peptide
AEEEIATTNPVATEQYGWVSTNQQVGER

SEQ ID NO: 18643 - protein, 30 aa, Artificial Sequence
  Description of Artificial Sequence: Synthetic polypeptide
DEEEIRTTNPVATEQYGSVSWTDQQDGNNM

SEQ ID NO: 18644 - protein, 31 aa, Artificial Sequence
  Description of Artificial Sequence: Synthetic polypeptide
TEEEIRTTNPVAYESYGSVSTNELSQRGNRW

SEQ ID NO: 18645 - protein, 29 aa, Artificial Sequence
  Description of Artificial Sequence: Synthetic peptide
DEEEIATTNPVATEQYGSVATNLQDGPQP

SEQ ID NO: 18646 - protein, 32 aa, Artificial Sequence
  Description of Artificial Sequence: Synthetic polypeptide
DEEEIRTTNPVATEQYGSVSNTELQHIGSNTR

SEQ ID NO: 18647 - protein, 29 aa, Artificial Sequence
  Description of Artificial Sequence: Synthetic peptide
DEEEIATTNPVATEQYGSVATNLQEDNQD

SEQ ID NO: 18648 - protein, 29 aa, Artificial Sequence
  Description of Artificial Sequence: Synthetic peptide
DEEEIRTTNPVGTEQYGSVSTNFLGNGFM

SEQ ID NO: 18649 - protein, 29 aa, Artificial Sequence
  Description of Artificial Sequence: Synthetic peptide
AEEEIATTNPVATEPYGSVSANLQRGNIS

SEQ ID NO: 18650 - protein, 29 aa, Artificial Sequence
  Description of Artificial Sequence: Synthetic peptide
DEEEIRTTNPVATECYGEVTSTNEQRTNF

SEQ ID NO: 18651 - protein, 31 aa, Artificial Sequence
  Description of Artificial Sequence: Synthetic polypeptide
DEEEIRTTNPVATEQYGSVQSNTNIQRGIFQ

SEQ ID NO: 18652 - protein, 30 aa, Artificial Sequence
  Description of Artificial Sequence: Synthetic polypeptide
DEEEIRTTNPVATEQYGSVQSPPLQLGINQ

SEQ ID NO: 18653 - protein, 29 aa, Artificial Sequence
  Description of Artificial Sequence: Synthetic peptide
VEEEICTTNPVATEQYGSVATNLQRPNVD

SEQ ID NO: 18654 - protein, 29 aa, Artificial Sequence
  Description of Artificial Sequence: Synthetic peptide
VEEEICTTNPVATEQYGSVATNLQRVPER

SEQ ID NO: 18655 - protein, 32 aa, Artificial Sequence
  Description of Artificial Sequence: Synthetic polypeptide
DEEEIRTTNPVATEQYGSVTSTNLQDTGGNNP

SEQ ID NO: 18656 - protein, 31 aa, Artificial Sequence
  Description of Artificial Sequence: Synthetic polypeptide
DEEEIRTTNPVAYEQYGNVSTNLSQRPVTNR

SEQ ID NO: 18657 - protein, 31 aa, Artificial Sequence
  Description of Artificial Sequence: Synthetic polypeptide
DEAEIRTTNPVATEQYGCVCSTNDLQNGNRS

SEQ ID NO: 18658 - protein, 32 aa, Artificial Sequence
  Description of Artificial Sequence: Synthetic polypeptide
DEEEIRTTNPVATEQYGSVTSTNLQFFNSDRE

SEQ ID NO: 18659 - protein, 30 aa, Artificial Sequence
  Description of Artificial Sequence: Synthetic polypeptide
DEEEIRTTNPVATEQYGSVSNTDGDFGDNR

SEQ ID NO: 18660 - protein, 29 aa, Artificial Sequence
  Description of Artificial Sequence: Synthetic peptide
DEEEIATTNPVATEQWGVVSTNLQDGNAE

SEQ ID NO: 18661 - protein, 32 aa, Artificial Sequence
  Description of Artificial Sequence: Synthetic polypeptide
DEEEIRTTNPVAYEQYGSVPSCTNLDQIVGNR

SEQ ID NO: 18662 - protein, 31 aa, Artificial Sequence
  Description of Artificial Sequence: Synthetic polypeptide
VEEEVATTNPVATEQYGSVSTSNLDQRIGNR

SEQ ID NO: 18663 - protein, 29 aa, Artificial Sequence
  Description of Artificial Sequence: Synthetic peptide
VEEEIRCTNPIATEQYGSVSENLMRGNER

SEQ ID NO: 18664 - protein, 29 aa, Artificial Sequence
  Description of Artificial Sequence: Synthetic peptide
VEEEIRCTNPIATEQYGSVSENLMRGNNR

SEQ ID NO: 18665 - protein, 32 aa, Artificial Sequence
  Description of Artificial Sequence: Synthetic polypeptide
DEEEIRTTNPVATEEYGSVSTENLQYFGSNFR

SEQ ID NO: 18666 - protein, 28 aa, Artificial Sequence
  Description of Artificial Sequence: Synthetic peptide
VEEEIRCTNPIATEQYGSVSENLMRMNR

SEQ ID NO: 18667 - protein, 28 aa, Artificial Sequence
  Description of Artificial Sequence: Synthetic peptide
VEEEIRCTNPIATEYYGSVSENLMRGNR

SEQ ID NO: 18668 - protein, 31 aa, Artificial Sequence
  Description of Artificial Sequence: Synthetic polypeptide
DEEEIRTTNPVATEQYGSVSNSMNLQRVNII

SEQ ID NO: 18669 - protein, 30 aa, Artificial Sequence
  Description of Artificial Sequence: Synthetic polypeptide
VEEEIRTTNPVATECYGSVSTNLNPQDGNN

SEQ ID NO: 18670 - protein, 31 aa, Artificial Sequence
  Description of Artificial Sequence: Synthetic polypeptide
VEEELRTTNPVATEQYGSVYTWNLDQRDGNR

SEQ ID NO: 18671 - protein, 30 aa, Artificial Sequence
  Description of Artificial Sequence: Synthetic polypeptide
DEEEIATTNPVATEQYGNVSTNLQHNGGNM

SEQ ID NO: 18672 - protein, 31 aa, Artificial Sequence
  Description of Artificial Sequence: Synthetic polypeptide
DEEEIRTTNPVATEQYGSVSPQYLQRGVNDL

SEQ ID NO: 18673 - protein, 29 aa, Artificial Sequence
  Description of Artificial Sequence: Synthetic peptide
DEEEIRTTNPVAYEQYGSVGTNLQVPDGR

SEQ ID NO: 18674 - protein, 31 aa, Artificial Sequence
  Description of Artificial Sequence: Synthetic polypeptide
DEEEIATTNPVATEQYGNVSTNLQGEDGNER

SEQ ID NO: 18675 - protein, 28 aa, Artificial Sequence
  Description of Artificial Sequence: Synthetic peptide
DEEEIRTTNPVATECYGTNSTNGQRENF

SEQ ID NO: 18676 - protein, 31 aa, Artificial Sequence
  Description of Artificial Sequence: Synthetic polypeptide
DEEEIRTTNPVAYEQYGMVSTNEQRFGSNFR

SEQ ID NO: 18677 - protein, 28 aa, Artificial Sequence
  Description of Artificial Sequence: Synthetic peptide
DEEEIRTTNPVATECYGTHSTNEQRMNF

SEQ ID NO: 18678 - protein, 31 aa, Artificial Sequence
  Description of Artificial Sequence: Synthetic polypeptide
VEEEVRTTNPVATEQYGSVSTADLDQRMGNR

SEQ ID NO: 18679 - protein, 29 aa, Artificial Sequence
  Description of Artificial Sequence: Synthetic peptide
DEEEIRTTNPVATEQYGSVHTPLQEGEQG

SEQ ID NO: 18680 - protein, 32 aa, Artificial Sequence
  Description of Artificial Sequence: Synthetic polypeptide
VEEEVRTTNPVATEQYGSVSATENLDQRNGNR

SEQ ID NO: 18681 - protein, 31 aa, Artificial Sequence
  Description of Artificial Sequence: Synthetic polypeptide
DEEEIRTTNPVATEQYGSVHTPNLQRVNVLF

SEQ ID NO: 18682 - protein, 30 aa, Artificial Sequence
  Description of Artificial Sequence: Synthetic polypeptide
DEEEIRTTNPVATEQYGSVSPTDLTRLQLR

SEQ ID NO: 18683 - protein, 29 aa, Artificial Sequence
  Description of Artificial Sequence: Synthetic peptide
VEEEIATTNPVATEQYGSVATNLQQGDRL

SEQ ID NO: 18684 - protein, 32 aa, Artificial Sequence
  Description of Artificial Sequence: Synthetic polypeptide
DEEEIRTTNPVAYEQYGSVPSVTNALQRGGNQ

SEQ ID NO: 18685 - protein, 31 aa, Artificial Sequence
  Description of Artificial Sequence: Synthetic polypeptide
DEEEIRTTNPVATEQYGSVTSTNLGDGVNVQ

SEQ ID NO: 18686 - protein, 31 aa, Artificial Sequence
  Description of Artificial Sequence: Synthetic polypeptide
DEEEIRTTNPVATEQYGSVTSTNLGGGGNNT

SEQ ID NO: 18687 - protein, 32 aa, Artificial Sequence
  Description of Artificial Sequence: Synthetic polypeptide
DEEEIRTTNPVAYEQYGSVPSCTNLQRGGNDQ

SEQ ID NO: 18688 - protein, 29 aa, Artificial Sequence
  Description of Artificial Sequence: Synthetic peptide
VEEEIATTNPVATEQYGSVATNLQQGNPV

SEQ ID NO: 18689 - protein, 30 aa, Artificial Sequence
  Description of Artificial Sequence: Synthetic polypeptide
DEEEIATTNPVATEQWGTVSTNELSQRVNR

SEQ ID NO: 18690 - protein, 30 aa, Artificial Sequence
  Description of Artificial Sequence: Synthetic polypeptide
VEEEIATTNPVATEQYGSVSTNLQNGNPES

SEQ ID NO: 18691 - protein, 32 aa, Artificial Sequence
  Description of Artificial Sequence: Synthetic polypeptide
DEEEIRTTNPVATEQYGSVISTNLQAFGGNQL

SEQ ID NO: 18692 - protein, 31 aa, Artificial Sequence
  Description of Artificial Sequence: Synthetic polypeptide
DEEEIRTTNPVATEQYGSVSPTDLSGGNDRI

SEQ ID NO: 18693 - protein, 32 aa, Artificial Sequence
  Description of Artificial Sequence: Synthetic polypeptide
DEEEIRTTNPVAYEQYGSVPSTNELSQRGDRE

SEQ ID NO: 18694 - protein, 33 aa, Artificial Sequence
  Description of Artificial Sequence: Synthetic polypeptide
DEEEIRTTNPVATEQYGSVQSVTGNLSGRGGNR

SEQ ID NO: 18695 - protein, 28 aa, Artificial Sequence
  Description of Artificial Sequence: Synthetic peptide
DEEEIRTTNPVATECYGTNSTNEQRPNF

SEQ ID NO: 18696 - protein, 32 aa, Artificial Sequence
  Description of Artificial Sequence: Synthetic polypeptide
DEEEIRTTNPVAYEQYGSVPSCTYLQRTGGNR

SEQ ID NO: 18697 - protein, 28 aa, Artificial Sequence
  Description of Artificial Sequence: Synthetic peptide
VEEEIATTNPVAYEQYGSVATNLQNGNT

SEQ ID NO: 18698 - protein, 31 aa, Artificial Sequence
  Description of Artificial Sequence: Synthetic polypeptide
DEEEIRTTNPVATEQYGSVTSTNLNTGNIAD

SEQ ID NO: 18699 - protein, 32 aa, Artificial Sequence
  Description of Artificial Sequence: Synthetic polypeptide
DEEEIRTTNPVATEQYGSVISTNLQAFGLNEL

SEQ ID NO: 18700 - protein, 31 aa, Artificial Sequence
  Description of Artificial Sequence: Synthetic polypeptide
DEEEIRTTNPVAYEQYGSVCTNQSQRTGTNR

SEQ ID NO: 18701 - protein, 30 aa, Artificial Sequence
  Description of Artificial Sequence: Synthetic polypeptide
DEEEIRTTNPVATEQYGSVSPTDLQITERI

SEQ ID NO: 18702 - protein, 31 aa, Artificial Sequence
  Description of Artificial Sequence: Synthetic polypeptide
DEEEIRTTNPVATEQYGSVSPSENLQRDNNN

SEQ ID NO: 18703 - protein, 32 aa, Artificial Sequence
  Description of Artificial Sequence: Synthetic polypeptide
DEEEIRTTNPVATEQYGSVISTNGQRQNNDRL

SEQ ID NO: 18704 - protein, 32 aa, Artificial Sequence
  Description of Artificial Sequence: Synthetic polypeptide
DEEEIRTTNPVATEQYGSVTSTNLQTQGGNDP

SEQ ID NO: 18705 - protein, 31 aa, Artificial Sequence
  Description of Artificial Sequence: Synthetic polypeptide
DEEEIRTTNPVAYEQYGSVATNLSQNGGNRG

SEQ ID NO: 18706 - protein, 32 aa, Artificial Sequence
  Description of Artificial Sequence: Synthetic polypeptide
DEEEIRTTNPVATEQYGSVTSTNLQTQGGNTP

SEQ ID NO: 18707 - protein, 28 aa, Artificial Sequence
  Description of Artificial Sequence: Synthetic peptide
DEEEIRTTNPVATECYGVNSTNEQRQNF

SEQ ID NO: 18708 - protein, 31 aa, Artificial Sequence
  Description of Artificial Sequence: Synthetic polypeptide
DEEEIRTTNPVATEQYGSVISTNGQRGDQVL

SEQ ID NO: 18709 - protein, 30 aa, Artificial Sequence
  Description of Artificial Sequence: Synthetic polypeptide
VEEEIRTTNPVATEQYGSVCTPNLQRPENQ

SEQ ID NO: 18710 - protein, 29 aa, Artificial Sequence
  Description of Artificial Sequence: Synthetic peptide
VEEEITTTNPVATEQYGNVSVTMLQGGNR

SEQ ID NO: 18711 - protein, 29 aa, Artificial Sequence
  Description of Artificial Sequence: Synthetic peptide
VEEEIRTTNPVATEQYGSVESNGQRGNQD

SEQ ID NO: 18712 - protein, 29 aa, Artificial Sequence
  Description of Artificial Sequence: Synthetic peptide
DEEEIRTTNPVAYEQYGSVATNLQVMEGR

SEQ ID NO: 18713 - protein, 31 aa, Artificial Sequence
  Description of Artificial Sequence: Synthetic polypeptide
DEEEIRTTNPVAYEQYGSVATQNLSDRGGNR

SEQ ID NO: 18714 - protein, 32 aa, Artificial Sequence
  Description of Artificial Sequence: Synthetic polypeptide
DEEEIRTTNPVATEQYGSVTSTNLVQGNGNQE

SEQ ID NO: 18715 - protein, 29 aa, Artificial Sequence
  Description of Artificial Sequence: Synthetic peptide
DEEEIRTTNPVAYEQYGSVATNLQSNNSD

SEQ ID NO: 18716 - protein, 29 aa, Artificial Sequence
  Description of Artificial Sequence: Synthetic peptide
DEEEIRTTNPVATECYGVVSTNLQNPDNN

SEQ ID NO: 18717 - protein, 30 aa, Artificial Sequence
  Description of Artificial Sequence: Synthetic polypeptide
DEEEIRTTNPVAYEQYGSVATNLQRSNTDQ

SEQ ID NO: 18718 - protein, 29 aa, Artificial Sequence
  Description of Artificial Sequence: Synthetic peptide
DEEEIRTTNPVAYEQYGSVATNLQRNVEM

SEQ ID NO: 18719 - protein, 30 aa, Artificial Sequence
  Description of Artificial Sequence: Synthetic polypeptide
DEEEIRTTNPVAYEQYGSVATNLQRNPENH

SEQ ID NO: 18720 - protein, 30 aa, Artificial Sequence
  Description of Artificial Sequence: Synthetic polypeptide
DEEEIRTTNPVAYEQYGSVATNLQRNNESD

SEQ ID NO: 18721 - protein, 31 aa, Artificial Sequence
  Description of Artificial Sequence: Synthetic polypeptide
DEEEIRTTNPVATEQYGSVSPTDLIRGNNQD

SEQ ID NO: 18722 - protein, 30 aa, Artificial Sequence
  Description of Artificial Sequence: Synthetic polypeptide
DEEEIRTTNPVAYEQYGSVATNLQRGPEGE

SEQ ID NO: 18723 - protein, 30 aa, Artificial Sequence
  Description of Artificial Sequence: Synthetic polypeptide
DEEEIRTTNPVATEEYGSVSSNDQRFGSNQ

SEQ ID NO: 18724 - protein, 31 aa, Artificial Sequence
  Description of Artificial Sequence: Synthetic polypeptide
VEEEIRTTNPVATEQYGSVGSTNLQEPGNLM

SEQ ID NO: 18725 - protein, 28 aa, Artificial Sequence
  Description of Artificial Sequence: Synthetic peptide
VEEEIRTTNPVATEQYGSVETALQNGFS

SEQ ID NO: 18726 - protein, 31 aa, Artificial Sequence
  Description of Artificial Sequence: Synthetic polypeptide
DEEEIRTTNPVAYEQYGSVATTNLSQRGNNT

SEQ ID NO: 18727 - protein, 31 aa, Artificial Sequence
  Description of Artificial Sequence: Synthetic polypeptide
VEEELRTTNPVATEQYGSVSTMNLDQGIGNR

SEQ ID NO: 18728 - protein, 29 aa, Artificial Sequence
  Description of Artificial Sequence: Synthetic peptide
VEEEIRTTNPVATEQYGSVATALQDGGDR

SEQ ID NO: 18729 - protein, 29 aa, Artificial Sequence
  Description of Artificial Sequence: Synthetic peptide
AEEEIACTNPVATEAYGSVSTNLQRGNTL

SEQ ID NO: 18730 - protein, 31 aa, Artificial Sequence
  Description of Artificial Sequence: Synthetic polypeptide
DEEEIRTTNPVATEQYGSVSNSNLQDIGNNV

SEQ ID NO: 18731 - protein, 31 aa, Artificial Sequence
  Description of Artificial Sequence: Synthetic polypeptide
DEEEIRTTNPVAYEQYGSVCSTNLQYFGSQR

SEQ ID NO: 18732 - protein, 31 aa, Artificial Sequence
  Description of Artificial Sequence: Synthetic polypeptide
DEEEIRTTNPVAYEQYGSVCSTNLQRFGELP

SEQ ID NO: 18733 - protein, 31 aa, Artificial Sequence
  Description of Artificial Sequence: Synthetic polypeptide
DEEEIRTTNPVAYEQYGSVCSTNLFQFGSQR

SEQ ID NO: 18734 - protein, 32 aa, Artificial Sequence
  Description of Artificial Sequence: Synthetic polypeptide
DEEEIRTTNPVATEQYGSVQSPTNLIQRVGQQ

SEQ ID NO: 18735 - protein, 30 aa, Artificial Sequence
  Description of Artificial Sequence: Synthetic polypeptide
DEEEIATTNPVATEQYGNVSTNGQHNGNER

SEQ ID NO: 18736 - protein, 32 aa, Artificial Sequence
  Description of Artificial Sequence: Synthetic polypeptide
DEEEIRTTNPVATEQYGSVVMTNLQLGENERI

SEQ ID NO: 18737 - protein, 28 aa, Artificial Sequence
  Description of Artificial Sequence: Synthetic peptide
DEEEIRTTNPVATECYGVFSTNEQRLNF

SEQ ID NO: 18738 - protein, 28 aa, Artificial Sequence
  Description of Artificial Sequence: Synthetic peptide
DEEEIRTTNPVATECYGVHSTNEQRINQ

SEQ ID NO: 18739 - protein, 30 aa, Artificial Sequence
  Description of Artificial Sequence: Synthetic polypeptide
DEEAIRTTNPVATEQWGSVATNLNQLGGNR

SEQ ID NO: 18740 - protein, 31 aa, Artificial Sequence
  Description of Artificial Sequence: Synthetic polypeptide
DEEEIRTTNPVATEQYGSVIATNLERGGNED

SEQ ID NO: 18741 - protein, 28 aa, Artificial Sequence
  Description of Artificial Sequence: Synthetic peptide
DEEEIRTTNPVATECYGVISTNEQRNNF

SEQ ID NO: 18742 - protein, 28 aa, Artificial Sequence
  Description of Artificial Sequence: Synthetic peptide
AEEEIACTNPIATEQYGSVSENLMRGNR

SEQ ID NO: 18743 - protein, 30 aa, Artificial Sequence
  Description of Artificial Sequence: Synthetic polypeptide
DEEEIRTTNPVATEQYGSVSPTDLQGDSRI

SEQ ID NO: 18744 - protein, 31 aa, Artificial Sequence
  Description of Artificial Sequence: Synthetic polypeptide
DEEEIRTTNPVATEQYGSVSNSNLQNIGNNV

SEQ ID NO: 18745 - protein, 28 aa, Artificial Sequence
  Description of Artificial Sequence: Synthetic peptide
AEEEIAATNPVATEQYGVVSTNLQQGNM

SEQ ID NO: 18746 - protein, 30 aa, Artificial Sequence
  Description of Artificial Sequence: Synthetic polypeptide
DEEEIRTTNPVATEQYGSVICTGLQRVNFE

SEQ ID NO: 18747 - protein, 30 aa, Artificial Sequence
  Description of Artificial Sequence: Synthetic polypeptide
DEEEIRTTNPVATEQYGSVICTSLQRVNIN

SEQ ID NO: 18748 - protein, 31 aa, Artificial Sequence
  Description of Artificial Sequence: Synthetic polypeptide
DEEEIRTTNPVATEQYGSVICVTELQRGPNS

SEQ ID NO: 18749 - protein, 33 aa, Artificial Sequence
  Description of Artificial Sequence: Synthetic polypeptide
DEEEIRTTNPVATEQYGSVISTNLDNERGNVRT

SEQ ID NO: 18750 - protein, 33 aa, Artificial Sequence
  Description of Artificial Sequence: Synthetic polypeptide
DEEEIRTTNPVATEQYGSVQSTQNALSQRGGNQ

SEQ ID NO: 18751 - protein, 31 aa, Artificial Sequence
  Description of Artificial Sequence: Synthetic polypeptide
DEEEIRTTNPVATEQYGSVVMTNLIRGELRN

SEQ ID NO: 18752 - protein, 29 aa, Artificial Sequence
  Description of Artificial Sequence: Synthetic peptide
DEEEIRTTNPVATEQYGSVSNSLDMGNEV

SEQ ID NO: 18753 - protein, 31 aa, Artificial Sequence
  Description of Artificial Sequence: Synthetic polypeptide
DEEEIRTTNPVAYEQYGKVSTNLSQPGGNRG

SEQ ID NO: 18754 - protein, 31 aa, Artificial Sequence
  Description of Artificial Sequence: Synthetic polypeptide
DEEEIRTTNPVAYEQYGSVQSCTNLQMGGND

SEQ ID NO: 18755 - protein, 31 aa, Artificial Sequence
  Description of Artificial Sequence: Synthetic polypeptide
DEEEIRTTNPVAYEQYGKVSTNLQETSGNNR

SEQ ID NO: 18756 - protein, 30 aa, Artificial Sequence
  Description of Artificial Sequence: Synthetic polypeptide
DEEEIRTTNPVAYEQYGSVSTGMLSQHVNR

SEQ ID NO: 18757 - protein, 30 aa, Artificial Sequence
  Description of Artificial Sequence: Synthetic polypeptide
DEEEIRTTNPVATEQYGSVHTNGLQDMNVI

SEQ ID NO: 18758 - protein, 32 aa, Artificial Sequence
  Description of Artificial Sequence: Synthetic polypeptide
DEEEIRTTNPVATEEYGSVVSCTNLSQHGNYR

SEQ ID NO: 18759 - protein, 33 aa, Artificial Sequence
  Description of Artificial Sequence: Synthetic polypeptide
DEEEIRTTNPVATEQYGSVQSCTNELSQRTVNR

SEQ ID NO: 18760 - protein, 32 aa, Artificial Sequence
  Description of Artificial Sequence: Synthetic polypeptide
DEEEIRTTNPVAYEQYGSVSTENLEQNFGSNR

SEQ ID NO: 18761 - protein, 31 aa, Artificial Sequence
  Description of Artificial Sequence: Synthetic polypeptide
DEEEIRTTNPVAYEQYGSVSTEDLQRFQSNR

SEQ ID NO: 18762 - protein, 32 aa, Artificial Sequence
  Description of Artificial Sequence: Synthetic polypeptide
DEEEIRTTNPVATEQYGSVVPSTGNLSQRSSR

SEQ ID NO: 18763 - protein, 31 aa, Artificial Sequence
  Description of Artificial Sequence: Synthetic polypeptide
DEEEIRTTNPVAYEQYGSVSTEDLMARGSNR

SEQ ID NO: 18764 - protein, 31 aa, Artificial Sequence
  Description of Artificial Sequence: Synthetic polypeptide
DEEEIRTTNPVAYEQYGSVSTEAHQRGSNRA

SEQ ID NO: 18765 - protein, 32 aa, Artificial Sequence
  Description of Artificial Sequence: Synthetic polypeptide
DEEEIRTTNPVAYEQYGSVSTANMLSQRGGMR

SEQ ID NO: 18766 - protein, 30 aa, Artificial Sequence
  Description of Artificial Sequence: Synthetic polypeptide
DEEEIRTTNPVAYEQYGSVSTGNHQNFGND

SEQ ID NO: 18767 - protein, 32 aa, Artificial Sequence
  Description of Artificial Sequence: Synthetic polypeptide
DEEEIRTTNPVAYEQYGESVSTNDLMQRGIRR

SEQ ID NO: 18768 - protein, 32 aa, Artificial Sequence
  Description of Artificial Sequence: Synthetic polypeptide
DEEEIRTTNPVATEQYGSVTSTMNLQTQGNGD

SEQ ID NO: 18769 - protein, 31 aa, Artificial Sequence
  Description of Artificial Sequence: Synthetic polypeptide
DEEEIRTTNPVAYEQYGSVSQNLSQNRGNNQ

SEQ ID NO: 18770 - protein, 28 aa, Artificial Sequence
  Description of Artificial Sequence: Synthetic peptide
VEDEIRCTNPVATEQYGSVATNLQHGNQ

SEQ ID NO: 18771 - protein, 30 aa, Artificial Sequence
  Description of Artificial Sequence: Synthetic polypeptide
DEEEIRTTNPVAYEQYGEVNATNLSGRGNR

SEQ ID NO: 18772 - protein, 32 aa, Artificial Sequence
  Description of Artificial Sequence: Synthetic polypeptide
DEEEIRTTNPVATEQYGSVVPSCTNLSPRGNT

SEQ ID NO: 18773 - protein, 32 aa, Artificial Sequence
  Description of Artificial Sequence: Synthetic polypeptide
DEEEIRTTNPVAYEQYGFSVSTNDELQRGVVR

SEQ ID NO: 18774 - protein, 30 aa, Artificial Sequence
  Description of Artificial Sequence: Synthetic polypeptide
DEEEIRTTNPVATEQYGSVHTNLQDGLDQQ

SEQ ID NO: 18775 - protein, 32 aa, Artificial Sequence
  Description of Artificial Sequence: Synthetic polypeptide
DEEEIRTTNPVAYEQYGFSVSTNLLDQRGILR

SEQ ID NO: 18776 - protein, 32 aa, Artificial Sequence
  Description of Artificial Sequence: Synthetic polypeptide
DEEEIRTTNPVAYEQYGSVSDTHLSQRTSGNR

SEQ ID NO: 18777 - protein, 30 aa, Artificial Sequence
  Description of Artificial Sequence: Synthetic polypeptide
DEEEIRTTNPVATEQYGSVQTALQQIGDNE

SEQ ID NO: 18778 - protein, 31 aa, Artificial Sequence
  Description of Artificial Sequence: Synthetic polypeptide
DEEEIRTTNPVAYEQYGETPSTNHLQRTGNR

SEQ ID NO: 18779 - protein, 31 aa, Artificial Sequence
  Description of Artificial Sequence: Synthetic polypeptide
DEEEIRTTNPVAYEQYGSVSTGNLQQTVNNR

SEQ ID NO: 18780 - protein, 30 aa, Artificial Sequence
  Description of Artificial Sequence: Synthetic polypeptide
DEEEIRTTNPVATEQYGSVSNTDLERIVFR

SEQ ID NO: 18781 - protein, 31 aa, Artificial Sequence
  Description of Artificial Sequence: Synthetic polypeptide
DEEEIRTTNPVAYEQYGCVSTNLQRGGSNIA

SEQ ID NO: 18782 - protein, 31 aa, Artificial Sequence
  Description of Artificial Sequence: Synthetic polypeptide
DEEEIRTTNPVAYEQYGSVSTNELSQMGNND

SEQ ID NO: 18783 - protein, 32 aa, Artificial Sequence
  Description of Artificial Sequence: Synthetic polypeptide
DEEEIRTTNPVAYEQYGSVSTNELQRPGDERL

SEQ ID NO: 18784 - protein, 32 aa, Artificial Sequence
  Description of Artificial Sequence: Synthetic polypeptide
DEEEIRTTNPVAYEQYGSVSTNELQRNGGNNT

SEQ ID NO: 18785 - protein, 32 aa, Artificial Sequence
  Description of Artificial Sequence: Synthetic polypeptide
DEEEIRTTNPVAYEQYGSVSTNELQQTSGNNR

SEQ ID NO: 18786 - protein, 32 aa, Artificial Sequence
  Description of Artificial Sequence: Synthetic polypeptide
DEEEIRTTNPVAYEQYGSVSTNELQHGGNNRM

SEQ ID NO: 18787 - protein, 31 aa, Artificial Sequence
  Description of Artificial Sequence: Synthetic polypeptide
DEEEIRTTNPVAYEQYGSVSTNEHQHTGNNR

SEQ ID NO: 18788 - protein, 30 aa, Artificial Sequence
  Description of Artificial Sequence: Synthetic polypeptide
DEEEIRTTNPVAYEQYGCVSTGLSQRGNNE

SEQ ID NO: 18789 - protein, 28 aa, Artificial Sequence
  Description of Artificial Sequence: Synthetic peptide
AEEEIACTNPVATEQYGSASENLQRGGR

SEQ ID NO: 18790 - protein, 31 aa, Artificial Sequence
  Description of Artificial Sequence: Synthetic polypeptide
DEEEIRTTNPVATEQYGSVISTNQQGGGNEQ

SEQ ID NO: 18791 - protein, 31 aa, Artificial Sequence
  Description of Artificial Sequence: Synthetic polypeptide
DEEEIRTTNPVAYEQYGCVSTNALSQRGNND

SEQ ID NO: 18792 - protein, 30 aa, Artificial Sequence
  Description of Artificial Sequence: Synthetic polypeptide
DEEEIRTTNPVAYEQYGSVSTNDLQEGDQE

SEQ ID NO: 18793 - protein, 32 aa, Artificial Sequence
  Description of Artificial Sequence: Synthetic polypeptide
DEEEIRTTNPVAYEQYGSVSTNALSQSRGGSR

SEQ ID NO: 18794 - protein, 33 aa, Artificial Sequence
  Description of Artificial Sequence: Synthetic polypeptide
DEEEIRTTNPVAYEQYGSVSTNALSQRTGQNRY

SEQ ID NO: 18795 - protein, 30 aa, Artificial Sequence
  Description of Artificial Sequence: Synthetic polypeptide
DEEEIRTTNPVATEQYGSVVPTLDLQAGNE

SEQ ID NO: 18796 - protein, 31 aa, Artificial Sequence
  Description of Artificial Sequence: Synthetic polypeptide
VEEEVRTTNPVATEQYGSVSTWNLDQEHGNR

SEQ ID NO: 18797 - protein, 31 aa, Artificial Sequence
  Description of Artificial Sequence: Synthetic polypeptide
DEEEIRTTNPVATECYGSVSTNLQGGGGENG

SEQ ID NO: 18798 - protein, 31 aa, Artificial Sequence
  Description of Artificial Sequence: Synthetic polypeptide
DEEEIRTTNPVAYEQYGSVSTGNQQITGGNR

SEQ ID NO: 18799 - protein, 31 aa, Artificial Sequence
  Description of Artificial Sequence: Synthetic polypeptide
DEEEIRTTNPVATEQYGSVQTDDLQENGENR

SEQ ID NO: 18800 - protein, 30 aa, Artificial Sequence
  Description of Artificial Sequence: Synthetic polypeptide
TTEEIRTTNPVATEQYGVTVSTNLQDGPNR

SEQ ID NO: 18801 - protein, 31 aa, Artificial Sequence
  Description of Artificial Sequence: Synthetic polypeptide
DEEEIRTTNPVAYEQYGSVSTGNLSQNGLTR

SEQ ID NO: 18802 - protein, 32 aa, Artificial Sequence
  Description of Artificial Sequence: Synthetic polypeptide
DEEEIRTTNPVATEQYGSVTSTMNLQGTGGNN

SEQ ID NO: 18803 - protein, 30 aa, Artificial Sequence
  Description of Artificial Sequence: Synthetic polypeptide
DEEEIRTTNPVAYEQYGCVSTNHSQKTGNR

SEQ ID NO: 18804 - protein, 30 aa, Artificial Sequence
  Description of Artificial Sequence: Synthetic polypeptide
TTEEIRTTNPVAYEPYGSVSTNELSQRGNR

SEQ ID NO: 18805 - protein, 32 aa, Artificial Sequence
  Description of Artificial Sequence: Synthetic polypeptide
DEEEIRTTNPVATEQYGSVSPTDNLQRELELR

SEQ ID NO: 18806 - protein, 30 aa, Artificial Sequence
  Description of Artificial Sequence: Synthetic polypeptide
DEEEIRTTNPVAYEQYGSVATNLQRENHSD

SEQ ID NO: 18807 - protein, 30 aa, Artificial Sequence
  Description of Artificial Sequence: Synthetic polypeptide
DEEEIRTTNPVATEQWGKVSCNNELPRGNR

SEQ ID NO: 18808 - protein, 31 aa, Artificial Sequence
  Description of Artificial Sequence: Synthetic polypeptide
DEEEIRTTNPVATEQYGSVISTNLTRGFQGG

SEQ ID NO: 18809 - protein, 31 aa, Artificial Sequence
  Description of Artificial Sequence: Synthetic polypeptide
DEEEIRTTNPVAYEQYGKTPSTNELSQRGNR

SEQ ID NO: 18810 - protein, 31 aa, Artificial Sequence
  Description of Artificial Sequence: Synthetic polypeptide
DEEEIRTTNPVAYEQYGSVSCTNALQTGGNL

SEQ ID NO: 18811 - protein, 33 aa, Artificial Sequence
  Description of Artificial Sequence: Synthetic polypeptide
DEEEIRTTNPVATEQWGISVSTNMLSQRGGENR

SEQ ID NO: 18812 - protein, 31 aa, Artificial Sequence
  Description of Artificial Sequence: Synthetic polypeptide
DEEEIRTTNPVAYEQYGSVSCTHLSQRSGNT

SEQ ID NO: 18813 - protein, 32 aa, Artificial Sequence
  Description of Artificial Sequence: Synthetic polypeptide
DEEEIRTTNPVATEQYGSVQSITNLQRQNLED

SEQ ID NO: 18814 - protein, 32 aa, Artificial Sequence
  Description of Artificial Sequence: Synthetic polypeptide
DEEEIRTTNPVAYEQYGSVSCTGRELQRGNNR

SEQ ID NO: 18815 - protein, 30 aa, Artificial Sequence
  Description of Artificial Sequence: Synthetic polypeptide
DEEEIRTTNPVATEQYGSVTSTNHQGGEQV

SEQ ID NO: 18816 - protein, 30 aa, Artificial Sequence
  Description of Artificial Sequence: Synthetic polypeptide
DEEEIRTTNPVAYEQYGSVSCTGLQMGGNQ

SEQ ID NO: 18817 - protein, 30 aa, Artificial Sequence
  Description of Artificial Sequence: Synthetic polypeptide
DEEEIRTTNPVAYEQYGKTVSTNLSQHPNR

SEQ ID NO: 18818 - protein, 31 aa, Artificial Sequence
  Description of Artificial Sequence: Synthetic polypeptide
VEEEVRTTNPVATEQYGSVSTNNLDQRIGER

SEQ ID NO: 18819 - protein, 32 aa, Artificial Sequence
  Description of Artificial Sequence: Synthetic polypeptide
DEEEIRTTNPVAYEQYGSVSCTNASQRTEGNR

SEQ ID NO: 18820 - protein, 32 aa, Artificial Sequence
  Description of Artificial Sequence: Synthetic polypeptide
DEEEIRTTNPVAYEQYGSVSCTGELPQRGNNR

SEQ ID NO: 18821 - protein, 31 aa, Artificial Sequence
  Description of Artificial Sequence: Synthetic polypeptide
DEEEIRTTNPVAYEQYGSVSCQNLATRVGNR

SEQ ID NO: 18822 - protein, 28 aa, Artificial Sequence
  Description of Artificial Sequence: Synthetic peptide
DEEEIRTTNPVATECYGTCSTNEQRENF

SEQ ID NO: 18823 - protein, 32 aa, Artificial Sequence
  Description of Artificial Sequence: Synthetic polypeptide
DEEEIRTTNPVATEQYGSVSPTDNIQRNSNIR

SEQ ID NO: 18824 - protein, 32 aa, Artificial Sequence
  Description of Artificial Sequence: Synthetic polypeptide
DEEEIRTTNPVATEQYGSVVPSCLNLSDRGNR

SEQ ID NO: 18825 - protein, 32 aa, Artificial Sequence
  Description of Artificial Sequence: Synthetic polypeptide
VEEEVRTTNPVATEQYGSVSTGNMLSQRTGNR

SEQ ID NO: 18826 - protein, 29 aa, Artificial Sequence
  Description of Artificial Sequence: Synthetic peptide
VEEEIATTNPVATEQWGSVSTNLQNNGNQ

SEQ ID NO: 18827 - protein, 32 aa, Artificial Sequence
  Description of Artificial Sequence: Synthetic polypeptide
DEEEIRTTNPVATEQYGSVTSTNLEQNGSNQV

SEQ ID NO: 18828 - protein, 31 aa, Artificial Sequence
  Description of Artificial Sequence: Synthetic polypeptide
DEEEIRTTNPVATEQYGSVTSTNLFGGGNGD

SEQ ID NO: 18829 - protein, 30 aa, Artificial Sequence
  Description of Artificial Sequence: Synthetic polypeptide
DEEEIRTTNPVAYEQYGSVQSQNLSQAGNG

SEQ ID NO: 18830 - protein, 31 aa, Artificial Sequence
  Description of Artificial Sequence: Synthetic polypeptide
DEEEIRTTNPVAYEQYGKVSCTTELQRGNNR

SEQ ID NO: 18831 - protein, 32 aa, Artificial Sequence
  Description of Artificial Sequence: Synthetic polypeptide
DEEEIRTTNPVATEQYGSVTSTNHQNFGSNRI

SEQ ID NO: 18832 - protein, 32 aa, Artificial Sequence
  Description of Artificial Sequence: Synthetic polypeptide
DEEEIRTTNPVAYEQYGSVSCTNEHQRTGNTR

SEQ ID NO: 18833 - protein, 32 aa, Artificial Sequence
  Description of Artificial Sequence: Synthetic polypeptide
DEEEIRTTNPVAYEQYGSVSCTNELQNPVGNR

SEQ ID NO: 18834 - protein, 32 aa, Artificial Sequence
  Description of Artificial Sequence: Synthetic polypeptide
DEEEIRTTNPVATEQYGSVVPSCTNDSARGNR

SEQ ID NO: 18835 - protein, 31 aa, Artificial Sequence
  Description of Artificial Sequence: Synthetic polypeptide
DEEEIRTTNPVAYEQYGICVSTNLSQRGNNT

SEQ ID NO: 18836 - protein, 31 aa, Artificial Sequence
  Description of Artificial Sequence: Synthetic polypeptide
DEEEIRTTNPVATEQYGSVTSTNDDRNGDDR

SEQ ID NO: 18837 - protein, 32 aa, Artificial Sequence
  Description of Artificial Sequence: Synthetic polypeptide
DEEEIRTTNPVAYEQYGSVSCTNLSQPTGNRG

SEQ ID NO: 18838 - protein, 31 aa, Artificial Sequence
  Description of Artificial Sequence: Synthetic polypeptide
DEEEIRTTNPVAYEQYGSVSCTNLSQMGGNG

SEQ ID NO: 18839 - protein, 31 aa, Artificial Sequence
  Description of Artificial Sequence: Synthetic polypeptide
VEEEVRTTNPVATEQYGSVSTWNFDQRDGNR

SEQ ID NO: 18840 - protein, 31 aa, Artificial Sequence
  Description of Artificial Sequence: Synthetic polypeptide
DEEEIRTTNPVAYEQYGSVSCTNLQSGGNDL

SEQ ID NO: 18841 - protein, 31 aa, Artificial Sequence
  Description of Artificial Sequence: Synthetic polypeptide
DEEEIRTTNPVAYEQYGSVSCTNLQMGGNTP

SEQ ID NO: 18842 - protein, 28 aa, Artificial Sequence
  Description of Artificial Sequence: Synthetic peptide
AEECIGTTNPVATEQYGSVSWNTQRGNQ

SEQ ID NO: 18843 - protein, 32 aa, Artificial Sequence
  Description of Artificial Sequence: Synthetic polypeptide
VEEEVRTTNPVATEQYGSVSTPNLDQRIGNRA

SEQ ID NO: 18844 - protein, 32 aa, Artificial Sequence
  Description of Artificial Sequence: Synthetic polypeptide
VEEEVRTTNPVATEQYGSVSTPNLDQRIGENR

SEQ ID NO: 18845 - protein, 32 aa, Artificial Sequence
  Description of Artificial Sequence: Synthetic polypeptide
DEEEIRTTNPVATEQYGSVSPPVNLQRTGDRQ

SEQ ID NO: 18846 - protein, 31 aa, Artificial Sequence
  Description of Artificial Sequence: Synthetic polypeptide
DEEEIRTTNPVAYEQYGSVSCTNLQLGGNNT

SEQ ID NO: 18847 - protein, 31 aa, Artificial Sequence
  Description of Artificial Sequence: Synthetic polypeptide
DEEEIRTTNPVAYEQYGSVSCTNLPQGGGNL

SEQ ID NO: 18848 - protein, 33 aa, Artificial Sequence
  Description of Artificial Sequence: Synthetic polypeptide
DEEEIRTTNPVATEQYGSVVPSCTNLSNRGNNR

SEQ ID NO: 18849 - protein, 32 aa, Artificial Sequence
  Description of Artificial Sequence: Synthetic polypeptide
DEEEIRTTNPVATEQYGSVVPSCTNLSERGSR

SEQ ID NO: 18850 - protein, 32 aa, Artificial Sequence
  Description of Artificial Sequence: Synthetic polypeptide
DEEEIRTTNPVAYEQYGSVSCTNLAQSAGSNR

SEQ ID NO: 18851 - protein, 33 aa, Artificial Sequence
  Description of Artificial Sequence: Synthetic polypeptide
DEEEIRTTNPVATEQYGSVVPSCTNELSSRGNR

SEQ ID NO: 18852 - protein, 31 aa, Artificial Sequence
  Description of Artificial Sequence: Synthetic polypeptide
VEEEVRTTNPVATEQYGSVSTNNLDQRIGNL

SEQ ID NO: 18853 - protein, 31 aa, Artificial Sequence
  Description of Artificial Sequence: Synthetic polypeptide
DEEEIRTTNPVAYEQYGSVSCTNIQSTGNNR

SEQ ID NO: 18854 - protein, 32 aa, Artificial Sequence
  Description of Artificial Sequence: Synthetic polypeptide
DEEEIRTTNPVAYEQYGISVVSTGNLSQSGNR

SEQ ID NO: 18855 - protein, 31 aa, Artificial Sequence
  Description of Artificial Sequence: Synthetic polypeptide
DEEEIRTTNPVAYEQYGSVSCTNHQQVGNER

SEQ ID NO: 18856 - protein, 30 aa, Artificial Sequence
  Description of Artificial Sequence: Synthetic polypeptide
DEEEIRTTNPVAYEQYGSVSCTNHQKGGNL

SEQ ID NO: 18857 - protein, 32 aa, Artificial Sequence
  Description of Artificial Sequence: Synthetic polypeptide
DEEEIRTTNPVAYEQYGSVSCTNELSARGNPR

SEQ ID NO: 18858 - protein, 31 aa, Artificial Sequence
  Description of Artificial Sequence: Synthetic polypeptide
DEAAIRTTNPVATEPYGSVSTNLSQNRGTNR

SEQ ID NO: 18859 - protein, 33 aa, Artificial Sequence
  Description of Artificial Sequence: Synthetic polypeptide
DEEEIRTTNPVAYEQYGSVSTNELSQRTGNQRL

SEQ ID NO: 18860 - protein, 30 aa, Artificial Sequence
  Description of Artificial Sequence: Synthetic polypeptide
DEEEIATTNPVATEQYGEVSTNSGQNGNER

SEQ ID NO: 18861 - protein, 29 aa, Artificial Sequence
  Description of Artificial Sequence: Synthetic peptide
DEEEIRTTNPVATECYGVVSTNLQNPNVQ

SEQ ID NO: 18862 - protein, 32 aa, Artificial Sequence
  Description of Artificial Sequence: Synthetic polypeptide
DEEEIRTTNPVATEQYGSVISPTNLQRETERN

SEQ ID NO: 18863 - protein, 32 aa, Artificial Sequence
  Description of Artificial Sequence: Synthetic polypeptide
DEEEIRTTNPVAYEQYGQSVSTNNLSQRGQDR

SEQ ID NO: 18864 - protein, 34 aa, Artificial Sequence
  Description of Artificial Sequence: Synthetic polypeptide
DEEEIRTTNPVATEQYGSVISPTNLQGRNGNTRN

SEQ ID NO: 18865 - protein, 32 aa, Artificial Sequence
  Description of Artificial Sequence: Synthetic polypeptide
DEEEIRTTNPVAYEQYGQSVSTNMLSQRGGER

SEQ ID NO: 18866 - protein, 32 aa, Artificial Sequence
  Description of Artificial Sequence: Synthetic polypeptide
DEEEIRTTNPVAYEQYGQSVSTNLSERGGNNR

SEQ ID NO: 18867 - protein, 32 aa, Artificial Sequence
  Description of Artificial Sequence: Synthetic polypeptide
DEEEIRTTNPVAYEQYGQSVSTNILLQRGITR

SEQ ID NO: 18868 - protein, 31 aa, Artificial Sequence
  Description of Artificial Sequence: Synthetic polypeptide
DEEEIRTTNPVATEQYGSVSNTATQEHGSNR

SEQ ID NO: 18869 - protein, 30 aa, Artificial Sequence
  Description of Artificial Sequence: Synthetic polypeptide
DEEEIRTTNPVATEQYGSVTTNMLVNGERD

SEQ ID NO: 18870 - protein, 31 aa, Artificial Sequence
  Description of Artificial Sequence: Synthetic polypeptide
DEEEIRTTNPVATEQYGSVISPTNLIQRTQQ

SEQ ID NO: 18871 - protein, 32 aa, Artificial Sequence
  Description of Artificial Sequence: Synthetic polypeptide
DEEEIRTTNPVAYEQYGQSVSTNELSQRGDAR

SEQ ID NO: 18872 - protein, 33 aa, Artificial Sequence
  Description of Artificial Sequence: Synthetic polypeptide
DEEEIRTTNPVATEQYGSVISPTNLQRNVNERN

SEQ ID NO: 18873 - protein, 32 aa, Artificial Sequence
  Description of Artificial Sequence: Synthetic polypeptide
DEEEIRTTNPVAYEQYGQSVSTNELFQRGGPR

SEQ ID NO: 18874 - protein, 32 aa, Artificial Sequence
  Description of Artificial Sequence: Synthetic polypeptide
DEEEIRTTNPVAYEQYGQSVSTNDLVQRGLER

SEQ ID NO: 18875 - protein, 32 aa, Artificial Sequence
  Description of Artificial Sequence: Synthetic polypeptide
DEEEIRTTNPVAYEQYGQSVSTNDLVQRGDRR

SEQ ID NO: 18876 - protein, 29 aa, Artificial Sequence
  Description of Artificial Sequence: Synthetic peptide
DEEEIRTTNPVATEQYGSVSPTALQDTEQ

SEQ ID NO: 18877 - protein, 31 aa, Artificial Sequence
  Description of Artificial Sequence: Synthetic polypeptide
DEAEIRTTNPVATEQYGCTISTNELQRGNER

SEQ ID NO: 18878 - protein, 30 aa, Artificial Sequence
  Description of Artificial Sequence: Synthetic polypeptide
DEEEIATTNPVATEQYGCVSTNLQPGGDNH

SEQ ID NO: 18879 - protein, 29 aa, Artificial Sequence
  Description of Artificial Sequence: Synthetic peptide
DEEEIRTTNPVATEQYGSVTTNNDRIEQR

SEQ ID NO: 18880 - protein, 32 aa, Artificial Sequence
  Description of Artificial Sequence: Synthetic polypeptide
DEEEIRTTNPVAYEQYGQSVSTNDLLQRGSAR

SEQ ID NO: 18881 - protein, 32 aa, Artificial Sequence
  Description of Artificial Sequence: Synthetic polypeptide
DEEEIRTTNPVATEEYGISVSTGNLQDRIMNR

SEQ ID NO: 18882 - protein, 30 aa, Artificial Sequence
  Description of Artificial Sequence: Synthetic polypeptide
DEEEIRTTNPVATEQYGSVTTPLQDFGERA

SEQ ID NO: 18883 - protein, 30 aa, Artificial Sequence
  Description of Artificial Sequence: Synthetic polypeptide
DEEEIATTNPVATEQYGCVSTNLQNMGDNN

SEQ ID NO: 18884 - protein, 32 aa, Artificial Sequence
  Description of Artificial Sequence: Synthetic polypeptide
DEEEIRTTNPVAYEQYGQSVSTNDLVQRGPRR

SEQ ID NO: 18885 - protein, 32 aa, Artificial Sequence
  Description of Artificial Sequence: Synthetic polypeptide
DEEEIRTTNPVAYEQYGQSVSTNDLLQRGDTR

SEQ ID NO: 18886 - protein, 32 aa, Artificial Sequence
  Description of Artificial Sequence: Synthetic polypeptide
DEEEIRTTNPVAYEQYGQSVSTNSLDQRGGGR

SEQ ID NO: 18887 - protein, 29 aa, Artificial Sequence
  Description of Artificial Sequence: Synthetic peptide
DEAEIRTTNPVATEQWGSVSTNLETGNPQ

SEQ ID NO: 18888 - protein, 31 aa, Artificial Sequence
  Description of Artificial Sequence: Synthetic polypeptide
DEEEIRTTNPVATEQYGSVISSTDLQIGDNV

SEQ ID NO: 18889 - protein, 31 aa, Artificial Sequence
  Description of Artificial Sequence: Synthetic polypeptide
DEEEIRTTNPVATEQYGSVTTNLNQFGNTGE

SEQ ID NO: 18890 - protein, 31 aa, Artificial Sequence
  Description of Artificial Sequence: Synthetic polypeptide
DEEEIRTTNPVATEQYGSVISESNLQRGEQD

SEQ ID NO: 18891 - protein, 31 aa, Artificial Sequence
  Description of Artificial Sequence: Synthetic polypeptide
DEEEIRTTNPVATEQYGSVTTNLNQGNGNGE

SEQ ID NO: 18892 - protein, 31 aa, Artificial Sequence
  Description of Artificial Sequence: Synthetic polypeptide
DEEEIRTTNPVATEEYGSVCFTNLTRGGNRM

SEQ ID NO: 18893 - protein, 31 aa, Artificial Sequence
  Description of Artificial Sequence: Synthetic polypeptide
DEEEIRTTNPVATEQWGCVCSTNDLQFGSNR

SEQ ID NO: 18894 - protein, 33 aa, Artificial Sequence
  Description of Artificial Sequence: Synthetic polypeptide
DEEEIRTTNPVATEQYGSVSPTANDLQRGLLRI

SEQ ID NO: 18895 - protein, 32 aa, Artificial Sequence
  Description of Artificial Sequence: Synthetic polypeptide
DEEEIRTTNPVATEQYGSVSPTALSQRSQNGR

SEQ ID NO: 18896 - protein, 30 aa, Artificial Sequence
  Description of Artificial Sequence: Synthetic polypeptide
DEEEIRTTNPVATEQYGSVSPSNLQTLNVF

SEQ ID NO: 18897 - protein, 28 aa, Artificial Sequence
  Description of Artificial Sequence: Synthetic peptide
DEEEIATTNPVATEQYGDVSENLMHGQR

SEQ ID NO: 18898 - protein, 32 aa, Artificial Sequence
  Description of Artificial Sequence: Synthetic polypeptide
DEEEIRTTNPVAYEQYGQSVSTNTLLQRGIMR

SEQ ID NO: 18899 - protein, 30 aa, Artificial Sequence
  Description of Artificial Sequence: Synthetic polypeptide
DEEEIRTTNPVATEQYGSVTTNLQNIGEDI

SEQ ID NO: 18900 - protein, 30 aa, Artificial Sequence
  Description of Artificial Sequence: Synthetic polypeptide
DEEEIRTTNPVATEQWGAVSTELQRGPERA

SEQ ID NO: 18901 - protein, 31 aa, Artificial Sequence
  Description of Artificial Sequence: Synthetic polypeptide
DEEEIRTTNPVATEQYGSVQSTEDLQEQNRD

SEQ ID NO: 18902 - protein, 30 aa, Artificial Sequence
  Description of Artificial Sequence: Synthetic polypeptide
DEEEIRTTNPVATEEYGCVSTEAHQRGSNR

SEQ ID NO: 18903 - protein, 30 aa, Artificial Sequence
  Description of Artificial Sequence: Synthetic polypeptide
DEEEIRTTNPVATEEYGCVSTELQRFGNQS

SEQ ID NO: 18904 - protein, 30 aa, Artificial Sequence
  Description of Artificial Sequence: Synthetic polypeptide
DEAEIRTTNPVATEQYGCVATNLQRGNEGA

SEQ ID NO: 18905 - protein, 32 aa, Artificial Sequence
  Description of Artificial Sequence: Synthetic polypeptide
DEEEIRTTNPVATEQYGSVQSTGNPQRFGNDS

SEQ ID NO: 18906 - protein, 31 aa, Artificial Sequence
  Description of Artificial Sequence: Synthetic polypeptide
DEEEIRTTNPVATEQYGSVISSNCIQQAGNR

SEQ ID NO: 18907 - protein, 32 aa, Artificial Sequence
  Description of Artificial Sequence: Synthetic polypeptide
DEEEIRTTNPVATEQYGSVISGTMNLQEGFNE

SEQ ID NO: 18908 - protein, 31 aa, Artificial Sequence
  Description of Artificial Sequence: Synthetic polypeptide
DEAEIRTTNPVATEQWGSVPSTNLSQAGTNR

SEQ ID NO: 18909 - protein, 30 aa, Artificial Sequence
  Description of Artificial Sequence: Synthetic polypeptide
VEEEIRTTNPVATEQYGSVSTGLQRNANFI

SEQ ID NO: 18910 - protein, 31 aa, Artificial Sequence
  Description of Artificial Sequence: Synthetic polypeptide
DEEEIRTTNPVATEQYGSVTTNLQQGIGGNA

SEQ ID NO: 18911 - protein, 30 aa, Artificial Sequence
  Description of Artificial Sequence: Synthetic polypeptide
DEEEIRTTNPVATEQYGSVTTPLQDNIGER

SEQ ID NO: 18912 - protein, 30 aa, Artificial Sequence
  Description of Artificial Sequence: Synthetic polypeptide
DEEEIATTNPVATEQYGCVSTNLQNFGFNQ

SEQ ID NO: 18913 - protein, 32 aa, Artificial Sequence
  Description of Artificial Sequence: Synthetic polypeptide
DEEEIRTTNPVATEQYGSVQSTMNLQGGSNDQ

SEQ ID NO: 18914 - protein, 32 aa, Artificial Sequence
  Description of Artificial Sequence: Synthetic polypeptide
DEEEIRTTNPVATEQYGSVISGTTNLQQNGNE

SEQ ID NO: 18915 - protein, 30 aa, Artificial Sequence
  Description of Artificial Sequence: Synthetic polypeptide
DEEAIRTTNPVATEQWGSVFTNNLQLGNNR

SEQ ID NO: 18916 - protein, 32 aa, Artificial Sequence
  Description of Artificial Sequence: Synthetic polypeptide
DEEEIRTTNPVAYEQYGQSVSQNDLDQRGNDR

SEQ ID NO: 18917 - protein, 30 aa, Artificial Sequence
  Description of Artificial Sequence: Synthetic polypeptide
VEEEIRTTNPVATEQYGSVSTPNLQRPEPY

SEQ ID NO: 18918 - protein, 30 aa, Artificial Sequence
  Description of Artificial Sequence: Synthetic polypeptide
VEEEIRTTNPVATEQYGSVSTPNLVRPENV

SEQ ID NO: 18919 - protein, 29 aa, Artificial Sequence
  Description of Artificial Sequence: Synthetic peptide
DEEEIRTTNPVATEQYGSVISNLERGELV

SEQ ID NO: 18920 - protein, 31 aa, Artificial Sequence
  Description of Artificial Sequence: Synthetic polypeptide
DEEEIRTTNPVATEQYGSVQSTNHTNMGSNR

SEQ ID NO: 18921 - protein, 30 aa, Artificial Sequence
  Description of Artificial Sequence: Synthetic polypeptide
VEEEIRTTNPVATEQYGSVSTPVGLQRGEQ

SEQ ID NO: 18922 - protein, 31 aa, Artificial Sequence
  Description of Artificial Sequence: Synthetic polypeptide
DEEEIRTTNPVATEQYGSVQSTNDQNGIDER

SEQ ID NO: 18923 - protein, 30 aa, Artificial Sequence
  Description of Artificial Sequence: Synthetic polypeptide
DEAEIRTTNPVATEQYGAVSTNLQTGMNDQ

SEQ ID NO: 18924 - protein, 30 aa, Artificial Sequence
  Description of Artificial Sequence: Synthetic polypeptide
DEEEIATTNPVATEQYGCVSTALQRGSNAS

SEQ ID NO: 18925 - protein, 30 aa, Artificial Sequence
  Description of Artificial Sequence: Synthetic polypeptide
DEEEIATTNPVATEQYGCVATNLQREENRD

SEQ ID NO: 18926 - protein, 32 aa, Artificial Sequence
  Description of Artificial Sequence: Synthetic polypeptide
DEEEIRTTNPVATEQYGSVQSTNDLQFGSNDM

SEQ ID NO: 18927 - protein, 33 aa, Artificial Sequence
  Description of Artificial Sequence: Synthetic polypeptide
DEEEIRTTNPVATEEYGSTVSTNLSQRGGNNRT

SEQ ID NO: 18928 - protein, 31 aa, Artificial Sequence
  Description of Artificial Sequence: Synthetic polypeptide
DEAEIRTTNPVATEQYGAVSTENLQDGGENR

SEQ ID NO: 18929 - protein, 32 aa, Artificial Sequence
  Description of Artificial Sequence: Synthetic polypeptide
DEEEIRTTNPVATEQYGSVQSTNDLNRNGNQE

SEQ ID NO: 18930 - protein, 31 aa, Artificial Sequence
  Description of Artificial Sequence: Synthetic polypeptide
DEEEIRTTNPVATEQYGSVVATVLQRGEERD

SEQ ID NO: 18931 - protein, 31 aa, Artificial Sequence
  Description of Artificial Sequence: Synthetic polypeptide
DEEEIRTTNPVATEQYGSVISPSNLQGGNEN

SEQ ID NO: 18932 - protein, 31 aa, Artificial Sequence
  Description of Artificial Sequence: Synthetic polypeptide
DEEEIRTTNPVATEQYGSVQSTNDENGSDNR

SEQ ID NO: 18933 - protein, 33 aa, Artificial Sequence
  Description of Artificial Sequence: Synthetic polypeptide
DEEEIRTTNPVATEQYGSVISPTALPQRGENRI

SEQ ID NO: 18934 - protein, 30 aa, Artificial Sequence
  Description of Artificial Sequence: Synthetic polypeptide
DEEEIRTTNPVATEQYGSVVATNLQRESFQ

SEQ ID NO: 18935 - protein, 32 aa, Artificial Sequence
  Description of Artificial Sequence: Synthetic polypeptide
DEEEIRTTNPVATEQYGSVVATNLSQPTGGNR

SEQ ID NO: 18936 - protein, 32 aa, Artificial Sequence
  Description of Artificial Sequence: Synthetic polypeptide
DEEEIRTTNPVATEQYGSVQSTNCIQNTLGNR

SEQ ID NO: 18937 - protein, 31 aa, Artificial Sequence
  Description of Artificial Sequence: Synthetic polypeptide
DEEEIRTTNPVATEQYGSVTVLTNQLQGDNR

SEQ ID NO: 18938 - protein, 33 aa, Artificial Sequence
  Description of Artificial Sequence: Synthetic polypeptide
DEEEIRTTNPVAYEQYGQSVSSTNDLLQRGNTR

SEQ ID NO: 18939 - protein, 30 aa, Artificial Sequence
  Description of Artificial Sequence: Synthetic polypeptide
DEEEIRTTNPVATEQYGSVVENNLQVRGDV

SEQ ID NO: 18940 - protein, 31 aa, Artificial Sequence
  Description of Artificial Sequence: Synthetic polypeptide
DEEEIATTNPVATEQYGCVSTNLQHAGDNNR

SEQ ID NO: 18941 - protein, 33 aa, Artificial Sequence
  Description of Artificial Sequence: Synthetic polypeptide
DEEEIRTTNPVATEQYGSVQSTNALSQRPVNNR

SEQ ID NO: 18942 - protein, 32 aa, Artificial Sequence
  Description of Artificial Sequence: Synthetic polypeptide
DEEEIRTTNPVAYEQYGQSVSTNDLIQRGILR

SEQ ID NO: 18943 - protein, 30 aa, Artificial Sequence
  Description of Artificial Sequence: Synthetic polypeptide
DEEEIRTTNPVATEQYGSVTTPLQNGGERG

SEQ ID NO: 18944 - protein, 32 aa, Artificial Sequence
  Description of Artificial Sequence: Synthetic polypeptide
DEEEIRTTNPVAYEQYGQSVSTNDLEQRGIVR

SEQ ID NO: 18945 - protein, 32 aa, Artificial Sequence
  Description of Artificial Sequence: Synthetic polypeptide
DEEEIRTTNPVATEQYGSVVFTNEGQERGNIR

SEQ ID NO: 18946 - protein, 32 aa, Artificial Sequence
  Description of Artificial Sequence: Synthetic polypeptide
DEEEIRTTNPVAYEQYGQSVSTNDLEQRGIIR

SEQ ID NO: 18947 - protein, 32 aa, Artificial Sequence
  Description of Artificial Sequence: Synthetic polypeptide
DEEEIRTTNPVAYEQYGQSVSTNDLEQRGEGR

SEQ ID NO: 18948 - protein, 32 aa, Artificial Sequence
  Description of Artificial Sequence: Synthetic polypeptide
DEEEIRTTNPVAYEQYGQSVSTNDLDQRGVVR

SEQ ID NO: 18949 - protein, 30 aa, Artificial Sequence
  Description of Artificial Sequence: Synthetic polypeptide
VEEEIRTTNPVATEQYGSVSTNGQTGEVRD

SEQ ID NO: 18950 - protein, 32 aa, Artificial Sequence
  Description of Artificial Sequence: Synthetic polypeptide
DEEEIRTTNPVAYEQYGQSVSTNDLDQRGIFR

SEQ ID NO: 18951 - protein, 28 aa, Artificial Sequence
  Description of Artificial Sequence: Synthetic peptide
DEEEIRTTNPVATEEYGKISTNEQRQNF

SEQ ID NO: 18952 - protein, 32 aa, Artificial Sequence
  Description of Artificial Sequence: Synthetic polypeptide
DEEEIRTTNPVATEQYGSVSPTALIQRLDNRI

SEQ ID NO: 18953 - protein, 30 aa, Artificial Sequence
  Description of Artificial Sequence: Synthetic polypeptide
DEEEIRTTNPVATEQWGATISTNELQNGNR

SEQ ID NO: 18954 - protein, 30 aa, Artificial Sequence
  Description of Artificial Sequence: Synthetic polypeptide
DEEEIATTNPVATEQYGCVSTNLGHGDDNR

SEQ ID NO: 18955 - protein, 33 aa, Artificial Sequence
  Description of Artificial Sequence: Synthetic polypeptide
DEEEIRTTNPVAYEQYGQSVSTNALSQRGGINR

SEQ ID NO: 18956 - protein, 33 aa, Artificial Sequence
  Description of Artificial Sequence: Synthetic polypeptide
DEEEIRTTNPVATEQYGSVQSTNCILQEEGENR

SEQ ID NO: 18957 - protein, 31 aa, Artificial Sequence
  Description of Artificial Sequence: Synthetic polypeptide
VEEEIRTTNPVATEQYGSVSTNLQQGGENGD

SEQ ID NO: 18958 - protein, 30 aa, Artificial Sequence
  Description of Artificial Sequence: Synthetic polypeptide
DEEEIRTTNPVATEQYGSVVETNLVNGETR

SEQ ID NO: 18959 - protein, 30 aa, Artificial Sequence
  Description of Artificial Sequence: Synthetic polypeptide
DEEEIRTTNPVAYEQYGQSVSTGPSQRGNF

SEQ ID NO: 18960 - protein, 31 aa, Artificial Sequence
  Description of Artificial Sequence: Synthetic polypeptide
DEEEIRTTNPVATEQYGSVQSTNCIPIEGNR

SEQ ID NO: 18961 - protein, 30 aa, Artificial Sequence
  Description of Artificial Sequence: Synthetic polypeptide
VEEEIRTTNPVATEQYGSVSTNLQRVVEAD

SEQ ID NO: 18962 - protein, 31 aa, Artificial Sequence
  Description of Artificial Sequence: Synthetic polypeptide
VEEEIRTTNPVATEQYGSVSTNLQSNGTGNN

SEQ ID NO: 18963 - protein, 31 aa, Artificial Sequence
  Description of Artificial Sequence: Synthetic polypeptide
DEEEIRTTNPVATEQYGSVISCTNGGQRGEE

SEQ ID NO: 18964 - protein, 30 aa, Artificial Sequence
  Description of Artificial Sequence: Synthetic polypeptide
DEEEIRTTNPVATEQYGSVTTNLETLENER

SEQ ID NO: 18965 - protein, 30 aa, Artificial Sequence
  Description of Artificial Sequence: Synthetic polypeptide
DEEAIRTTNPVATEQWGSVQTNNLQGGGNR

SEQ ID NO: 18966 - protein, 31 aa, Artificial Sequence
  Description of Artificial Sequence: Synthetic polypeptide
DEEEIRTTNPVATEQYGSVIPTNLDQRGDQQ

SEQ ID NO: 18967 - protein, 32 aa, Artificial Sequence
  Description of Artificial Sequence: Synthetic polypeptide
DEEEIRTTNPVAYEQYGSVATNELSQRGGNRQ

SEQ ID NO: 18968 - protein, 32 aa, Artificial Sequence
  Description of Artificial Sequence: Synthetic polypeptide
DEEEIRTTNPVATEQYGSVISTGNLQDGNIEQ

SEQ ID NO: 18969 - protein, 32 aa, Artificial Sequence
  Description of Artificial Sequence: Synthetic polypeptide
DEEEIRTTNPVATEQYGSVIEPTNLQRGNVLS

SEQ ID NO: 18970 - protein, 30 aa, Artificial Sequence
  Description of Artificial Sequence: Synthetic polypeptide
DEEAIRTTNPVATEQYDYSVSWNLQRGSNA

SEQ ID NO: 18971 - protein, 32 aa, Artificial Sequence
  Description of Artificial Sequence: Synthetic polypeptide
DEEEIRTTNPVATEEYGSVCSTPNLQRGGSNA

SEQ ID NO: 18972 - protein, 28 aa, Artificial Sequence
  Description of Artificial Sequence: Synthetic peptide
DEEEIRTTNPVATECYGYHSTNEQRDNF

SEQ ID NO: 18973 - protein, 30 aa, Artificial Sequence
  Description of Artificial Sequence: Synthetic polypeptide
DEEEIRTTNPVATEQYGSVIETNLERVNDI

SEQ ID NO: 18974 - protein, 32 aa, Artificial Sequence
  Description of Artificial Sequence: Synthetic polypeptide
VEEEIRTTNPVATEQYGSVNTGNLDQRGENPR

SEQ ID NO: 18975 - protein, 32 aa, Artificial Sequence
  Description of Artificial Sequence: Synthetic polypeptide
DEEEIRTTNPVAYEQYGSVACTNLSQRGGNRP

SEQ ID NO: 18976 - protein, 30 aa, Artificial Sequence
  Description of Artificial Sequence: Synthetic polypeptide
DEEEIRTTNPVAYEQYGSVACTNLQRVNND

SEQ ID NO: 18977 - protein, 29 aa, Artificial Sequence
  Description of Artificial Sequence: Synthetic peptide
DEEEIRTTNPVAYEQYGSVATNEQNGNDF

SEQ ID NO: 18978 - protein, 30 aa, Artificial Sequence
  Description of Artificial Sequence: Synthetic polypeptide
DEEEIRTTNPVAYEQYGSVACTNLQMGGNA

SEQ ID NO: 18979 - protein, 31 aa, Artificial Sequence
  Description of Artificial Sequence: Synthetic polypeptide
DEEEIRTTNPVATEQYGSVQSTPDLQRGLTE

SEQ ID NO: 18980 - protein, 30 aa, Artificial Sequence
  Description of Artificial Sequence: Synthetic polypeptide
DEEEIRTTNPVAYEQYGSVAATNLQQGDRQ

SEQ ID NO: 18981 - protein, 32 aa, Artificial Sequence
  Description of Artificial Sequence: Synthetic polypeptide
DEEEIRTTNPVATEQYGSVISTELQPRGINDQ

SEQ ID NO: 18982 - protein, 32 aa, Artificial Sequence
  Description of Artificial Sequence: Synthetic polypeptide
VEEEIRTTNPVATEQYGSVVTSNLVQRGENDR

SEQ ID NO: 18983 - protein, 32 aa, Artificial Sequence
  Description of Artificial Sequence: Synthetic polypeptide
VEEEIRTTNPVATEQYGSVNTSNLSQRGGNNR

SEQ ID NO: 18984 - protein, 31 aa, Artificial Sequence
  Description of Artificial Sequence: Synthetic polypeptide
DEEEIRTTNPVATEQYGSVQSTNVQRENNDS

SEQ ID NO: 18985 - protein, 31 aa, Artificial Sequence
  Description of Artificial Sequence: Synthetic polypeptide
DEEEIRTTNPVAYEQYGSTVSTTMLSQHGNR

SEQ ID NO: 18986 - protein, 32 aa, Artificial Sequence
  Description of Artificial Sequence: Synthetic polypeptide
VEEEIRTTNPVATEQYGSVNTSNLTQRGENYR

SEQ ID NO: 18987 - protein, 32 aa, Artificial Sequence
  Description of Artificial Sequence: Synthetic polypeptide
DEEEIRTTNPVAYEQYGSTVSTNSLSQRGTER

SEQ ID NO: 18988 - protein, 31 aa, Artificial Sequence
  Description of Artificial Sequence: Synthetic polypeptide
DEEEIRTTNPVATEQYGSVIFNSLQNEGVNR

SEQ ID NO: 18989 - protein, 31 aa, Artificial Sequence
  Description of Artificial Sequence: Synthetic polypeptide
DEEAIRTTNPVATEQYDYSCVSINLQRGDNR

SEQ ID NO: 18990 - protein, 30 aa, Artificial Sequence
  Description of Artificial Sequence: Synthetic polypeptide
DEEEIRTTNPVAYEQYGSVATNLENNGNDR

SEQ ID NO: 18991 - protein, 31 aa, Artificial Sequence
  Description of Artificial Sequence: Synthetic polypeptide
VEEEIRTTNPVATEQYGSVNSTNLQNDGNIQ

SEQ ID NO: 18992 - protein, 30 aa, Artificial Sequence
  Description of Artificial Sequence: Synthetic polypeptide
DEEEIRTTNPVAYEQYGSVATNLETGNNDR

SEQ ID NO: 18993 - protein, 30 aa, Artificial Sequence
  Description of Artificial Sequence: Synthetic polypeptide
DEEEIRTTNPVAYEQYGSVATNLQNNGEGR

SEQ ID NO: 18994 - protein, 31 aa, Artificial Sequence
  Description of Artificial Sequence: Synthetic polypeptide
DEEEIRTTNPVAYEQYGSVATNLQNDGNTRA

SEQ ID NO: 18995 - protein, 31 aa, Artificial Sequence
  Description of Artificial Sequence: Synthetic polypeptide
DEEEIATTNPVATEQYGEVSTNLQNDGNNSR

SEQ ID NO: 18996 - protein, 32 aa, Artificial Sequence
  Description of Artificial Sequence: Synthetic polypeptide
DEEEIRTTNPVATEQYGSVTSTNNLQGGSNDM

SEQ ID NO: 18997 - protein, 29 aa, Artificial Sequence
  Description of Artificial Sequence: Synthetic peptide
DEEEIRTTNPVAYEQYGSVATNLQGGDMH

SEQ ID NO: 18998 - protein, 30 aa, Artificial Sequence
  Description of Artificial Sequence: Synthetic polypeptide
DEEEIRTTNPVAYEQYGSVATNLQGGDDAR

SEQ ID NO: 18999 - protein, 30 aa, Artificial Sequence
  Description of Artificial Sequence: Synthetic polypeptide
DEEEIRTTNPVAYEQYGSVATNLQGFDGSR

SEQ ID NO: 19000 - protein, 29 aa, Artificial Sequence
  Description of Artificial Sequence: Synthetic peptide
DEAEIRTTNPVATEQWGETSTNLQRGDNS

SEQ ID NO: 19001 - protein, 30 aa, Artificial Sequence
  Description of Artificial Sequence: Synthetic polypeptide
DEEEIATTNPVATEQYGEVSTNLQHDNGNG

SEQ ID NO: 19002 - protein, 31 aa, Artificial Sequence
  Description of Artificial Sequence: Synthetic polypeptide
DEEEIRTTNPVAYEQYGSVATNLQDRGDNSM

SEQ ID NO: 19003 - protein, 32 aa, Artificial Sequence
  Description of Artificial Sequence: Synthetic polypeptide
DEEEIRTTNPVATEQYGSVVMTGNLQRGPQDR

SEQ ID NO: 19004 - protein, 31 aa, Artificial Sequence
  Description of Artificial Sequence: Synthetic polypeptide
DEEEIRTTNPVATEQYGSVISTMDQRGNDLV

SEQ ID NO: 19005 - protein, 30 aa, Artificial Sequence
  Description of Artificial Sequence: Synthetic polypeptide
DEEEIRTTNPVAYEQYGSVATNLQDGNGNM

SEQ ID NO: 19006 - protein, 31 aa, Artificial Sequence
  Description of Artificial Sequence: Synthetic polypeptide
DEEEIRTTNPVATEQYGSVTSTNVQQGGGNQ

SEQ ID NO: 19007 - protein, 31 aa, Artificial Sequence
  Description of Artificial Sequence: Synthetic polypeptide
DEEEIRTTNPVATEQYGSVTSTPLQRFGEQP

SEQ ID NO: 19008 - protein, 31 aa, Artificial Sequence
  Description of Artificial Sequence: Synthetic polypeptide
DEEEIRTTNPVATEQYGSVTSTQNEQGGGNI

SEQ ID NO: 19009 - protein, 31 aa, Artificial Sequence
  Description of Artificial Sequence: Synthetic polypeptide
DEEEIATTNPVATEQYGEVSTNLQGDDGHNR

SEQ ID NO: 19010 - protein, 28 aa, Artificial Sequence
  Description of Artificial Sequence: Synthetic peptide
DEEEIRTTNPVATECYGWCSTNEQRNNF

SEQ ID NO: 19011 - protein, 29 aa, Artificial Sequence
  Description of Artificial Sequence: Synthetic peptide
DEEEIRTTNPVAYEQYGSVATNLQANDAR

SEQ ID NO: 19012 - protein, 32 aa, Artificial Sequence
  Description of Artificial Sequence: Synthetic polypeptide
DEEEIRTTNPVATEQYGSVVMTGNLQRGEQER

SEQ ID NO: 19013 - protein, 32 aa, Artificial Sequence
  Description of Artificial Sequence: Synthetic polypeptide
DEEEIRTTNPVATEQYGSVISTLNLQEVAGNN

SEQ ID NO: 19014 - protein, 31 aa, Artificial Sequence
  Description of Artificial Sequence: Synthetic polypeptide
DEEEIRTTNPVATEQYGSVTSTTDLQRDERM

SEQ ID NO: 19015 - protein, 31 aa, Artificial Sequence
  Description of Artificial Sequence: Synthetic polypeptide
VEEEIRTTNPVATEQYGSVNSTNLQMNIGNQ

SEQ ID NO: 19016 - protein, 31 aa, Artificial Sequence
  Description of Artificial Sequence: Synthetic polypeptide
DEEEIRTTNPVATEQYGSVTSTVNTLGMGNV

SEQ ID NO: 19017 - protein, 30 aa, Artificial Sequence
  Description of Artificial Sequence: Synthetic polypeptide
DEEEIRTTNPVATEQYGSVSPSNEQRDDDR

SEQ ID NO: 19018 - protein, 30 aa, Artificial Sequence
  Description of Artificial Sequence: Synthetic polypeptide
VEEEIRTTNPVATEQYGSVSAENLDEFGNR

SEQ ID NO: 19019 - protein, 31 aa, Artificial Sequence
  Description of Artificial Sequence: Synthetic polypeptide
DEEEIRTTNPVATEQYGSVIFTNLQPVGNEG

SEQ ID NO: 19020 - protein, 30 aa, Artificial Sequence
  Description of Artificial Sequence: Synthetic polypeptide
DEEEIRTTNPVATEQYGSVVLTVGQRGVRF

SEQ ID NO: 19021 - protein, 30 aa, Artificial Sequence
  Description of Artificial Sequence: Synthetic polypeptide
DEEAIRTTNPVATEQWGSVATNNLQLGTNR

SEQ ID NO: 19022 - protein, 32 aa, Artificial Sequence
  Description of Artificial Sequence: Synthetic polypeptide
DEEEIRTTNPVATEQYGSVSPTDGLGQRSDNR

SEQ ID NO: 19023 - protein, 31 aa, Artificial Sequence
  Description of Artificial Sequence: Synthetic polypeptide
DEEEIRTTNPVATEQYGSVILTNLTRGNEEG

SEQ ID NO: 19024 - protein, 30 aa, Artificial Sequence
  Description of Artificial Sequence: Synthetic polypeptide
DEEAIRTTNPVATEQWGSVYTNNLQIGVNR

SEQ ID NO: 19025 - protein, 32 aa, Artificial Sequence
  Description of Artificial Sequence: Synthetic polypeptide
DEEEIRTTNPVAYEQYGSSVSTNDLLQRGVER

SEQ ID NO: 19026 - protein, 32 aa, Artificial Sequence
  Description of Artificial Sequence: Synthetic polypeptide
VEEEIRTTNPVATEQYGSVSPAENLQRGENER

SEQ ID NO: 19027 - protein, 31 aa, Artificial Sequence
  Description of Artificial Sequence: Synthetic polypeptide
DEEEIRTTNPVATEQYGSVSPTDALQGGDRN

SEQ ID NO: 19028 - protein, 32 aa, Artificial Sequence
  Description of Artificial Sequence: Synthetic polypeptide
DEEEIRTTNPVATEQYGSVIMTNLQRGFNQDD

SEQ ID NO: 19029 - protein, 31 aa, Artificial Sequence
  Description of Artificial Sequence: Synthetic polypeptide
DEEEIRTTNPVATEQYGSVQSTDMQQRGDRQ

SEQ ID NO: 19030 - protein, 31 aa, Artificial Sequence
  Description of Artificial Sequence: Synthetic polypeptide
DEEEIRTTNPVATEQYGSVILTNEQRGEERI

SEQ ID NO: 19031 - protein, 31 aa, Artificial Sequence
  Description of Artificial Sequence: Synthetic polypeptide
DEEEIRTTNPVATEQWGESVSTNDLQNFGNQ

SEQ ID NO: 19032 - protein, 30 aa, Artificial Sequence
  Description of Artificial Sequence: Synthetic polypeptide
DEEEIRTTNPVATEQYGSVSNTAGDRGNNQ

SEQ ID NO: 19033 - protein, 31 aa, Artificial Sequence
  Description of Artificial Sequence: Synthetic polypeptide
DEEEIRTTNPVATEQYGSVTTNLEQRGEDMV

SEQ ID NO: 19034 - protein, 31 aa, Artificial Sequence
  Description of Artificial Sequence: Synthetic polypeptide
DEEEIRTTNPVATEQYGSVINTNDQRGSNND

SEQ ID NO: 19035 - protein, 30 aa, Artificial Sequence
  Description of Artificial Sequence: Synthetic polypeptide
DEEEIRTTNPVATEQYGSVINTNLDEGDER

SEQ ID NO: 19036 - protein, 30 aa, Artificial Sequence
  Description of Artificial Sequence: Synthetic polypeptide
DEEEIRTTNPVATEQYGSVIPENLQMQGER

SEQ ID NO: 19037 - protein, 30 aa, Artificial Sequence
  Description of Artificial Sequence: Synthetic polypeptide
DEEEIRTTNPVATEQYGSVVITMNGQRGID

SEQ ID NO: 19038 - protein, 28 aa, Artificial Sequence
  Description of Artificial Sequence: Synthetic peptide
AEECISTTNPVATEQYGSVSWNHQRGNV

SEQ ID NO: 19039 - protein, 30 aa, Artificial Sequence
  Description of Artificial Sequence: Synthetic polypeptide
DEEEIRTTNPVATEQWGCVSTELQNFGNRE

SEQ ID NO: 19040 - protein, 31 aa, Artificial Sequence
  Description of Artificial Sequence: Synthetic polypeptide
DEEEIRTTNPVATEQYGSVTTNLERSDQNER

SEQ ID NO: 19041 - protein, 31 aa, Artificial Sequence
  Description of Artificial Sequence: Synthetic polypeptide
VEEEIRTTNPVATEQYGSVSSTNLQEEGNNN

SEQ ID NO: 19042 - protein, 31 aa, Artificial Sequence
  Description of Artificial Sequence: Synthetic polypeptide
DEEEIRTTNPVATEQYGSVTTNLAQGNGNQD

SEQ ID NO: 19043 - protein, 30 aa, Artificial Sequence
  Description of Artificial Sequence: Synthetic polypeptide
DEEEIRTTNPVATEQYGSVTTGLEPGNERQ

SEQ ID NO: 19044 - protein, 30 aa, Artificial Sequence
  Description of Artificial Sequence: Synthetic polypeptide
DEEEIRTTNPVATEQYGSVTTGDLQGGDDR

SEQ ID NO: 19045 - protein, 31 aa, Artificial Sequence
  Description of Artificial Sequence: Synthetic polypeptide
DEEEIRTTNPVATEQYGSVIITNLQRPGTVH

SEQ ID NO: 19046 - protein, 31 aa, Artificial Sequence
  Description of Artificial Sequence: Synthetic polypeptide
DEEEIRTTNPVATEEYGSVCSTPLQRFGNAA

SEQ ID NO: 19047 - protein, 33 aa, Artificial Sequence
  Description of Artificial Sequence: Synthetic polypeptide
DEEEIRTTNPVAYEQYGSTVSTNLSQTRNGNYR

SEQ ID NO: 19048 - protein, 32 aa, Artificial Sequence
  Description of Artificial Sequence: Synthetic polypeptide
DEEEIRTTNPVATEQYGSVISTDNNLQNGERI

SEQ ID NO: 19049 - protein, 31 aa, Artificial Sequence
  Description of Artificial Sequence: Synthetic polypeptide
DEEEIRTTNPVATEQYGSVIGNGLQEMGNRI

SEQ ID NO: 19050 - protein, 33 aa, Artificial Sequence
  Description of Artificial Sequence: Synthetic polypeptide
DEEEIRTTNPVAYEQYGSTVSTGNLSQRGGNGR

SEQ ID NO: 19051 - protein, 31 aa, Artificial Sequence
  Description of Artificial Sequence: Synthetic polypeptide
DEEEIRTTNPVAYEQYGSTVSTGLSGRGNNR

SEQ ID NO: 19052 - protein, 34 aa, Artificial Sequence
  Description of Artificial Sequence: Synthetic polypeptide
DEEEIRTTNPVATEQYGSVTSVTENLSQRIGNRI

SEQ ID NO: 19053 - protein, 33 aa, Artificial Sequence
  Description of Artificial Sequence: Synthetic polypeptide
DEEEIRTTNPVAYEQYGSTVSCTNSLQRTGGNR

SEQ ID NO: 19054 - protein, 31 aa, Artificial Sequence
  Description of Artificial Sequence: Synthetic polypeptide
DEEEIRTTNPVAYEQYGSTVSCTNMLQRVNQ

SEQ ID NO: 19055 - protein, 33 aa, Artificial Sequence
  Description of Artificial Sequence: Synthetic polypeptide
DEEEIRTTNPVAYEQYGSTVSCTNMLQRTGNRF

SEQ ID NO: 19056 - protein, 31 aa, Artificial Sequence
  Description of Artificial Sequence: Synthetic polypeptide
DEEEIRTTNPVATEQYGSVQSSGNLQGGSND

SEQ ID NO: 19057 - protein, 31 aa, Artificial Sequence
  Description of Artificial Sequence: Synthetic polypeptide
DEEEIRTTNPVAYEQYGSTVSCTNLQMGGNL

SEQ ID NO: 19058 - protein, 32 aa, Artificial Sequence
  Description of Artificial Sequence: Synthetic polypeptide
DEEEIRTTNPVATEQYGSVISTDNMLQLGERN

SEQ ID NO: 19059 - protein, 30 aa, Artificial Sequence
  Description of Artificial Sequence: Synthetic polypeptide
DEEEIRTTNPVATEQYGSVTTDIQREGDRT

SEQ ID NO: 19060 - protein, 29 aa, Artificial Sequence
  Description of Artificial Sequence: Synthetic peptide
DEEEIRTTNPVATEQYGSVSPTDLDREFS

SEQ ID NO: 19061 - protein, 31 aa, Artificial Sequence
  Description of Artificial Sequence: Synthetic polypeptide
VEEEIRTTNPVATEQYGSVSITNLQRNMERD

SEQ ID NO: 19062 - protein, 31 aa, Artificial Sequence
  Description of Artificial Sequence: Synthetic polypeptide
DEEEIRTTNPVATEQYGSVISTDNDPQVGER

SEQ ID NO: 19063 - protein, 32 aa, Artificial Sequence
  Description of Artificial Sequence: Synthetic polypeptide
DEEEIRTTNPVAYEQYGSTVSCTNALQLTGNR

SEQ ID NO: 19064 - protein, 32 aa, Artificial Sequence
  Description of Artificial Sequence: Synthetic polypeptide
DEEEIRTTNPVATEQYGSVISTDLQREGMNQV

SEQ ID NO: 19065 - protein, 31 aa, Artificial Sequence
  Description of Artificial Sequence: Synthetic polypeptide
DEEEIRTTNPVATEQYGSVSPTDLDQFRDER

SEQ ID NO: 19066 - protein, 32 aa, Artificial Sequence
  Description of Artificial Sequence: Synthetic polypeptide
DEEEIRTTNPVAYEQYGSTVSCTGNLQFPGNR

SEQ ID NO: 19067 - protein, 33 aa, Artificial Sequence
  Description of Artificial Sequence: Synthetic polypeptide
DEEEIRTTNPVATEQYGSVIITNLQREGVNTRD

SEQ ID NO: 19068 - protein, 31 aa, Artificial Sequence
  Description of Artificial Sequence: Synthetic polypeptide
DEEEIRTTNPVATEQYGSVIITNLQRPGIFG

SEQ ID NO: 19069 - protein, 32 aa, Artificial Sequence
  Description of Artificial Sequence: Synthetic polypeptide
DEEEIRTTNPVAYEQYGSTVSTNLSTQEGNER

SEQ ID NO: 19070 - protein, 31 aa, Artificial Sequence
  Description of Artificial Sequence: Synthetic polypeptide
DEEEISTTNPVATEQYGSVSWNDLQYFGSNR

SEQ ID NO: 19071 - protein, 33 aa, Artificial Sequence
  Description of Artificial Sequence: Synthetic polypeptide
DEEEIRTTNPVATEQYGSVQSCTNELQTTGGNR

SEQ ID NO: 19072 - protein, 32 aa, Artificial Sequence
  Description of Artificial Sequence: Synthetic polypeptide
DEEEIRTTNPVAYEQYGSVSTNETSQRTGNNR

SEQ ID NO: 19073 - protein, 32 aa, Artificial Sequence
  Description of Artificial Sequence: Synthetic polypeptide
DEEEIRTTNPVATEQYGSVGSTNLQMFGQNED

SEQ ID NO: 19074 - protein, 32 aa, Artificial Sequence
  Description of Artificial Sequence: Synthetic polypeptide
DEEEIRTTNPVATEQYGSVGSTNLQMTIGNGV

SEQ ID NO: 19075 - protein, 33 aa, Artificial Sequence
  Description of Artificial Sequence: Synthetic polypeptide
DEEEIRTTNPVATEQYGSVTSMTENSSQRIGNR

SEQ ID NO: 19076 - protein, 29 aa, Artificial Sequence
  Description of Artificial Sequence: Synthetic peptide
DEEEIRTTNPVCTEIYGSVSVPNLQEGNN

SEQ ID NO: 19077 - protein, 29 aa, Artificial Sequence
  Description of Artificial Sequence: Synthetic peptide
DEEEIRTTNPVCTEIYGSVSNPNLQQGNL

SEQ ID NO: 19078 - protein, 30 aa, Artificial Sequence
  Description of Artificial Sequence: Synthetic polypeptide
DEEEIRTTNPVCTEIYGSVSNENLQRGTNL

SEQ ID NO: 19079 - protein, 32 aa, Artificial Sequence
  Description of Artificial Sequence: Synthetic polypeptide
DEEEIRTTNPVATEQYGSVGSTNLQNFGNEDG

SEQ ID NO: 19080 - protein, 33 aa, Artificial Sequence
  Description of Artificial Sequence: Synthetic polypeptide
DEEEIRTTNPVATEQYGSVTSMTGNLQYFGSNR

SEQ ID NO: 19081 - protein, 30 aa, Artificial Sequence
  Description of Artificial Sequence: Synthetic polypeptide
DEEEIRTTNPVCTEHYGSVSYPNLQRFGNG

SEQ ID NO: 19082 - protein, 29 aa, Artificial Sequence
  Description of Artificial Sequence: Synthetic peptide
DEEEIRTTNPVCTEHYGSVSWPNLQRGTH

SEQ ID NO: 19083 - protein, 29 aa, Artificial Sequence
  Description of Artificial Sequence: Synthetic peptide
DEEEIRTTNPVCTEPYGSVSVPNLQDGNL

SEQ ID NO: 19084 - protein, 31 aa, Artificial Sequence
  Description of Artificial Sequence: Synthetic polypeptide
DEEEIRTTNPVATEQYGSVTSNLNQLQGDNR

SEQ ID NO: 19085 - protein, 30 aa, Artificial Sequence
  Description of Artificial Sequence: Synthetic polypeptide
DEEEIRTTNPVATEQYGSVITNLERGLDSD

SEQ ID NO: 19086 - protein, 29 aa, Artificial Sequence
  Description of Artificial Sequence: Synthetic peptide
DEAEIRTTNPVATEIYGSVSTNGDDGNSR

SEQ ID NO: 19087 - protein, 29 aa, Artificial Sequence
  Description of Artificial Sequence: Synthetic peptide
DEEEIRTTNPVATEQFGTVVSTGLERGNN

SEQ ID NO: 19088 - protein, 29 aa, Artificial Sequence
  Description of Artificial Sequence: Synthetic peptide
DEEEIRTTNPVCTEHYGSVSWENLQHGNL

SEQ ID NO: 19089 - protein, 30 aa, Artificial Sequence
  Description of Artificial Sequence: Synthetic polypeptide
DEEEIRTTNPVATEQYGSVSPNNLQTIVRI

SEQ ID NO: 19090 - protein, 33 aa, Artificial Sequence
  Description of Artificial Sequence: Synthetic polypeptide
WEEEIRTTNPVATEQYGSVSETSNLEQRGENVR

SEQ ID NO: 19091 - protein, 29 aa, Artificial Sequence
  Description of Artificial Sequence: Synthetic peptide
DEEEIRTTNPVATEQWGSVATPDQRGNPE

SEQ ID NO: 19092 - protein, 28 aa, Artificial Sequence
  Description of Artificial Sequence: Synthetic peptide
DEEEIRTTNPVATECYGQNSTNGQRINF

SEQ ID NO: 19093 - protein, 28 aa, Artificial Sequence
  Description of Artificial Sequence: Synthetic peptide
DEEEIRTTNPVATECYGQQSTNEQRVNF

SEQ ID NO: 19094 - protein, 28 aa, Artificial Sequence
  Description of Artificial Sequence: Synthetic peptide
TQEEIATTNPVATEQWGTVSTNLQEGNR

SEQ ID NO: 19095 - protein, 28 aa, Artificial Sequence
  Description of Artificial Sequence: Synthetic peptide
DEEEIRTTNPVATECYGNNSTNEQRDNF

SEQ ID NO: 19096 - protein, 30 aa, Artificial Sequence
  Description of Artificial Sequence: Synthetic polypeptide
DEEEIRTTNPVATEQYGSVQTNLQDGEDQG

SEQ ID NO: 19097 - protein, 32 aa, Artificial Sequence
  Description of Artificial Sequence: Synthetic polypeptide
DEEEIRTTNPVATEQYGSVGSTNLQMDGNEDD

SEQ ID NO: 19098 - protein, 30 aa, Artificial Sequence
  Description of Artificial Sequence: Synthetic polypeptide
DEEEIRTTNPVATEQYGSVITNLQLAIGSL

SEQ ID NO: 19099 - protein, 28 aa, Artificial Sequence
  Description of Artificial Sequence: Synthetic peptide
TETEIRCTNPVATEQYGSVFTNLQHGNQ

SEQ ID NO: 19100 - protein, 32 aa, Artificial Sequence
  Description of Artificial Sequence: Synthetic polypeptide
DEEEIRTTNPVATEQYGSVGSTNLQMDGDNGE

SEQ ID NO: 19101 - protein, 29 aa, Artificial Sequence
  Description of Artificial Sequence: Synthetic peptide
DEEEIRTTNPVATECYGKISTNQQRVGNQ

SEQ ID NO: 19102 - protein, 32 aa, Artificial Sequence
  Description of Artificial Sequence: Synthetic polypeptide
DEEEIRTTNPVATEQYGSVSPNNLQRVEENRM

SEQ ID NO: 19103 - protein, 29 aa, Artificial Sequence
  Description of Artificial Sequence: Synthetic peptide
DEACIRTTNPVATEQYGCVTETNPQRGNR

SEQ ID NO: 19104 - protein, 29 aa, Artificial Sequence
  Description of Artificial Sequence: Synthetic peptide
TEVEIRTTNPVATEQYGSVWTNELQIGSR

SEQ ID NO: 19105 - protein, 28 aa, Artificial Sequence
  Description of Artificial Sequence: Synthetic peptide
TEYEIRATNPVATEQYGSVQTNLQHGNQ

SEQ ID NO: 19106 - protein, 28 aa, Artificial Sequence
  Description of Artificial Sequence: Synthetic peptide
DEEEIRTTNPVATECYGKMSTNEQRYNF

SEQ ID NO: 19107 - protein, 30 aa, Artificial Sequence
  Description of Artificial Sequence: Synthetic polypeptide
DEEEIRTTNPVATEQYGSVSNNLQSTEENS

SEQ ID NO: 19108 - protein, 31 aa, Artificial Sequence
  Description of Artificial Sequence: Synthetic polypeptide
DEEEIRTTNPVATEQYGSVSPTMELQREFND

SEQ ID NO: 19109 - protein, 28 aa, Artificial Sequence
  Description of Artificial Sequence: Synthetic peptide
DEEEIRTTNPVCTEQYGDVSENLQEGDW

SEQ ID NO: 19110 - protein, 30 aa, Artificial Sequence
  Description of Artificial Sequence: Synthetic polypeptide
WEEEIRTTNPVATEQYGSVSVWNLEEIGNR

SEQ ID NO: 19111 - protein, 31 aa, Artificial Sequence
  Description of Artificial Sequence: Synthetic polypeptide
DEEEIRTTNPVATEQYGSVSPTMDLQRDLRE

SEQ ID NO: 19112 - protein, 31 aa, Artificial Sequence
  Description of Artificial Sequence: Synthetic polypeptide
DEEEIRTTNPVATEQYGSVITNLQQGFNEVD

SEQ ID NO: 19113 - protein, 28 aa, Artificial Sequence
  Description of Artificial Sequence: Synthetic peptide
DEEEIRTTNPVATECYGMISTNEQRENF

SEQ ID NO: 19114 - protein, 31 aa, Artificial Sequence
  Description of Artificial Sequence: Synthetic polypeptide
DEEEIRTTNPVATEQYGSVITNLQNVPSFNR

SEQ ID NO: 19115 - protein, 31 aa, Artificial Sequence
  Description of Artificial Sequence: Synthetic polypeptide
DEEEIRTTNPVATEQWGSVCTGNLSQGGGNR

SEQ ID NO: 19116 - protein, 33 aa, Artificial Sequence
  Description of Artificial Sequence: Synthetic polypeptide
WEEEIRTTNPVATEQYGSVSTSNLQERIGENGR

SEQ ID NO: 19117 - protein, 30 aa, Artificial Sequence
  Description of Artificial Sequence: Synthetic polypeptide
DEEEIRTTNPVATEQYGSVSNNLQVTEERD

SEQ ID NO: 19118 - protein, 33 aa, Artificial Sequence
  Description of Artificial Sequence: Synthetic polypeptide
DEEEIRTTNPVATEQYGSVSPTLNLQNRSGDER

SEQ ID NO: 19119 - protein, 31 aa, Artificial Sequence
  Description of Artificial Sequence: Synthetic polypeptide
TNEEIRTTNPVATEQYGSVSTNLQGTDGDNR

SEQ ID NO: 19120 - protein, 29 aa, Artificial Sequence
  Description of Artificial Sequence: Synthetic peptide
DEAEIRTTNPVATEIYGSVSGNDQGDGNR

SEQ ID NO: 19121 - protein, 30 aa, Artificial Sequence
  Description of Artificial Sequence: Synthetic polypeptide
DEEEIRTTNPVATEQYGSVSPNNLQTIPIR

SEQ ID NO: 19122 - protein, 30 aa, Artificial Sequence
  Description of Artificial Sequence: Synthetic polypeptide
DEEEIRTTNPVATEQYGSVSPTLLQRDEVQ

SEQ ID NO: 19123 - protein, 30 aa, Artificial Sequence
  Description of Artificial Sequence: Synthetic polypeptide
DEEEIRTTNPVCTEHYGSVSSPNLQRGGNL

SEQ ID NO: 19124 - protein, 30 aa, Artificial Sequence
  Description of Artificial Sequence: Synthetic polypeptide
DEEEIRTTNPVCTEHYGSVSSPNLLQRGND

SEQ ID NO: 19125 - protein, 29 aa, Artificial Sequence
  Description of Artificial Sequence: Synthetic peptide
DEEEIRTTNPVCTEHYGSVSDPNLQRDNL

SEQ ID NO: 19126 - protein, 29 aa, Artificial Sequence
  Description of Artificial Sequence: Synthetic peptide
DEEEIRTTNPVCTEHYGSVSCPNLQAGNL

SEQ ID NO: 19127 - protein, 30 aa, Artificial Sequence
  Description of Artificial Sequence: Synthetic polypeptide
DEEAIRTTNPVATEQLGSVSTNLQHGSNQL

SEQ ID NO: 19128 - protein, 30 aa, Artificial Sequence
  Description of Artificial Sequence: Synthetic polypeptide
DEEEIRTTNPVATEQYGSVTSPTLEQEGER

SEQ ID NO: 19129 - protein, 30 aa, Artificial Sequence
  Description of Artificial Sequence: Synthetic polypeptide
DEEEIRTTNPVATEQYGSVSNTDMQRSEDR

SEQ ID NO: 19130 - protein, 30 aa, Artificial Sequence
  Description of Artificial Sequence: Synthetic polypeptide
DEEEIRTTNPVCTEHYGSVSAPNMLQRGNL

SEQ ID NO: 19131 - protein, 30 aa, Artificial Sequence
  Description of Artificial Sequence: Synthetic polypeptide
DEEEIRTTNPVATEQYGSVSPTLLERNDER

SEQ ID NO: 19132 - protein, 30 aa, Artificial Sequence
  Description of Artificial Sequence: Synthetic polypeptide
DEAEIRTTNPVATENYGSVSTNLNGDSGNR

SEQ ID NO: 19133 - protein, 31 aa, Artificial Sequence
  Description of Artificial Sequence: Synthetic polypeptide
DEEEIRTTNPVATEQYGSVSPTLILQRDLRE

SEQ ID NO: 19134 - protein, 32 aa, Artificial Sequence
  Description of Artificial Sequence: Synthetic polypeptide
DEEEIRTTNPVATEQYGSVGSTPNLQTFGNND

SEQ ID NO: 19135 - protein, 30 aa, Artificial Sequence
  Description of Artificial Sequence: Synthetic polypeptide
DEEEIRTTNPVCTEHYGSVSDPNLQRGNLL

SEQ ID NO: 19136 - protein, 30 aa, Artificial Sequence
  Description of Artificial Sequence: Synthetic polypeptide
DEEEIRTTNPVATEQYGSVTSSELQYGSNQ

SEQ ID NO: 19137 - protein, 30 aa, Artificial Sequence
  Description of Artificial Sequence: Synthetic polypeptide
DEEEIRTTNPVATEQYGSVQTNLIAGEEER

SEQ ID NO: 19138 - protein, 31 aa, Artificial Sequence
  Description of Artificial Sequence: Synthetic polypeptide
DEEEIRTTNPVATEQYGSVQTNLDRGGENNS

SEQ ID NO: 19139 - protein, 28 aa, Artificial Sequence
  Description of Artificial Sequence: Synthetic peptide
TSEEIRSTNPVATEQYGSISTNGQRGNN

SEQ ID NO: 19140 - protein, 30 aa, Artificial Sequence
  Description of Artificial Sequence: Synthetic polypeptide
DEEEIRTTNPVCTEGYGSVSMPNLQRFGNL

SEQ ID NO: 19141 - protein, 32 aa, Artificial Sequence
  Description of Artificial Sequence: Synthetic polypeptide
DEEEIRTTNPVATEQYGSVSPTLGLQRGQVRD

SEQ ID NO: 19142 - protein, 30 aa, Artificial Sequence
  Description of Artificial Sequence: Synthetic polypeptide
DEEEIRTTNPVCTEGYGSVCSSPNLQRGNL

SEQ ID NO: 19143 - protein, 31 aa, Artificial Sequence
  Description of Artificial Sequence: Synthetic polypeptide
DEEEIRTTNPVATEQYGSVITINMEQRGNEL

SEQ ID NO: 19144 - protein, 30 aa, Artificial Sequence
  Description of Artificial Sequence: Synthetic polypeptide
DEEEIRTTNPVCTEFYGSVSVGPNLQRGNG

SEQ ID NO: 19145 - protein, 30 aa, Artificial Sequence
  Description of Artificial Sequence: Synthetic polypeptide
DEEEIRTTNPVCTECYGSVSVPNGLQRGNT

SEQ ID NO: 19146 - protein, 32 aa, Artificial Sequence
  Description of Artificial Sequence: Synthetic polypeptide
WEEEIRTTNPVATEQYGSVQTMNLYQRGENVR

SEQ ID NO: 19147 - protein, 32 aa, Artificial Sequence
  Description of Artificial Sequence: Synthetic polypeptide
DEEEIRTTNPVATEQYGSVTSTANLQNDGNEF

SEQ ID NO: 19148 - protein, 30 aa, Artificial Sequence
  Description of Artificial Sequence: Synthetic polypeptide
DEEEIRTTNPVATEQYGSVQTNLILDENER

SEQ ID NO: 19149 - protein, 31 aa, Artificial Sequence
  Description of Artificial Sequence: Synthetic polypeptide
DEEEIRTTNPVATECYGSVCFTNLTNRGGNR

SEQ ID NO: 19150 - protein, 30 aa, Artificial Sequence
  Description of Artificial Sequence: Synthetic polypeptide
DEEEIRTTNPVATEQWGSVATNLERGDNQM

SEQ ID NO: 19151 - protein, 32 aa, Artificial Sequence
  Description of Artificial Sequence: Synthetic polypeptide
DEEEIRTTNPVATEQYGSVQPTNLQRGENAEL

SEQ ID NO: 19152 - protein, 29 aa, Artificial Sequence
  Description of Artificial Sequence: Synthetic peptide
DEEEIRTTNPVCTEHYGSVSSPNLARGNL

SEQ ID NO: 19153 - protein, 32 aa, Artificial Sequence
  Description of Artificial Sequence: Synthetic polypeptide
DEEEIRTTNPVATEQYGSVGSTNLQTFGDNDD

SEQ ID NO: 19154 - protein, 30 aa, Artificial Sequence
  Description of Artificial Sequence: Synthetic polypeptide
DEEEIRTTNPVATEQYGSVQTNLQDGEDDI

SEQ ID NO: 19155 - protein, 29 aa, Artificial Sequence
  Description of Artificial Sequence: Synthetic peptide
DEEEIRTTNPVCTEHYGSVSPPNLQEGNL

SEQ ID NO: 19156 - protein, 31 aa, Artificial Sequence
  Description of Artificial Sequence: Synthetic polypeptide
DEEEIRTTNPVATEQYGSVSPTLLQRDALRQ

SEQ ID NO: 19157 - protein, 32 aa, Artificial Sequence
  Description of Artificial Sequence: Synthetic polypeptide
DEEEIRTTNPVATEQWGSVATNLQRGIENNRP

SEQ ID NO: 19158 - protein, 32 aa, Artificial Sequence
  Description of Artificial Sequence: Synthetic polypeptide
DEEEIRTTNPVATEQYGSVGSTNLQTFGNEEI

SEQ ID NO: 19159 - protein, 30 aa, Artificial Sequence
  Description of Artificial Sequence: Synthetic polypeptide
DEEEIRTTNPVATEQYGSVSPNNLQTSDQR

SEQ ID NO: 19160 - protein, 29 aa, Artificial Sequence
  Description of Artificial Sequence: Synthetic peptide
DEEEIRTTNPVATEQYGSVITNIQRDDQS

SEQ ID NO: 19161 - protein, 29 aa, Artificial Sequence
  Description of Artificial Sequence: Synthetic peptide
DEEEIRTTNPVCTEHYGSVSMPNLQMGNE

SEQ ID NO: 19162 - protein, 31 aa, Artificial Sequence
  Description of Artificial Sequence: Synthetic polypeptide
DEEEIRTTNPVATEQYGSVITNGQLRVGVRF

SEQ ID NO: 19163 - protein, 31 aa, Artificial Sequence
  Description of Artificial Sequence: Synthetic polypeptide
DEEEIRTTNPVATEQYGSVTSNTDLQQRGEN

SEQ ID NO: 19164 - protein, 28 aa, Artificial Sequence
  Description of Artificial Sequence: Synthetic peptide
DEEEIRTTNPVATEQWGSVATNLERPDD

SEQ ID NO: 19165 - protein, 30 aa, Artificial Sequence
  Description of Artificial Sequence: Synthetic polypeptide
DEEEIRTTNPVCTEHYGSVSMNNELQRGNL

SEQ ID NO: 19166 - protein, 32 aa, Artificial Sequence
  Description of Artificial Sequence: Synthetic polypeptide
DEEEIRTTNPVATEQYGSVTSNTNLERGENVE

SEQ ID NO: 19167 - protein, 29 aa, Artificial Sequence
  Description of Artificial Sequence: Synthetic peptide
DEEEIRTTNPVCTEHYGSVSMDNDQRGNL

SEQ ID NO: 19168 - protein, 30 aa, Artificial Sequence
  Description of Artificial Sequence: Synthetic polypeptide
DEEEIRTTNPVATEQWGSVATNLERGTDRL

SEQ ID NO: 19169 - protein, 30 aa, Artificial Sequence
  Description of Artificial Sequence: Synthetic polypeptide
DEEEIRTTNPVCTEHYGSVSLPNLQRGGNE

SEQ ID NO: 19170 - protein, 29 aa, Artificial Sequence
  Description of Artificial Sequence: Synthetic peptide
DEEEIRTTNPVCTEHYGSVSLPNLQDGND

SEQ ID NO: 19171 - protein, 29 aa, Artificial Sequence
  Description of Artificial Sequence: Synthetic peptide
DEEEIRTTNPVATEQWGSVATNLERGQDM

SEQ ID NO: 19172 - protein, 29 aa, Artificial Sequence
  Description of Artificial Sequence: Synthetic peptide
DEEEIRTTNPVCTEHYGSVSGPNLQSGNL

SEQ ID NO: 19173 - protein, 30 aa, Artificial Sequence
  Description of Artificial Sequence: Synthetic polypeptide
DEEEIRTTNPVATEQYGSVSPNQQQTGVER

SEQ ID NO: 19174 - protein, 29 aa, Artificial Sequence
  Description of Artificial Sequence: Synthetic peptide
DEEEIRTTNPVCTETYGSVSMPNLERGNL

SEQ ID NO: 19175 - protein, 31 aa, Artificial Sequence
  Description of Artificial Sequence: Synthetic polypeptide
DEEEIRTTNPVATEQYGSVQTNLQPRGSQIQ

SEQ ID NO: 19176 - protein, 29 aa, Artificial Sequence
  Description of Artificial Sequence: Synthetic peptide
TESEIRTTNPVAYERYGSVSTNLQRGTNI

SEQ ID NO: 19177 - protein, 31 aa, Artificial Sequence
  Description of Artificial Sequence: Synthetic polypeptide
DEEEIRTTNPVAYEPYGVTVSTNLQRTGNNR

SEQ ID NO: 19178 - protein, 28 aa, Artificial Sequence
  Description of Artificial Sequence: Synthetic peptide
DEEEIATTNPVATEQWGSVATNLQREDH

SEQ ID NO: 19179 - protein, 28 aa, Artificial Sequence
  Description of Artificial Sequence: Synthetic peptide
TENGIRTTNPVATEQYGSVSTNLVMLNR

SEQ ID NO: 19180 - protein, 32 aa, Artificial Sequence
  Description of Artificial Sequence: Synthetic polypeptide
DEEEIRTTNPVATEQYGSVGSTGNLQDGGNIA

SEQ ID NO: 19181 - protein, 31 aa, Artificial Sequence
  Description of Artificial Sequence: Synthetic polypeptide
DEEEIRTTNPVGTEQYGSVSPTNMLIRGVNP

SEQ ID NO: 19182 - protein, 32 aa, Artificial Sequence
  Description of Artificial Sequence: Synthetic polypeptide
DEEEIRTTNPVATECYGISVSTVNLQDRITNR

SEQ ID NO: 19183 - protein, 30 aa, Artificial Sequence
  Description of Artificial Sequence: Synthetic polypeptide
DEEEIRTTNPVGTEQYGSVSPTNFLTRGVV

SEQ ID NO: 19184 - protein, 31 aa, Artificial Sequence
  Description of Artificial Sequence: Synthetic polypeptide
DEEEIRTTNPVATEQYGSVTPTNLQIGVDNI

SEQ ID NO: 19185 - protein, 29 aa, Artificial Sequence
  Description of Artificial Sequence: Synthetic peptide
TEREIRTTNPVATEQYGSVWTNLQGGGSR

SEQ ID NO: 19186 - protein, 32 aa, Artificial Sequence
  Description of Artificial Sequence: Synthetic polypeptide
DEEEIRTTNPVATEQYGSVSPTNAHSQRVNNR

SEQ ID NO: 19187 - protein, 30 aa, Artificial Sequence
  Description of Artificial Sequence: Synthetic polypeptide
DEEEIRTTNPVGTEQYGSVSDTNDLGRGFP

SEQ ID NO: 19188 - protein, 32 aa, Artificial Sequence
  Description of Artificial Sequence: Synthetic polypeptide
DEEEIRTTNPVATECYGISVSTVNLQDRAKNR

SEQ ID NO: 19189 - protein, 32 aa, Artificial Sequence
  Description of Artificial Sequence: Synthetic polypeptide
DEEEIRTTNPVATEQYGSVGSTGNLQQQGEND

SEQ ID NO: 19190 - protein, 30 aa, Artificial Sequence
  Description of Artificial Sequence: Synthetic polypeptide
DEEEIRTTNPVGTEQYGSVNSTNFLGRGLP

SEQ ID NO: 19191 - protein, 28 aa, Artificial Sequence
  Description of Artificial Sequence: Synthetic peptide
DEEEIRTTNPVATECYGKASTNQQRLNF

SEQ ID NO: 19192 - protein, 29 aa, Artificial Sequence
  Description of Artificial Sequence: Synthetic peptide
TESEIATTNPVAYEQYGSVSTNLQRGNDQ

SEQ ID NO: 19193 - protein, 30 aa, Artificial Sequence
  Description of Artificial Sequence: Synthetic polypeptide
DEAEIRTTNPVATEHYGSVSTENLGNGNAR

SEQ ID NO: 19194 - protein, 31 aa, Artificial Sequence
  Description of Artificial Sequence: Synthetic polypeptide
DEEEIRTTNPVATEQYGSVSPTMNLQSLTNG

SEQ ID NO: 19195 - protein, 32 aa, Artificial Sequence
  Description of Artificial Sequence: Synthetic polypeptide
DEEEIRTTNPVATEQYGSVTQSTNNLQQGNQF

SEQ ID NO: 19196 - protein, 32 aa, Artificial Sequence
  Description of Artificial Sequence: Synthetic polypeptide
DEEEIRTTNPVATEQYGSVSPTMNLQRTLNGE

SEQ ID NO: 19197 - protein, 30 aa, Artificial Sequence
  Description of Artificial Sequence: Synthetic polypeptide
DEEEIRTTNPVAYEPYGSVPSTNLQPGGNQ

SEQ ID NO: 19198 - protein, 28 aa, Artificial Sequence
  Description of Artificial Sequence: Synthetic peptide
TESEIRSTNPVATEQYGSVPTNLQHGNQ

SEQ ID NO: 19199 - protein, 28 aa, Artificial Sequence
  Description of Artificial Sequence: Synthetic peptide
DEEEIRTTNPVATECYGKHSTNAQRENF

SEQ ID NO: 19200 - protein, 29 aa, Artificial Sequence
  Description of Artificial Sequence: Synthetic peptide
DEEEIRTTNPVGTEQYGSVPTNFLGRGGT

SEQ ID NO: 19201 - protein, 30 aa, Artificial Sequence
  Description of Artificial Sequence: Synthetic polypeptide
DEEEIATTNPVATEQWGSVATNLQGGNPRD

SEQ ID NO: 19202 - protein, 29 aa, Artificial Sequence
  Description of Artificial Sequence: Synthetic peptide
DEEEIRTTNPVGTEQYGSVSTDELGRGFP

SEQ ID NO: 19203 - protein, 29 aa, Artificial Sequence
  Description of Artificial Sequence: Synthetic peptide
DEEEIATTNPVATEQWGSVATNLQADGNQ

SEQ ID NO: 19204 - protein, 29 aa, Artificial Sequence
  Description of Artificial Sequence: Synthetic peptide
AEEEIATTNPVATEPYGEVSTNLQGGNRM

SEQ ID NO: 19205 - protein, 29 aa, Artificial Sequence
  Description of Artificial Sequence: Synthetic peptide
DEEEIRTTNPVATEQYGSVTPNLQNSGEI

SEQ ID NO: 19206 - protein, 29 aa, Artificial Sequence
  Description of Artificial Sequence: Synthetic peptide
DEEEIRTTNPVGTEQYGSVSTNELGSGSP

SEQ ID NO: 19207 - protein, 29 aa, Artificial Sequence
  Description of Artificial Sequence: Synthetic peptide
DEEEIRTTNPVGTEQYGSVSTNELGRPDP

SEQ ID NO: 19208 - protein, 29 aa, Artificial Sequence
  Description of Artificial Sequence: Synthetic peptide
DEAEIRTTNPVATEHYGCVSTNLQGEGNG

SEQ ID NO: 19209 - protein, 30 aa, Artificial Sequence
  Description of Artificial Sequence: Synthetic polypeptide
DEEEIRTTNPVGTEQYGSVSTNELGRGPEP

SEQ ID NO: 19210 - protein, 30 aa, Artificial Sequence
  Description of Artificial Sequence: Synthetic polypeptide
DEEEIRTTNPVGTEQYGSVSTNELGRGEAP

SEQ ID NO: 19211 - protein, 30 aa, Artificial Sequence
  Description of Artificial Sequence: Synthetic polypeptide
DEEEIRTTNPVGTEQYGSVSTNELGRGDEP

SEQ ID NO: 19212 - protein, 31 aa, Artificial Sequence
  Description of Artificial Sequence: Synthetic polypeptide
DEEEIRTTNPVAYEPYGSVASTNLSQRVDNR

SEQ ID NO: 19213 - protein, 29 aa, Artificial Sequence
  Description of Artificial Sequence: Synthetic peptide
DEEEIRTTNPVGTEQYGSVSTNELGDGDP

SEQ ID NO: 19214 - protein, 30 aa, Artificial Sequence
  Description of Artificial Sequence: Synthetic polypeptide
DEEEIRTTNPVGTEQYGSVSTNELGARGFD

SEQ ID NO: 19215 - protein, 28 aa, Artificial Sequence
  Description of Artificial Sequence: Synthetic peptide
DEEEIRTTNPVATECYGFSSTNEQRTND

SEQ ID NO: 19216 - protein, 29 aa, Artificial Sequence
  Description of Artificial Sequence: Synthetic peptide
AEEEIATTNPVATEHYGSVSTNLQGGNDI

SEQ ID NO: 19217 - protein, 29 aa, Artificial Sequence
  Description of Artificial Sequence: Synthetic peptide
DEEEIRTTNPVAYEPYGSVATNLQDGNDQ

SEQ ID NO: 19218 - protein, 29 aa, Artificial Sequence
  Description of Artificial Sequence: Synthetic peptide
AEEEIATTNPVATEGYGSVSTNLQIGPNQ

SEQ ID NO: 19219 - protein, 29 aa, Artificial Sequence
  Description of Artificial Sequence: Synthetic peptide
DEEEIRTTNPVATEQYGSVQTNNQGLNEE

SEQ ID NO: 19220 - protein, 30 aa, Artificial Sequence
  Description of Artificial Sequence: Synthetic polypeptide
DEEEIRTTNPVAYEPYGSVCATNLTRGGNR

SEQ ID NO: 19221 - protein, 30 aa, Artificial Sequence
  Description of Artificial Sequence: Synthetic polypeptide
DEEEIATTNPVATEQYGSISLPNALQRDNR

SEQ ID NO: 19222 - protein, 30 aa, Artificial Sequence
  Description of Artificial Sequence: Synthetic polypeptide
DEEEIRTTNPVGTEQYGSVSTLNALGRGSP

SEQ ID NO: 19223 - protein, 29 aa, Artificial Sequence
  Description of Artificial Sequence: Synthetic peptide
DEEEIRTTNPVGTEQYGSVSTLFLGRGGP

SEQ ID NO: 19224 - protein, 29 aa, Artificial Sequence
  Description of Artificial Sequence: Synthetic peptide
TENEIQPTNPVATEQYGSVSTNLQQRGTR

SEQ ID NO: 19225 - protein, 28 aa, Artificial Sequence
  Description of Artificial Sequence: Synthetic peptide
DEEEIRTTNPVATECYGGCSTNEQRRNF

SEQ ID NO: 19226 - protein, 31 aa, Artificial Sequence
  Description of Artificial Sequence: Synthetic polypeptide
DEEEIRTTNPVATEQYGSVQTNLVIRGEELR

SEQ ID NO: 19227 - protein, 32 aa, Artificial Sequence
  Description of Artificial Sequence: Synthetic polypeptide
DEEEIRTTNPVATEQYGSVSPTMNLQQRAMNV

SEQ ID NO: 19228 - protein, 29 aa, Artificial Sequence
  Description of Artificial Sequence: Synthetic peptide
DEEEIACTNPVATEQYGNVSETLQRVGNR

SEQ ID NO: 19229 - protein, 30 aa, Artificial Sequence
  Description of Artificial Sequence: Synthetic polypeptide
DEAEIRTTNPVATEHYGSVSTNDQEPGNDR

SEQ ID NO: 19230 - protein, 31 aa, Artificial Sequence
  Description of Artificial Sequence: Synthetic polypeptide
DEEEIRTTNPVATEQYGSVTQTNLQTGVNLF

SEQ ID NO: 19231 - protein, 32 aa, Artificial Sequence
  Description of Artificial Sequence: Synthetic polypeptide
DEEEIRTTNPVATEQYGSVGSTNLFQGGENED

SEQ ID NO: 19232 - protein, 32 aa, Artificial Sequence
  Description of Artificial Sequence: Synthetic polypeptide
DEEEIRTTNPVAYEPYGSVSTNLSQRTGNNRM

SEQ ID NO: 19233 - protein, 32 aa, Artificial Sequence
  Description of Artificial Sequence: Synthetic polypeptide
DEEEIRTTNPVATEQYGSVGSTNLFQGNGNID

SEQ ID NO: 19234 - protein, 30 aa, Artificial Sequence
  Description of Artificial Sequence: Synthetic polypeptide
DEEAIRTTNPVATEIYGVVTTTNLQRGSNR

SEQ ID NO: 19235 - protein, 32 aa, Artificial Sequence
  Description of Artificial Sequence: Synthetic polypeptide
DEEEIRTTNPVATEQYGSVGSTNLIQGIGNGD

SEQ ID NO: 19236 - protein, 30 aa, Artificial Sequence
  Description of Artificial Sequence: Synthetic polypeptide
DEEEIRTTNPVATEQFGTSVSTYLTRGNSV

SEQ ID NO: 19237 - protein, 29 aa, Artificial Sequence
  Description of Artificial Sequence: Synthetic peptide
DEEEIRTTNPVGTEHYGSVSMVNLQRTNQ

SEQ ID NO: 19238 - protein, 31 aa, Artificial Sequence
  Description of Artificial Sequence: Synthetic polypeptide
DEEEIRTTNPVGTEHYGSVSMTNLQRGNELF

SEQ ID NO: 19239 - protein, 31 aa, Artificial Sequence
  Description of Artificial Sequence: Synthetic polypeptide
DEEEIRTTNPVATEQYGSVSPTMNLEQRLTL

SEQ ID NO: 19240 - protein, 30 aa, Artificial Sequence
  Description of Artificial Sequence: Synthetic polypeptide
DEEEIRTTNPVATEQFGTSVSTYLVRGNAS

SEQ ID NO: 19241 - protein, 30 aa, Artificial Sequence
  Description of Artificial Sequence: Synthetic polypeptide
DEEEIRTTNPVATEQYGSVTSENDNRGENN

SEQ ID NO: 19242 - protein, 32 aa, Artificial Sequence
  Description of Artificial Sequence: Synthetic polypeptide
DEEEIRTTNPVATEQYGSVGSTNLNQGGGNPD

SEQ ID NO: 19243 - protein, 32 aa, Artificial Sequence
  Description of Artificial Sequence: Synthetic polypeptide
DEEEIRTTNPVATEQWGSVPSCTGNVQRGGNR

SEQ ID NO: 19244 - protein, 29 aa, Artificial Sequence
  Description of Artificial Sequence: Synthetic peptide
DEEEIRTTNPVGTEAYGSVSDPNLIRGNL

SEQ ID NO: 19245 - protein, 33 aa, Artificial Sequence
  Description of Artificial Sequence: Synthetic polypeptide
DEEEIRTTNPVATEQWGSVPSCTGNLSQRNGNR

SEQ ID NO: 19246 - protein, 30 aa, Artificial Sequence
  Description of Artificial Sequence: Synthetic polypeptide
DEEEIRTTNPVAYEPYGSVWTNLSQRGGNL

SEQ ID NO: 19247 - protein, 29 aa, Artificial Sequence
  Description of Artificial Sequence: Synthetic peptide
DEEAIRTTNPVATELYSEEVSTNLQIGNR

SEQ ID NO: 19248 - protein, 32 aa, Artificial Sequence
  Description of Artificial Sequence: Synthetic polypeptide
DEEEIRTTNPVATEQYGSVGSTNLQEDGFNED

SEQ ID NO: 19249 - protein, 33 aa, Artificial Sequence
  Description of Artificial Sequence: Synthetic polypeptide
DEEEIRTTNPVATEQWGSVPSCTGNLQRGTNNR

SEQ ID NO: 19250 - protein, 30 aa, Artificial Sequence
  Description of Artificial Sequence: Synthetic polypeptide
DEEAIRTTNPVATEQFGVVSTNLQNFGNRG

SEQ ID NO: 19251 - protein, 30 aa, Artificial Sequence
  Description of Artificial Sequence: Synthetic polypeptide
TESEIRTTNPVAYEQYGSVSCTNGQRPGNR

SEQ ID NO: 19252 - protein, 30 aa, Artificial Sequence
  Description of Artificial Sequence: Synthetic polypeptide
TESEIRTTNPVAYEQYGSVSQTNGQRGGNR

SEQ ID NO: 19253 - protein, 32 aa, Artificial Sequence
  Description of Artificial Sequence: Synthetic polypeptide
DEEEIRTTNPVATEQWGSVPSCTNNLSQRGSR

SEQ ID NO: 19254 - protein, 29 aa, Artificial Sequence
  Description of Artificial Sequence: Synthetic peptide
DEEEIRTTNPVGTEQWGSVSTDNLGRGFP

SEQ ID NO: 19255 - protein, 29 aa, Artificial Sequence
  Description of Artificial Sequence: Synthetic peptide
DEEEIRTTNPVGTEQWGSVSTNALGRGEP

SEQ ID NO: 19256 - protein, 30 aa, Artificial Sequence
  Description of Artificial Sequence: Synthetic polypeptide
DEEEIRTTNPVATEQFGTSVSTYLLRGNVE

SEQ ID NO: 19257 - protein, 29 aa, Artificial Sequence
  Description of Artificial Sequence: Synthetic peptide
DEEEIRTTNPVGTEQYGCVSTNALARGDQ

SEQ ID NO: 19258 - protein, 30 aa, Artificial Sequence
  Description of Artificial Sequence: Synthetic polypeptide
DEAEIRTTNPVATEHYGSVSTNLNQDGNEN

SEQ ID NO: 19259 - protein, 32 aa, Artificial Sequence
  Description of Artificial Sequence: Synthetic polypeptide
DEEEIRTTNPVATEQYGSVSPTMNLLIQRGLD

SEQ ID NO: 19260 - protein, 31 aa, Artificial Sequence
  Description of Artificial Sequence: Synthetic polypeptide
DEEEIRTTNPVAYEPYGSVSCTLLSQRGGNR

SEQ ID NO: 19261 - protein, 31 aa, Artificial Sequence
  Description of Artificial Sequence: Synthetic polypeptide
TESEIRTTNPVATEQYGQSVSTNLSQTGGNR

SEQ ID NO: 19262 - protein, 34 aa, Artificial Sequence
  Description of Artificial Sequence: Synthetic polypeptide
DEEEIRTTNPVATEQYGSVTSATENLSQERIGNR

SEQ ID NO: 19263 - protein, 32 aa, Artificial Sequence
  Description of Artificial Sequence: Synthetic polypeptide
DEAEIRTTNPVATEHYGSVSTNLQGDRGGNER

SEQ ID NO: 19264 - protein, 31 aa, Artificial Sequence
  Description of Artificial Sequence: Synthetic polypeptide
DEEEIRTTNPVATEQYGSVTSATPNQQDGNV

SEQ ID NO: 19265 - protein, 31 aa, Artificial Sequence
  Description of Artificial Sequence: Synthetic polypeptide
DEEEIRTTNPVATEQYGSVSPTMNLIQRNLQ

SEQ ID NO: 19266 - protein, 31 aa, Artificial Sequence
  Description of Artificial Sequence: Synthetic polypeptide
DEEEIRTTNPVATEQYGSVGSTNDQIGNEDE

SEQ ID NO: 19267 - protein, 29 aa, Artificial Sequence
  Description of Artificial Sequence: Synthetic peptide
DEEEIRTTNPVGTEQWGTSVSTALDRGNA

SEQ ID NO: 19268 - protein, 32 aa, Artificial Sequence
  Description of Artificial Sequence: Synthetic polypeptide
DEEEIRTTNPVATEQYGSVSPTMNLIQRGLLE

SEQ ID NO: 19269 - protein, 29 aa, Artificial Sequence
  Description of Artificial Sequence: Synthetic peptide
DEEEIRTTNPVGTEQWGSVSTNELGRGQT

SEQ ID NO: 19270 - protein, 30 aa, Artificial Sequence
  Description of Artificial Sequence: Synthetic polypeptide
DEEEIRTTNPVAYEPYGSVSCTNLAGSGNR

SEQ ID NO: 19271 - protein, 30 aa, Artificial Sequence
  Description of Artificial Sequence: Synthetic polypeptide
DEAEIRTTNPVATEHYGSVSTNLQGDSGNM

SEQ ID NO: 19272 - protein, 32 aa, Artificial Sequence
  Description of Artificial Sequence: Synthetic polypeptide
TESEIRTTNPVATEQYGSVSCTNMLSQRGNRA

SEQ ID NO: 19273 - protein, 30 aa, Artificial Sequence
  Description of Artificial Sequence: Synthetic polypeptide
DEEEIRTTNPVATEQFGTSVSTYLLRGNND

SEQ ID NO: 19274 - protein, 30 aa, Artificial Sequence
  Description of Artificial Sequence: Synthetic polypeptide
DEEEIRTTNPVATEQYGSVGSTNDQNNMNP

SEQ ID NO: 19275 - protein, 31 aa, Artificial Sequence
  Description of Artificial Sequence: Synthetic polypeptide
DEEEIRTTNPVAYEPYGSVSTNLQKPGGNNR

SEQ ID NO: 19276 - protein, 31 aa, Artificial Sequence
  Description of Artificial Sequence: Synthetic polypeptide
DEEEIRTTNPVATEQYGSVQTNLQRGLDQII

SEQ ID NO: 19277 - protein, 31 aa, Artificial Sequence
  Description of Artificial Sequence: Synthetic polypeptide
DEEEIRTTNPVATEQYGSVGSTNLDMTGNES

SEQ ID NO: 19278 - protein, 28 aa, Artificial Sequence
  Description of Artificial Sequence: Synthetic peptide
DEEEIRTTNPVATECYGKHSTNEQRFNQ

SEQ ID NO: 19279 - protein, 32 aa, Artificial Sequence
  Description of Artificial Sequence: Synthetic polypeptide
DEEEIRTTNPVATEQYGSVGSTNLDQGFGNED

SEQ ID NO: 19280 - protein, 29 aa, Artificial Sequence
  Description of Artificial Sequence: Synthetic peptide
DEEEIRTTNPVGTEQYGCVSTNFLIRGEQ

SEQ ID NO: 19281 - protein, 31 aa, Artificial Sequence
  Description of Artificial Sequence: Synthetic polypeptide
DEEEIRTTNPVAYEQYGSVSTNEQSTHGGNR

SEQ ID NO: 19282 - protein, 32 aa, Artificial Sequence
  Description of Artificial Sequence: Synthetic polypeptide
WEEEIRTTNPVATEQYGSVNTSNLMQRGENIR

SEQ ID NO: 19283 - protein, 31 aa, Artificial Sequence
  Description of Artificial Sequence: Synthetic polypeptide
DEEEIRTTNPVATEQYGSVSPNVQQEGVNRN

SEQ ID NO: 19284 - protein, 33 aa, Artificial Sequence
  Description of Artificial Sequence: Synthetic polypeptide
DEEEIRTTNPVAYEQYGSVVSTNLDQERTGNRE

SEQ ID NO: 19285 - protein, 31 aa, Artificial Sequence
  Description of Artificial Sequence: Synthetic polypeptide
DEEEIRTTNPVATEQYGSVQTNAQRGNGQEE

SEQ ID NO: 19286 - protein, 29 aa, Artificial Sequence
  Description of Artificial Sequence: Synthetic peptide
DEAEIRTTNPVATEQYGCVSSNLFNNGNR

SEQ ID NO: 19287 - protein, 30 aa, Artificial Sequence
  Description of Artificial Sequence: Synthetic polypeptide
DEEEIRTTNPVAYEQYGCVCSTNDQNGNNR

SEQ ID NO: 19288 - protein, 33 aa, Artificial Sequence
  Description of Artificial Sequence: Synthetic polypeptide
DEEEIRTTNPVAYEQYGSVVSTNALSQRPGNNR

SEQ ID NO: 19289 - protein, 31 aa, Artificial Sequence
  Description of Artificial Sequence: Synthetic polypeptide
DEEEIRTTNPVAYEQYGSVVSTGNLSQTGMR

SEQ ID NO: 19290 - protein, 29 aa, Artificial Sequence
  Description of Artificial Sequence: Synthetic peptide
DEEEIRTTNPVATEQYGSVGTVLQNNGEI

SEQ ID NO: 19291 - protein, 32 aa, Artificial Sequence
  Description of Artificial Sequence: Synthetic polypeptide
DEEEIRTTNPVAYEQYGSVVSTDMLSQRGNNR

SEQ ID NO: 19292 - protein, 31 aa, Artificial Sequence
  Description of Artificial Sequence: Synthetic polypeptide
DEAEIRTTNPVATEPYGSVSTNLNQDNGNSR

SEQ ID NO: 19293 - protein, 30 aa, Artificial Sequence
  Description of Artificial Sequence: Synthetic polypeptide
DEEEIRTTNPVATEQWGSTSLPNDLQRDNR

SEQ ID NO: 19294 - protein, 31 aa, Artificial Sequence
  Description of Artificial Sequence: Synthetic polypeptide
DEEEIRTTNPVAYEQYGSVVSTNLQTGGNNL

SEQ ID NO: 19295 - protein, 32 aa, Artificial Sequence
  Description of Artificial Sequence: Synthetic polypeptide
DEEEIRTTNPVAYEQYGSVVSCTNLQQEGNNR

SEQ ID NO: 19296 - protein, 30 aa, Artificial Sequence
  Description of Artificial Sequence: Synthetic polypeptide
DEAEIRTTNPVATEPYGSVSTNLNQGEGNS

SEQ ID NO: 19297 - protein, 32 aa, Artificial Sequence
  Description of Artificial Sequence: Synthetic polypeptide
DEEEIRTTNPVATEQYGSVTSTLNLEDQGGNQ

SEQ ID NO: 19298 - protein, 30 aa, Artificial Sequence
  Description of Artificial Sequence: Synthetic polypeptide
TSEEIRTTNPVAYEQYGSVSTNMLSQRGSR

SEQ ID NO: 19299 - protein, 32 aa, Artificial Sequence
  Description of Artificial Sequence: Synthetic polypeptide
DEEEIRTTNPVATEQYGSVTSTLNLELQGGNQ

SEQ ID NO: 19300 - protein, 29 aa, Artificial Sequence
  Description of Artificial Sequence: Synthetic peptide
DEEEIRTTNPVATEQYGSVGYINNQNGER

SEQ ID NO: 19301 - protein, 31 aa, Artificial Sequence
  Description of Artificial Sequence: Synthetic polypeptide
DEEEIRTTNPVATEQYGSVTSTLNLENQGNQ

SEQ ID NO: 19302 - protein, 28 aa, Artificial Sequence
  Description of Artificial Sequence: Synthetic peptide
VEEPIATTNPVATEQYGSVSMNSQRGNS

SEQ ID NO: 19303 - protein, 31 aa, Artificial Sequence
  Description of Artificial Sequence: Synthetic polypeptide
DEEEIRTTNPVATEQYGSVSPTEPLQRGVFF

SEQ ID NO: 19304 - protein, 30 aa, Artificial Sequence
  Description of Artificial Sequence: Synthetic polypeptide
DEEEIRTTNPVATEQYGSVHMNLQREVNNF

SEQ ID NO: 19305 - protein, 30 aa, Artificial Sequence
  Description of Artificial Sequence: Synthetic polypeptide
DEEEIRTTNPVATEQYGSVSPPNVQRDGMA

SEQ ID NO: 19306 - protein, 31 aa, Artificial Sequence
  Description of Artificial Sequence: Synthetic polypeptide
DEEEIRTTNPVAYEQYGSVVSCTNLARTGND

SEQ ID NO: 19307 - protein, 31 aa, Artificial Sequence
  Description of Artificial Sequence: Synthetic polypeptide
VEEEVRTTNPVAYEQYGSVSTGNLSQRAGNR

SEQ ID NO: 19308 - protein, 32 aa, Artificial Sequence
  Description of Artificial Sequence: Synthetic polypeptide
DEEEIRTTNPVAYEQYGSVVSTNLSQRGGNSN

SEQ ID NO: 19309 - protein, 31 aa, Artificial Sequence
  Description of Artificial Sequence: Synthetic polypeptide
DEAEIRTTNPVATEPYGSVSTNLGQDEGNNR

SEQ ID NO: 19310 - protein, 33 aa, Artificial Sequence
  Description of Artificial Sequence: Synthetic polypeptide
DEEEIRTTNPVATEQYGSVVSCTGNLSQRSSNR

SEQ ID NO: 19311 - protein, 31 aa, Artificial Sequence
  Description of Artificial Sequence: Synthetic polypeptide
DEEEIRTTNPVATEQYGSVSPTFNLQVNNDQ

SEQ ID NO: 19312 - protein, 28 aa, Artificial Sequence
  Description of Artificial Sequence: Synthetic peptide
DEAEIRTTNPVATEQYGCVSTHLQRPDD

SEQ ID NO: 19313 - protein, 29 aa, Artificial Sequence
  Description of Artificial Sequence: Synthetic peptide
DEEEIRTTNPVATEQYGSVGTNNNSGENL

SEQ ID NO: 19314 - protein, 30 aa, Artificial Sequence
  Description of Artificial Sequence: Synthetic polypeptide
DEEEIRTTNPVATEQYGSVGTNSDQRGQDE

SEQ ID NO: 19315 - protein, 32 aa, Artificial Sequence
  Description of Artificial Sequence: Synthetic polypeptide
DEEEIRTTNPVATEQYGSVSPTFNLQGRLEIR

SEQ ID NO: 19316 - protein, 31 aa, Artificial Sequence
  Description of Artificial Sequence: Synthetic polypeptide
DEEEIRTTNPVATEQYGSVGTNTNLQFEGNG

SEQ ID NO: 19317 - protein, 32 aa, Artificial Sequence
  Description of Artificial Sequence: Synthetic polypeptide
DEEEIRTTNPVATEQYGSVTSTGNLQEGGSNQ

SEQ ID NO: 19318 - protein, 30 aa, Artificial Sequence
  Description of Artificial Sequence: Synthetic polypeptide
DEAEIRTTNPVATEPYGSTVSTNLSGTGNR

SEQ ID NO: 19319 - protein, 32 aa, Artificial Sequence
  Description of Artificial Sequence: Synthetic polypeptide
DEEEIRTTNPVATEQYGSVISTSLQRMGENPT

SEQ ID NO: 19320 - protein, 30 aa, Artificial Sequence
  Description of Artificial Sequence: Synthetic polypeptide
DEEEIRTTNPVATEQYGSVGTTNLDNGERF

SEQ ID NO: 19321 - protein, 28 aa, Artificial Sequence
  Description of Artificial Sequence: Synthetic peptide
DEAEIRTTNPVATEQYGCVSTELQYPND

SEQ ID NO: 19322 - protein, 29 aa, Artificial Sequence
  Description of Artificial Sequence: Synthetic peptide
DEEEIRTTNPVAYEQYGSVWTNLQQEDSR

SEQ ID NO: 19323 - protein, 29 aa, Artificial Sequence
  Description of Artificial Sequence: Synthetic peptide
AEEEIACTNPVATEQYGSVATNLQRDNRN

SEQ ID NO: 19324 - protein, 32 aa, Artificial Sequence
  Description of Artificial Sequence: Synthetic polypeptide
DEAEIRTTNPVATEPYGSVPSCTNELSQRGNR

SEQ ID NO: 19325 - protein, 30 aa, Artificial Sequence
  Description of Artificial Sequence: Synthetic polypeptide
DEAEIRTTNPVATEQYGCVSTEELQRGNQS

SEQ ID NO: 19326 - protein, 31 aa, Artificial Sequence
  Description of Artificial Sequence: Synthetic polypeptide
DEEEIRTTNPVATEQYGSVTSTGNLQTGEGT

SEQ ID NO: 19327 - protein, 29 aa, Artificial Sequence
  Description of Artificial Sequence: Synthetic peptide
DEAEIRTTNPVATEQYGCVSTDLQRPSND

SEQ ID NO: 19328 - protein, 29 aa, Artificial Sequence
  Description of Artificial Sequence: Synthetic peptide
DEEEIRTTNPVATEQYGSVQTNDDDGQFR

SEQ ID NO: 19329 - protein, 32 aa, Artificial Sequence
  Description of Artificial Sequence: Synthetic polypeptide
DEEEIRTTNPVATEQYGSVGTPNLQRGNVFVF

SEQ ID NO: 19330 - protein, 31 aa, Artificial Sequence
  Description of Artificial Sequence: Synthetic polypeptide
DEEEIRTTNPVATEQYGSVGTSNGQRGENNV

SEQ ID NO: 19331 - protein, 29 aa, Artificial Sequence
  Description of Artificial Sequence: Synthetic peptide
DEEEIATTNPVATEQWGSVSQNDQRGNMD

SEQ ID NO: 19332 - protein, 29 aa, Artificial Sequence
  Description of Artificial Sequence: Synthetic peptide
DEEEIRTTNPVAYEQYGSVWTNLQQFDER

SEQ ID NO: 19333 - protein, 32 aa, Artificial Sequence
  Description of Artificial Sequence: Synthetic polypeptide
DEEEIRTTNPVATEQYGSVTSTLNLQNQGNEQ

SEQ ID NO: 19334 - protein, 31 aa, Artificial Sequence
  Description of Artificial Sequence: Synthetic polypeptide
DEEEIRTTNPVAYEQYGSVVACNLSQRTGNR

SEQ ID NO: 19335 - protein, 30 aa, Artificial Sequence
  Description of Artificial Sequence: Synthetic polypeptide
DEEEIRTTNPVAYEQYGSVTTDLGQGGGNR

SEQ ID NO: 19336 - protein, 29 aa, Artificial Sequence
  Description of Artificial Sequence: Synthetic peptide
DEEEIRTTNPVATEQYGSVSNPLDNGNNG

SEQ ID NO: 19337 - protein, 30 aa, Artificial Sequence
  Description of Artificial Sequence: Synthetic polypeptide
DEEEIRTTNPVATEQYGSVVQTNLQNGVLD

SEQ ID NO: 19338 - protein, 33 aa, Artificial Sequence
  Description of Artificial Sequence: Synthetic polypeptide
DEEEIRTTNPVAYEQYGSVSTNLSQRTGTNQRC

SEQ ID NO: 19339 - protein, 32 aa, Artificial Sequence
  Description of Artificial Sequence: Synthetic polypeptide
DEEEIRTTNPVAYEQYGSVSTNLSQRPVNNRM

SEQ ID NO: 19340 - protein, 31 aa, Artificial Sequence
  Description of Artificial Sequence: Synthetic polypeptide
DEEEIRTTNPVATEQYGSVVQTDLQRGLQRD

SEQ ID NO: 19341 - protein, 30 aa, Artificial Sequence
  Description of Artificial Sequence: Synthetic polypeptide
DEEEIRTTNPVAYEQYGSVSTNLQVGTAME

SEQ ID NO: 19342 - protein, 31 aa, Artificial Sequence
  Description of Artificial Sequence: Synthetic polypeptide
DEEEIRTTNPVAYEQYGCVSCTNLSQRGNNM

SEQ ID NO: 19343 - protein, 29 aa, Artificial Sequence
  Description of Artificial Sequence: Synthetic peptide
TTEEIRATNPVATEQYGSKVSTNLQCGTR

SEQ ID NO: 19344 - protein, 28 aa, Artificial Sequence
  Description of Artificial Sequence: Synthetic peptide
DEEEIRTTNPVATECYGSVSTEIERLER

SEQ ID NO: 19345 - protein, 30 aa, Artificial Sequence
  Description of Artificial Sequence: Synthetic polypeptide
DEEEIRTTNPVATEQWGMTISTNELDRGNR

SEQ ID NO: 19346 - protein, 28 aa, Artificial Sequence
  Description of Artificial Sequence: Synthetic peptide
DEEEIRTTNPVATEQYGSVQTDLERLET

SEQ ID NO: 19347 - protein, 28 aa, Artificial Sequence
  Description of Artificial Sequence: Synthetic peptide
DEEEIRTTNPVATEQYGSVSNPLQNMVE

SEQ ID NO: 19348 - protein, 32 aa, Artificial Sequence
  Description of Artificial Sequence: Synthetic polypeptide
DEEEIRTTNPVATEQYGSVSPTEDLQRGSNDV

SEQ ID NO: 19349 - protein, 30 aa, Artificial Sequence
  Description of Artificial Sequence: Synthetic polypeptide
DEEEIRTTNPVATEQYGSVSNPLQRELNEQ

SEQ ID NO: 19350 - protein, 31 aa, Artificial Sequence
  Description of Artificial Sequence: Synthetic polypeptide
DEEEIRTTNPVATEQYGSVTSTMNLIGGNTQ

SEQ ID NO: 19351 - protein, 30 aa, Artificial Sequence
  Description of Artificial Sequence: Synthetic polypeptide
DEEEIRTTNPVAYEQYGSVSTNLQFTSNDY

SEQ ID NO: 19352 - protein, 28 aa, Artificial Sequence
  Description of Artificial Sequence: Synthetic peptide
DEAAIRTTNPVATEQYGCFSTNLIFGNR

SEQ ID NO: 19353 - protein, 31 aa, Artificial Sequence
  Description of Artificial Sequence: Synthetic polypeptide
DEEEIRTTNPVATEQYGSVISTPNLNYGNDP

SEQ ID NO: 19354 - protein, 31 aa, Artificial Sequence
  Description of Artificial Sequence: Synthetic polypeptide
DEEEIRTTNPVATEQYGSVSPTDPLQRGSQQ

SEQ ID NO: 19355 - protein, 29 aa, Artificial Sequence
  Description of Artificial Sequence: Synthetic peptide
DEEEIRTTNPVATEQYGSVVPVLGQRGTQ

SEQ ID NO: 19356 - protein, 31 aa, Artificial Sequence
  Description of Artificial Sequence: Synthetic polypeptide
DEEEIRTTNPVAYEQYGSVSTNGSQTGGNRY

SEQ ID NO: 19357 - protein, 30 aa, Artificial Sequence
  Description of Artificial Sequence: Synthetic polypeptide
DEEEIRTTNPVATECYGSVSTNLEINGNDG

SEQ ID NO: 19358 - protein, 29 aa, Artificial Sequence
  Description of Artificial Sequence: Synthetic peptide
TTEEIRTTNPCATEHYGSVSCNLQREGNR

SEQ ID NO: 19359 - protein, 31 aa, Artificial Sequence
  Description of Artificial Sequence: Synthetic polypeptide
VEEEVRTTNPVATEQYGSVSTWNLDQRQGNE

SEQ ID NO: 19360 - protein, 29 aa, Artificial Sequence
  Description of Artificial Sequence: Synthetic peptide
DEEEIRTTNPVAYEQYGSVSTNPQGFGED

SEQ ID NO: 19361 - protein, 30 aa, Artificial Sequence
  Description of Artificial Sequence: Synthetic polypeptide
DEEEIRTTNPVAYEQYGSVSTNPQNFGNQD

SEQ ID NO: 19362 - protein, 32 aa, Artificial Sequence
  Description of Artificial Sequence: Synthetic polypeptide
DEEEIRTTNPVAYEQYGSVSYTQNLSTRVGNR

SEQ ID NO: 19363 - protein, 28 aa, Artificial Sequence
  Description of Artificial Sequence: Synthetic peptide
DEAAIRTTNPVATEQYGSTSTNLIIGNT

SEQ ID NO: 19364 - protein, 29 aa, Artificial Sequence
  Description of Artificial Sequence: Synthetic peptide
DEEEIRTTNPVATEQYGSVQTIEQRVDRG

SEQ ID NO: 19365 - protein, 31 aa, Artificial Sequence
  Description of Artificial Sequence: Synthetic polypeptide
DEEEIRTTNPVATEQYGSVTSTLNVQGGGNQ

SEQ ID NO: 19366 - protein, 30 aa, Artificial Sequence
  Description of Artificial Sequence: Synthetic polypeptide
DEEEIRTTNPVATEQWGSHSLPNMLQRVNR

SEQ ID NO: 19367 - protein, 31 aa, Artificial Sequence
  Description of Artificial Sequence: Synthetic polypeptide
DEEEIRTTNPVAYEQYGSVSYTGNLTRGGNQ

SEQ ID NO: 19368 - protein, 32 aa, Artificial Sequence
  Description of Artificial Sequence: Synthetic polypeptide
DEEEIRTTNPVATEQYGSVSPTENLQRTNQLQ

SEQ ID NO: 19369 - protein, 28 aa, Artificial Sequence
  Description of Artificial Sequence: Synthetic peptide
TSEEIRTTNPVAYHQYGSVSTWLQRGND

SEQ ID NO: 19370 - protein, 31 aa, Artificial Sequence
  Description of Artificial Sequence: Synthetic polypeptide
DEEEIRTTNPVAYEQYGSVSVTGLSSRGGNR

SEQ ID NO: 19371 - protein, 29 aa, Artificial Sequence
  Description of Artificial Sequence: Synthetic peptide
DEAAIRTTNPVATEQYGSFSTNLIGGNRS

SEQ ID NO: 19372 - protein, 32 aa, Artificial Sequence
  Description of Artificial Sequence: Synthetic polypeptide
DEEEIRTTNPVATEQYGSVSPTENLQRTNNTN

SEQ ID NO: 19373 - protein, 30 aa, Artificial Sequence
  Description of Artificial Sequence: Synthetic polypeptide
DEEEIRTTNPVAYEQYGSVSVNLSQQRGME

SEQ ID NO: 19374 - protein, 32 aa, Artificial Sequence
  Description of Artificial Sequence: Synthetic polypeptide
DEEEIRTTNPVATEQYGSVSPTENLQRGELVQ

SEQ ID NO: 19375 - protein, 28 aa, Artificial Sequence
  Description of Artificial Sequence: Synthetic peptide
DEEEIRTTNPVATEQYGSVSNPDQRELV

SEQ ID NO: 19376 - protein, 31 aa, Artificial Sequence
  Description of Artificial Sequence: Synthetic polypeptide
VEEEVRTTNPVAYEQYGSVSTGNLDQRTGNR

SEQ ID NO: 19377 - protein, 32 aa, Artificial Sequence
  Description of Artificial Sequence: Synthetic polypeptide
DEEEIRTTNPVAYEQYGSVSTQNLSGRTGGNR

SEQ ID NO: 19378 - protein, 31 aa, Artificial Sequence
  Description of Artificial Sequence: Synthetic polypeptide
DEEEIRTTNPVAYEQYGSVSTQNHSMRGGNR

SEQ ID NO: 19379 - protein, 30 aa, Artificial Sequence
  Description of Artificial Sequence: Synthetic polypeptide
DEEEIRTTNPVAYEQYGSVSTNTQNFGNDQ

SEQ ID NO: 19380 - protein, 30 aa, Artificial Sequence
  Description of Artificial Sequence: Synthetic polypeptide
DEAEIRTTNPVATEQYGCVPTNLQRGSERT

SEQ ID NO: 19381 - protein, 30 aa, Artificial Sequence
  Description of Artificial Sequence: Synthetic polypeptide
DEEEIRTTNPVATEQWGQSVPSTHLLRGNS

SEQ ID NO: 19382 - protein, 30 aa, Artificial Sequence
  Description of Artificial Sequence: Synthetic polypeptide
DEEEIRTTNPVATEQYGSVQTDLQRIMNGQ

SEQ ID NO: 19383 - protein, 31 aa, Artificial Sequence
  Description of Artificial Sequence: Synthetic polypeptide
DEEEIRTTNPVATEQYGSVSNTDLQGTGGNN

SEQ ID NO: 19384 - protein, 29 aa, Artificial Sequence
  Description of Artificial Sequence: Synthetic peptide
DEEEIRTTNPVATEQWGQSVATYLLRGNS

SEQ ID NO: 19385 - protein, 31 aa, Artificial Sequence
  Description of Artificial Sequence: Synthetic polypeptide
DEEEIRTTNPVATEQYGSVGTNLQRQNVNVM

SEQ ID NO: 19386 - protein, 31 aa, Artificial Sequence
  Description of Artificial Sequence: Synthetic polypeptide
DEEEIRTTNPVAYEQYGAVSCTNLSQITGNR

SEQ ID NO: 19387 - protein, 30 aa, Artificial Sequence
  Description of Artificial Sequence: Synthetic polypeptide
DEEEIRTTNPVATEQYGSVGTNLQRIQADV

SEQ ID NO: 19388 - protein, 31 aa, Artificial Sequence
  Description of Artificial Sequence: Synthetic polypeptide
TSEEIRTTNPVATEQYGSVSTNLSQNRGGNV

SEQ ID NO: 19389 - protein, 31 aa, Artificial Sequence
  Description of Artificial Sequence: Synthetic polypeptide
DEEEIRTTNPVAYEQYGVVSTNALSQKTGNR

SEQ ID NO: 19390 - protein, 30 aa, Artificial Sequence
  Description of Artificial Sequence: Synthetic polypeptide
DEEEIRTTNPVAYEQYGVVSCTNLQHGGNL

SEQ ID NO: 19391 - protein, 33 aa, Artificial Sequence
  Description of Artificial Sequence: Synthetic polypeptide
DEEEIRTTNPVATEQYGSVSPTINLQRGDNNEE

SEQ ID NO: 19392 - protein, 32 aa, Artificial Sequence
  Description of Artificial Sequence: Synthetic polypeptide
DEEEIRTTNPVATEQYGSVGSTVNLQQNGINP

SEQ ID NO: 19393 - protein, 32 aa, Artificial Sequence
  Description of Artificial Sequence: Synthetic polypeptide
DEEEIRTTNPVAYEQYGVTVSCTNELQRTGNR

SEQ ID NO: 19394 - protein, 30 aa, Artificial Sequence
  Description of Artificial Sequence: Synthetic polypeptide
DEEEIRTTNPVAYEQWGSVSCTNMLQRVNA

SEQ ID NO: 19395 - protein, 31 aa, Artificial Sequence
  Description of Artificial Sequence: Synthetic polypeptide
DEEEIRTTNPVAYEQYGVTISTNELQRGDNR

SEQ ID NO: 19396 - protein, 32 aa, Artificial Sequence
  Description of Artificial Sequence: Synthetic polypeptide
DEEEIRTTNPVAYEQYGVSVSTNDLLQRGIAR

SEQ ID NO: 19397 - protein, 30 aa, Artificial Sequence
  Description of Artificial Sequence: Synthetic polypeptide
DEAEIRTTNPVATEQYGCVSTNLQGAGENK

SEQ ID NO: 19398 - protein, 32 aa, Artificial Sequence
  Description of Artificial Sequence: Synthetic polypeptide
DEEEIRTTNPVAYEQYGVSVSTNDLHQRGIAR

SEQ ID NO: 19399 - protein, 32 aa, Artificial Sequence
  Description of Artificial Sequence: Synthetic polypeptide
DEEEIRTTNPVATECYGSVPSCTNLSQSGGNR

SEQ ID NO: 19400 - protein, 33 aa, Artificial Sequence
  Description of Artificial Sequence: Synthetic polypeptide
DEEEIRTTNPVAYEQYGVSVSTNDLAQRGIDNR

SEQ ID NO: 19401 - protein, 32 aa, Artificial Sequence
  Description of Artificial Sequence: Synthetic polypeptide
WEEEIRTTNPVATEQYGSVNTENLMQRGENNR

SEQ ID NO: 19402 - protein, 32 aa, Artificial Sequence
  Description of Artificial Sequence: Synthetic polypeptide
DEEEIRTTNPVATEQWGSTVSTNALSQRGNNV

SEQ ID NO: 19403 - protein, 32 aa, Artificial Sequence
  Description of Artificial Sequence: Synthetic polypeptide
DEEEIRTTNPVATEQYGSVGSTVNLVQNGENM

SEQ ID NO: 19404 - protein, 28 aa, Artificial Sequence
  Description of Artificial Sequence: Synthetic peptide
AEEEIACVNPVATEQYGEVSDNLQRGNR

SEQ ID NO: 19405 - protein, 30 aa, Artificial Sequence
  Description of Artificial Sequence: Synthetic polypeptide
DEEEIRTTNPVAYEQWGSVSINLSQEPGNR

SEQ ID NO: 19406 - protein, 30 aa, Artificial Sequence
  Description of Artificial Sequence: Synthetic polypeptide
DEAEIRTTNPVATEQYGCVSTNLQADGNAM

SEQ ID NO: 19407 - protein, 30 aa, Artificial Sequence
  Description of Artificial Sequence: Synthetic polypeptide
DEAEIRTTNPVATENYGTVSTNLQRGDGND

SEQ ID NO: 19408 - protein, 32 aa, Artificial Sequence
  Description of Artificial Sequence: Synthetic polypeptide
DEEEIRTTNPVATEQYGSVSPPDNEQRGENRM

SEQ ID NO: 19409 - protein, 30 aa, Artificial Sequence
  Description of Artificial Sequence: Synthetic polypeptide
DEAEIRTTNPVATEQYGCVSTNLNQGAGNA

SEQ ID NO: 19410 - protein, 30 aa, Artificial Sequence
  Description of Artificial Sequence: Synthetic polypeptide
DEEEIRTTNPVATEQYGSVGTALQSGSNQQ

SEQ ID NO: 19411 - protein, 29 aa, Artificial Sequence
  Description of Artificial Sequence: Synthetic peptide
DEAEIRTTNPVATEQYGCVSTNLQGAGDL

SEQ ID NO: 19412 - protein, 32 aa, Artificial Sequence
  Description of Artificial Sequence: Synthetic polypeptide
DEEEIRTTNPVAYEQWGSVSCTNELQRTGNRF

SEQ ID NO: 19413 - protein, 33 aa, Artificial Sequence
  Description of Artificial Sequence: Synthetic polypeptide
DEEEIRTTNPVATEQWGSTVSTQNLSQRGGNPR

SEQ ID NO: 19414 - protein, 30 aa, Artificial Sequence
  Description of Artificial Sequence: Synthetic polypeptide
DEAEIRTTNPVATEQYGCVSTNLQGDGNGA

SEQ ID NO: 19415 - protein, 29 aa, Artificial Sequence
  Description of Artificial Sequence: Synthetic peptide
DEEEIRTTNPVATEQWGSVAANDERGNDR

SEQ ID NO: 19416 - protein, 28 aa, Artificial Sequence
  Description of Artificial Sequence: Synthetic peptide
AEEEIASTNPVCTEQYGVVSENLQRGNR

SEQ ID NO: 19417 - protein, 32 aa, Artificial Sequence
  Description of Artificial Sequence: Synthetic polypeptide
DEEEIRTTNPVATEQYGSVTSTEEHQRGSNRN

SEQ ID NO: 19418 - protein, 29 aa, Artificial Sequence
  Description of Artificial Sequence: Synthetic peptide
DEEEIRTTNPVATEQYGSVQTNDQTGAFD

SEQ ID NO: 19419 - protein, 33 aa, Artificial Sequence
  Description of Artificial Sequence: Synthetic polypeptide
DEEEIRTTNPVATEQWGSTVSVTNSLSQRGNNR

SEQ ID NO: 19420 - protein, 31 aa, Artificial Sequence
  Description of Artificial Sequence: Synthetic polypeptide
DEEEIRTTNPVATEQYGSVTSTELQLRGEEI

SEQ ID NO: 19421 - protein, 30 aa, Artificial Sequence
  Description of Artificial Sequence: Synthetic polypeptide
DEAEIRTTNPVATEQYGCVSTNLQYGSNAL

SEQ ID NO: 19422 - protein, 31 aa, Artificial Sequence
  Description of Artificial Sequence: Synthetic polypeptide
DEEEIRTTNPVAYTEQYGSVSNLNLGQRVNE

SEQ ID NO: 19423 - protein, 31 aa, Artificial Sequence
  Description of Artificial Sequence: Synthetic polypeptide
DEEEIRTTNPVAYEQWGSVPSCTNLQREGNH

SEQ ID NO: 19424 - protein, 31 aa, Artificial Sequence
  Description of Artificial Sequence: Synthetic polypeptide
DEEEIRTTNPVAYEWYGSVSCTNLQQTGNQR

SEQ ID NO: 19425 - protein, 30 aa, Artificial Sequence
  Description of Artificial Sequence: Synthetic polypeptide
DEAEIRTTNPVATEQYGCVSTNLQNGDNQE

SEQ ID NO: 19426 - protein, 32 aa, Artificial Sequence
  Description of Artificial Sequence: Synthetic polypeptide
DEEEIRTTNPVAYESYGSVVSTGNLSQRGGNR

SEQ ID NO: 19427 - protein, 32 aa, Artificial Sequence
  Description of Artificial Sequence: Synthetic polypeptide
DEEEIRTTNPVATEQYGSVGSTVNLQETDGNA

SEQ ID NO: 19428 - protein, 31 aa, Artificial Sequence
  Description of Artificial Sequence: Synthetic polypeptide
DEEEIRTTNPVAYEQWGSVSCTAELQRGNNR

SEQ ID NO: 19429 - protein, 29 aa, Artificial Sequence
  Description of Artificial Sequence: Synthetic peptide
DEEEIRTTNPVATEQYGSVQTNDQRNQEE

SEQ ID NO: 19430 - protein, 30 aa, Artificial Sequence
  Description of Artificial Sequence: Synthetic polypeptide
DEAEIRTTNPVATEQYGCVSTNLQMDGNTQ

SEQ ID NO: 19431 - protein, 28 aa, Artificial Sequence
  Description of Artificial Sequence: Synthetic peptide
AEEEIAQTNPEATEQYGDVSTNLQRGER

SEQ ID NO: 19432 - protein, 31 aa, Artificial Sequence
  Description of Artificial Sequence: Synthetic polypeptide
DEEEIRTTNPVAYEQWGSVSCTNELQGGNRC

SEQ ID NO: 19433 - protein, 33 aa, Artificial Sequence
  Description of Artificial Sequence: Synthetic polypeptide
DEEEIRTTNPVATEQYGSVQTNDLDQMRGENER

SEQ ID NO: 19434 - protein, 30 aa, Artificial Sequence
  Description of Artificial Sequence: Synthetic polypeptide
DEAEIRTTNPVATEQYGCVSTNLQGNGNMG

SEQ ID NO: 19435 - protein, 32 aa, Artificial Sequence
  Description of Artificial Sequence: Synthetic polypeptide
DEEEIRTTNPVATEQYGSVGSTVNLQNGGNEG

SEQ ID NO: 19436 - protein, 29 aa, Artificial Sequence
  Description of Artificial Sequence: Synthetic peptide
DEAEIRTTNPVATEQYGCVSTNLQGHDNG

SEQ ID NO: 19437 - protein, 29 aa, Artificial Sequence
  Description of Artificial Sequence: Synthetic peptide
DEEEIRTTNPVATECYGSVNSTNEQNENF

SEQ ID NO: 19438 - protein, 29 aa, Artificial Sequence
  Description of Artificial Sequence: Synthetic peptide
DEEAIRTTNPVATEQYGCVSTNPQFGNQN

SEQ ID NO: 19439 - protein, 31 aa, Artificial Sequence
  Description of Artificial Sequence: Synthetic polypeptide
DEEEIRTTNPVATEQYGSVITGNGQRVGNIG

SEQ ID NO: 19440 - protein, 30 aa, Artificial Sequence
  Description of Artificial Sequence: Synthetic polypeptide
DEEEIRTTNPVATEQYGSVGTDNGQSGNDE

SEQ ID NO: 19441 - protein, 30 aa, Artificial Sequence
  Description of Artificial Sequence: Synthetic polypeptide
DEEEIRTTNPVAYEQWGSVSTPLSQSGGNR

SEQ ID NO: 19442 - protein, 33 aa, Artificial Sequence
  Description of Artificial Sequence: Synthetic polypeptide
DEEEIRTTNPVATEQYGSVVSCTNELSTRGNPR

SEQ ID NO: 19443 - protein, 29 aa, Artificial Sequence
  Description of Artificial Sequence: Synthetic peptide
TSEEIRTTNPVATEQWGTVSCTNLQEGNR

SEQ ID NO: 19444 - protein, 33 aa, Artificial Sequence
  Description of Artificial Sequence: Synthetic polypeptide
DEEEIRTTNPVATEQYGSVISTVLQQRGINEER

SEQ ID NO: 19445 - protein, 30 aa, Artificial Sequence
  Description of Artificial Sequence: Synthetic polypeptide
DEEEIRTTNPVATEQYGSVSPTGLQIDETR

SEQ ID NO: 19446 - protein, 30 aa, Artificial Sequence
  Description of Artificial Sequence: Synthetic polypeptide
DEEEIRTTNPVATEQYGSVGTNLQNFGFEQ

SEQ ID NO: 19447 - protein, 33 aa, Artificial Sequence
  Description of Artificial Sequence: Synthetic polypeptide
DEEEIRTTNPVATEQYGSVVSCTNELSQGTGNR

SEQ ID NO: 19448 - protein, 28 aa, Artificial Sequence
  Description of Artificial Sequence: Synthetic peptide
WEEEICCTNPIATEQYGSVSENLMRGNR

SEQ ID NO: 19449 - protein, 31 aa, Artificial Sequence
  Description of Artificial Sequence: Synthetic polypeptide
DEEEIRTTNPVATEQYGSVSPTGLEQRGMQI

SEQ ID NO: 19450 - protein, 29 aa, Artificial Sequence
  Description of Artificial Sequence: Synthetic peptide
AEEEIACTNPVATEQYGSVSTNLQQGPNE

SEQ ID NO: 19451 - protein, 34 aa, Artificial Sequence
  Description of Artificial Sequence: Synthetic polypeptide
DEEEIRTTNPVATEQYGSVVSCTNALSQRAGNPR

SEQ ID NO: 19452 - protein, 28 aa, Artificial Sequence
  Description of Artificial Sequence: Synthetic peptide
WEEEIRCTNPIATEQYGSVSENLMRPNR

SEQ ID NO: 19453 - protein, 29 aa, Artificial Sequence
  Description of Artificial Sequence: Synthetic peptide
AEEEIACTNPVATEQYGSVSTNLQHGDNP

SEQ ID NO: 19454 - protein, 33 aa, Artificial Sequence
  Description of Artificial Sequence: Synthetic polypeptide
DEEEIRTTNPVATEQWGSTVQSTLNLSQRGGNR

SEQ ID NO: 19455 - protein, 32 aa, Artificial Sequence
  Description of Artificial Sequence: Synthetic polypeptide
DEEEIRTTNPVATEQYGSVISTTNVLEQNGER

SEQ ID NO: 19456 - protein, 30 aa, Artificial Sequence
  Description of Artificial Sequence: Synthetic polypeptide
DEEEIRTTNPVATEQYGSVISTTNLQVVEE

SEQ ID NO: 19457 - protein, 30 aa, Artificial Sequence
  Description of Artificial Sequence: Synthetic polypeptide
DEEEIRTTNPVATEQYGSVSPPNLDERGEQ

SEQ ID NO: 19458 - protein, 31 aa, Artificial Sequence
  Description of Artificial Sequence: Synthetic polypeptide
DEEEIRTTNPVATEQYGSVSPTFSLQRLQLR

SEQ ID NO: 19459 - protein, 29 aa, Artificial Sequence
  Description of Artificial Sequence: Synthetic peptide
DEEEIRTTNPVATEQYGSVSPPNLEEGEI

SEQ ID NO: 19460 - protein, 32 aa, Artificial Sequence
  Description of Artificial Sequence: Synthetic polypeptide
DEEEIRTTNPVATEQWGSTVPSCTNLSNRGNR

SEQ ID NO: 19461 - protein, 31 aa, Artificial Sequence
  Description of Artificial Sequence: Synthetic polypeptide
TSEEIRTTNPVATEQYGSVSCTNLQRGGNND

SEQ ID NO: 19462 - protein, 32 aa, Artificial Sequence
  Description of Artificial Sequence: Synthetic polypeptide
DEEEIRTTNPVATEQYGSVISTTNLQMGNQGG

SEQ ID NO: 19463 - protein, 31 aa, Artificial Sequence
  Description of Artificial Sequence: Synthetic polypeptide
TSEEIRTTNPVATEQYGSVSTNLSQDRGENM

SEQ ID NO: 19464 - protein, 30 aa, Artificial Sequence
  Description of Artificial Sequence: Synthetic polypeptide
DEEEIRTTNPVATEQYGSVQPVNLQTGNLM

SEQ ID NO: 19465 - protein, 29 aa, Artificial Sequence
  Description of Artificial Sequence: Synthetic peptide
WEEEIRCTNPIATEQYGSVSENLPMRGNR

SEQ ID NO: 19466 - protein, 31 aa, Artificial Sequence
  Description of Artificial Sequence: Synthetic polypeptide
DEEEIRTTNPVATEQYGSVGTNLQGQNGGNV

SEQ ID NO: 19467 - protein, 30 aa, Artificial Sequence
  Description of Artificial Sequence: Synthetic polypeptide
DEAEIRTTNPVATEQYGCVSTNHQNFGSNR

SEQ ID NO: 19468 - protein, 29 aa, Artificial Sequence
  Description of Artificial Sequence: Synthetic peptide
DEAEIRTTNPVATEQYGCVSTNLERGDVS

SEQ ID NO: 19469 - protein, 31 aa, Artificial Sequence
  Description of Artificial Sequence: Synthetic polypeptide
DEEEIRTTNPVATEQWGSTVSCTNMLQRVNS

SEQ ID NO: 19470 - protein, 30 aa, Artificial Sequence
  Description of Artificial Sequence: Synthetic polypeptide
DEEEIRTTNPVATEQYGSVGTNADQRGIDD

SEQ ID NO: 19471 - protein, 31 aa, Artificial Sequence
  Description of Artificial Sequence: Synthetic polypeptide
DEEEIRTTNPVAYEQYGTYTISTNELQRGNR

SEQ ID NO: 19472 - protein, 31 aa, Artificial Sequence
  Description of Artificial Sequence: Synthetic polypeptide
DEEEIRTTNPVATEQYGSVGTNGLQRFGSQQ

SEQ ID NO: 19473 - protein, 31 aa, Artificial Sequence
  Description of Artificial Sequence: Synthetic polypeptide
DEEEIRTTNPVATEQYGSVQPTTNLQTGNLF

SEQ ID NO: 19474 - protein, 31 aa, Artificial Sequence
  Description of Artificial Sequence: Synthetic polypeptide
DEEEIRTTNPVAYEQWGSVSYTNELQNGNRC

SEQ ID NO: 19475 - protein, 32 aa, Artificial Sequence
  Description of Artificial Sequence: Synthetic polypeptide
DEEEIRTTNPVATEQYGSVSPTGNLQLGEGRD

SEQ ID NO: 19476 - protein, 30 aa, Artificial Sequence
  Description of Artificial Sequence: Synthetic polypeptide
DEEEIRTTNPVATEQYGSVQTNDDRGNEHN

SEQ ID NO: 19477 - protein, 33 aa, Artificial Sequence
  Description of Artificial Sequence: Synthetic polypeptide
DEEEIRTTNPVATEQYGSVVSCTPNLQRGGNNE

SEQ ID NO: 19478 - protein, 31 aa, Artificial Sequence
  Description of Artificial Sequence: Synthetic polypeptide
DEEEIRTTNPVAYEQYGTVSTNLSQQGGNRW

SEQ ID NO: 19479 - protein, 31 aa, Artificial Sequence
  Description of Artificial Sequence: Synthetic polypeptide
DEEEIRTTNPVAYEQYGTVSTNLSQNEGGNR

SEQ ID NO: 19480 - protein, 29 aa, Artificial Sequence
  Description of Artificial Sequence: Synthetic peptide
DEEAIRTTNPVATEQYGCVSTNDQFFGND

SEQ ID NO: 19481 - protein, 31 aa, Artificial Sequence
  Description of Artificial Sequence: Synthetic polypeptide
DEEEIRTTNPVAYEQYGTVSTNLSGRVGNRM

SEQ ID NO: 19482 - protein, 30 aa, Artificial Sequence
  Description of Artificial Sequence: Synthetic polypeptide
DEEEIRTTNPVAYEQYGTVSTNLQHFGSER

SEQ ID NO: 19483 - protein, 31 aa, Artificial Sequence
  Description of Artificial Sequence: Synthetic polypeptide
DEEEIRTTNPVAYEQYGTVSTNALSGRGNRD

SEQ ID NO: 19484 - protein, 31 aa, Artificial Sequence
  Description of Artificial Sequence: Synthetic polypeptide
DEEEIRTTNPVAYEQYGTVSTDLSQRTGGNR

SEQ ID NO: 19485 - protein, 28 aa, Artificial Sequence
  Description of Artificial Sequence: Synthetic peptide
DEEAIRTTNPVATEQYGCVSTNDEMGNA

SEQ ID NO: 19486 - protein, 31 aa, Artificial Sequence
  Description of Artificial Sequence: Synthetic polypeptide
DEEEIRTTNPVATEQYGSVGTNLGQTGTNGE

SEQ ID NO: 19487 - protein, 32 aa, Artificial Sequence
  Description of Artificial Sequence: Synthetic polypeptide
DEEEIRTTNPVATEQYGSVVSCTNLSVRGGNS

SEQ ID NO: 19488 - protein, 31 aa, Artificial Sequence
  Description of Artificial Sequence: Synthetic polypeptide
DEEEIRTTNPVATEQYGSVISVSQNLQRVNI

SEQ ID NO: 19489 - protein, 30 aa, Artificial Sequence
  Description of Artificial Sequence: Synthetic polypeptide
DEAEIRTTNPVATEQYGCVSTNLDQGQGNG

SEQ ID NO: 19490 - protein, 32 aa, Artificial Sequence
  Description of Artificial Sequence: Synthetic polypeptide
DEEEIRTTNPVATEQYGSVSPTGLQRQQENRL

SEQ ID NO: 19491 - protein, 31 aa, Artificial Sequence
  Description of Artificial Sequence: Synthetic polypeptide
DEEEIRTTNPVAYEQWGSVSTNEHQRTGNYR

SEQ ID NO: 19492 - protein, 32 aa, Artificial Sequence
  Description of Artificial Sequence: Synthetic polypeptide
DEEEISTTNPVATEQYGSVVCSTNPQRGSNRS

SEQ ID NO: 19493 - protein, 30 aa, Artificial Sequence
  Description of Artificial Sequence: Synthetic polypeptide
DEEEIRTTNPVATEPYGSVVPTNLIRGGNN

SEQ ID NO: 19494 - protein, 31 aa, Artificial Sequence
  Description of Artificial Sequence: Synthetic polypeptide
DEEEIRTTNPVATEQYGSVFTNEGQEGENIR

SEQ ID NO: 19495 - protein, 31 aa, Artificial Sequence
  Description of Artificial Sequence: Synthetic polypeptide
DDEEIRTTNPVATEQYGSVSTNDLQGGSQRA

SEQ ID NO: 19496 - protein, 29 aa, Artificial Sequence
  Description of Artificial Sequence: Synthetic peptide
DEEEIRTTNPVATESFGTSVSTYLLRGNS

SEQ ID NO: 19497 - protein, 31 aa, Artificial Sequence
  Description of Artificial Sequence: Synthetic polypeptide
DDEEIRTTNPVATEQYGSVSTNHQRSGSDRP

SEQ ID NO: 19498 - protein, 31 aa, Artificial Sequence
  Description of Artificial Sequence: Synthetic polypeptide
DEEEIRTTNPVATEQYGSVSVNLDQSRDQER

SEQ ID NO: 19499 - protein, 29 aa, Artificial Sequence
  Description of Artificial Sequence: Synthetic peptide
DEAEIRTTNPCATEQYGSVSTNLQMGGEA

SEQ ID NO: 19500 - protein, 32 aa, Artificial Sequence
  Description of Artificial Sequence: Synthetic polypeptide
DEEEIRTTNPVATEQYGSVSVNLEQRSGEERI

SEQ ID NO: 19501 - protein, 32 aa, Artificial Sequence
  Description of Artificial Sequence: Synthetic polypeptide
DEEEIRTTNPVATEQYGSVSMTEYLQGGSNRF

SEQ ID NO: 19502 - protein, 32 aa, Artificial Sequence
  Description of Artificial Sequence: Synthetic polypeptide
DEEEIRTTNPVATEQYGSVSMTGNLQNGGERP

SEQ ID NO: 19503 - protein, 30 aa, Artificial Sequence
  Description of Artificial Sequence: Synthetic polypeptide
DEEEIATTNPVATECYGSVSTNLQNNGNDT

SEQ ID NO: 19504 - protein, 30 aa, Artificial Sequence
  Description of Artificial Sequence: Synthetic polypeptide
DEEEIRTTNPVATEQYGCVATNLEERNNDR

SEQ ID NO: 19505 - protein, 32 aa, Artificial Sequence
  Description of Artificial Sequence: Synthetic polypeptide
DEEEIRTTNPVATEQYGSVSPWLEEQDRGENR

SEQ ID NO: 19506 - protein, 30 aa, Artificial Sequence
  Description of Artificial Sequence: Synthetic polypeptide
DEEEIRTTNPVATEAYGVVSTNLQDGNQED

SEQ ID NO: 19507 - protein, 30 aa, Artificial Sequence
  Description of Artificial Sequence: Synthetic polypeptide
DEEEIATTNPVATECYGSVSTNLQQDGNDS

SEQ ID NO: 19508 - protein, 30 aa, Artificial Sequence
  Description of Artificial Sequence: Synthetic polypeptide
DEEEIATTNPVATECYGSVSTNLQQGNDAL

SEQ ID NO: 19509 - protein, 30 aa, Artificial Sequence
  Description of Artificial Sequence: Synthetic polypeptide
DEEEIATTNPVATECYGSVSTNLQQGNDEH

SEQ ID NO: 19510 - protein, 29 aa, Artificial Sequence
  Description of Artificial Sequence: Synthetic peptide
TEEEIRTTNPVATEAYGSLSTHLQRVGGR

SEQ ID NO: 19511 - protein, 32 aa, Artificial Sequence
  Description of Artificial Sequence: Synthetic polypeptide
DEEEIRTTNPVATEAYGVVSTNLSQRGGSNRS

SEQ ID NO: 19512 - protein, 31 aa, Artificial Sequence
  Description of Artificial Sequence: Synthetic polypeptide
DEEEIRTTNPVATEAYGVVSTNMLSQRGGNS

SEQ ID NO: 19513 - protein, 30 aa, Artificial Sequence
  Description of Artificial Sequence: Synthetic polypeptide
DEEEIRTTNPVATEQYGCVATNDQRPAENR

SEQ ID NO: 19514 - protein, 31 aa, Artificial Sequence
  Description of Artificial Sequence: Synthetic polypeptide
DEEEIRTTNPVATEQYGSVCTPNLQRGVDSD

SEQ ID NO: 19515 - protein, 29 aa, Artificial Sequence
  Description of Artificial Sequence: Synthetic peptide
DEEVIMTTNPVATECYGSVNTNLLQRGNM

SEQ ID NO: 19516 - protein, 31 aa, Artificial Sequence
  Description of Artificial Sequence: Synthetic polypeptide
DEEEIRTTNPVATEQYGSVCTPNLQRTNDVD

SEQ ID NO: 19517 - protein, 30 aa, Artificial Sequence
  Description of Artificial Sequence: Synthetic polypeptide
DEEEIRTTNPVATEQYGCVATNLDTRGDRM

SEQ ID NO: 19518 - protein, 30 aa, Artificial Sequence
  Description of Artificial Sequence: Synthetic polypeptide
DEEVICTTNPVATEQYGSVSTNLQENGQNE

SEQ ID NO: 19519 - protein, 29 aa, Artificial Sequence
  Description of Artificial Sequence: Synthetic peptide
DEEEIRTTNPVATEQYGSVSMTDSNGENR

SEQ ID NO: 19520 - protein, 30 aa, Artificial Sequence
  Description of Artificial Sequence: Synthetic polypeptide
DEEEIRTTNPVATEQYGCVATNLERHGENQ

SEQ ID NO: 19521 - protein, 29 aa, Artificial Sequence
  Description of Artificial Sequence: Synthetic peptide
DEDEIRTTNPVAYEQYGSVSTNNGQDGER

SEQ ID NO: 19522 - protein, 32 aa, Artificial Sequence
  Description of Artificial Sequence: Synthetic polypeptide
DEEEIRTTNPVATERYGSVVSTNLSQGGGNRM

SEQ ID NO: 19523 - protein, 30 aa, Artificial Sequence
  Description of Artificial Sequence: Synthetic polypeptide
DEEVIRTTNPVATEQWGSVATANLQLGGNR

SEQ ID NO: 19524 - protein, 31 aa, Artificial Sequence
  Description of Artificial Sequence: Synthetic polypeptide
DEEEIRTTNPVATEQYGSVCTNVLQVRVGDD

SEQ ID NO: 19525 - protein, 29 aa, Artificial Sequence
  Description of Artificial Sequence: Synthetic peptide
DEEEIRTTNPVATEQYGSVPTNSDRGEQS

SEQ ID NO: 19526 - protein, 29 aa, Artificial Sequence
  Description of Artificial Sequence: Synthetic peptide
DEEEIRTTNPVATEQYGCVATNLQMLNDE

SEQ ID NO: 19527 - protein, 31 aa, Artificial Sequence
  Description of Artificial Sequence: Synthetic polypeptide
DEEEIRTTNPVATEQYGSVCTNWLERGEDIR

SEQ ID NO: 19528 - protein, 28 aa, Artificial Sequence
  Description of Artificial Sequence: Synthetic peptide
DEEEIRTTNPVATEQYGSVCTNYQQEEL

SEQ ID NO: 19529 - protein, 30 aa, Artificial Sequence
  Description of Artificial Sequence: Synthetic polypeptide
DEEEIRTTNPVATEQYGSVCTPALQNGNPV

SEQ ID NO: 19530 - protein, 30 aa, Artificial Sequence
  Description of Artificial Sequence: Synthetic polypeptide
DEEEIATTNPVATECYGSVSTNLQHPGNDT

SEQ ID NO: 19531 - protein, 32 aa, Artificial Sequence
  Description of Artificial Sequence: Synthetic polypeptide
DEEEIRTTNPVATEQYGSVSPWNLDRIGNERT

SEQ ID NO: 19532 - protein, 30 aa, Artificial Sequence
  Description of Artificial Sequence: Synthetic polypeptide
DEEEIATTNPVATECYGSVSTNLQKGDGNQ

SEQ ID NO: 19533 - protein, 30 aa, Artificial Sequence
  Description of Artificial Sequence: Synthetic polypeptide
DEEEIATTNPVATECYGSVSTNLQLGQNDT

SEQ ID NO: 19534 - protein, 29 aa, Artificial Sequence
  Description of Artificial Sequence: Synthetic peptide
DEEVIRTTNPVATEIYGCVATNLQRGDNG

SEQ ID NO: 19535 - protein, 30 aa, Artificial Sequence
  Description of Artificial Sequence: Synthetic polypeptide
DEEEIRTTNPVATEQYGCVATNLQDGNGME

SEQ ID NO: 19536 - protein, 30 aa, Artificial Sequence
  Description of Artificial Sequence: Synthetic polypeptide
DEEEIRTTNPVATEQYGSVSPYDLQNGERF

SEQ ID NO: 19537 - protein, 31 aa, Artificial Sequence
  Description of Artificial Sequence: Synthetic polypeptide
DEEEIRTTNPVATEQYGSVSPWNLQDGNNES

SEQ ID NO: 19538 - protein, 29 aa, Artificial Sequence
  Description of Artificial Sequence: Synthetic peptide
DEEEIRTTNPVATEQYGSVCTPLLQRVEQ

SEQ ID NO: 19539 - protein, 31 aa, Artificial Sequence
  Description of Artificial Sequence: Synthetic polypeptide
DEEEIRTTNPVATEQYGSVSVNDNQEGENRM

SEQ ID NO: 19540 - protein, 28 aa, Artificial Sequence
  Description of Artificial Sequence: Synthetic peptide
DEEVIRCTNPVAYEQYGSVSMNFQRGNL

SEQ ID NO: 19541 - protein, 31 aa, Artificial Sequence
  Description of Artificial Sequence: Synthetic polypeptide
DEEEIRTTNPVATEQYGSVSMTDNDQRNERM

SEQ ID NO: 19542 - protein, 30 aa, Artificial Sequence
  Description of Artificial Sequence: Synthetic polypeptide
DEEVIRATNPVATEQYGSVSTNLQDNGDNQ

SEQ ID NO: 19543 - protein, 29 aa, Artificial Sequence
  Description of Artificial Sequence: Synthetic peptide
DEEEIRTTNPVATEQYGSVCTPDQRGEEY

SEQ ID NO: 19544 - protein, 30 aa, Artificial Sequence
  Description of Artificial Sequence: Synthetic polypeptide
DEEEIRTTNPVATEQYGCVATNDQRNDNMR

SEQ ID NO: 19545 - protein, 29 aa, Artificial Sequence
  Description of Artificial Sequence: Synthetic peptide
DEEEIRTTNPVATEQYGCVATNDQREIND

SEQ ID NO: 19546 - protein, 28 aa, Artificial Sequence
  Description of Artificial Sequence: Synthetic peptide
DEAEIATTNPVATEQYGAVSTNLQNGMA

SEQ ID NO: 19547 - protein, 31 aa, Artificial Sequence
  Description of Artificial Sequence: Synthetic polypeptide
DEEEIRTTNPVATEQYGSVCTWLNQRTGNDI

SEQ ID NO: 19548 - protein, 31 aa, Artificial Sequence
  Description of Artificial Sequence: Synthetic polypeptide
DEEEIRTTNPVATEQYGSVCTWNLQRMQQNI

SEQ ID NO: 19549 - protein, 28 aa, Artificial Sequence
  Description of Artificial Sequence: Synthetic peptide
DEETIRVTNPVATEQYGSVSSNVQRTNN

SEQ ID NO: 19550 - protein, 31 aa, Artificial Sequence
  Description of Artificial Sequence: Synthetic polypeptide
DEEEIRTTNPVATEQYGSVCTWNNLQRGEVP

SEQ ID NO: 19551 - protein, 30 aa, Artificial Sequence
  Description of Artificial Sequence: Synthetic polypeptide
DEEEIRTTNPVATEQYGSVSATNNQDLESR

SEQ ID NO: 19552 - protein, 29 aa, Artificial Sequence
  Description of Artificial Sequence: Synthetic peptide
DEDEIRTTNPVAYEQYGSVSTNLGDGDAR

SEQ ID NO: 19553 - protein, 32 aa, Artificial Sequence
  Description of Artificial Sequence: Synthetic polypeptide
DEEEIRTTNPVATEQYGSVSMTNDLQPGDNDV

SEQ ID NO: 19554 - protein, 31 aa, Artificial Sequence
  Description of Artificial Sequence: Synthetic polypeptide
DEEEIRTTNPVATEQYGSVSMTNDQEINDRM

SEQ ID NO: 19555 - protein, 32 aa, Artificial Sequence
  Description of Artificial Sequence: Synthetic polypeptide
DEEEIRTTNPVATEQYGSVSPVGNLQRGNTVN

SEQ ID NO: 19556 - protein, 31 aa, Artificial Sequence
  Description of Artificial Sequence: Synthetic polypeptide
DEEEIRTTNPVATEQYGSVCVTTNLTNRGTR

SEQ ID NO: 19557 - protein, 29 aa, Artificial Sequence
  Description of Artificial Sequence: Synthetic peptide
DEETITTTNPVATEAYGSVNTNGLQRGNM

SEQ ID NO: 19558 - protein, 29 aa, Artificial Sequence
  Description of Artificial Sequence: Synthetic peptide
DEETIRTTNPVATESYGVVTTNLQRGSNG

SEQ ID NO: 19559 - protein, 30 aa, Artificial Sequence
  Description of Artificial Sequence: Synthetic polypeptide
DEETIRTTNPVATEQYGYSSSINLQREDNR

SEQ ID NO: 19560 - protein, 31 aa, Artificial Sequence
  Description of Artificial Sequence: Synthetic polypeptide
DEEEIRTTNPVATEQYGSVSVNLQRLVNAET

SEQ ID NO: 19561 - protein, 29 aa, Artificial Sequence
  Description of Artificial Sequence: Synthetic peptide
DEDEIRTTNPVAYEQYGSVSTNHEQGGER

SEQ ID NO: 19562 - protein, 32 aa, Artificial Sequence
  Description of Artificial Sequence: Synthetic polypeptide
TEEEIRTTNPVATEAYGSVSVTNLSQRGGNRS

SEQ ID NO: 19563 - protein, 31 aa, Artificial Sequence
  Description of Artificial Sequence: Synthetic polypeptide
DEETIRTTNPVATEQYGVVSVSINEQRGDNR

SEQ ID NO: 19564 - protein, 31 aa, Artificial Sequence
  Description of Artificial Sequence: Synthetic polypeptide
DEETIRTTNPVATEQYGVVSVSDNLQAGDNR

SEQ ID NO: 19565 - protein, 31 aa, Artificial Sequence
  Description of Artificial Sequence: Synthetic polypeptide
DEEEIRTTNPVATEQYGSVSMTNDQRFNDVM

SEQ ID NO: 19566 - protein, 31 aa, Artificial Sequence
  Description of Artificial Sequence: Synthetic polypeptide
DEEEIRTTNPVATEQYGCVAATNLQHPGENR

SEQ ID NO: 19567 - protein, 31 aa, Artificial Sequence
  Description of Artificial Sequence: Synthetic polypeptide
DEEEIRTTNPVATEQYGSVCYTNLQRFGSEN

SEQ ID NO: 19568 - protein, 31 aa, Artificial Sequence
  Description of Artificial Sequence: Synthetic polypeptide
TEEEIRTTNPVATEAYGSVVSCTNELQRVNR

SEQ ID NO: 19569 - protein, 30 aa, Artificial Sequence
  Description of Artificial Sequence: Synthetic polypeptide
TEEEIRTTNPVATEAYGSVSTNLSQRVNNQ

SEQ ID NO: 19570 - protein, 32 aa, Artificial Sequence
  Description of Artificial Sequence: Synthetic polypeptide
DEEEIRTTNPVATEQYGSVWPTNDLQDGNLRI

SEQ ID NO: 19571 - protein, 31 aa, Artificial Sequence
  Description of Artificial Sequence: Synthetic polypeptide
TEEEIRTTNPVATEAYGSVSTNELSQDRGNE

SEQ ID NO: 19572 - protein, 32 aa, Artificial Sequence
  Description of Artificial Sequence: Synthetic polypeptide
DEEEIRTTNPVATESYGISVSTVNLQDRTNNR

SEQ ID NO: 19573 - protein, 30 aa, Artificial Sequence
  Description of Artificial Sequence: Synthetic polypeptide
DDEEIRTTNPVATEQYGSVSTVLQRGIEDG

SEQ ID NO: 19574 - protein, 31 aa, Artificial Sequence
  Description of Artificial Sequence: Synthetic polypeptide
DEAEIRTTNPCATEQYGSVSTNLQRGENGEQ

SEQ ID NO: 19575 - protein, 29 aa, Artificial Sequence
  Description of Artificial Sequence: Synthetic peptide
DEEEIRTTNPVATEQYGCVATNDQDPGNI

SEQ ID NO: 19576 - protein, 31 aa, Artificial Sequence
  Description of Artificial Sequence: Synthetic polypeptide
DEEEIRTTNPVATEQYGCVATNDLQRGDNPD

SEQ ID NO: 19577 - protein, 31 aa, Artificial Sequence
  Description of Artificial Sequence: Synthetic polypeptide
DEEEIRTTNPVATEQYGSVSPVNLQTGFNTQ

SEQ ID NO: 19578 - protein, 30 aa, Artificial Sequence
  Description of Artificial Sequence: Synthetic polypeptide
DEEEIRTTNPVATEQYGSVSVNLNTREDTR

SEQ ID NO: 19579 - protein, 30 aa, Artificial Sequence
  Description of Artificial Sequence: Synthetic polypeptide
DEEEIRTTNPVATEQYGSVCTTNDQRGLLM

SEQ ID NO: 19580 - protein, 29 aa, Artificial Sequence
  Description of Artificial Sequence: Synthetic peptide
DEEVIATTNPVATEQYSENVSTNLQVGNR

SEQ ID NO: 19581 - protein, 31 aa, Artificial Sequence
  Description of Artificial Sequence: Synthetic polypeptide
DEEEIRTTNPVATEQYGSVCTTNLQLRDQER

SEQ ID NO: 19582 - protein, 31 aa, Artificial Sequence
  Description of Artificial Sequence: Synthetic polypeptide
TEEEIRTTNPVATEAYGSVSENLSQRTGNNR

SEQ ID NO: 19583 - protein, 32 aa, Artificial Sequence
  Description of Artificial Sequence: Synthetic polypeptide
DEEEIRTTNPVATEQYGSVSPVNLQQGQNIRD

SEQ ID NO: 19584 - protein, 31 aa, Artificial Sequence
  Description of Artificial Sequence: Synthetic polypeptide
DEEVIATTNPVATEQYGQSLVSTNLSQRVNR

SEQ ID NO: 19585 - protein, 30 aa, Artificial Sequence
  Description of Artificial Sequence: Synthetic polypeptide
DEAEIATTNPVATEQYGAVSTNLQGEGMNR

SEQ ID NO: 19586 - protein, 29 aa, Artificial Sequence
  Description of Artificial Sequence: Synthetic peptide
DEAEIATTNPVATEQYGAVSTNLQAGDSR

SEQ ID NO: 19587 - protein, 31 aa, Artificial Sequence
  Description of Artificial Sequence: Synthetic polypeptide
DEEEIRTTNPVATEQYGSVCTTNLQRIQNLD

SEQ ID NO: 19588 - protein, 29 aa, Artificial Sequence
  Description of Artificial Sequence: Synthetic peptide
DEEVIATTNPVATEQYFEEVSTNLQMGNR

SEQ ID NO: 19589 - protein, 32 aa, Artificial Sequence
  Description of Artificial Sequence: Synthetic polypeptide
DEEEIRTTNPVATEQYGSVCTTNNLQRGNVLQ

SEQ ID NO: 19590 - protein, 30 aa, Artificial Sequence
  Description of Artificial Sequence: Synthetic polypeptide
DEDEIRTTNPVAYEQYGSVSTNMQDGGMNR

SEQ ID NO: 19591 - protein, 30 aa, Artificial Sequence
  Description of Artificial Sequence: Synthetic polypeptide
DEDEIRTTNPVAYEQYGSVSTNLQSGGDMR

SEQ ID NO: 19592 - protein, 28 aa, Artificial Sequence
  Description of Artificial Sequence: Synthetic peptide
DEEEIRTTNPVATESYGCTSTNEQRDNF

SEQ ID NO: 19593 - protein, 31 aa, Artificial Sequence
  Description of Artificial Sequence: Synthetic polypeptide
DEEEIRTTNPVATEQYGSVSVNLQMRMIERA

SEQ ID NO: 19594 - protein, 31 aa, Artificial Sequence
  Description of Artificial Sequence: Synthetic polypeptide
DEEEIRTTNPVATEQYGSVSMTNDLQDNENQ

SEQ ID NO: 19595 - protein, 31 aa, Artificial Sequence
  Description of Artificial Sequence: Synthetic polypeptide
TEEEIRTTNPVATEAYGSVSTNEHQRPGGNR

SEQ ID NO: 19596 - protein, 30 aa, Artificial Sequence
  Description of Artificial Sequence: Synthetic polypeptide
DEEVIRTTNPVATEQWGSVATNNLQAGENR

SEQ ID NO: 19597 - protein, 30 aa, Artificial Sequence
  Description of Artificial Sequence: Synthetic polypeptide
DEEVIRTTNPVATEQWGSVATNNLQTGSNR

SEQ ID NO: 19598 - protein, 31 aa, Artificial Sequence
  Description of Artificial Sequence: Synthetic polypeptide
DEEEIATTNPVATECYGSVSTNLQETNGNDR

SEQ ID NO: 19599 - protein, 31 aa, Artificial Sequence
  Description of Artificial Sequence: Synthetic polypeptide
DEEEIRTTNPVATERYGSVSTNLSQRTVGSE

SEQ ID NO: 19600 - protein, 31 aa, Artificial Sequence
  Description of Artificial Sequence: Synthetic polypeptide
YEEEIRTTNPVGTEQYGGSVSTWNNQRGVNR

SEQ ID NO: 19601 - protein, 31 aa, Artificial Sequence
  Description of Artificial Sequence: Synthetic polypeptide
DEEEIRTTNPVATEQYGSVSPDNLQNGNEDP

SEQ ID NO: 19602 - protein, 30 aa, Artificial Sequence
  Description of Artificial Sequence: Synthetic polypeptide
DEEEIRTTNPVATERYGKVSTNLSQTGGSR

SEQ ID NO: 19603 - protein, 30 aa, Artificial Sequence
  Description of Artificial Sequence: Synthetic polypeptide
DEEVIRTTNPVATEQYGSVSTELQHGGSNQ

SEQ ID NO: 19604 - protein, 31 aa, Artificial Sequence
  Description of Artificial Sequence: Synthetic polypeptide
DEEEIRTTNPVATEQYGSVCTNLVQEGTGRE

SEQ ID NO: 19605 - protein, 28 aa, Artificial Sequence
  Description of Artificial Sequence: Synthetic peptide
DEEVIRTTNPVATEQYGSVSTEELRENT

SEQ ID NO: 19606 - protein, 30 aa, Artificial Sequence
  Description of Artificial Sequence: Synthetic polypeptide
DEEEIRTTNPVATEQYGCVCFTELQRGERS

SEQ ID NO: 19607 - protein, 30 aa, Artificial Sequence
  Description of Artificial Sequence: Synthetic polypeptide
DEEVIRTTNPVATEQYGSVSTALDDNGQNR

SEQ ID NO: 19608 - protein, 31 aa, Artificial Sequence
  Description of Artificial Sequence: Synthetic polypeptide
DEEEIRTTNPVATEQYGSVSQMPLQRGNLAN

SEQ ID NO: 19609 - protein, 28 aa, Artificial Sequence
  Description of Artificial Sequence: Synthetic peptide
TEEEIRCTNPIATEQYGSVSENLMRGGR

SEQ ID NO: 19610 - protein, 30 aa, Artificial Sequence
  Description of Artificial Sequence: Synthetic polypeptide
DEEEIRTTNPVATEQYGSVSPDNLDNGEER

SEQ ID NO: 19611 - protein, 33 aa, Artificial Sequence
  Description of Artificial Sequence: Synthetic polypeptide
DEEEIRTTNPVATERYGQSVVSTNLSQRGGNRE

SEQ ID NO: 19612 - protein, 30 aa, Artificial Sequence
  Description of Artificial Sequence: Synthetic polypeptide
DEEEIATTNPVATECYGSVSTDNLQGAGNS

SEQ ID NO: 19613 - protein, 32 aa, Artificial Sequence
  Description of Artificial Sequence: Synthetic polypeptide
DEEEIRTTNPVATEQYGSVSVINLQRTGNQDF

SEQ ID NO: 19614 - protein, 32 aa, Artificial Sequence
  Description of Artificial Sequence: Synthetic polypeptide
DEEEIRTTNPVATEQYGSVSCANLQTGENERQ

SEQ ID NO: 19615 - protein, 30 aa, Artificial Sequence
  Description of Artificial Sequence: Synthetic polypeptide
DEEEIRTTNPVATEQYGSVSVLFNEQRNNI

SEQ ID NO: 19616 - protein, 31 aa, Artificial Sequence
  Description of Artificial Sequence: Synthetic polypeptide
DEEEIRTTNPVATEQYGSVSVLIQRGENERP

SEQ ID NO: 19617 - protein, 29 aa, Artificial Sequence
  Description of Artificial Sequence: Synthetic peptide
DEEEIRTTNPVATEQYGSVSVLLAARQER

SEQ ID NO: 19618 - protein, 30 aa, Artificial Sequence
  Description of Artificial Sequence: Synthetic polypeptide
DEEEIRTTNPVATEQYGSVCTNMEQRGEEI

SEQ ID NO: 19619 - protein, 28 aa, Artificial Sequence
  Description of Artificial Sequence: Synthetic peptide
TEEEIRCTNPIATEQYGSVSENLMRHNR

SEQ ID NO: 19620 - protein, 32 aa, Artificial Sequence
  Description of Artificial Sequence: Synthetic polypeptide
DEEEIRTTNPVATERYGSTVASCTNLQSGNMR

SEQ ID NO: 19621 - protein, 30 aa, Artificial Sequence
  Description of Artificial Sequence: Synthetic polypeptide
DEEVIRTTNPVATEQYGSVGTNLNDNGQNR

SEQ ID NO: 19622 - protein, 29 aa, Artificial Sequence
  Description of Artificial Sequence: Synthetic peptide
DEEEIRTTNPVATEQYGSVPTNLQTEEEG

SEQ ID NO: 19623 - protein, 31 aa, Artificial Sequence
  Description of Artificial Sequence: Synthetic polypeptide
DEEVIRTTNPVATEQYGSVSTGNLGDNGENR

SEQ ID NO: 19624 - protein, 31 aa, Artificial Sequence
  Description of Artificial Sequence: Synthetic polypeptide
DEEEIRTTNPVATEQYGSVSQNIQERGDENS

SEQ ID NO: 19625 - protein, 31 aa, Artificial Sequence
  Description of Artificial Sequence: Synthetic polypeptide
DEEEIRTTNPVATEQYGSVCTNLTRTGNNDG

SEQ ID NO: 19626 - protein, 29 aa, Artificial Sequence
  Description of Artificial Sequence: Synthetic peptide
TEEEIMTTNPVATEQYGCVSVTMLQGGNR

SEQ ID NO: 19627 - protein, 33 aa, Artificial Sequence
  Description of Artificial Sequence: Synthetic polypeptide
DEEEIRTTNPVATEQYGSVSNTNDTQRGGENRD

SEQ ID NO: 19628 - protein, 30 aa, Artificial Sequence
  Description of Artificial Sequence: Synthetic polypeptide
DEEVIRTTNPVATEQYGSVSTNLEDNGENM

SEQ ID NO: 19629 - protein, 29 aa, Artificial Sequence
  Description of Artificial Sequence: Synthetic peptide
TEEEIQTTNPVATEQYGNVSVTQLQGGNR

SEQ ID NO: 19630 - protein, 31 aa, Artificial Sequence
  Description of Artificial Sequence: Synthetic polypeptide
DEEEIRTTNPVATEQYGSVSNTNDQTGGNNG

SEQ ID NO: 19631 - protein, 29 aa, Artificial Sequence
  Description of Artificial Sequence: Synthetic peptide
TEEEIRATNPVATENYGSVSTNLQNGERE

SEQ ID NO: 19632 - protein, 31 aa, Artificial Sequence
  Description of Artificial Sequence: Synthetic polypeptide
DEEVIRTTNPVATEQYGSVSTNLEDFGGQNR

SEQ ID NO: 19633 - protein, 30 aa, Artificial Sequence
  Description of Artificial Sequence: Synthetic polypeptide
DEEVIRTTNPVATEQYGSVSTNLEDDDQNR

SEQ ID NO: 19634 - protein, 30 aa, Artificial Sequence
  Description of Artificial Sequence: Synthetic polypeptide
DEEEIRTTNPVATEQYGSVSQNLQNNSIDR

SEQ ID NO: 19635 - protein, 29 aa, Artificial Sequence
  Description of Artificial Sequence: Synthetic peptide
DEEEIRTTNPVATEQYGCVCPTYHQGGNR

SEQ ID NO: 19636 - protein, 29 aa, Artificial Sequence
  Description of Artificial Sequence: Synthetic peptide
DEEEIRTTNPVATERFGQSVSTYLGRGNS

SEQ ID NO: 19637 - protein, 32 aa, Artificial Sequence
  Description of Artificial Sequence: Synthetic polypeptide
DEEEIRTTNPVATEQYGSVWSLPNELQRMDNR

SEQ ID NO: 19638 - protein, 31 aa, Artificial Sequence
  Description of Artificial Sequence: Synthetic polypeptide
DEEVIRTTNPVATEQYGSVSTNELSDMGQNR

SEQ ID NO: 19639 - protein, 31 aa, Artificial Sequence
  Description of Artificial Sequence: Synthetic polypeptide
DEEEIRTTNPVATEQYGSVNGTGNLQETGNE

SEQ ID NO: 19640 - protein, 31 aa, Artificial Sequence
  Description of Artificial Sequence: Synthetic polypeptide
DEEVIRTTNPVATEQYGSVSTNDLRDGGQNR

SEQ ID NO: 19641 - protein, 28 aa, Artificial Sequence
  Description of Artificial Sequence: Synthetic peptide
TEEEIRCTNPIATEQYGSVAENLMRGNR

SEQ ID NO: 19642 - protein, 31 aa, Artificial Sequence
  Description of Artificial Sequence: Synthetic polypeptide
DEEEIRTTNPVATERWGSVSCTDLSQRSGNR

SEQ ID NO: 19643 - protein, 30 aa, Artificial Sequence
  Description of Artificial Sequence: Synthetic polypeptide
DEEEIRTTNPVATEQYGSVSQNLDQTGSQN

SEQ ID NO: 19644 - protein, 29 aa, Artificial Sequence
  Description of Artificial Sequence: Synthetic peptide
DEEVIRTTNPVATEQYGSVSTHGPLRGNT

SEQ ID NO: 19645 - protein, 30 aa, Artificial Sequence
  Description of Artificial Sequence: Synthetic polypeptide
DEEVIRTTNPVATEQYGSVSTHELTRGENE

SEQ ID NO: 19646 - protein, 30 aa, Artificial Sequence
  Description of Artificial Sequence: Synthetic polypeptide
DEEEIRTTNPVATERWGSVSTALSQSGGNR

SEQ ID NO: 19647 - protein, 30 aa, Artificial Sequence
  Description of Artificial Sequence: Synthetic polypeptide
DEEEIRTTNPVATEQYGSVCTNLTRGDEDQ

SEQ ID NO: 19648 - protein, 29 aa, Artificial Sequence
  Description of Artificial Sequence: Synthetic peptide
DEEVIRTTNPVATEQYGSVSTHEERGNQE

SEQ ID NO: 19649 - protein, 30 aa, Artificial Sequence
  Description of Artificial Sequence: Synthetic polypeptide
DEEEIRTTNPVATEQYGSVPTNLQVTNLVT

SEQ ID NO: 19650 - protein, 32 aa, Artificial Sequence
  Description of Artificial Sequence: Synthetic polypeptide
DEEEIRTTNPVATEQYGSVSPVDNLQRGENEM

SEQ ID NO: 19651 - protein, 30 aa, Artificial Sequence
  Description of Artificial Sequence: Synthetic polypeptide
DEEEIRTTNPVATEQYGSVSVLLDQRMDRQ

SEQ ID NO: 19652 - protein, 31 aa, Artificial Sequence
  Description of Artificial Sequence: Synthetic polypeptide
DEEEIRTTNPVATEQYGSVSMTDLDQQRSER

SEQ ID NO: 19653 - protein, 31 aa, Artificial Sequence
  Description of Artificial Sequence: Synthetic polypeptide
DEEEIRTTNPVATEQYGSVSATWLLQNSQNR

SEQ ID NO: 19654 - protein, 28 aa, Artificial Sequence
  Description of Artificial Sequence: Synthetic peptide
DEEVIRTTNPVATEQYGCVSTNGDFGNE

SEQ ID NO: 19655 - protein, 29 aa, Artificial Sequence
  Description of Artificial Sequence: Synthetic peptide
DEEVIRTTNPVATEQYGCVSTNDQGEGNN

SEQ ID NO: 19656 - protein, 29 aa, Artificial Sequence
  Description of Artificial Sequence: Synthetic peptide
DEEVIRTTNPVATEQYGCVSTNDQFGNSF

SEQ ID NO: 19657 - protein, 28 aa, Artificial Sequence
  Description of Artificial Sequence: Synthetic peptide
DEEVIRTTNPVATEQYGCVSTNDQDPNN

SEQ ID NO: 19658 - protein, 33 aa, Artificial Sequence
  Description of Artificial Sequence: Synthetic polypeptide
DEEEIRTTNPVATERYGSVQSYTNLSQRGGNTR

SEQ ID NO: 19659 - protein, 33 aa, Artificial Sequence
  Description of Artificial Sequence: Synthetic polypeptide
DEEEIRTTNPVATERYGSVSCTGNALQRGGVNR

SEQ ID NO: 19660 - protein, 30 aa, Artificial Sequence
  Description of Artificial Sequence: Synthetic polypeptide
DEEEIRTTNPVATEQYGCVATNLQRGDGTA

SEQ ID NO: 19661 - protein, 32 aa, Artificial Sequence
  Description of Artificial Sequence: Synthetic polypeptide
DDEEIRTTNPVATEQYGSVSTGNDQRFGSNRS

SEQ ID NO: 19662 - protein, 32 aa, Artificial Sequence
  Description of Artificial Sequence: Synthetic polypeptide
DEEEIRTTNPVATEPYGISVSTRNLQDRDKNR

SEQ ID NO: 19663 - protein, 31 aa, Artificial Sequence
  Description of Artificial Sequence: Synthetic polypeptide
DDEEIRTTNPVATEQYGSVSTGELQRGSNAM

SEQ ID NO: 19664 - protein, 32 aa, Artificial Sequence
  Description of Artificial Sequence: Synthetic polypeptide
DEEEIRTTNPVATERYGSVSCTNLSNRGGVNR

SEQ ID NO: 19665 - protein, 30 aa, Artificial Sequence
  Description of Artificial Sequence: Synthetic polypeptide
DEEEIRTTNPVATEQYGSVSVMNLQSGILQ

SEQ ID NO: 19666 - protein, 31 aa, Artificial Sequence
  Description of Artificial Sequence: Synthetic polypeptide
DEEEIRTTNPVATERYGSVSINELSQQGGNR

SEQ ID NO: 19667 - protein, 30 aa, Artificial Sequence
  Description of Artificial Sequence: Synthetic polypeptide
YEEEIRTTNPVCTEQYGSVSDPNLQRGMNQ

SEQ ID NO: 19668 - protein, 32 aa, Artificial Sequence
  Description of Artificial Sequence: Synthetic polypeptide
DEEEIRTTNPVATEQYGSVSATPNVLDQRGEN

SEQ ID NO: 19669 - protein, 32 aa, Artificial Sequence
  Description of Artificial Sequence: Synthetic polypeptide
DEEEIRTTNPVATERYGSVSTHELSQRTGNNR

SEQ ID NO: 19670 - protein, 30 aa, Artificial Sequence
  Description of Artificial Sequence: Synthetic polypeptide
TEEEIRTTNCVATEQYGSVCSTNSQGGNRN

SEQ ID NO: 19671 - protein, 31 aa, Artificial Sequence
  Description of Artificial Sequence: Synthetic polypeptide
DEEEIRTTNPVATEQYGSVSQGNLQVVDNDR

SEQ ID NO: 19672 - protein, 28 aa, Artificial Sequence
  Description of Artificial Sequence: Synthetic peptide
DEEVIRTTNPVATEQYGCVATNDQNGNT

SEQ ID NO: 19673 - protein, 31 aa, Artificial Sequence
  Description of Artificial Sequence: Synthetic polypeptide
DEEEIRTTNPVATEQYGSVSVMSLQRDVNER

SEQ ID NO: 19674 - protein, 29 aa, Artificial Sequence
  Description of Artificial Sequence: Synthetic peptide
DEEVIRTTNPVATEQYGAVSTNQQAFGNE

SEQ ID NO: 19675 - protein, 32 aa, Artificial Sequence
  Description of Artificial Sequence: Synthetic polypeptide
DEEEIRTTNPVATERYGSVSCTWELSQRVGNR

SEQ ID NO: 19676 - protein, 31 aa, Artificial Sequence
  Description of Artificial Sequence: Synthetic polypeptide
DEEEIRTTNPVATEQYGSVSAVLNRGNTQRD

SEQ ID NO: 19677 - protein, 29 aa, Artificial Sequence
  Description of Artificial Sequence: Synthetic peptide
DEEEIRTTNPVATEQYGSVPTNNERDDVR

SEQ ID NO: 19678 - protein, 30 aa, Artificial Sequence
  Description of Artificial Sequence: Synthetic polypeptide
DEEEIRTTNPVATEQYGCVATNLQRLDNDF

SEQ ID NO: 19679 - protein, 28 aa, Artificial Sequence
  Description of Artificial Sequence: Synthetic peptide
DEEEIRTTNPVATEQYGSVSVLLNRDTI

SEQ ID NO: 19680 - protein, 29 aa, Artificial Sequence
  Description of Artificial Sequence: Synthetic peptide
TEEEIRCTNPIATEQYGSVSENMLTRGNR

SEQ ID NO: 19681 - protein, 29 aa, Artificial Sequence
  Description of Artificial Sequence: Synthetic peptide
TEEEIRCTNPIATEQYGSVSENPLMRGNR

SEQ ID NO: 19682 - protein, 30 aa, Artificial Sequence
  Description of Artificial Sequence: Synthetic polypeptide
DEEEIRTTNPVATEQYGSVCTNMQRFGEEA

SEQ ID NO: 19683 - protein, 32 aa, Artificial Sequence
  Description of Artificial Sequence: Synthetic polypeptide
DEEEIRTTNPVATEPYGISVSTQNLQARITNR

SEQ ID NO: 19684 - protein, 31 aa, Artificial Sequence
  Description of Artificial Sequence: Synthetic polypeptide
DEEEIRTTNPVATERYGSTVSTALSQTGGNR

SEQ ID NO: 19685 - protein, 31 aa, Artificial Sequence
  Description of Artificial Sequence: Synthetic polypeptide
DEEVIRTTNPVATEQYGDVSTNLQDNGQNDR

SEQ ID NO: 19686 - protein, 30 aa, Artificial Sequence
  Description of Artificial Sequence: Synthetic polypeptide
DEEEIATTNPVATECYGSVSTNDQGLGDNR

SEQ ID NO: 19687 - protein, 32 aa, Artificial Sequence
  Description of Artificial Sequence: Synthetic polypeptide
DEEEIRTTNPVATERYGSTVSTNALAQTGGNR

SEQ ID NO: 19688 - protein, 31 aa, Artificial Sequence
  Description of Artificial Sequence: Synthetic polypeptide
DEEEIRTTNPVATEQYGCVATNLTRPGENRE

SEQ ID NO: 19689 - protein, 30 aa, Artificial Sequence
  Description of Artificial Sequence: Synthetic polypeptide
DEEEIRTTNPVATEQYGSVCTNMQRGELGY

SEQ ID NO: 19690 - protein, 32 aa, Artificial Sequence
  Description of Artificial Sequence: Synthetic polypeptide
DEEEIRTTNPVATERYGSTVSTNMLSQMGNNR

SEQ ID NO: 19691 - protein, 30 aa, Artificial Sequence
  Description of Artificial Sequence: Synthetic polypeptide
DEEEIRTTNPVATEQYGCVATNLQVGDNEV

SEQ ID NO: 19692 - protein, 30 aa, Artificial Sequence
  Description of Artificial Sequence: Synthetic polypeptide
DEEEIRTTNPVATEQYGSVPTNNDQRGDQQ

SEQ ID NO: 19693 - protein, 29 aa, Artificial Sequence
  Description of Artificial Sequence: Synthetic peptide
DEDEIRTTNPVAYEQYGSVSTNPQDGTER

SEQ ID NO: 19694 - protein, 29 aa, Artificial Sequence
  Description of Artificial Sequence: Synthetic peptide
DEEEIRTTNPVATEQYGCVATNLQRPPDE

SEQ ID NO: 19695 - protein, 30 aa, Artificial Sequence
  Description of Artificial Sequence: Synthetic polypeptide
DEEEIRTTNPVATEQYGSVCTNMQRGSEEI

SEQ ID NO: 19696 - protein, 29 aa, Artificial Sequence
  Description of Artificial Sequence: Synthetic peptide
DEEEIRTTNPVATEQYGCVATNLQRPDDD

SEQ ID NO: 19697 - protein, 29 aa, Artificial Sequence
  Description of Artificial Sequence: Synthetic peptide
DDEEIRTTNPVATEQYGSVSTEIQAGSNQ

SEQ ID NO: 19698 - protein, 32 aa, Artificial Sequence
  Description of Artificial Sequence: Synthetic polypeptide
DDEEIRTTNPVATEQYGSVSTENEQRFGSNRD

SEQ ID NO: 19699 - protein, 30 aa, Artificial Sequence
  Description of Artificial Sequence: Synthetic polypeptide
DDEEIRTTNPVATEQYGSVSTENLEFFGND

SEQ ID NO: 19700 - protein, 31 aa, Artificial Sequence
  Description of Artificial Sequence: Synthetic polypeptide
DDEEIRTTNPVATEQYGSVSTENLQAGSNAY

SEQ ID NO: 19701 - protein, 30 aa, Artificial Sequence
  Description of Artificial Sequence: Synthetic polypeptide
DEEEIATTNPVATECYGSVSTNLQDHDGSR

SEQ ID NO: 19702 - protein, 29 aa, Artificial Sequence
  Description of Artificial Sequence: Synthetic peptide
DEEEIRTTNPVATEQYGSVSVLLNPNNRL

SEQ ID NO: 19703 - protein, 28 aa, Artificial Sequence
  Description of Artificial Sequence: Synthetic peptide
DEEEIATTNPVATECYGSVSMPLQQGNN

SEQ ID NO: 19704 - protein, 31 aa, Artificial Sequence
  Description of Artificial Sequence: Synthetic polypeptide
DEEEIRTTNPVATEQYGSVSVNLQRVVNEQT

SEQ ID NO: 19705 - protein, 31 aa, Artificial Sequence
  Description of Artificial Sequence: Synthetic polypeptide
DEEEIRTTNPVATESYGSTVSCTNLSTGGNR

SEQ ID NO: 19706 - protein, 31 aa, Artificial Sequence
  Description of Artificial Sequence: Synthetic polypeptide
TEEEIRTTNPVATEPYGSVSYTTLSQRGGNR

SEQ ID NO: 19707 - protein, 33 aa, Artificial Sequence
  Description of Artificial Sequence: Synthetic polypeptide
DEEEIRTTNPVATEQYGSVDSTNALQQFGSNTR

SEQ ID NO: 19708 - protein, 33 aa, Artificial Sequence
  Description of Artificial Sequence: Synthetic polypeptide
DEEEIRTTNPVATEPYGISVVSCTNLQRTGNNR

SEQ ID NO: 19709 - protein, 32 aa, Artificial Sequence
  Description of Artificial Sequence: Synthetic polypeptide
DEEEIRTTNPVATEQYGSVDSTNDLQQGEVRD

SEQ ID NO: 19710 - protein, 29 aa, Artificial Sequence
  Description of Artificial Sequence: Synthetic peptide
DEETIRTTNPVATEQYGAVSTNQQFGNLE

SEQ ID NO: 19711 - protein, 29 aa, Artificial Sequence
  Description of Artificial Sequence: Synthetic peptide
DEETIRTTNPVATEQYGAVSTNDQVGVNC

SEQ ID NO: 19712 - protein, 28 aa, Artificial Sequence
  Description of Artificial Sequence: Synthetic peptide
DEEEIRTTNPVATESYGTASTNEQRENF

SEQ ID NO: 19713 - protein, 31 aa, Artificial Sequence
  Description of Artificial Sequence: Synthetic polypeptide
TEEEIRTTNPVATEPYGSVVPSTALSQRGNR

SEQ ID NO: 19714 - protein, 30 aa, Artificial Sequence
  Description of Artificial Sequence: Synthetic polypeptide
DEEEIRTTNPVATEQYGSVDSTNHQGSSNA

SEQ ID NO: 19715 - protein, 31 aa, Artificial Sequence
  Description of Artificial Sequence: Synthetic polypeptide
TEEEIRTTNPVATEPYGSVVSCTNMLQRGSR

SEQ ID NO: 19716 - protein, 29 aa, Artificial Sequence
  Description of Artificial Sequence: Synthetic peptide
DEETIRTTNPVATEQYGCVSTNSEQFGNI

SEQ ID NO: 19717 - protein, 28 aa, Artificial Sequence
  Description of Artificial Sequence: Synthetic peptide
DDEEIRTTNPVGTEQWGWVSTNLQGGER

SEQ ID NO: 19718 - protein, 30 aa, Artificial Sequence
  Description of Artificial Sequence: Synthetic polypeptide
DEETIRTTNPVATEQWGSVMTVNLQVGVNR

SEQ ID NO: 19719 - protein, 30 aa, Artificial Sequence
  Description of Artificial Sequence: Synthetic polypeptide
DEETIRTTNPVATEQWGSVETGNLQLGVNR

SEQ ID NO: 19720 - protein, 29 aa, Artificial Sequence
  Description of Artificial Sequence: Synthetic peptide
DDEEIRTTNPVSTEQWGMVSTNLQRGVRD

SEQ ID NO: 19721 - protein, 31 aa, Artificial Sequence
  Description of Artificial Sequence: Synthetic polypeptide
DEEEIRTTNPVATEQYGSVSVSFNLQRVNES

SEQ ID NO: 19722 - protein, 31 aa, Artificial Sequence
  Description of Artificial Sequence: Synthetic polypeptide
DEEEIRTTNPVATEQYGCQVETNLQRFGSER

SEQ ID NO: 19723 - protein, 29 aa, Artificial Sequence
  Description of Artificial Sequence: Synthetic peptide
DDEEIRYTNPVATEQYGCVVSTNLQNGQR

SEQ ID NO: 19724 - protein, 30 aa, Artificial Sequence
  Description of Artificial Sequence: Synthetic polypeptide
DEEEIRTTNPVATEQYGSVDSTNLIGQSNQ

SEQ ID NO: 19725 - protein, 31 aa, Artificial Sequence
  Description of Artificial Sequence: Synthetic polypeptide
TEEEIRTTNPVATEPYGSVVSTNELSQAGNR

SEQ ID NO: 19726 - protein, 31 aa, Artificial Sequence
  Description of Artificial Sequence: Synthetic polypeptide
TEEEIRTTNPVATEPYGSVVSTNLSQRGNNQ

SEQ ID NO: 19727 - protein, 33 aa, Artificial Sequence
  Description of Artificial Sequence: Synthetic polypeptide
DEEEIRTTNPVATEPYGISVVSTVNLQDRVGNR

SEQ ID NO: 19728 - protein, 29 aa, Artificial Sequence
  Description of Artificial Sequence: Synthetic peptide
DEEEIRTTNPVATESYGTVSSTNEQRNNG

SEQ ID NO: 19729 - protein, 31 aa, Artificial Sequence
  Description of Artificial Sequence: Synthetic polypeptide
DEEEIRTTNPVATEQYGSVSVSFNPLQRVNL

SEQ ID NO: 19730 - protein, 29 aa, Artificial Sequence
  Description of Artificial Sequence: Synthetic peptide
DEETIRTTNPVATEQYGCVSTQNSQQGNT

SEQ ID NO: 19731 - protein, 30 aa, Artificial Sequence
  Description of Artificial Sequence: Synthetic polypeptide
DEEEIRTTNPVATEQYGSVNATNLDRNNNE

SEQ ID NO: 19732 - protein, 30 aa, Artificial Sequence
  Description of Artificial Sequence: Synthetic polypeptide
DEEEIRTTNPVATESYGSVSTNMTQDGNIQ

SEQ ID NO: 19733 - protein, 29 aa, Artificial Sequence
  Description of Artificial Sequence: Synthetic peptide
DEETIRTTNPVATEQYGNVSTNQQFGNEP

SEQ ID NO: 19734 - protein, 31 aa, Artificial Sequence
  Description of Artificial Sequence: Synthetic polypeptide
TEEEIRTTNPVATEPYGSVSTNLSTRTGGNR

SEQ ID NO: 19735 - protein, 31 aa, Artificial Sequence
  Description of Artificial Sequence: Synthetic polypeptide
DEEEIRTTNPVATEQYGSVWDTNILQSGEND

SEQ ID NO: 19736 - protein, 29 aa, Artificial Sequence
  Description of Artificial Sequence: Synthetic peptide
DEECLRTTNPIAYEQYGCVSTNLQERGNR

SEQ ID NO: 19737 - protein, 32 aa, Artificial Sequence
  Description of Artificial Sequence: Synthetic polypeptide
DEEEIRTTNPVATEPYGISVSTVNLQQRSTNR

SEQ ID NO: 19738 - protein, 31 aa, Artificial Sequence
  Description of Artificial Sequence: Synthetic polypeptide
DEEEIRTTNPVATEQYGSVSNTNDNQNGSER

SEQ ID NO: 19739 - protein, 30 aa, Artificial Sequence
  Description of Artificial Sequence: Synthetic polypeptide
DEEEIRTTNPVATEQYGSVSVSFNLQEMNA

SEQ ID NO: 19740 - protein, 32 aa, Artificial Sequence
  Description of Artificial Sequence: Synthetic polypeptide
DEEEIRTTNPVATEQYGSVVYPTNLQRNNERN

SEQ ID NO: 19741 - protein, 32 aa, Artificial Sequence
  Description of Artificial Sequence: Synthetic polypeptide
DEEEIRTTNPVATEQYGSVDSTGNLQGGSNND

SEQ ID NO: 19742 - protein, 32 aa, Artificial Sequence
  Description of Artificial Sequence: Synthetic polypeptide
TEEEIRTTNPVATEPYGSVSYTNLSQRAGGNR

SEQ ID NO: 19743 - protein, 31 aa, Artificial Sequence
  Description of Artificial Sequence: Synthetic polypeptide
DEEEIRTTNPVATEQYGSVSVSFNLQERVNQ

SEQ ID NO: 19744 - protein, 30 aa, Artificial Sequence
  Description of Artificial Sequence: Synthetic polypeptide
DEEEIRTTNPVATEQYGSVDSTGSQTGNEQ

SEQ ID NO: 19745 - protein, 32 aa, Artificial Sequence
  Description of Artificial Sequence: Synthetic polypeptide
DEEEIRTTNPVATEQYGSVSPTVNLQRGVVSQ

SEQ ID NO: 19746 - protein, 31 aa, Artificial Sequence
  Description of Artificial Sequence: Synthetic polypeptide
DEEEIRTTNPVATEQYGCQVSTGNLARGSNQ

SEQ ID NO: 19747 - protein, 29 aa, Artificial Sequence
  Description of Artificial Sequence: Synthetic peptide
DEEEIATTNPVATEGYGSVATNLQQGNDQ

SEQ ID NO: 19748 - protein, 30 aa, Artificial Sequence
  Description of Artificial Sequence: Synthetic polypeptide
DEETIRTTNPVATEQYGDSVSINGQRGDNN

SEQ ID NO: 19749 - protein, 32 aa, Artificial Sequence
  Description of Artificial Sequence: Synthetic polypeptide
TEEEIRTTNPVATEPYGSVSTSNLSQRGGNYR

SEQ ID NO: 19750 - protein, 31 aa, Artificial Sequence
  Description of Artificial Sequence: Synthetic polypeptide
DEEEIRTTNPVATEQYGSVSVSFNLQRDINI

SEQ ID NO: 19751 - protein, 31 aa, Artificial Sequence
  Description of Artificial Sequence: Synthetic polypeptide
DEEEIRTTNPVATEQYGSVDSTMDGQERGLR

SEQ ID NO: 19752 - protein, 30 aa, Artificial Sequence
  Description of Artificial Sequence: Synthetic polypeptide
DEEEIATTNPVATEGYGSVATNLQQGNERE

SEQ ID NO: 19753 - protein, 32 aa, Artificial Sequence
  Description of Artificial Sequence: Synthetic polypeptide
DEEEIRTTNPVATEQYGSVDSTMNLQGIGSND

SEQ ID NO: 19754 - protein, 31 aa, Artificial Sequence
  Description of Artificial Sequence: Synthetic polypeptide
DEEEIRTTNPVATEQYGSVSMTPPLQEGVTR

SEQ ID NO: 19755 - protein, 31 aa, Artificial Sequence
  Description of Artificial Sequence: Synthetic polypeptide
TEEEIRTTNPVATEPYGSVVSTNMLQTGNNR

SEQ ID NO: 19756 - protein, 30 aa, Artificial Sequence
  Description of Artificial Sequence: Synthetic polypeptide
DEEEIATTNPVATEGYGSVSTNLQQGNDTT

SEQ ID NO: 19757 - protein, 29 aa, Artificial Sequence
  Description of Artificial Sequence: Synthetic peptide
DEEEIRTTNPVATESYGTVTSTNEQRENF

SEQ ID NO: 19758 - protein, 29 aa, Artificial Sequence
  Description of Artificial Sequence: Synthetic peptide
DEECLRTTNPIAYEQYGEVSTNLQRGNER

SEQ ID NO: 19759 - protein, 30 aa, Artificial Sequence
  Description of Artificial Sequence: Synthetic polypeptide
DEEEIRTTNPVATEQYGSVDSTTGQTGNEQ

SEQ ID NO: 19760 - protein, 32 aa, Artificial Sequence
  Description of Artificial Sequence: Synthetic polypeptide
DEEEIRTTNPVATEQYGSVSATENLQQGNVME

SEQ ID NO: 19761 - protein, 31 aa, Artificial Sequence
  Description of Artificial Sequence: Synthetic polypeptide
DEEEIRTTNPVATEQYGSVVTTNNLQRINDG

SEQ ID NO: 19762 - protein, 29 aa, Artificial Sequence
  Description of Artificial Sequence: Synthetic peptide
DEETIRTTNPVACEQYGQVSTINNQRGND

SEQ ID NO: 19763 - protein, 31 aa, Artificial Sequence
  Description of Artificial Sequence: Synthetic polypeptide
DEEEIATTNPVATEHYGSVSTNLQGQGNENR

SEQ ID NO: 19764 - protein, 29 aa, Artificial Sequence
  Description of Artificial Sequence: Synthetic peptide
DEETIRTTNPVACEQYGNVSTSNNQRGNN

SEQ ID NO: 19765 - protein, 30 aa, Artificial Sequence
  Description of Artificial Sequence: Synthetic polypeptide
DEEEIRTTNPVATETYGSVCFTNDERGGNR

SEQ ID NO: 19766 - protein, 31 aa, Artificial Sequence
  Description of Artificial Sequence: Synthetic polypeptide
DEEEIRTTNPVATEQYGSVSVSMNLQERTNI

SEQ ID NO: 19767 - protein, 30 aa, Artificial Sequence
  Description of Artificial Sequence: Synthetic polypeptide
DEEEIRTTNPVATEQYGSVSVSMNLQGNNI

SEQ ID NO: 19768 - protein, 31 aa, Artificial Sequence
  Description of Artificial Sequence: Synthetic polypeptide
DEEEIRTTNPVATEQYGSVVTVNAVAQTGNR

SEQ ID NO: 19769 - protein, 29 aa, Artificial Sequence
  Description of Artificial Sequence: Synthetic peptide
DEETIRGTNPVATEQYGSVSVNFQRGING

SEQ ID NO: 19770 - protein, 30 aa, Artificial Sequence
  Description of Artificial Sequence: Synthetic polypeptide
DEETIRGTNPVATEQYGSVSITNGQGRGNG

SEQ ID NO: 19771 - protein, 29 aa, Artificial Sequence
  Description of Artificial Sequence: Synthetic peptide
DEETIRGTNPVATEQYGSVSINGQREGNG

SEQ ID NO: 19772 - protein, 30 aa, Artificial Sequence
  Description of Artificial Sequence: Synthetic polypeptide
AEEEIRTTNPVATEAYGSVSTNLQEQGNIT

SEQ ID NO: 19773 - protein, 29 aa, Artificial Sequence
  Description of Artificial Sequence: Synthetic peptide
DEETIRGTNPVATEQYGSVSINGQDRGNE

SEQ ID NO: 19774 - protein, 31 aa, Artificial Sequence
  Description of Artificial Sequence: Synthetic polypeptide
DEEEIRTTNPVATEQYGSVSVSMNLQRVNVI

SEQ ID NO: 19775 - protein, 30 aa, Artificial Sequence
  Description of Artificial Sequence: Synthetic polypeptide
DEEEIRTTNPVATEQYGSVSATDQDQQGER

SEQ ID NO: 19776 - protein, 29 aa, Artificial Sequence
  Description of Artificial Sequence: Synthetic peptide
DEETIRGTNPVATEQYGSVSIANGQRGNL

SEQ ID NO: 19777 - protein, 28 aa, Artificial Sequence
  Description of Artificial Sequence: Synthetic peptide
AEEEIRTTNPVATEAYGSVSTMLNMGIR

SEQ ID NO: 19778 - protein, 32 aa, Artificial Sequence
  Description of Artificial Sequence: Synthetic polypeptide
DEEEIRTTNPVATEQYGSVSVSNLQRGFNNQT

SEQ ID NO: 19779 - protein, 30 aa, Artificial Sequence
  Description of Artificial Sequence: Synthetic polypeptide
DEEEIRTTNPVATEQYGSVSVSNNLQQVNI

SEQ ID NO: 19780 - protein, 28 aa, Artificial Sequence
  Description of Artificial Sequence: Synthetic peptide
DEETIRGTNPVATEQYGSVSSNEQRGSE

SEQ ID NO: 19781 - protein, 30 aa, Artificial Sequence
  Description of Artificial Sequence: Synthetic polypeptide
DEETIRTTNPVACEQYGVVSTINNLQRGNN

SEQ ID NO: 19782 - protein, 31 aa, Artificial Sequence
  Description of Artificial Sequence: Synthetic polypeptide
DEEEIRTTNPVATEQYGSVDSTPLPLDRGNW

SEQ ID NO: 19783 - protein, 29 aa, Artificial Sequence
  Description of Artificial Sequence: Synthetic peptide
DEETIRTTNPVATDIYGQVTTNLQRGNNR

SEQ ID NO: 19784 - protein, 28 aa, Artificial Sequence
  Description of Artificial Sequence: Synthetic peptide
DEEEIRTTNPVATESYGVSSTNEQRVNF

SEQ ID NO: 19785 - protein, 30 aa, Artificial Sequence
  Description of Artificial Sequence: Synthetic polypeptide
DEEEIRTTNPVATEQYGSVSVSGNDQRVNM

SEQ ID NO: 19786 - protein, 31 aa, Artificial Sequence
  Description of Artificial Sequence: Synthetic polypeptide
DEEEIRTTNPVATEQYGSVSVSGNELQRVNS

SEQ ID NO: 19787 - protein, 32 aa, Artificial Sequence
  Description of Artificial Sequence: Synthetic polypeptide
DEEEIRTTNPVATEQYGCMVSTNLQRMGSNVE

SEQ ID NO: 19788 - protein, 29 aa, Artificial Sequence
  Description of Artificial Sequence: Synthetic peptide
DEDEIRTTNPVAYEQYGNVSTNPNQNGNR

SEQ ID NO: 19789 - protein, 31 aa, Artificial Sequence
  Description of Artificial Sequence: Synthetic polypeptide
DEEEIRTTNPVATEQYGCMVSTNLQRFGSEQ

SEQ ID NO: 19790 - protein, 29 aa, Artificial Sequence
  Description of Artificial Sequence: Synthetic peptide
DEEEIRTTNPVATEQYGSVVVNGQRGTPL

SEQ ID NO: 19791 - protein, 30 aa, Artificial Sequence
  Description of Artificial Sequence: Synthetic polypeptide
DEETIRTTNPVATEQWGSVATNNLQQGDNR

SEQ ID NO: 19792 - protein, 30 aa, Artificial Sequence
  Description of Artificial Sequence: Synthetic polypeptide
DEEEIRTTNPVATEQYGSVSVSGNLQQSNI

SEQ ID NO: 19793 - protein, 30 aa, Artificial Sequence
  Description of Artificial Sequence: Synthetic polypeptide
DEETIRTTNPVATEQWGSVATGNLQNGVNR

SEQ ID NO: 19794 - protein, 30 aa, Artificial Sequence
  Description of Artificial Sequence: Synthetic polypeptide
DEAEIATTNPVATEPYGSVSATNLDQQGNR

SEQ ID NO: 19795 - protein, 30 aa, Artificial Sequence
  Description of Artificial Sequence: Synthetic polypeptide
TEEEIRTTNPVATEQWGSTVSTNLSTTGNR

SEQ ID NO: 19796 - protein, 28 aa, Artificial Sequence
  Description of Artificial Sequence: Synthetic peptide
DEAEIATTNPVATEPYGSVSANLERGNY

SEQ ID NO: 19797 - protein, 31 aa, Artificial Sequence
  Description of Artificial Sequence: Synthetic polypeptide
TEEEIRTTNPVATEQWGSVATNELQRGGNNR

SEQ ID NO: 19798 - protein, 30 aa, Artificial Sequence
  Description of Artificial Sequence: Synthetic polypeptide
DEEEIATTNPVATEHYGSVSTNLNGEMGNR

SEQ ID NO: 19799 - protein, 30 aa, Artificial Sequence
  Description of Artificial Sequence: Synthetic polypeptide
DEEEIATTNPVATEHYGSVSTNLQAGGNEH

SEQ ID NO: 19800 - protein, 30 aa, Artificial Sequence
  Description of Artificial Sequence: Synthetic polypeptide
DEEEIRTTNPVATEQYGSVDSTNLSTSGEF

SEQ ID NO: 19801 - protein, 30 aa, Artificial Sequence
  Description of Artificial Sequence: Synthetic polypeptide
DEEEIATTNPVATEHYGSVSTNLQDGNDDY

SEQ ID NO: 19802 - protein, 31 aa, Artificial Sequence
  Description of Artificial Sequence: Synthetic polypeptide
DEEEIRTTNPVATEQYGSVSVSGNLQRVNDI

SEQ ID NO: 19803 - protein, 31 aa, Artificial Sequence
  Description of Artificial Sequence: Synthetic polypeptide
DEEEIRTTNPVATEQYGSVDSTNLVRSLERD

SEQ ID NO: 19804 - protein, 31 aa, Artificial Sequence
  Description of Artificial Sequence: Synthetic polypeptide
TEEEIRTTNPVATEQWGSVCATNELQRGGNR

SEQ ID NO: 19805 - protein, 29 aa, Artificial Sequence
  Description of Artificial Sequence: Synthetic peptide
DEEEIATTNPVATEHYGSVSTNLQDNQND

SEQ ID NO: 19806 - protein, 30 aa, Artificial Sequence
  Description of Artificial Sequence: Synthetic polypeptide
DEEEIRTTNPVATEQYGSVDSTNTQNGQVQ

SEQ ID NO: 19807 - protein, 31 aa, Artificial Sequence
  Description of Artificial Sequence: Synthetic polypeptide
TEEEIRTTNPVATEPYGSVSTNLSQRGGSNM

SEQ ID NO: 19808 - protein, 32 aa, Artificial Sequence
  Description of Artificial Sequence: Synthetic polypeptide
YEEEIRTTNPVATEQYGSVNTSNLPQRGENTR

SEQ ID NO: 19809 - protein, 33 aa, Artificial Sequence
  Description of Artificial Sequence: Synthetic polypeptide
DEEEIRTTNPVATEPYGISVSTVNLQERIGNNR

SEQ ID NO: 19810 - protein, 31 aa, Artificial Sequence
  Description of Artificial Sequence: Synthetic polypeptide
DEETIRTTNPVATEQYGQSVSINNLQRGDND

SEQ ID NO: 19811 - protein, 32 aa, Artificial Sequence
  Description of Artificial Sequence: Synthetic polypeptide
DEETIRTTNPVATEQYGSVSVSTVNLQQGDNR

SEQ ID NO: 19812 - protein, 31 aa, Artificial Sequence
  Description of Artificial Sequence: Synthetic polypeptide
DEETIRTTNPVATEQYGSVSVSNNLQNGDNR

SEQ ID NO: 19813 - protein, 32 aa, Artificial Sequence
  Description of Artificial Sequence: Synthetic polypeptide
DEEEIRTTNPVATEQYGCTPSCTNEMLQRGNR

SEQ ID NO: 19814 - protein, 31 aa, Artificial Sequence
  Description of Artificial Sequence: Synthetic polypeptide
DEEEIRTTNPVATEQYGSVDNTNNLDRGNID

SEQ ID NO: 19815 - protein, 32 aa, Artificial Sequence
  Description of Artificial Sequence: Synthetic polypeptide
DEEEIRTTNPVATESYGSVPSTHLSQRGGNNR

SEQ ID NO: 19816 - protein, 30 aa, Artificial Sequence
  Description of Artificial Sequence: Synthetic polypeptide
DEEEIRTTNPVATEQYGSVSVNPNLQHVNQ

SEQ ID NO: 19817 - protein, 31 aa, Artificial Sequence
  Description of Artificial Sequence: Synthetic polypeptide
DEEEIRTTNPVATEQYGCTISTNELQRFGNL

SEQ ID NO: 19818 - protein, 30 aa, Artificial Sequence
  Description of Artificial Sequence: Synthetic polypeptide
DEEEIRTTNPVATEQYGCTISTNELQHNNR

SEQ ID NO: 19819 - protein, 29 aa, Artificial Sequence
  Description of Artificial Sequence: Synthetic peptide
DEEEIRTTNPVATEQYGSVDPNDQGGDNS

SEQ ID NO: 19820 - protein, 31 aa, Artificial Sequence
  Description of Artificial Sequence: Synthetic polypeptide
DEEEIRTTNPVATEQYGCTISTNELQAGSNR

SEQ ID NO: 19821 - protein, 32 aa, Artificial Sequence
  Description of Artificial Sequence: Synthetic polypeptide
DEEEIRTTNPVATESYGSVPSCTPLSQRGGNR

SEQ ID NO: 19822 - protein, 31 aa, Artificial Sequence
  Description of Artificial Sequence: Synthetic polypeptide
DEEEIRTTNPVATEQYGSVSATNLQQREQHQ

SEQ ID NO: 19823 - protein, 32 aa, Artificial Sequence
  Description of Artificial Sequence: Synthetic polypeptide
DEEEIRTTNPVATEQYGSVSATNLQGKGENDG

SEQ ID NO: 19824 - protein, 32 aa, Artificial Sequence
  Description of Artificial Sequence: Synthetic polypeptide
DEEEIRTTNPVATEQYGSVSPTWSLVQRSQNR

SEQ ID NO: 19825 - protein, 32 aa, Artificial Sequence
  Description of Artificial Sequence: Synthetic polypeptide
DEEEIRTTNPVATEQYGSVDSETDDQRDGENR

SEQ ID NO: 19826 - protein, 30 aa, Artificial Sequence
  Description of Artificial Sequence: Synthetic polypeptide
DEEEIRTTNPVATESYGSVSTDNLHGGNNQ

SEQ ID NO: 19827 - protein, 31 aa, Artificial Sequence
  Description of Artificial Sequence: Synthetic polypeptide
DEEEIRTTNPVATEQYGSVDSIGNLERLVNR

SEQ ID NO: 19828 - protein, 29 aa, Artificial Sequence
  Description of Artificial Sequence: Synthetic peptide
DEEEIRTTNPVATEQYGSVSVPLQRIDIF

SEQ ID NO: 19829 - protein, 29 aa, Artificial Sequence
  Description of Artificial Sequence: Synthetic peptide
DDEEIRTTNPVATEQYGSVYTDLQRGEDM

SEQ ID NO: 19830 - protein, 29 aa, Artificial Sequence
  Description of Artificial Sequence: Synthetic peptide
DDEEIRTTNPVATEQYGSVYTPNLQRNEG

SEQ ID NO: 19831 - protein, 31 aa, Artificial Sequence
  Description of Artificial Sequence: Synthetic polypeptide
DEEEIRTTNPVATEQYGSVDSNTNLQNGEQI

SEQ ID NO: 19832 - protein, 30 aa, Artificial Sequence
  Description of Artificial Sequence: Synthetic polypeptide
DDEEIRTTNPVATEQYGTVSTNLQNGSNQA

SEQ ID NO: 19833 - protein, 33 aa, Artificial Sequence
  Description of Artificial Sequence: Synthetic polypeptide
DEEEIRTTNPVATESYGSVSMTNMLSQRNLGNR

SEQ ID NO: 19834 - protein, 30 aa, Artificial Sequence
  Description of Artificial Sequence: Synthetic polypeptide
TEEEIRTTNPVATEHWGSVSCTNLARGNRD

SEQ ID NO: 19835 - protein, 32 aa, Artificial Sequence
  Description of Artificial Sequence: Synthetic polypeptide
DEEEIRTTNPVATEQYGCTPSTNGLSQRGGNR

SEQ ID NO: 19836 - protein, 31 aa, Artificial Sequence
  Description of Artificial Sequence: Synthetic polypeptide
DEEEIRTTNPVATEQYGSVSPTYLQEQGEQR

SEQ ID NO: 19837 - protein, 31 aa, Artificial Sequence
  Description of Artificial Sequence: Synthetic polypeptide
DEEEIRTTNPVATEQYGSVSNTNDQGGNNGN

SEQ ID NO: 19838 - protein, 31 aa, Artificial Sequence
  Description of Artificial Sequence: Synthetic polypeptide
TEEEIRTTNPVATEAYGSVVSCTNLSQPGNR

SEQ ID NO: 19839 - protein, 31 aa, Artificial Sequence
  Description of Artificial Sequence: Synthetic polypeptide
DEEEIRTTNPVATEQYGSVDCTMNLCRGNDC

SEQ ID NO: 19840 - protein, 30 aa, Artificial Sequence
  Description of Artificial Sequence: Synthetic polypeptide
DEETIRTTNPVATEQYGTVVSVNLQSGDNR

SEQ ID NO: 19841 - protein, 30 aa, Artificial Sequence
  Description of Artificial Sequence: Synthetic polypeptide
DEETIRTTNPVATEQYGTVVSTTNLQQGNQ

SEQ ID NO: 19842 - protein, 30 aa, Artificial Sequence
  Description of Artificial Sequence: Synthetic polypeptide
DEEEIRTTNPVATEQYGSVSVNLQSQNADQ

SEQ ID NO: 19843 - protein, 29 aa, Artificial Sequence
  Description of Artificial Sequence: Synthetic peptide
DEAEIATTNPVATEQWGSVSTNLQGDGND

SEQ ID NO: 19844 - protein, 31 aa, Artificial Sequence
  Description of Artificial Sequence: Synthetic polypeptide
DEEEIRTTNPVATEQYGSVSVNLQTPGNADQ

SEQ ID NO: 19845 - protein, 30 aa, Artificial Sequence
  Description of Artificial Sequence: Synthetic polypeptide
DEETIRTTNPVATEQYGTVVSTNLQIGGND

SEQ ID NO: 19846 - protein, 30 aa, Artificial Sequence
  Description of Artificial Sequence: Synthetic polypeptide
DEETIRTTNPVATEQYGTVVSTNLQEIGNN

SEQ ID NO: 19847 - protein, 29 aa, Artificial Sequence
  Description of Artificial Sequence: Synthetic peptide
DEEEIRTTNPVATESYGSVCSTEHQNGNA

SEQ ID NO: 19848 - protein, 31 aa, Artificial Sequence
  Description of Artificial Sequence: Synthetic polypeptide
DEEEIRTTNPVATEQYGSVSPTYNLQGNEFT

SEQ ID NO: 19849 - protein, 32 aa, Artificial Sequence
  Description of Artificial Sequence: Synthetic polypeptide
TEEEIRTTNPVATEAYGSVVSYTNELSQRGNR

SEQ ID NO: 19850 - protein, 30 aa, Artificial Sequence
  Description of Artificial Sequence: Synthetic polypeptide
DEEEIRTTNPVATEQYGSVSVNNAQRSLDR

SEQ ID NO: 19851 - protein, 31 aa, Artificial Sequence
  Description of Artificial Sequence: Synthetic polypeptide
DEEEIRTTNPVATEQYGCTVSTNMLSQHVNR

SEQ ID NO: 19852 - protein, 32 aa, Artificial Sequence
  Description of Artificial Sequence: Synthetic polypeptide
DEEEIRTTNPVATEQYGCTVSTGNLSQRGNNS

SEQ ID NO: 19853 - protein, 30 aa, Artificial Sequence
  Description of Artificial Sequence: Synthetic polypeptide
DEEEIRTTNPVATEQYGSVDETGMQRGNLI

SEQ ID NO: 19854 - protein, 29 aa, Artificial Sequence
  Description of Artificial Sequence: Synthetic peptide
DEETIRTTNPVATEQYGTVSTPNQQFGNE

SEQ ID NO: 19855 - protein, 30 aa, Artificial Sequence
  Description of Artificial Sequence: Synthetic polypeptide
DEETIRTTNPVATEQYGTVSSTNLQIGNTE

SEQ ID NO: 19856 - protein, 31 aa, Artificial Sequence
  Description of Artificial Sequence: Synthetic polypeptide
DEEEIRTTNPVATEQYGSVSMTNGIQIDGDR

SEQ ID NO: 19857 - protein, 32 aa, Artificial Sequence
  Description of Artificial Sequence: Synthetic polypeptide
DEEEIRTTNPVATEQYGCTSTTENLSQRIGNR

SEQ ID NO: 19858 - protein, 28 aa, Artificial Sequence
  Description of Artificial Sequence: Synthetic peptide
TEEEIRTTNPVATEEYGCISINLQRGNP

SEQ ID NO: 19859 - protein, 30 aa, Artificial Sequence
  Description of Artificial Sequence: Synthetic polypeptide
DEETIRTTNPVATEQYGSVSWPLQRFGSNL

SEQ ID NO: 19860 - protein, 32 aa, Artificial Sequence
  Description of Artificial Sequence: Synthetic polypeptide
DEEEIRTTNPVATEQYGCTCSNTNELQRGGNR

SEQ ID NO: 19861 - protein, 31 aa, Artificial Sequence
  Description of Artificial Sequence: Synthetic polypeptide
DEEEIRTTNPVATEQYGSVDCEMNLQAGNDR

SEQ ID NO: 19862 - protein, 32 aa, Artificial Sequence
  Description of Artificial Sequence: Synthetic polypeptide
DEEEIRTTNPVATEQYGSVDSNTNLQRGSDQS

SEQ ID NO: 19863 - protein, 31 aa, Artificial Sequence
  Description of Artificial Sequence: Synthetic polypeptide
TEEEIRTTNPVATEHYGSVPSTTLSQRGGNR

SEQ ID NO: 19864 - protein, 32 aa, Artificial Sequence
  Description of Artificial Sequence: Synthetic polypeptide
YEEEIRTTNPVATEQYGSVSTSNLNQRGENYV

SEQ ID NO: 19865 - protein, 32 aa, Artificial Sequence
  Description of Artificial Sequence: Synthetic polypeptide
DEEEIRTTNPVATEQYGSVSMTNLQERGSDFQ

SEQ ID NO: 19866 - protein, 31 aa, Artificial Sequence
  Description of Artificial Sequence: Synthetic polypeptide
DEEEIRTTNPVATEQYGSVDSTAPQRGSNAS

SEQ ID NO: 19867 - protein, 31 aa, Artificial Sequence
  Description of Artificial Sequence: Synthetic polypeptide
DEEEIRTTNPVATEQYGSVSATNEGGQRGDF

SEQ ID NO: 19868 - protein, 31 aa, Artificial Sequence
  Description of Artificial Sequence: Synthetic polypeptide
TEEEIRTTNPVATEPYGSVSCTNLQRGGNNH

SEQ ID NO: 19869 - protein, 31 aa, Artificial Sequence
  Description of Artificial Sequence: Synthetic polypeptide
DEEEIRTTNPVATEQYGSVDSTDLEEDGNER

SEQ ID NO: 19870 - protein, 32 aa, Artificial Sequence
  Description of Artificial Sequence: Synthetic polypeptide
DEEEIRTTNPVATEQYGSVSMTNLQNGGSIRS

SEQ ID NO: 19871 - protein, 32 aa, Artificial Sequence
  Description of Artificial Sequence: Synthetic polypeptide
DEEEIRTTNPVATEQYGSVDSTELQNGSNTRQ

SEQ ID NO: 19872 - protein, 29 aa, Artificial Sequence
  Description of Artificial Sequence: Synthetic peptide
DEEEIRTTNPVATEQYGSVNCNLQDNEIR

SEQ ID NO: 19873 - protein, 32 aa, Artificial Sequence
  Description of Artificial Sequence: Synthetic polypeptide
DEEEIRTTNPVATEQYGSVDSTELQRFGSNAA

SEQ ID NO: 19874 - protein, 31 aa, Artificial Sequence
  Description of Artificial Sequence: Synthetic polypeptide
DEEEIRTTNPVATEQYGSVDSTALQRNSNFA

SEQ ID NO: 19875 - protein, 29 aa, Artificial Sequence
  Description of Artificial Sequence: Synthetic peptide
DEEEIRTTNPVATEQYGSVWENMLDNGER

SEQ ID NO: 19876 - protein, 30 aa, Artificial Sequence
  Description of Artificial Sequence: Synthetic polypeptide
DEEEIRTTNPVATEQYGSVSMTNLQNPVEP

SEQ ID NO: 19877 - protein, 30 aa, Artificial Sequence
  Description of Artificial Sequence: Synthetic polypeptide
DEEEIRTTNPVATEQYGSVSATNDGVRGEQ

SEQ ID NO: 19878 - protein, 29 aa, Artificial Sequence
  Description of Artificial Sequence: Synthetic peptide
DEEEIRTTNPVATEQYGCSSTEPQRGSER

SEQ ID NO: 19879 - protein, 32 aa, Artificial Sequence
  Description of Artificial Sequence: Synthetic polypeptide
DEEEIRTTNPVATEQYGCSSMTENLNQRIGNR

SEQ ID NO: 19880 - protein, 29 aa, Artificial Sequence
  Description of Artificial Sequence: Synthetic peptide
DEDEIRTTNPVAYEQYGSVSSNMQGGDNR

SEQ ID NO: 19881 - protein, 32 aa, Artificial Sequence
  Description of Artificial Sequence: Synthetic polypeptide
DEEEIRTTNPVATEPYGISVSTVNLQDRQDNR

SEQ ID NO: 19882 - protein, 32 aa, Artificial Sequence
  Description of Artificial Sequence: Synthetic polypeptide
DEEEIRTTNPVATEQYGSVSMTNLQRGELELN

SEQ ID NO: 19883 - protein, 32 aa, Artificial Sequence
  Description of Artificial Sequence: Synthetic polypeptide
DEEEIRTTNPVATEQYGSVDSTENHQRFGNIA

SEQ ID NO: 19884 - protein, 32 aa, Artificial Sequence
  Description of Artificial Sequence: Synthetic polypeptide
DEEEIRTTNPVATEQYGCQVSTNLQRSGNEDS

SEQ ID NO: 19885 - protein, 31 aa, Artificial Sequence
  Description of Artificial Sequence: Synthetic polypeptide
TEEEIRTTNPVATEPYGSVSTNLQTPGGNNR

SEQ ID NO: 19886 - protein, 29 aa, Artificial Sequence
  Description of Artificial Sequence: Synthetic peptide
DEDEIRTTNPVAYEQYGSVSTDDLQNGNA

SEQ ID NO: 19887 - protein, 31 aa, Artificial Sequence
  Description of Artificial Sequence: Synthetic polypeptide
DEEEIRTTNPVATEQYGSVSMTNLQASGSDQ

SEQ ID NO: 19888 - protein, 30 aa, Artificial Sequence
  Description of Artificial Sequence: Synthetic polypeptide
DEEEIRTTNPVATEQYGSVSPTVVQIGERD

SEQ ID NO: 19889 - protein, 31 aa, Artificial Sequence
  Description of Artificial Sequence: Synthetic polypeptide
DEEEIRTTNPVATEQYGSVSVSENLSQRVNE

SEQ ID NO: 19890 - protein, 29 aa, Artificial Sequence
  Description of Artificial Sequence: Synthetic peptide
DEETIRTTNPVATEQYGSVSTSLELGGNT

SEQ ID NO: 19891 - protein, 28 aa, Artificial Sequence
  Description of Artificial Sequence: Synthetic peptide
TEEEIRTTNPVATELYGQISYNEQRGNR

SEQ ID NO: 19892 - protein, 29 aa, Artificial Sequence
  Description of Artificial Sequence: Synthetic peptide
DEETIRTTNPVATEQYGSVSTPGEDRGNT

SEQ ID NO: 19893 - protein, 28 aa, Artificial Sequence
  Description of Artificial Sequence: Synthetic peptide
DEECCRTTNPIAYEQYGTVSTNLQRGNQ

SEQ ID NO: 19894 - protein, 30 aa, Artificial Sequence
  Description of Artificial Sequence: Synthetic polypeptide
TEEEIRTTNPVATEPWGSVSTNLSTRGNNR

SEQ ID NO: 19895 - protein, 32 aa, Artificial Sequence
  Description of Artificial Sequence: Synthetic polypeptide
DEEEIRTTNPVATESYGSVSTNDLQNFGSNRI

SEQ ID NO: 19896 - protein, 31 aa, Artificial Sequence
  Description of Artificial Sequence: Synthetic polypeptide
TEEEIRTTNPVATEPWGSVSTNSLQRGGNYR

SEQ ID NO: 19897 - protein, 31 aa, Artificial Sequence
  Description of Artificial Sequence: Synthetic polypeptide
DEEEIRTTNPVATEQYGSVSPTWLQRQDNIE

SEQ ID NO: 19898 - protein, 30 aa, Artificial Sequence
  Description of Artificial Sequence: Synthetic polypeptide
DEEEIRTTNPVATEQYGSVSPTWLPRDTRD

SEQ ID NO: 19899 - protein, 31 aa, Artificial Sequence
  Description of Artificial Sequence: Synthetic polypeptide
DEEEIRTTNPVATESYGSVSTNGGQGGNGNR

SEQ ID NO: 19900 - protein, 30 aa, Artificial Sequence
  Description of Artificial Sequence: Synthetic polypeptide
TEEEIRTTNPVATEPYGSTVSTNLSHRGNE

SEQ ID NO: 19901 - protein, 28 aa, Artificial Sequence
  Description of Artificial Sequence: Synthetic peptide
DEECCRTTNPIAYEQYGEVSTNLQRHNR

SEQ ID NO: 19902 - protein, 31 aa, Artificial Sequence
  Description of Artificial Sequence: Synthetic polypeptide
DEETIRTTNPVATEQYGSVSTNLQDQNGQNS

SEQ ID NO: 19903 - protein, 31 aa, Artificial Sequence
  Description of Artificial Sequence: Synthetic polypeptide
DEETIRTTNPVATEQYGSVSTNLQDNTGQND

SEQ ID NO: 19904 - protein, 28 aa, Artificial Sequence
  Description of Artificial Sequence: Synthetic peptide
YEEEIRTTNPVATEQYGVVSDNLMAGNA

SEQ ID NO: 19905 - protein, 28 aa, Artificial Sequence
  Description of Artificial Sequence: Synthetic peptide
DEDEIRTTNPVAYEQYGSVSTNDQHGMQ

SEQ ID NO: 19906 - protein, 32 aa, Artificial Sequence
  Description of Artificial Sequence: Synthetic polypeptide
DDEEIRTTNPVATEQYGVVSTNNLQRFGSNRD

SEQ ID NO: 19907 - protein, 30 aa, Artificial Sequence
  Description of Artificial Sequence: Synthetic polypeptide
DEEEIRTTNPVATEQYGSVSVSDNEQRVNI

SEQ ID NO: 19908 - protein, 30 aa, Artificial Sequence
  Description of Artificial Sequence: Synthetic polypeptide
DEEEIRTTNPVATEQYGSVSVSENLQHDNI

SEQ ID NO: 19909 - protein, 30 aa, Artificial Sequence
  Description of Artificial Sequence: Synthetic polypeptide
DEETIRTTNPVATEQYGSVSTNLQDNIQNA

SEQ ID NO: 19910 - protein, 30 aa, Artificial Sequence
  Description of Artificial Sequence: Synthetic polypeptide
TEEEIRTTNPVATEPYGSVPFTNLTREGNR

SEQ ID NO: 19911 - protein, 30 aa, Artificial Sequence
  Description of Artificial Sequence: Synthetic polypeptide
DEETIRTTNPVATEQYGSVSTNLQDNGQTN

SEQ ID NO: 19912 - protein, 31 aa, Artificial Sequence
  Description of Artificial Sequence: Synthetic polypeptide
DEDEIRTTNPVAYEQYGSVSTNALQRTVNNR

SEQ ID NO: 19913 - protein, 31 aa, Artificial Sequence
  Description of Artificial Sequence: Synthetic polypeptide
DEEEIRTTNPVATEQYGCSYSLPNDLQRDNR

SEQ ID NO: 19914 - protein, 31 aa, Artificial Sequence
  Description of Artificial Sequence: Synthetic polypeptide
DEEEIATTNPVATEHYGSVSTNLQHDGGNGR

SEQ ID NO: 19915 - protein, 32 aa, Artificial Sequence
  Description of Artificial Sequence: Synthetic polypeptide
DEEEIRTTNPVATEQYGSVWSLPNMLQQGDNR

SEQ ID NO: 19916 - protein, 31 aa, Artificial Sequence
  Description of Artificial Sequence: Synthetic polypeptide
TEEEIKTTNPVATEQYGSVPSTNMLQDGNNR

SEQ ID NO: 19917 - protein, 31 aa, Artificial Sequence
  Description of Artificial Sequence: Synthetic polypeptide
DEEEIRTTNPVATEQYGSVCTLLQQGVNQRI

SEQ ID NO: 19918 - protein, 30 aa, Artificial Sequence
  Description of Artificial Sequence: Synthetic polypeptide
AEEEIRTTNPVATEEYGSVSTVNLQNGENN

SEQ ID NO: 19919 - protein, 30 aa, Artificial Sequence
  Description of Artificial Sequence: Synthetic polypeptide
YEEEIRTVNPVATEQYGSVSCSNLQRSGNG

SEQ ID NO: 19920 - protein, 28 aa, Artificial Sequence
  Description of Artificial Sequence: Synthetic peptide
DEGAIRTTNPVATEQYGSFSTNLTIGSR

SEQ ID NO: 19921 - protein, 30 aa, Artificial Sequence
  Description of Artificial Sequence: Synthetic polypeptide
YEEEIRTVNPVATEQYGSASTNFLERGNRY

SEQ ID NO: 19922 - protein, 28 aa, Artificial Sequence
  Description of Artificial Sequence: Synthetic peptide
DEEEIRTTNPVATEQYGSVWTLEQEGEF

SEQ ID NO: 19923 - protein, 32 aa, Artificial Sequence
  Description of Artificial Sequence: Synthetic polypeptide
DEEEIRTTNPVATEQYGSVSTYNLMNNQNGNA

SEQ ID NO: 19924 - protein, 29 aa, Artificial Sequence
  Description of Artificial Sequence: Synthetic peptide
DEGAIRTTNPVATEQYGSFSTNLEIGNRG

SEQ ID NO: 19925 - protein, 29 aa, Artificial Sequence
  Description of Artificial Sequence: Synthetic peptide
YEEEIRTVNPVATEQYGEVSTNLEQRNNG

SEQ ID NO: 19926 - protein, 29 aa, Artificial Sequence
  Description of Artificial Sequence: Synthetic peptide
DEAEIRTTNGVAYQQYGSVSTNLQRNGDR

SEQ ID NO: 19927 - protein, 29 aa, Artificial Sequence
  Description of Artificial Sequence: Synthetic peptide
DEGAIRTTNPVATEQYGSISTNALTIGNR

SEQ ID NO: 19928 - protein, 32 aa, Artificial Sequence
  Description of Artificial Sequence: Synthetic polypeptide
DEEEIRTTNPVATEQYGSVSTYNLNNQNGNNQ

SEQ ID NO: 19929 - protein, 31 aa, Artificial Sequence
  Description of Artificial Sequence: Synthetic polypeptide
DEEEIRTTNPVATEQYGSVCTNADQVRDGDR

SEQ ID NO: 19930 - protein, 33 aa, Artificial Sequence
  Description of Artificial Sequence: Synthetic polypeptide
DEEEIRTTNPVATEQYGSVCTNALDQRLGDNRL

SEQ ID NO: 19931 - protein, 29 aa, Artificial Sequence
  Description of Artificial Sequence: Synthetic peptide
AEEEIRTTNPVATEEYGSVSTNLQEQNGI

SEQ ID NO: 19932 - protein, 31 aa, Artificial Sequence
  Description of Artificial Sequence: Synthetic polypeptide
YEEEIRTVNPVATEMYGSVSTGNLQRVGQNR

SEQ ID NO: 19933 - protein, 30 aa, Artificial Sequence
  Description of Artificial Sequence: Synthetic polypeptide
DEAEIRTTNPVATEQYGSVSENLDQSGEER

SEQ ID NO: 19934 - protein, 28 aa, Artificial Sequence
  Description of Artificial Sequence: Synthetic peptide
DEEEIATTNPVATEAYGTVSTNMQHGDR

SEQ ID NO: 19935 - protein, 28 aa, Artificial Sequence
  Description of Artificial Sequence: Synthetic peptide
DEGAIRTTNPVATEQYGSESTNIEIGNR

SEQ ID NO: 19936 - protein, 29 aa, Artificial Sequence
  Description of Artificial Sequence: Synthetic peptide
DEGAIRTTNPVATEQYGSDFSTNLIGGNR

SEQ ID NO: 19937 - protein, 31 aa, Artificial Sequence
  Description of Artificial Sequence: Synthetic polypeptide
YEEEIRTVNPVATEFYGSVSTGNLQRVGNMR

SEQ ID NO: 19938 - protein, 28 aa, Artificial Sequence
  Description of Artificial Sequence: Synthetic peptide
DEGAIRTTNPVATEQYGSCSTNLIGGNA

SEQ ID NO: 19939 - protein, 30 aa, Artificial Sequence
  Description of Artificial Sequence: Synthetic polypeptide
DEAEIRTTNPVATEQYGSVSENLQNGDNEM

SEQ ID NO: 19940 - protein, 29 aa, Artificial Sequence
  Description of Artificial Sequence: Synthetic peptide
TEECIRTTNPVATEQYGSVSTNLNIHLNR

SEQ ID NO: 19941 - protein, 29 aa, Artificial Sequence
  Description of Artificial Sequence: Synthetic peptide
AEEEIRTTNPVATEEYGTISCINLQRGNR

SEQ ID NO: 19942 - protein, 29 aa, Artificial Sequence
  Description of Artificial Sequence: Synthetic peptide
DEGAIRTTNPVATEQYGSISTNLPIEGNR

SEQ ID NO: 19943 - protein, 30 aa, Artificial Sequence
  Description of Artificial Sequence: Synthetic polypeptide
DEEEIRTTNPVATEQYGSVCTGLEQRGGLL

SEQ ID NO: 19944 - protein, 31 aa, Artificial Sequence
  Description of Artificial Sequence: Synthetic polypeptide
DEEEIRTTNPVATEQYGSVSCNLDQTIGNNS

SEQ ID NO: 19945 - protein, 28 aa, Artificial Sequence
  Description of Artificial Sequence: Synthetic peptide
DEGCIRTTNPVATEQYGSFSTNLTIVNR

SEQ ID NO: 19946 - protein, 28 aa, Artificial Sequence
  Description of Artificial Sequence: Synthetic peptide
DEGAISTTNPVATEQYGSTSTNLIGGNR

SEQ ID NO: 19947 - protein, 28 aa, Artificial Sequence
  Description of Artificial Sequence: Synthetic peptide
TEECIRTTNPVATEQYGSVSTNDSNLNR

SEQ ID NO: 19948 - protein, 29 aa, Artificial Sequence
  Description of Artificial Sequence: Synthetic peptide
AEEEIRTTNPVATEEYGVVSSVNLQRGNG

SEQ ID NO: 19949 - protein, 33 aa, Artificial Sequence
  Description of Artificial Sequence: Synthetic polypeptide
DEEEIRTTNPVATEQYGSVSQTNLQPNIGNLRM

SEQ ID NO: 19950 - protein, 31 aa, Artificial Sequence
  Description of Artificial Sequence: Synthetic polypeptide
DEEEIRTTNPVATEQYGSVCTGNLQNWNERE

SEQ ID NO: 19951 - protein, 31 aa, Artificial Sequence
  Description of Artificial Sequence: Synthetic polypeptide
DEEEIRTTNPVATEQYGSVSTYNLGNDGGNV

SEQ ID NO: 19952 - protein, 30 aa, Artificial Sequence
  Description of Artificial Sequence: Synthetic polypeptide
DEEEIRTTNPVATEQYGSVCTLLEVRGGNQ

SEQ ID NO: 19953 - protein, 29 aa, Artificial Sequence
  Description of Artificial Sequence: Synthetic peptide
DEGAIRTTNPVATEQYGSISTNLDITGNR

SEQ ID NO: 19954 - protein, 28 aa, Artificial Sequence
  Description of Artificial Sequence: Synthetic peptide
AEEEIRTTNPVATEEYGVISENLQRGIR

SEQ ID NO: 19955 - protein, 31 aa, Artificial Sequence
  Description of Artificial Sequence: Synthetic polypeptide
DEEEIRTTNPVATEQYGSVSQTNLQPGGILQ

SEQ ID NO: 19956 - protein, 30 aa, Artificial Sequence
  Description of Artificial Sequence: Synthetic polypeptide
DEEEIRTTNPVATEQYGSVSMNLQRSLDSE

SEQ ID NO: 19957 - protein, 28 aa, Artificial Sequence
  Description of Artificial Sequence: Synthetic peptide
AEEEIRTTNPVATEEYGTISNNLQRGNI

SEQ ID NO: 19958 - protein, 29 aa, Artificial Sequence
  Description of Artificial Sequence: Synthetic peptide
DEGAIRTTNPVATEQYGSVASTNLIIGNT

SEQ ID NO: 19959 - protein, 28 aa, Artificial Sequence
  Description of Artificial Sequence: Synthetic peptide
DEGAIRTTNPVATEQYGSTSTNLIVENR

SEQ ID NO: 19960 - protein, 31 aa, Artificial Sequence
  Description of Artificial Sequence: Synthetic polypeptide
DEEEIRTTNPVATEQYGYTVSTNEDQRGING

SEQ ID NO: 19961 - protein, 28 aa, Artificial Sequence
  Description of Artificial Sequence: Synthetic peptide
DEGAIRTTNPVATEQYGSTSTNLAIGNM

SEQ ID NO: 19962 - protein, 28 aa, Artificial Sequence
  Description of Artificial Sequence: Synthetic peptide
AEEEIRTTNPVATEEYGTISENLQVGNR

SEQ ID NO: 19963 - protein, 31 aa, Artificial Sequence
  Description of Artificial Sequence: Synthetic polypeptide
YEEEIRTVNPVATEQYGSVSDTENLQGRGNI

SEQ ID NO: 19964 - protein, 31 aa, Artificial Sequence
  Description of Artificial Sequence: Synthetic polypeptide
YEEEIRTVNPVATEQYGSVSCTSNLQRFGNT

SEQ ID NO: 19965 - protein, 30 aa, Artificial Sequence
  Description of Artificial Sequence: Synthetic polypeptide
DEGAIRTTNPVATEQYGSVSSTNLIIGNIR

SEQ ID NO: 19966 - protein, 32 aa, Artificial Sequence
  Description of Artificial Sequence: Synthetic polypeptide
DEEEIRTTNPVATEPYGISVSTNNLQDRIHNR

SEQ ID NO: 19967 - protein, 30 aa, Artificial Sequence
  Description of Artificial Sequence: Synthetic polypeptide
YEEEIRTVNPVATEFYGSVSTGNLQGDGNR

SEQ ID NO: 19968 - protein, 31 aa, Artificial Sequence
  Description of Artificial Sequence: Synthetic polypeptide
DEEEIRTTNPVATEQYGSVPTNLNRNGNENF

SEQ ID NO: 19969 - protein, 31 aa, Artificial Sequence
  Description of Artificial Sequence: Synthetic polypeptide
YEEEIRTTNPYAYEQYGSVSTNPLQRSGNDR

SEQ ID NO: 19970 - protein, 28 aa, Artificial Sequence
  Description of Artificial Sequence: Synthetic peptide
DEFVIRTTNPVATEQYGCVETNEQEGNR

SEQ ID NO: 19971 - protein, 32 aa, Artificial Sequence
  Description of Artificial Sequence: Synthetic polypeptide
DEEEIRTTNPVATEQYGSVCTNGLDQERGENN

SEQ ID NO: 19972 - protein, 32 aa, Artificial Sequence
  Description of Artificial Sequence: Synthetic polypeptide
DEEEIRTTNPVATEQYGSVCTNGLMRGNNNRA

SEQ ID NO: 19973 - protein, 28 aa, Artificial Sequence
  Description of Artificial Sequence: Synthetic peptide
DEFVIRTTNPVATEQYGCVETDDQRGNR

SEQ ID NO: 19974 - protein, 28 aa, Artificial Sequence
  Description of Artificial Sequence: Synthetic peptide
DEEEIRTTNPVATEQYGSVCTNGQPNED

SEQ ID NO: 19975 - protein, 32 aa, Artificial Sequence
  Description of Artificial Sequence: Synthetic polypeptide
DEEEIRTTNPVATEQYGSVSTYNLQTETGNNL

SEQ ID NO: 19976 - protein, 30 aa, Artificial Sequence
  Description of Artificial Sequence: Synthetic polypeptide
AEEEIRTTNPVATEEYGCTVSINLQREGNR

SEQ ID NO: 19977 - protein, 30 aa, Artificial Sequence
  Description of Artificial Sequence: Synthetic polypeptide
DEEEIRTTNPVATEQYGSVCTNILQELGEG

SEQ ID NO: 19978 - protein, 28 aa, Artificial Sequence
  Description of Artificial Sequence: Synthetic peptide
DEFVIRTTNPVATEQYGCVATNPQRGDR

SEQ ID NO: 19979 - protein, 32 aa, Artificial Sequence
  Description of Artificial Sequence: Synthetic polypeptide
DEEEIRTTNPVATEQYGSVSTYNLQSVGENSN

SEQ ID NO: 19980 - protein, 29 aa, Artificial Sequence
  Description of Artificial Sequence: Synthetic peptide
DEEEIRTTNPVATEQYGSVCTNIQIFNDD

SEQ ID NO: 19981 - protein, 29 aa, Artificial Sequence
  Description of Artificial Sequence: Synthetic peptide
YEEEIRTTNPYATEQYGWVSTNLSQRGET

SEQ ID NO: 19982 - protein, 30 aa, Artificial Sequence
  Description of Artificial Sequence: Synthetic polypeptide
DEEEIRTTNPVATEQYGSVCTNIQRGDEDA

SEQ ID NO: 19983 - protein, 28 aa, Artificial Sequence
  Description of Artificial Sequence: Synthetic peptide
AEEEIRTTNPVATEEYGCTSNNLQRGDR

SEQ ID NO: 19984 - protein, 32 aa, Artificial Sequence
  Description of Artificial Sequence: Synthetic polypeptide
DEEEIRTTNPVATEQYGSVNITDLDQRGENER

SEQ ID NO: 19985 - protein, 32 aa, Artificial Sequence
  Description of Artificial Sequence: Synthetic polypeptide
DEEEIRTTNPVATEQYGSVSQTNLQGGLEEND

SEQ ID NO: 19986 - protein, 28 aa, Artificial Sequence
  Description of Artificial Sequence: Synthetic peptide
AEEEIRTTNPVATEEYGCTSENLQMGNR

SEQ ID NO: 19987 - protein, 29 aa, Artificial Sequence
  Description of Artificial Sequence: Synthetic peptide
YEEEIRTTNPYATEQYGSVSTTLVQRGES

SEQ ID NO: 19988 - protein, 30 aa, Artificial Sequence
  Description of Artificial Sequence: Synthetic polypeptide
DEEEIRTTNPVATEQYGSVCTNLDEAEGND

SEQ ID NO: 19989 - protein, 32 aa, Artificial Sequence
  Description of Artificial Sequence: Synthetic polypeptide
YEEEIRTTNPYATEQYGSVSTNSLQRSGHNDR

SEQ ID NO: 19990 - protein, 30 aa, Artificial Sequence
  Description of Artificial Sequence: Synthetic polypeptide
DEEEIRTTNPVATEQYGSVCTNLDRGGPDN

SEQ ID NO: 19991 - protein, 28 aa, Artificial Sequence
  Description of Artificial Sequence: Synthetic peptide
DEFVIRTTNPVATEQYGCLETNEQRGNR

SEQ ID NO: 19992 - protein, 29 aa, Artificial Sequence
  Description of Artificial Sequence: Synthetic peptide
YEEEIRTTNTVATEFYGSVSTNIERGNRL

SEQ ID NO: 19993 - protein, 30 aa, Artificial Sequence
  Description of Artificial Sequence: Synthetic polypeptide
YEEEIRTVNPEATEFYGSVSTGNLQRNGNR

SEQ ID NO: 19994 - protein, 31 aa, Artificial Sequence
  Description of Artificial Sequence: Synthetic polypeptide
DEAEIRTTNPVATEQYGSVSDTALNQRSQNR

SEQ ID NO: 19995 - protein, 30 aa, Artificial Sequence
  Description of Artificial Sequence: Synthetic polypeptide
TEECIRTTNPVATEQYGSVSTNLRDNGGNR

SEQ ID NO: 19996 - protein, 31 aa, Artificial Sequence
  Description of Artificial Sequence: Synthetic polypeptide
DEEEIRTTNPVATEQYGSVSTYNLQDEQNDN

SEQ ID NO: 19997 - protein, 29 aa, Artificial Sequence
  Description of Artificial Sequence: Synthetic peptide
TEECIRTTNPVATEQYGSVSTNLSMALNR

SEQ ID NO: 19998 - protein, 32 aa, Artificial Sequence
  Description of Artificial Sequence: Synthetic polypeptide
DEEEIRTTNPVATEQYGSVSTYNLQDTNGNPF

SEQ ID NO: 19999 - protein, 28 aa, Artificial Sequence
  Description of Artificial Sequence: Synthetic peptide
DEGAIRSTNPVATEQYGSFSTNLIEGNR

SEQ ID NO: 20000 - protein, 32 aa, Artificial Sequence
  Description of Artificial Sequence: Synthetic polypeptide
DEEEIRTTNPVATEQYGSVSTYNLQDTTGNEG

SEQ ID NO: 20001 - protein, 28 aa, Artificial Sequence
  Description of Artificial Sequence: Synthetic peptide
DEGAIRATNPVATEQYGSCSTNLIIGNR

SEQ ID NO: 20002 - protein, 32 aa, Artificial Sequence
  Description of Artificial Sequence: Synthetic polypeptide
DEEEIRTTNPVATEQYGSVSTYNLQETGEQRM

SEQ ID NO: 20003 - protein, 29 aa, Artificial Sequence
  Description of Artificial Sequence: Synthetic peptide
AEEEIRTTNPVATEEYGKISINELQRGNR

SEQ ID NO: 20004 - protein, 31 aa, Artificial Sequence
  Description of Artificial Sequence: Synthetic polypeptide
YEEEIRTVNPVATEFYGSVSTENSLQRIGNR

SEQ ID NO: 20005 - protein, 31 aa, Artificial Sequence
  Description of Artificial Sequence: Synthetic polypeptide
DDEEIRTTNPVATEQYGCVCSTENLQFGNRA

SEQ ID NO: 20006 - protein, 29 aa, Artificial Sequence
  Description of Artificial Sequence: Synthetic peptide
DEEEIRTTNPVATEQYGSVWTELDRGEDA

SEQ ID NO: 20007 - protein, 31 aa, Artificial Sequence
  Description of Artificial Sequence: Synthetic polypeptide
DEEEIRTTNPVATEQYGSVSQTNLQNGELEF

SEQ ID NO: 20008 - protein, 31 aa, Artificial Sequence
  Description of Artificial Sequence: Synthetic polypeptide
DEEEIRTTNPVATEQYGSVSCNEPQDREGNG

SEQ ID NO: 20009 - protein, 30 aa, Artificial Sequence
  Description of Artificial Sequence: Synthetic polypeptide
YEEEIRTVNPEATEQYGSVSTSNLQRFGNG

SEQ ID NO: 20010 - protein, 28 aa, Artificial Sequence
  Description of Artificial Sequence: Synthetic peptide
AEEEIRTTNPVATEEYGETSINEQRGNR

SEQ ID NO: 20011 - protein, 30 aa, Artificial Sequence
  Description of Artificial Sequence: Synthetic polypeptide
TEECIRTTNPVATEQYGSVSYTNLSMVGNR

SEQ ID NO: 20012 - protein, 29 aa, Artificial Sequence
  Description of Artificial Sequence: Synthetic peptide
DEFVIRTTNPVATEQYGTVATNPQRGGNR

SEQ ID NO: 20013 - protein, 29 aa, Artificial Sequence
  Description of Artificial Sequence: Synthetic peptide
DEFVIRTTNPVATEQYGQVPETNQQRGNR

SEQ ID NO: 20014 - protein, 28 aa, Artificial Sequence
  Description of Artificial Sequence: Synthetic peptide
DEEEIRTTNPVATEAYGTASTNEQRTNN

SEQ ID NO: 20015 - protein, 32 aa, Artificial Sequence
  Description of Artificial Sequence: Synthetic polypeptide
DEEEIRTTNPVATEQYGSVCTNGEQRGPNDRA

SEQ ID NO: 20016 - protein, 29 aa, Artificial Sequence
  Description of Artificial Sequence: Synthetic peptide
DEFVIRTTNPVATEQYGCVETNVQERGNR

SEQ ID NO: 20017 - protein, 32 aa, Artificial Sequence
  Description of Artificial Sequence: Synthetic polypeptide
DEEEIRTTNPVATEQYGSVSQTNLQIEGIVRD

SEQ ID NO: 20018 - protein, 31 aa, Artificial Sequence
  Description of Artificial Sequence: Synthetic polypeptide
DEEEIRTTNPVATEQYGSVSMNLQRSDGDDE

SEQ ID NO: 20019 - protein, 31 aa, Artificial Sequence
  Description of Artificial Sequence: Synthetic polypeptide
DEEEIRTTNPVATEQYGYTVSTNEDDQRGNF

SEQ ID NO: 20020 - protein, 31 aa, Artificial Sequence
  Description of Artificial Sequence: Synthetic polypeptide
YEEEIRTVNPVATEQYGSVSDTENLQRGNDG

SEQ ID NO: 20021 - protein, 29 aa, Artificial Sequence
  Description of Artificial Sequence: Synthetic peptide
DEEEIRTTNPVATEQYGSVCTELQREEEM

SEQ ID NO: 20022 - protein, 30 aa, Artificial Sequence
  Description of Artificial Sequence: Synthetic polypeptide
AEEEIRTTNPVATEIYGSVSTNLQQTGNNA

SEQ ID NO: 20023 - protein, 30 aa, Artificial Sequence
  Description of Artificial Sequence: Synthetic polypeptide
YEEEIRTVNPVATEQYGSVSTNTSERSGNR

SEQ ID NO: 20024 - protein, 30 aa, Artificial Sequence
  Description of Artificial Sequence: Synthetic polypeptide
DEEEIRTTNPVATEQYGSVCSVNLQDLNDE

SEQ ID NO: 20025 - protein, 30 aa, Artificial Sequence
  Description of Artificial Sequence: Synthetic polypeptide
DEEEIRTTNPVATEQYGYTISTNEEQGGNR

SEQ ID NO: 20026 - protein, 29 aa, Artificial Sequence
  Description of Artificial Sequence: Synthetic peptide
DDEEIRTTNPVATEQWGSVCSTLLQNGTR

SEQ ID NO: 20027 - protein, 30 aa, Artificial Sequence
  Description of Artificial Sequence: Synthetic polypeptide
DDEEIRTTNPVATEQWGSVCSTLLQRGDRN

SEQ ID NO: 20028 - protein, 31 aa, Artificial Sequence
  Description of Artificial Sequence: Synthetic polypeptide
DDEEIRTTNPVATEQWGSVCSTLLQRGGNTR

SEQ ID NO: 20029 - protein, 30 aa, Artificial Sequence
  Description of Artificial Sequence: Synthetic polypeptide
DDEEIRTTNPVATEQWGSVMSTLLQRVGTR

SEQ ID NO: 20030 - protein, 30 aa, Artificial Sequence
  Description of Artificial Sequence: Synthetic polypeptide
DDEEIRTTNPVATEQWGSVQSTGLQREGTR

SEQ ID NO: 20031 - protein, 30 aa, Artificial Sequence
  Description of Artificial Sequence: Synthetic polypeptide
AEEEIRTTNPVATEIYGSVSTNLQMGGNGN

SEQ ID NO: 20032 - protein, 31 aa, Artificial Sequence
  Description of Artificial Sequence: Synthetic polypeptide
DEEEIRTTNPVATEQYGYTISTGELQRGNNR

SEQ ID NO: 20033 - protein, 29 aa, Artificial Sequence
  Description of Artificial Sequence: Synthetic peptide
DDEEIRTTNPVATEQWGSVSSTLLQRGMD

SEQ ID NO: 20034 - protein, 32 aa, Artificial Sequence
  Description of Artificial Sequence: Synthetic polypeptide
DEEEIATTNPVATEQYGSVCSTNDQDRGGNER

SEQ ID NO: 20035 - protein, 30 aa, Artificial Sequence
  Description of Artificial Sequence: Synthetic polypeptide
DEEEIRTTNPVATEQYGSVSTYMQVRSNDQ

SEQ ID NO: 20036 - protein, 31 aa, Artificial Sequence
  Description of Artificial Sequence: Synthetic polypeptide
DEEEIATTNPVATEQYGSVCSTNDIQDQGNR

SEQ ID NO: 20037 - protein, 29 aa, Artificial Sequence
  Description of Artificial Sequence: Synthetic peptide
AEEEIRTTNPVATEIYGSVSTNLNQGNGN

SEQ ID NO: 20038 - protein, 30 aa, Artificial Sequence
  Description of Artificial Sequence: Synthetic polypeptide
DEEEIRTTNPVATEQYGSVSMNLQRSDDQT

SEQ ID NO: 20039 - protein, 30 aa, Artificial Sequence
  Description of Artificial Sequence: Synthetic polypeptide
DEAEIRTTNPVATEQYGSVSNTNLQNGDIE

SEQ ID NO: 20040 - protein, 31 aa, Artificial Sequence
  Description of Artificial Sequence: Synthetic polypeptide
DEAEIRTTNPVATEQYGSVSNTNLGQEDGND

SEQ ID NO: 20041 - protein, 30 aa, Artificial Sequence
  Description of Artificial Sequence: Synthetic polypeptide
DDEEIRTTNPVATEQWGSVTSTLLQRMGDR

SEQ ID NO: 20042 - protein, 28 aa, Artificial Sequence
  Description of Artificial Sequence: Synthetic peptide
DEAEIRTTNGVAYCQYGSVSTNLQYGQR

SEQ ID NO: 20043 - protein, 30 aa, Artificial Sequence
  Description of Artificial Sequence: Synthetic polypeptide
AEEEIRTTNPVATEIYGSVSTNLEQGGNGN

SEQ ID NO: 20044 - protein, 32 aa, Artificial Sequence
  Description of Artificial Sequence: Synthetic polypeptide
DEEEIRTTNPVATEQYGSVCSVNQLQTRGDDR

SEQ ID NO: 20045 - protein, 30 aa, Artificial Sequence
  Description of Artificial Sequence: Synthetic polypeptide
AEEEIRTTNPVATEIYGSVSTNLQSGINGN

SEQ ID NO: 20046 - protein, 28 aa, Artificial Sequence
  Description of Artificial Sequence: Synthetic peptide
DEAEIRTTNGVAYCQYGSVSTNLQRGIG

SEQ ID NO: 20047 - protein, 31 aa, Artificial Sequence
  Description of Artificial Sequence: Synthetic polypeptide
DEEEIATTNPVATEQYGSVCSTNGLQDQGNE

SEQ ID NO: 20048 - protein, 31 aa, Artificial Sequence
  Description of Artificial Sequence: Synthetic polypeptide
DEEEIRTTNPVATEQYGSVCSTVNLQPEGVV

SEQ ID NO: 20049 - protein, 30 aa, Artificial Sequence
  Description of Artificial Sequence: Synthetic polypeptide
DEGEIATTNPVATEQYGSVATNLQRNNDRA

SEQ ID NO: 20050 - protein, 31 aa, Artificial Sequence
  Description of Artificial Sequence: Synthetic polypeptide
YEEEIRTVNPVATEQYGSVSTSNLQRMGNGN

SEQ ID NO: 20051 - protein, 32 aa, Artificial Sequence
  Description of Artificial Sequence: Synthetic polypeptide
DEEEIRTTNPVATEQYGSVNNTELQERGENER

SEQ ID NO: 20052 - protein, 29 aa, Artificial Sequence
  Description of Artificial Sequence: Synthetic peptide
DEGEIATTNPVATEQYGSVATNLQQRGDL

SEQ ID NO: 20053 - protein, 31 aa, Artificial Sequence
  Description of Artificial Sequence: Synthetic polypeptide
DEEEIRTTNPVATEQYGSVSTYLQIDGDNAQ

SEQ ID NO: 20054 - protein, 29 aa, Artificial Sequence
  Description of Artificial Sequence: Synthetic peptide
DEGEIATTNPVATEQYGSVATNLQQGNEM

SEQ ID NO: 20055 - protein, 31 aa, Artificial Sequence
  Description of Artificial Sequence: Synthetic polypeptide
DEEEIRTTNPVATEQYGSVNNTDNLYGRGTR

SEQ ID NO: 20056 - protein, 30 aa, Artificial Sequence
  Description of Artificial Sequence: Synthetic polypeptide
DEEEIRTTNPVATEQYGSVCSTYHQGGNFN

SEQ ID NO: 20057 - protein, 30 aa, Artificial Sequence
  Description of Artificial Sequence: Synthetic polypeptide
DEEEIRTTNPVATEQYGSVCSTYLQHGEQI

SEQ ID NO: 20058 - protein, 31 aa, Artificial Sequence
  Description of Artificial Sequence: Synthetic polypeptide
DEEEIRTTNPVATEQYGSVSMNLQRQGPEFN

SEQ ID NO: 20059 - protein, 29 aa, Artificial Sequence
  Description of Artificial Sequence: Synthetic peptide
YEEEIRTVNPVATEQYGSVSTNWEQRNNQ

SEQ ID NO: 20060 - protein, 32 aa, Artificial Sequence
  Description of Artificial Sequence: Synthetic polypeptide
DEEEIRTTNPVATEQYGSVSTYLQNIGSNFRV

SEQ ID NO: 20061 - protein, 30 aa, Artificial Sequence
  Description of Artificial Sequence: Synthetic polypeptide
DEEEIRTTNPVATEQYGSVPTNLIQESGEQ

SEQ ID NO: 20062 - protein, 29 aa, Artificial Sequence
  Description of Artificial Sequence: Synthetic peptide
AEEEIRTTNPVATEIYGSVSTTNLQGTNP

SEQ ID NO: 20063 - protein, 29 aa, Artificial Sequence
  Description of Artificial Sequence: Synthetic peptide
DEAEIRTTNGVAYCQYGSVSTNLQRGDSR

SEQ ID NO: 20064 - protein, 29 aa, Artificial Sequence
  Description of Artificial Sequence: Synthetic peptide
AEEEIRTTNPVATEIYGSVSTSAEQGGNR

SEQ ID NO: 20065 - protein, 29 aa, Artificial Sequence
  Description of Artificial Sequence: Synthetic peptide
AEEEIRTTNPVATEIYGSVSTQLQGGGNN

SEQ ID NO: 20066 - protein, 29 aa, Artificial Sequence
  Description of Artificial Sequence: Synthetic peptide
DEGEIATTNPVATEQYGSVATNLDRGNLD

SEQ ID NO: 20067 - protein, 29 aa, Artificial Sequence
  Description of Artificial Sequence: Synthetic peptide
DEAEIRTTNGVAYCQYGSVSTNLQRGGER

SEQ ID NO: 20068 - protein, 31 aa, Artificial Sequence
  Description of Artificial Sequence: Synthetic polypeptide
DEEEIRTTNPVATEQYGSVCSTYLQYGQNQP

SEQ ID NO: 20069 - protein, 31 aa, Artificial Sequence
  Description of Artificial Sequence: Synthetic polypeptide
DEEEIRTTNPVATEQYGSVSTYLQRTINQDD

SEQ ID NO: 20070 - protein, 29 aa, Artificial Sequence
  Description of Artificial Sequence: Synthetic peptide
AEEEIRTTNPVATEIYGSVSTNNQQGNSE

SEQ ID NO: 20071 - protein, 32 aa, Artificial Sequence
  Description of Artificial Sequence: Synthetic polypeptide
DEEEIATTNPVATEQYGSVCSTNALQRFNSNR

SEQ ID NO: 20072 - protein, 29 aa, Artificial Sequence
  Description of Artificial Sequence: Synthetic peptide
DEFVIGTTNPVATEQDGSVSTEMLQRGNR

SEQ ID NO: 20073 - protein, 29 aa, Artificial Sequence
  Description of Artificial Sequence: Synthetic peptide
AEEEIRTTNPVATEIYGSVSTNEQQGNET

SEQ ID NO: 20074 - protein, 31 aa, Artificial Sequence
  Description of Artificial Sequence: Synthetic polypeptide
DEGEIATTNPVATEQYGCVSTNLQERGNDRQ

SEQ ID NO: 20075 - protein, 30 aa, Artificial Sequence
  Description of Artificial Sequence: Synthetic polypeptide
DDEEIRTTNPVATEQYGCTISTNELQRGNE

SEQ ID NO: 20076 - protein, 30 aa, Artificial Sequence
  Description of Artificial Sequence: Synthetic polypeptide
DEEEIRTTNPVATEQYGYTISTWELQRGNQ

SEQ ID NO: 20077 - protein, 28 aa, Artificial Sequence
  Description of Artificial Sequence: Synthetic peptide
AEEEIRTTNPVATEGYGSVSTNLDLTNM

SEQ ID NO: 20078 - protein, 31 aa, Artificial Sequence
  Description of Artificial Sequence: Synthetic polypeptide
DEEEIRTTNPVATEQYGSVCSWNLQRGSIQA

SEQ ID NO: 20079 - protein, 32 aa, Artificial Sequence
  Description of Artificial Sequence: Synthetic polypeptide
DEEEIRTTNPVATEQYGSVSTYNLDQFGGNTS

SEQ ID NO: 20080 - protein, 29 aa, Artificial Sequence
  Description of Artificial Sequence: Synthetic peptide
TEECIRTTNPVATEPYGSVSTNLSMLGNR

SEQ ID NO: 20081 - protein, 32 aa, Artificial Sequence
  Description of Artificial Sequence: Synthetic polypeptide
DEEEIRTTNPVATEAYGSVVPSCTNLSIRGNR

SEQ ID NO: 20082 - protein, 31 aa, Artificial Sequence
  Description of Artificial Sequence: Synthetic polypeptide
DEEEIRTTNPVATEQYGSVWTMNDLQNGNQG

SEQ ID NO: 20083 - protein, 33 aa, Artificial Sequence
  Description of Artificial Sequence: Synthetic polypeptide
DEEEIRTTNPVATEAYGSVVQSYTNLSQRGNNR

SEQ ID NO: 20084 - protein, 29 aa, Artificial Sequence
  Description of Artificial Sequence: Synthetic peptide
YEEEIRTVNPVATEQYGSVSTNGETGFNR

SEQ ID NO: 20085 - protein, 31 aa, Artificial Sequence
  Description of Artificial Sequence: Synthetic polypeptide
DEAEIRTTNPVATEQYGSVSMDNLFQDGENR

SEQ ID NO: 20086 - protein, 33 aa, Artificial Sequence
  Description of Artificial Sequence: Synthetic polypeptide
DEEEIRTTNPVATEAYGSVVSCTQNLSQRGNNR

SEQ ID NO: 20087 - protein, 31 aa, Artificial Sequence
  Description of Artificial Sequence: Synthetic polypeptide
DEEEIRTTNPVATEQYGSVSQTNLQQVFMRD

SEQ ID NO: 20088 - protein, 31 aa, Artificial Sequence
  Description of Artificial Sequence: Synthetic polypeptide
DEEEIATTNPVATEAYGSVSTNELSQRGNNS

SEQ ID NO: 20089 - protein, 29 aa, Artificial Sequence
  Description of Artificial Sequence: Synthetic peptide
YEEEIRTVNPVATEQYGSVSTLTERFGNR

SEQ ID NO: 20090 - protein, 30 aa, Artificial Sequence
  Description of Artificial Sequence: Synthetic polypeptide
DEEEIRTTNPVATEQYGSVSQTNLQQNEIV

SEQ ID NO: 20091 - protein, 32 aa, Artificial Sequence
  Description of Artificial Sequence: Synthetic polypeptide
DEEEIRTTNPVATEAYGSVVSTNELSQRGNNE

SEQ ID NO: 20092 - protein, 29 aa, Artificial Sequence
  Description of Artificial Sequence: Synthetic peptide
DEEEIRTTNPVATEQYGSVCTDLLQRTEQ

SEQ ID NO: 20093 - protein, 31 aa, Artificial Sequence
  Description of Artificial Sequence: Synthetic polypeptide
DEEEIRTTNPVATEAYGSVVSTNELSTRGND

SEQ ID NO: 20094 - protein, 31 aa, Artificial Sequence
  Description of Artificial Sequence: Synthetic polypeptide
DEEEIRTTNPVATEQYGSVCTDNLQDEGNEN

SEQ ID NO: 20095 - protein, 31 aa, Artificial Sequence
  Description of Artificial Sequence: Synthetic polypeptide
YEEEIRTVNPVATEQYGSVSDTENLQRGNNT

SEQ ID NO: 20096 - protein, 30 aa, Artificial Sequence
  Description of Artificial Sequence: Synthetic polypeptide
DEEEIATTNPVATEAYGSVSTNLQSGGGNH

SEQ ID NO: 20097 - protein, 32 aa, Artificial Sequence
  Description of Artificial Sequence: Synthetic polypeptide
DEEEIRTTNPVATEQYGSVSTYNLEQSIGGNE

SEQ ID NO: 20098 - protein, 31 aa, Artificial Sequence
  Description of Artificial Sequence: Synthetic polypeptide
DEEEIRTTNPVATEQYGSVSTYNLDLFGGNV

SEQ ID NO: 20099 - protein, 32 aa, Artificial Sequence
  Description of Artificial Sequence: Synthetic polypeptide
DEEEIRTTNPVATEQYGSVSTYNLDHFGEDNR

SEQ ID NO: 20100 - protein, 28 aa, Artificial Sequence
  Description of Artificial Sequence: Synthetic peptide
AEEEIRTTNPVATEGYGVTSINLQRSNR

SEQ ID NO: 20101 - protein, 31 aa, Artificial Sequence
  Description of Artificial Sequence: Synthetic polypeptide
DDEEIRTTNPVATEQWGSVVSTDLQREGNTR

SEQ ID NO: 20102 - protein, 28 aa, Artificial Sequence
  Description of Artificial Sequence: Synthetic peptide
DEEEIATTNPVATEAYGSVATNLQAPND

SEQ ID NO: 20103 - protein, 32 aa, Artificial Sequence
  Description of Artificial Sequence: Synthetic polypeptide
DEEEIRTTNPVATEQYGYTISTNELEQPRGNR

SEQ ID NO: 20104 - protein, 31 aa, Artificial Sequence
  Description of Artificial Sequence: Synthetic polypeptide
DEEEIRTTNPVATEQYGSVCSVTGNDQEGER

SEQ ID NO: 20105 - protein, 32 aa, Artificial Sequence
  Description of Artificial Sequence: Synthetic polypeptide
DEEEIRTTNPVATEQYGYTISTNELQRGNERF

SEQ ID NO: 20106 - protein, 30 aa, Artificial Sequence
  Description of Artificial Sequence: Synthetic polypeptide
DEAEIRTTNPVATEQYGSVSNNLQHGGDQR

SEQ ID NO: 20107 - protein, 32 aa, Artificial Sequence
  Description of Artificial Sequence: Synthetic polypeptide
DEEEIRTTNPVATEQYGSVCSVTNLEQSGSND

SEQ ID NO: 20108 - protein, 32 aa, Artificial Sequence
  Description of Artificial Sequence: Synthetic polypeptide
DEEEIRTTNPVATEQYGSVCSVTNLERGENQD

SEQ ID NO: 20109 - protein, 32 aa, Artificial Sequence
  Description of Artificial Sequence: Synthetic polypeptide
DEEEIRTTNPVATEQYGSVCSVTNLQNFGNQS

SEQ ID NO: 20110 - protein, 31 aa, Artificial Sequence
  Description of Artificial Sequence: Synthetic polypeptide
DEEEIRTTNPVATEQYGYTISTNELQRGNIP

SEQ ID NO: 20111 - protein, 30 aa, Artificial Sequence
  Description of Artificial Sequence: Synthetic polypeptide
YEEEIRTVNPVATEQYGSVSTNTELRQGNR

SEQ ID NO: 20112 - protein, 30 aa, Artificial Sequence
  Description of Artificial Sequence: Synthetic polypeptide
DEAEIRTTNPVATEQYGSVSNNLQGGNNGL

SEQ ID NO: 20113 - protein, 33 aa, Artificial Sequence
  Description of Artificial Sequence: Synthetic polypeptide
DEEEIRTTNPVATEQYGSVSCNNLSQRPVGNNR

SEQ ID NO: 20114 - protein, 32 aa, Artificial Sequence
  Description of Artificial Sequence: Synthetic polypeptide
DEEEIRTTNPVATEQYGSVSTYNDLQGGNNTE

SEQ ID NO: 20115 - protein, 32 aa, Artificial Sequence
  Description of Artificial Sequence: Synthetic polypeptide
DEEEIRTTNPVATEQYGYTISTNELQRGNSRS

SEQ ID NO: 20116 - protein, 31 aa, Artificial Sequence
  Description of Artificial Sequence: Synthetic polypeptide
DEEEIRTTNPVATEQYGYTISTNELQRGVND

SEQ ID NO: 20117 - protein, 32 aa, Artificial Sequence
  Description of Artificial Sequence: Synthetic polypeptide
DEEEIRTTNPVATEQYGSVCSWENLQRNSNRD

SEQ ID NO: 20118 - protein, 31 aa, Artificial Sequence
  Description of Artificial Sequence: Synthetic polypeptide
DEEEIRTTNPVATEQYGYTISTNELVQRGER

SEQ ID NO: 20119 - protein, 30 aa, Artificial Sequence
  Description of Artificial Sequence: Synthetic polypeptide
DEGEIATTNPVATEHYGSVSTNLQQGNERH

SEQ ID NO: 20120 - protein, 31 aa, Artificial Sequence
  Description of Artificial Sequence: Synthetic polypeptide
DEEEIRTTNPVATEQYGSVSQTNLQVIDARS

SEQ ID NO: 20121 - protein, 32 aa, Artificial Sequence
  Description of Artificial Sequence: Synthetic polypeptide
DEEEIRTTNPVATEQYGSVSTYNGLDRGQDIR

SEQ ID NO: 20122 - protein, 31 aa, Artificial Sequence
  Description of Artificial Sequence: Synthetic polypeptide
DEEEIATTNPVATEAYGSVSCTNHSQRGNPR

SEQ ID NO: 20123 - protein, 29 aa, Artificial Sequence
  Description of Artificial Sequence: Synthetic peptide
DEGEIATTNPCSTEQYGSVSTNLQSGMNR

SEQ ID NO: 20124 - protein, 32 aa, Artificial Sequence
  Description of Artificial Sequence: Synthetic polypeptide
DEEEIATTNPVATEQYGSVCSTGELQERFGNR

SEQ ID NO: 20125 - protein, 31 aa, Artificial Sequence
  Description of Artificial Sequence: Synthetic polypeptide
DEEVIRTTNPVATEQYGSVSTNLFDENGQNR

SEQ ID NO: 20126 - protein, 30 aa, Artificial Sequence
  Description of Artificial Sequence: Synthetic polypeptide
DEFVIGTTNPVATEQDGSVSTDNLQRGNRE

SEQ ID NO: 20127 - protein, 29 aa, Artificial Sequence
  Description of Artificial Sequence: Synthetic peptide
YEEEIRTTNPYATEQYGSVSTNLVQLGET

SEQ ID NO: 20128 - protein, 33 aa, Artificial Sequence
  Description of Artificial Sequence: Synthetic polypeptide
DEEEIRTTNPVATEQYGCVCSNTGNLNQRFGNR

SEQ ID NO: 20129 - protein, 30 aa, Artificial Sequence
  Description of Artificial Sequence: Synthetic polypeptide
DEEEIRTTNPVATEQYGSVCTNLQRELIQT

SEQ ID NO: 20130 - protein, 31 aa, Artificial Sequence
  Description of Artificial Sequence: Synthetic polypeptide
DEEEIRTTNPVATEQYGSVSVDNLQRFGIDD

SEQ ID NO: 20131 - protein, 32 aa, Artificial Sequence
  Description of Artificial Sequence: Synthetic polypeptide
DEEEIRTTNPVATEQYGSVSQTNDQRGVNEEN

SEQ ID NO: 20132 - protein, 31 aa, Artificial Sequence
  Description of Artificial Sequence: Synthetic polypeptide
DEEEIRTTNPVATEQYGSVSVDYNLERDENR

SEQ ID NO: 20133 - protein, 30 aa, Artificial Sequence
  Description of Artificial Sequence: Synthetic polypeptide
DEAEIATTNPVATEQYGCVSTNLQRGDNES

SEQ ID NO: 20134 - protein, 32 aa, Artificial Sequence
  Description of Artificial Sequence: Synthetic polypeptide
DEEEIRTTNPVATEQYGSVSQTNDQRGENGEN

SEQ ID NO: 20135 - protein, 29 aa, Artificial Sequence
  Description of Artificial Sequence: Synthetic peptide
DEDEIRTTNPVAYEQYGVVSTNLQEGDAR

SEQ ID NO: 20136 - protein, 28 aa, Artificial Sequence
  Description of Artificial Sequence: Synthetic peptide
DEAEIATTNPVATEQYGCVSTNLQNGPD

SEQ ID NO: 20137 - protein, 33 aa, Artificial Sequence
  Description of Artificial Sequence: Synthetic polypeptide
DEEEIRTTNPVATEQYGSVSPANLQRIGEENRT

SEQ ID NO: 20138 - protein, 31 aa, Artificial Sequence
  Description of Artificial Sequence: Synthetic polypeptide
DEDEIRTTNPVATEQYGVVSTNLQLDGMNQR

SEQ ID NO: 20139 - protein, 31 aa, Artificial Sequence
  Description of Artificial Sequence: Synthetic polypeptide
DEEEIRTTNPVATEQYGSVPTNLQNGELNVA

SEQ ID NO: 20140 - protein, 32 aa, Artificial Sequence
  Description of Artificial Sequence: Synthetic polypeptide
DEEEIRTTNPVATEQYGSVSQTMNLIQRGLHD

SEQ ID NO: 20141 - protein, 31 aa, Artificial Sequence
  Description of Artificial Sequence: Synthetic polypeptide
DEEEIRTTNPVATEQYGSVSQTMNLIQDGLV

SEQ ID NO: 20142 - protein, 30 aa, Artificial Sequence
  Description of Artificial Sequence: Synthetic polypeptide
DEAEIATTNPVATEQYGCVSTNLQERGNHW

SEQ ID NO: 20143 - protein, 31 aa, Artificial Sequence
  Description of Artificial Sequence: Synthetic polypeptide
DEEEIRTTNPVATEQYGSVSMPNLQRVSEIR

SEQ ID NO: 20144 - protein, 31 aa, Artificial Sequence
  Description of Artificial Sequence: Synthetic polypeptide
DEEEIRTTNPVATEQYGSVNGTNLQMEGNIG

SEQ ID NO: 20145 - protein, 31 aa, Artificial Sequence
  Description of Artificial Sequence: Synthetic polypeptide
DEEEIRTTNPVATEQYGSVNGTNLQGIGNNN

SEQ ID NO: 20146 - protein, 28 aa, Artificial Sequence
  Description of Artificial Sequence: Synthetic peptide
DEAEIATTNPVATEQYGCVSTNLAYGNQ

SEQ ID NO: 20147 - protein, 30 aa, Artificial Sequence
  Description of Artificial Sequence: Synthetic polypeptide
DEEVIRTTNPVATEQYGTVSTNLEDNGQNR

SEQ ID NO: 20148 - protein, 31 aa, Artificial Sequence
  Description of Artificial Sequence: Synthetic polypeptide
DEEEIRTTNPVATEQYGSVWSLQNMLQRDQR

SEQ ID NO: 20149 - protein, 29 aa, Artificial Sequence
  Description of Artificial Sequence: Synthetic peptide
DEEEIRTTNPVATEQYGSVSMPNMDRGVQ

SEQ ID NO: 20150 - protein, 31 aa, Artificial Sequence
  Description of Artificial Sequence: Synthetic polypeptide
DEEEIRTTNPVATEQYGSVSPANLQTGNFAQ

SEQ ID NO: 20151 - protein, 29 aa, Artificial Sequence
  Description of Artificial Sequence: Synthetic peptide
DEEEIRTTNPVATEQYGSVSMPNNDRGEQ

SEQ ID NO: 20152 - protein, 30 aa, Artificial Sequence
  Description of Artificial Sequence: Synthetic polypeptide
DEEWIRTTNPVATEQWGSVATNNLQAGENR

SEQ ID NO: 20153 - protein, 32 aa, Artificial Sequence
  Description of Artificial Sequence: Synthetic polypeptide
DEEEIRTTNPVATEQYGCVCSNTNELQNGNRG

SEQ ID NO: 20154 - protein, 31 aa, Artificial Sequence
  Description of Artificial Sequence: Synthetic polypeptide
DEEEIRTTNPVATEQYGSVCTNLQPRVENSI

SEQ ID NO: 20155 - protein, 31 aa, Artificial Sequence
  Description of Artificial Sequence: Synthetic polypeptide
DEEEIRTTNPVATEQYGSVSQTNEQRGEPGT

SEQ ID NO: 20156 - protein, 31 aa, Artificial Sequence
  Description of Artificial Sequence: Synthetic polypeptide
TEEEIATTNPVATEQYGSVVSTNLSQRGDNS

SEQ ID NO: 20157 - protein, 31 aa, Artificial Sequence
  Description of Artificial Sequence: Synthetic polypeptide
TEEEIATTNPVATEQYGSVVSTNLSQRGGSR

SEQ ID NO: 20158 - protein, 33 aa, Artificial Sequence
  Description of Artificial Sequence: Synthetic polypeptide
DDEEIRTTNPVATEQYGSVCSTGNLQRFGSNRA

SEQ ID NO: 20159 - protein, 30 aa, Artificial Sequence
  Description of Artificial Sequence: Synthetic polypeptide
TEEEIATTNPVATEQYGTVSTDNLQDGNRL

SEQ ID NO: 20160 - protein, 30 aa, Artificial Sequence
  Description of Artificial Sequence: Synthetic polypeptide
DEEEIRTTNPVATEQYGSVPTNLQIRFMQQ

SEQ ID NO: 20161 - protein, 32 aa, Artificial Sequence
  Description of Artificial Sequence: Synthetic polypeptide
DEEEIRTTNPVATEQYGSVSQTNEQRGENLGI

SEQ ID NO: 20162 - protein, 30 aa, Artificial Sequence
  Description of Artificial Sequence: Synthetic polypeptide
DEDEIRTTNPVATEQYGVVSCTGLQRVGND

SEQ ID NO: 20163 - protein, 31 aa, Artificial Sequence
  Description of Artificial Sequence: Synthetic polypeptide
DDEEIRTTNPVATEQYGSVCSTNLQNGFNQG

SEQ ID NO: 20164 - protein, 30 aa, Artificial Sequence
  Description of Artificial Sequence: Synthetic polypeptide
DEEEIRTTNPVATEQYGSVSNTNHQATNSQ

SEQ ID NO: 20165 - protein, 31 aa, Artificial Sequence
  Description of Artificial Sequence: Synthetic polypeptide
DDEEIRTTNPVATEQYGSVCSTNLQNGQNDE

SEQ ID NO: 20166 - protein, 31 aa, Artificial Sequence
  Description of Artificial Sequence: Synthetic polypeptide
DEEEIRTTNPVATEQYGYVSTNLQNNGNGNA

SEQ ID NO: 20167 - protein, 31 aa, Artificial Sequence
  Description of Artificial Sequence: Synthetic polypeptide
DEEEIRTTNPVATEQYGYVSTNLQQGINQNA

SEQ ID NO: 20168 - protein, 31 aa, Artificial Sequence
  Description of Artificial Sequence: Synthetic polypeptide
DEEEIRTTNPVATEQYGSVCTNLQQRVNLLN

SEQ ID NO: 20169 - protein, 29 aa, Artificial Sequence
  Description of Artificial Sequence: Synthetic peptide
DEFCIRTTNPVATEQYGCVETNPQRGGNR

SEQ ID NO: 20170 - protein, 29 aa, Artificial Sequence
  Description of Artificial Sequence: Synthetic peptide
DEFCIRTTNPVATEQYGCVEDTNQQRGNR

SEQ ID NO: 20171 - protein, 32 aa, Artificial Sequence
  Description of Artificial Sequence: Synthetic polypeptide
DEEEIRTTNPVATEQYGSVSPANLIQTGNERQ

SEQ ID NO: 20172 - protein, 31 aa, Artificial Sequence
  Description of Artificial Sequence: Synthetic polypeptide
DEEAIATTNPVATEQYGESVSINLQRGDNNR

SEQ ID NO: 20173 - protein, 31 aa, Artificial Sequence
  Description of Artificial Sequence: Synthetic polypeptide
DEEEIRTTNPVATEQYGCVCSNTNLERSGNQ

SEQ ID NO: 20174 - protein, 30 aa, Artificial Sequence
  Description of Artificial Sequence: Synthetic polypeptide
YEEEIRTTNPVNTEQYGSVSTNNLERGNGD

SEQ ID NO: 20175 - protein, 30 aa, Artificial Sequence
  Description of Artificial Sequence: Synthetic polypeptide
DEDEIRTTNPVATEQYGVVSTNLQGDMGNV

SEQ ID NO: 20176 - protein, 30 aa, Artificial Sequence
  Description of Artificial Sequence: Synthetic polypeptide
DEEEIRTTNPVATEQYGSVWSTNPLINGEQ

SEQ ID NO: 20177 - protein, 32 aa, Artificial Sequence
  Description of Artificial Sequence: Synthetic polypeptide
DEEEIRTTNPVATEQYGSVSQTEGLQRGNFET

SEQ ID NO: 20178 - protein, 29 aa, Artificial Sequence
  Description of Artificial Sequence: Synthetic peptide
DEECIVTVNPVATEGYGSVSTDNLERGNR

SEQ ID NO: 20179 - protein, 32 aa, Artificial Sequence
  Description of Artificial Sequence: Synthetic polypeptide
DEEEIRTTNPVATEQYGSVSQTDNEQRGNDQT

SEQ ID NO: 20180 - protein, 31 aa, Artificial Sequence
  Description of Artificial Sequence: Synthetic polypeptide
DEEEIRTTNPVATEQYGSVSMSNLQNGSNAA

SEQ ID NO: 20181 - protein, 32 aa, Artificial Sequence
  Description of Artificial Sequence: Synthetic polypeptide
DEEEIRTTNPVATEQYGSVSMSNLQSFGSNRS

SEQ ID NO: 20182 - protein, 31 aa, Artificial Sequence
  Description of Artificial Sequence: Synthetic polypeptide
DEEEIRTTNPVATEQYGSVSQPNLQQVMNER

SEQ ID NO: 20183 - protein, 31 aa, Artificial Sequence
  Description of Artificial Sequence: Synthetic polypeptide
DEEEIRTTNPVATEQYGSVSMSSNLQRFNDD

SEQ ID NO: 20184 - protein, 30 aa, Artificial Sequence
  Description of Artificial Sequence: Synthetic polypeptide
DEEVIRTTNPVATEQYGSVSTNLQDNTQND

SEQ ID NO: 20185 - protein, 29 aa, Artificial Sequence
  Description of Artificial Sequence: Synthetic peptide
DEDEIRTTNPVAYEQYGTVSTNLQHGDTR

SEQ ID NO: 20186 - protein, 30 aa, Artificial Sequence
  Description of Artificial Sequence: Synthetic polypeptide
DEEEIRTTNPVATEQYGSVSNTNGEQYGDF

SEQ ID NO: 20187 - protein, 31 aa, Artificial Sequence
  Description of Artificial Sequence: Synthetic polypeptide
DEEVIRTTNPVATEQYGSVSTNLPDVAGDNR

SEQ ID NO: 20188 - protein, 31 aa, Artificial Sequence
  Description of Artificial Sequence: Synthetic polypeptide
DEEEIRTTNPVATEQYGCVCSINLQRFGNDI

SEQ ID NO: 20189 - protein, 30 aa, Artificial Sequence
  Description of Artificial Sequence: Synthetic polypeptide
DEECIATTNPVATEPYGYSVSSNLQRGDNR

SEQ ID NO: 20190 - protein, 31 aa, Artificial Sequence
  Description of Artificial Sequence: Synthetic polypeptide
DEEEIRTTNPVATEQYGSVSMSNLQHGSNQM

SEQ ID NO: 20191 - protein, 31 aa, Artificial Sequence
  Description of Artificial Sequence: Synthetic polypeptide
DEEEIRTTNPVATEQYGSVSNTNEQVVGNGE

SEQ ID NO: 20192 - protein, 31 aa, Artificial Sequence
  Description of Artificial Sequence: Synthetic polypeptide
DEEEIRTTNPVATEQYGSVSPDAMQRGNDRD

SEQ ID NO: 20193 - protein, 32 aa, Artificial Sequence
  Description of Artificial Sequence: Synthetic polypeptide
DEEEIRTTNPVATEQYGSVWSLPNMLQRGDNL

SEQ ID NO: 20194 - protein, 30 aa, Artificial Sequence
  Description of Artificial Sequence: Synthetic polypeptide
DEEEIRTTNPVATEQYGSVSVGANEQRVNN

SEQ ID NO: 20195 - protein, 32 aa, Artificial Sequence
  Description of Artificial Sequence: Synthetic polypeptide
DEEEIRTTNPVATEQYGSVSQNNLEQRINERQ

SEQ ID NO: 20196 - protein, 31 aa, Artificial Sequence
  Description of Artificial Sequence: Synthetic polypeptide
DEEVIRTTNPVATEQYGSVSTNLIDNNGENR

SEQ ID NO: 20197 - protein, 28 aa, Artificial Sequence
  Description of Artificial Sequence: Synthetic peptide
DEECLATTNPSAYEQYGEVSTNLQRGNR

SEQ ID NO: 20198 - protein, 30 aa, Artificial Sequence
  Description of Artificial Sequence: Synthetic polypeptide
DEEEIRTTNPVATEQYGSVSPDLLQRTFNV

SEQ ID NO: 20199 - protein, 31 aa, Artificial Sequence
  Description of Artificial Sequence: Synthetic polypeptide
DEEVIRTTNPVATEQYGSVSTNLHDENGQNR

SEQ ID NO: 20200 - protein, 32 aa, Artificial Sequence
  Description of Artificial Sequence: Synthetic polypeptide
DEEEIRTTNPVATEQYGCVCSDTELNQRGSNR

SEQ ID NO: 20201 - protein, 29 aa, Artificial Sequence
  Description of Artificial Sequence: Synthetic peptide
TEEEIKTTNPVATEQYGNVSCTHLQGGNR

SEQ ID NO: 20202 - protein, 31 aa, Artificial Sequence
  Description of Artificial Sequence: Synthetic polypeptide
DEEVIRTTNPVATEQYGSVSTNLNDNSGSNR

SEQ ID NO: 20203 - protein, 30 aa, Artificial Sequence
  Description of Artificial Sequence: Synthetic polypeptide
DEEEIRTTNPVATEQYGSVSNTNGGQEGGN

SEQ ID NO: 20204 - protein, 30 aa, Artificial Sequence
  Description of Artificial Sequence: Synthetic polypeptide
DEAEIRTTNPVATEQYGSVNTNLQRGSTQG

SEQ ID NO: 20205 - protein, 31 aa, Artificial Sequence
  Description of Artificial Sequence: Synthetic polypeptide
DEEEIRTTNPVATEQYGSVSNTNGGQRGDKF

SEQ ID NO: 20206 - protein, 30 aa, Artificial Sequence
  Description of Artificial Sequence: Synthetic polypeptide
DEEVIRTTNPVATEQYGSVSTTLEDNGQNR

SEQ ID NO: 20207 - protein, 29 aa, Artificial Sequence
  Description of Artificial Sequence: Synthetic peptide
DEEEIRTTNPVATEQYGSVNGTNEQSGDF

SEQ ID NO: 20208 - protein, 32 aa, Artificial Sequence
  Description of Artificial Sequence: Synthetic polypeptide
DEEEIRTTNPVATEQYGYVSTVNLEQVVGQNR

SEQ ID NO: 20209 - protein, 30 aa, Artificial Sequence
  Description of Artificial Sequence: Synthetic polypeptide
DEEEIATTNPVATECYGSVATNLQSGDNER

SEQ ID NO: 20210 - protein, 30 aa, Artificial Sequence
  Description of Artificial Sequence: Synthetic polypeptide
TEEEICTTNPVATEQYGSVACTNLQSGNNR

SEQ ID NO: 20211 - protein, 31 aa, Artificial Sequence
  Description of Artificial Sequence: Synthetic polypeptide
DEEVIRTTNPVATEQYGSVSTNNLRDNGGNR

SEQ ID NO: 20212 - protein, 30 aa, Artificial Sequence
  Description of Artificial Sequence: Synthetic polypeptide
DEEVIRTTNPVATEQYGSVSTNLYDNGQNI

SEQ ID NO: 20213 - protein, 30 aa, Artificial Sequence
  Description of Artificial Sequence: Synthetic polypeptide
DEEVIRTTNPVATEQYGSVSTNLVGNGQNG

SEQ ID NO: 20214 - protein, 29 aa, Artificial Sequence
  Description of Artificial Sequence: Synthetic peptide
TEEEICTTNPVATEQYGSVATNLQHGNDD

SEQ ID NO: 20215 - protein, 29 aa, Artificial Sequence
  Description of Artificial Sequence: Synthetic peptide
DEEEIRTTNPVATEQYGSVCTNLQSALQT

SEQ ID NO: 20216 - protein, 32 aa, Artificial Sequence
  Description of Artificial Sequence: Synthetic polypeptide
DEEEIRTTNPVATEQYGCVCSMTPNLQYSGNR

SEQ ID NO: 20217 - protein, 31 aa, Artificial Sequence
  Description of Artificial Sequence: Synthetic polypeptide
DEEEIRTTNPVATEQYGYVSTYDQRSGSNRV

SEQ ID NO: 20218 - protein, 31 aa, Artificial Sequence
  Description of Artificial Sequence: Synthetic polypeptide
DEEVIRTTNPVATEQYGSVSTNLTDNGQNIR

SEQ ID NO: 20219 - protein, 28 aa, Artificial Sequence
  Description of Artificial Sequence: Synthetic peptide
DEECIYTVNPVATEEYGSVSDNLERGNR

SEQ ID NO: 20220 - protein, 30 aa, Artificial Sequence
  Description of Artificial Sequence: Synthetic polypeptide
DEEEIRTTNPVATEQYGSVSPAPLIRGNEI

SEQ ID NO: 20221 - protein, 31 aa, Artificial Sequence
  Description of Artificial Sequence: Synthetic polypeptide
DEEVIRTTNPVATEQYGSVSTNLSDNGTNRP

SEQ ID NO: 20222 - protein, 31 aa, Artificial Sequence
  Description of Artificial Sequence: Synthetic polypeptide
DEEVIRTTNPVATEQYGSVSTNLSDNGQNRG

SEQ ID NO: 20223 - protein, 30 aa, Artificial Sequence
  Description of Artificial Sequence: Synthetic polypeptide
TEEEICTTNPVATEQYGSVSTNLQHGNSDE

SEQ ID NO: 20224 - protein, 32 aa, Artificial Sequence
  Description of Artificial Sequence: Synthetic polypeptide
DEEEIRTTNPVATEQYGSVSNTNGLQRAPNET

SEQ ID NO: 20225 - protein, 31 aa, Artificial Sequence
  Description of Artificial Sequence: Synthetic polypeptide
DEEEIRTTNPVATEQYGSVSNTNGGQRMGEF

SEQ ID NO: 20226 - protein, 33 aa, Artificial Sequence
  Description of Artificial Sequence: Synthetic polypeptide
DEEEIRTTNPVATEQYGSVSPATNLQRGENNNN

SEQ ID NO: 20227 - protein, 31 aa, Artificial Sequence
  Description of Artificial Sequence: Synthetic polypeptide
DEEVIRTTNPVATEQYGSVSTNLRDNGSNRQ

SEQ ID NO: 20228 - protein, 30 aa, Artificial Sequence
  Description of Artificial Sequence: Synthetic polypeptide
DEEVIRTTNPVATEQYGSVSTNLRDNGSNM

SEQ ID NO: 20229 - protein, 28 aa, Artificial Sequence
  Description of Artificial Sequence: Synthetic peptide
DEAEIATTNPVATEQYGEASTNLQPGND

SEQ ID NO: 20230 - protein, 30 aa, Artificial Sequence
  Description of Artificial Sequence: Synthetic polypeptide
DEEEIRTTNPVATEQYGSVSVDALQNGERV

SEQ ID NO: 20231 - protein, 29 aa, Artificial Sequence
  Description of Artificial Sequence: Synthetic peptide
DEAEIATTNPVATEQYGESVATNLQGGNQ

SEQ ID NO: 20232 - protein, 31 aa, Artificial Sequence
  Description of Artificial Sequence: Synthetic polypeptide
DEEEIRTTNPVATEQYGSVSVCNNLSQRVNI

SEQ ID NO: 20233 - protein, 31 aa, Artificial Sequence
  Description of Artificial Sequence: Synthetic polypeptide
DEEEIRTTNPVATEQYGSVCTNLLQREMNLL

SEQ ID NO: 20234 - protein, 29 aa, Artificial Sequence
  Description of Artificial Sequence: Synthetic peptide
AEEEIRTTNPVATEEYGCISWNLQRGNRP

SEQ ID NO: 20235 - protein, 28 aa, Artificial Sequence
  Description of Artificial Sequence: Synthetic peptide
AEEEIRTTNPVATEEYGCISINLQDGNR

SEQ ID NO: 20236 - protein, 31 aa, Artificial Sequence
  Description of Artificial Sequence: Synthetic polypeptide
DEFEIRTTNPVATEQYGSVCSTNLQRGSEQL

SEQ ID NO: 20237 - protein, 30 aa, Artificial Sequence
  Description of Artificial Sequence: Synthetic polypeptide
DEEEIRTTNPVATEQYGSVPTNLQIEGIID

SEQ ID NO: 20238 - protein, 30 aa, Artificial Sequence
  Description of Artificial Sequence: Synthetic polypeptide
DEDEIRTTNPVATEQYGTVSTNLQHEGNDH

SEQ ID NO: 20239 - protein, 32 aa, Artificial Sequence
  Description of Artificial Sequence: Synthetic polypeptide
YEEEIRTTNPYATEQYGSVSTNILEQRSGNRE

SEQ ID NO: 20240 - protein, 31 aa, Artificial Sequence
  Description of Artificial Sequence: Synthetic polypeptide
YEEEIRTTNPYATEQYGSVSTNDPQRSGNRA

SEQ ID NO: 20241 - protein, 30 aa, Artificial Sequence
  Description of Artificial Sequence: Synthetic polypeptide
DEEEIRTTNPVATEQYGYVSTNLIDGNTVA

SEQ ID NO: 20242 - protein, 29 aa, Artificial Sequence
  Description of Artificial Sequence: Synthetic peptide
TEEEIATTNPVATEQYGKVSVTVLQGGNR

SEQ ID NO: 20243 - protein, 28 aa, Artificial Sequence
  Description of Artificial Sequence: Synthetic peptide
DEDEIRTTNPVATEQYGTTSTNLQNGDG

SEQ ID NO: 20244 - protein, 31 aa, Artificial Sequence
  Description of Artificial Sequence: Synthetic polypeptide
DEDEIRTTNPVATEQYGTVSTNLQREGNSQN

SEQ ID NO: 20245 - protein, 30 aa, Artificial Sequence
  Description of Artificial Sequence: Synthetic polypeptide
DEDEIRTTNPVATEQYGTVSTNPQEGNDRE

SEQ ID NO: 20246 - protein, 28 aa, Artificial Sequence
  Description of Artificial Sequence: Synthetic peptide
AEEEIRTTNPVATEEYGCFSINQQRGNR

SEQ ID NO: 20247 - protein, 29 aa, Artificial Sequence
  Description of Artificial Sequence: Synthetic peptide
AEEEIRTTNPVATEEYGCFSINLQRGNPR

SEQ ID NO: 20248 - protein, 30 aa, Artificial Sequence
  Description of Artificial Sequence: Synthetic polypeptide
DEEEIRTTNPVATEQYGSVSQTNGQPRDDS

SEQ ID NO: 20249 - protein, 30 aa, Artificial Sequence
  Description of Artificial Sequence: Synthetic polypeptide
DEEEIRTTNPVATEQYGSVCTNLQADNDNN

SEQ ID NO: 20250 - protein, 30 aa, Artificial Sequence
  Description of Artificial Sequence: Synthetic polypeptide
DEDEIRTTNPVATEQYGTVTSTNLQRGTDA

SEQ ID NO: 20251 - protein, 28 aa, Artificial Sequence
  Description of Artificial Sequence: Synthetic peptide
DEFEICTVNPVATEQYGSVSTNLVEGNA

SEQ ID NO: 20252 - protein, 28 aa, Artificial Sequence
  Description of Artificial Sequence: Synthetic peptide
DEFEICTVNPVATEQYGSVSTNLVAGNH

SEQ ID NO: 20253 - protein, 28 aa, Artificial Sequence
  Description of Artificial Sequence: Synthetic peptide
AEEEIRTTNPVATEEYGCCSIGLQRGNR

SEQ ID NO: 20254 - protein, 29 aa, Artificial Sequence
  Description of Artificial Sequence: Synthetic peptide
DEFEICTVNPVATEQYGSVSTNLQFGGNT

SEQ ID NO: 20255 - protein, 28 aa, Artificial Sequence
  Description of Artificial Sequence: Synthetic peptide
DEFEIITVNPVATEQYGSVSTNLVEGND

SEQ ID NO: 20256 - protein, 29 aa, Artificial Sequence
  Description of Artificial Sequence: Synthetic peptide
TEEEIATTNPVATEQWGSVSENLQRGTTR

SEQ ID NO: 20257 - protein, 30 aa, Artificial Sequence
  Description of Artificial Sequence: Synthetic polypeptide
TEEEIATTNPVATEQWGSVCTNELQRGGNR

SEQ ID NO: 20258 - protein, 32 aa, Artificial Sequence
  Description of Artificial Sequence: Synthetic polypeptide
DEEEIRTTNPVATEQYGSVSQTNHQRGVNEDN

SEQ ID NO: 20259 - protein, 29 aa, Artificial Sequence
  Description of Artificial Sequence: Synthetic peptide
DEDEIRTTNPVATEQYGSVTTNLQHQGDH

SEQ ID NO: 20260 - protein, 28 aa, Artificial Sequence
  Description of Artificial Sequence: Synthetic peptide
AEEEIRTTNPVATEEYGCSSNNLQGGNR

SEQ ID NO: 20261 - protein, 31 aa, Artificial Sequence
  Description of Artificial Sequence: Synthetic polypeptide
DEEEIRTTNPVATEQYGSVSQTNLGRLIDRD

SEQ ID NO: 20262 - protein, 28 aa, Artificial Sequence
  Description of Artificial Sequence: Synthetic peptide
TEEEIACTNPIATEQYGSVSENLMRGNR

SEQ ID NO: 20263 - protein, 31 aa, Artificial Sequence
  Description of Artificial Sequence: Synthetic polypeptide
DEEEIRTTNPVATEQYGCVCSSNLQRGSNAI

SEQ ID NO: 20264 - protein, 29 aa, Artificial Sequence
  Description of Artificial Sequence: Synthetic peptide
TEEEIACTNPVATEPYGSVSTNLQRGNMN

SEQ ID NO: 20265 - protein, 29 aa, Artificial Sequence
  Description of Artificial Sequence: Synthetic peptide
DEFVICTTNPVATEQFGSVSTDFLQRGNR

SEQ ID NO: 20266 - protein, 30 aa, Artificial Sequence
  Description of Artificial Sequence: Synthetic polypeptide
TEEEIACTNPVATEQYGSVSTNLQRGNEVM

SEQ ID NO: 20267 - protein, 31 aa, Artificial Sequence
  Description of Artificial Sequence: Synthetic polypeptide
DEEEIRTTNPVATEQYGSVWSWPNGLQRDQR

SEQ ID NO: 20268 - protein, 29 aa, Artificial Sequence
  Description of Artificial Sequence: Synthetic peptide
YEEEIRTTNPYATEQYGSVSTNLGHRGET

SEQ ID NO: 20269 - protein, 31 aa, Artificial Sequence
  Description of Artificial Sequence: Synthetic polypeptide
YEEEIRTTNPYATEQYGSVSTNLEQDSGNRS

SEQ ID NO: 20270 - protein, 29 aa, Artificial Sequence
  Description of Artificial Sequence: Synthetic peptide
TEEEIATTNPVATEGYGSVSTNLQGGNDL

SEQ ID NO: 20271 - protein, 29 aa, Artificial Sequence
  Description of Artificial Sequence: Synthetic peptide
DEFVIATTNPVATEQDGSVSTGFLQRGNR

SEQ ID NO: 20272 - protein, 31 aa, Artificial Sequence
  Description of Artificial Sequence: Synthetic polypeptide
DEEEIRTTNPVATEQYGSVCTNLEVRGGGNN

SEQ ID NO: 20273 - protein, 29 aa, Artificial Sequence
  Description of Artificial Sequence: Synthetic peptide
DEFSIGTTNPVATEQFGSVSTDFLQRGNR

SEQ ID NO: 20274 - protein, 28 aa, Artificial Sequence
  Description of Artificial Sequence: Synthetic peptide
DEFNIRTTNPVATEQYGCVETNQQRGNQ

SEQ ID NO: 20275 - protein, 28 aa, Artificial Sequence
  Description of Artificial Sequence: Synthetic peptide
DEFEIYTTNPVATEQYGSVSTNQMYGNT

SEQ ID NO: 20276 - protein, 30 aa, Artificial Sequence
  Description of Artificial Sequence: Synthetic polypeptide
TEEEIATTNPVATEHYGSVVSTNLSQRGDR

SEQ ID NO: 20277 - protein, 28 aa, Artificial Sequence
  Description of Artificial Sequence: Synthetic peptide
TEEEIATTNPVATEHYGVVSTNLQQGNL

SEQ ID NO: 20278 - protein, 31 aa, Artificial Sequence
  Description of Artificial Sequence: Synthetic polypeptide
DEEEIRTTNPVATEQYGSVCTNLEVRGGNDG

SEQ ID NO: 20279 - protein, 28 aa, Artificial Sequence
  Description of Artificial Sequence: Synthetic peptide
DEFEISTVNPVATEQYGSVSTNLEEGNH

SEQ ID NO: 20280 - protein, 29 aa, Artificial Sequence
  Description of Artificial Sequence: Synthetic peptide
DEAEIRTTNPVATEQYGSVSANNQESGNQ

SEQ ID NO: 20281 - protein, 30 aa, Artificial Sequence
  Description of Artificial Sequence: Synthetic polypeptide
TEEEIATTNPVATEPYGSVSTNLSQRGNNT

SEQ ID NO: 20282 - protein, 31 aa, Artificial Sequence
  Description of Artificial Sequence: Synthetic polypeptide
DEEEIRTTNPVATEQYGYVSTNLIQGGNGGN

SEQ ID NO: 20283 - protein, 31 aa, Artificial Sequence
  Description of Artificial Sequence: Synthetic polypeptide
DEEEIRTTNPVATEQYGSVSTYNLSNFGGNV

SEQ ID NO: 20284 - protein, 28 aa, Artificial Sequence
  Description of Artificial Sequence: Synthetic peptide
DEAEIRTTNPVATEQYGSVQTALIRENE

SEQ ID NO: 20285 - protein, 28 aa, Artificial Sequence
  Description of Artificial Sequence: Synthetic peptide
DEAEIRTTNPVATEQYGSVQTALIGDNR

SEQ ID NO: 20286 - protein, 30 aa, Artificial Sequence
  Description of Artificial Sequence: Synthetic polypeptide
AEEEIRTTNPVATECYGSVSTGNTQNGDNR

SEQ ID NO: 20287 - protein, 30 aa, Artificial Sequence
  Description of Artificial Sequence: Synthetic polypeptide
DEEEIRTTNPVATEQYGSVSTYTNQRVELR

SEQ ID NO: 20288 - protein, 30 aa, Artificial Sequence
  Description of Artificial Sequence: Synthetic polypeptide
YEEEIRTTNPYATEQYGSVSSPTNLQRGHG

SEQ ID NO: 20289 - protein, 32 aa, Artificial Sequence
  Description of Artificial Sequence: Synthetic polypeptide
YEEEIRTTNPYATEQYGSVSFTNLDQRSGNRA

SEQ ID NO: 20290 - protein, 29 aa, Artificial Sequence
  Description of Artificial Sequence: Synthetic peptide
DEAEIATTNPVATEQYGIVSTNLQAGGNQ

SEQ ID NO: 20291 - protein, 29 aa, Artificial Sequence
  Description of Artificial Sequence: Synthetic peptide
DEDEIRTTNPVATEQYGVNSTNLQRGDSL

SEQ ID NO: 20292 - protein, 30 aa, Artificial Sequence
  Description of Artificial Sequence: Synthetic polypeptide
YEEEIRTTNPYATEQYGQVNSTPLNQRGNR

SEQ ID NO: 20293 - protein, 31 aa, Artificial Sequence
  Description of Artificial Sequence: Synthetic polypeptide
DEEEIRTTNPVATEQYGSVSTYVLQESGNGE

SEQ ID NO: 20294 - protein, 31 aa, Artificial Sequence
  Description of Artificial Sequence: Synthetic polypeptide
DEEEIRTTNPVATEQYGSVNGTNLQTVGNIN

SEQ ID NO: 20295 - protein, 32 aa, Artificial Sequence
  Description of Artificial Sequence: Synthetic polypeptide
DDEEIRTTNPVATEQYGQSVSTNLNQRFGSNA

SEQ ID NO: 20296 - protein, 30 aa, Artificial Sequence
  Description of Artificial Sequence: Synthetic polypeptide
DEEEIRTTNPVATEQYGSVCTNLQEAVNDS

SEQ ID NO: 20297 - protein, 31 aa, Artificial Sequence
  Description of Artificial Sequence: Synthetic polypeptide
DDEEIRTTNPVATEQYGQSVSWNLQRSGSNQ

SEQ ID NO: 20298 - protein, 30 aa, Artificial Sequence
  Description of Artificial Sequence: Synthetic polypeptide
DEEEIRTTNPVATEQYGSVSCENDGQRGAF

SEQ ID NO: 20299 - protein, 30 aa, Artificial Sequence
  Description of Artificial Sequence: Synthetic polypeptide
DEEEIRTTNPVATEQYGCVCSNTNLQRNEQ

SEQ ID NO: 20300 - protein, 29 aa, Artificial Sequence
  Description of Artificial Sequence: Synthetic peptide
AEEEIRTTNPVATEAYGVVTSGNLQGGNR

SEQ ID NO: 20301 - protein, 32 aa, Artificial Sequence
  Description of Artificial Sequence: Synthetic polypeptide
DEEEIRTTNPVATEPYGISVSTPNLQDRVVNR

SEQ ID NO: 20302 - protein, 32 aa, Artificial Sequence
  Description of Artificial Sequence: Synthetic polypeptide
DEEEIRTTNPVATEQYGSVCTNLQHRLGDQRL

SEQ ID NO: 20303 - protein, 30 aa, Artificial Sequence
  Description of Artificial Sequence: Synthetic polypeptide
DEEEIRTTNPVATEQYGSVCTNLQIFNNDI

SEQ ID NO: 20304 - protein, 31 aa, Artificial Sequence
  Description of Artificial Sequence: Synthetic polypeptide
DEEEIRTTNPVATEQYGSVSQTNGEQNRDNI

SEQ ID NO: 20305 - protein, 30 aa, Artificial Sequence
  Description of Artificial Sequence: Synthetic polypeptide
DEEEIATTNPVATECYGCVSTNLQGMGDNR

SEQ ID NO: 20306 - protein, 30 aa, Artificial Sequence
  Description of Artificial Sequence: Synthetic polypeptide
TEEEIATTNPVATEQYGSVSCANLQSGGNR

SEQ ID NO: 20307 - protein, 31 aa, Artificial Sequence
  Description of Artificial Sequence: Synthetic polypeptide
TEEEIATTNPVATEQYGSVSCTNLSQNRGNQ

SEQ ID NO: 20308 - protein, 28 aa, Artificial Sequence
  Description of Artificial Sequence: Synthetic peptide
DEDEIRTTNPVATEQYGVTSTNLQLGDS

SEQ ID NO: 20309 - protein, 28 aa, Artificial Sequence
  Description of Artificial Sequence: Synthetic peptide
DEFEICTVNPVATEQYGSVSTNLAEGNS

SEQ ID NO: 20310 - protein, 28 aa, Artificial Sequence
  Description of Artificial Sequence: Synthetic peptide
DEFEICTVNPVATEQYGSVSTNLAHGNF

SEQ ID NO: 20311 - protein, 28 aa, Artificial Sequence
  Description of Artificial Sequence: Synthetic peptide
DEFEICTVNPVATEQYGSVSTNLDEGNN

SEQ ID NO: 20312 - protein, 29 aa, Artificial Sequence
  Description of Artificial Sequence: Synthetic peptide
DEFEICTVNPVATEQYGSVSTNLQDEGNH

SEQ ID NO: 20313 - protein, 30 aa, Artificial Sequence
  Description of Artificial Sequence: Synthetic polypeptide
DEEEIRTTNPVATEQYGSVCTNLQDGEDMV

SEQ ID NO: 20314 - protein, 31 aa, Artificial Sequence
  Description of Artificial Sequence: Synthetic polypeptide
DEEEIRTTNPVATEQYGYVSTNLQFDGNGNE

SEQ ID NO: 20315 - protein, 32 aa, Artificial Sequence
  Description of Artificial Sequence: Synthetic polypeptide
DEEEIRTTNPVATEQYGSVSCINELSQRVGVR

SEQ ID NO: 20316 - protein, 29 aa, Artificial Sequence
  Description of Artificial Sequence: Synthetic peptide
DEDEIRTTNPVATEQYGTVTSTNLQYGDV

SEQ ID NO: 20317 - protein, 28 aa, Artificial Sequence
  Description of Artificial Sequence: Synthetic peptide
DEFEICTVNPVATEQYGSVSTNLISGNH

SEQ ID NO: 20318 - protein, 28 aa, Artificial Sequence
  Description of Artificial Sequence: Synthetic peptide
DEFEICTVNPVATEQYGSVSTNLIQGNE

SEQ ID NO: 20319 - protein, 28 aa, Artificial Sequence
  Description of Artificial Sequence: Synthetic peptide
DEFEICTVNPVATEQYGSVSTNLGEGNG

SEQ ID NO: 20320 - protein, 31 aa, Artificial Sequence
  Description of Artificial Sequence: Synthetic polypeptide
DEEEIRTTNPVATEQYGYVSTNLQFNGNGEG

SEQ ID NO: 20321 - protein, 28 aa, Artificial Sequence
  Description of Artificial Sequence: Synthetic peptide
DEFEICTVNPVATEQYGSVSTNLFQGNN

SEQ ID NO: 20322 - protein, 31 aa, Artificial Sequence
  Description of Artificial Sequence: Synthetic polypeptide
DEEEIRTTNPVATEQYGSVSQTNGQNRDNVD

SEQ ID NO: 20323 - protein, 31 aa, Artificial Sequence
  Description of Artificial Sequence: Synthetic polypeptide
DEEEIRTTNPVATEQYGSVSTYNLTGFGGNA

SEQ ID NO: 20324 - protein, 32 aa, Artificial Sequence
  Description of Artificial Sequence: Synthetic polypeptide
DEEEIRTTNPVATEQYGSVSTYNLVNQNGGNA

SEQ ID NO: 20325 - protein, 32 aa, Artificial Sequence
  Description of Artificial Sequence: Synthetic polypeptide
DEEEIRTTNPVATEQYGSVSTYNLVQNFGNQN

SEQ ID NO: 20326 - protein, 29 aa, Artificial Sequence
  Description of Artificial Sequence: Synthetic peptide
AEEEIRTTNPVATEEYGAVTSGNLQGGNR

SEQ ID NO: 20327 - protein, 28 aa, Artificial Sequence
  Description of Artificial Sequence: Synthetic peptide
AEEEIRTTNPVATEEYGAISENLQRGNT

SEQ ID NO: 20328 - protein, 31 aa, Artificial Sequence
  Description of Artificial Sequence: Synthetic polypeptide
DEEEIRTTNPVATEQYGSVSQTNGQNRANLA

SEQ ID NO: 20329 - protein, 31 aa, Artificial Sequence
  Description of Artificial Sequence: Synthetic polypeptide
DEEEIRTTNPVATEQYGCVCSNTYLQRNNRG

SEQ ID NO: 20330 - protein, 30 aa, Artificial Sequence
  Description of Artificial Sequence: Synthetic polypeptide
YEEEIRTTNPYATEQYGSVSTMNNQKAGNR

SEQ ID NO: 20331 - protein, 31 aa, Artificial Sequence
  Description of Artificial Sequence: Synthetic polypeptide
DEEEIRTTNPVATEQYGYVSTNLQGDGNQNI

SEQ ID NO: 20332 - protein, 31 aa, Artificial Sequence
  Description of Artificial Sequence: Synthetic polypeptide
YEEEIRTTNPYATEQYGSVSTGNLQRSGNPC

SEQ ID NO: 20333 - protein, 32 aa, Artificial Sequence
  Description of Artificial Sequence: Synthetic polypeptide
DEAEIRTTNPVATEQYGSVPSVTNLSQTGNNR

SEQ ID NO: 20334 - protein, 28 aa, Artificial Sequence
  Description of Artificial Sequence: Synthetic peptide
DEFEICTVNPVATEQYGSVSTNLEDGNH

SEQ ID NO: 20335 - protein, 29 aa, Artificial Sequence
  Description of Artificial Sequence: Synthetic peptide
AEEEIRTTNPVATEEYGCCSENLQRGGNR

SEQ ID NO: 20336 - protein, 30 aa, Artificial Sequence
  Description of Artificial Sequence: Synthetic polypeptide
AEEEIRTTNPVATEIYGSVSTVNLQNGNQQ

SEQ ID NO: 20337 - protein, 28 aa, Artificial Sequence
  Description of Artificial Sequence: Synthetic peptide
DEEEIRTTNPVATEQYGSVDTDDERGED

SEQ ID NO: 20338 - protein, 30 aa, Artificial Sequence
  Description of Artificial Sequence: Synthetic polypeptide
DEEEIATTNPVATEHYGSVSTNLQHDGGNH

SEQ ID NO: 20339 - protein, 28 aa, Artificial Sequence
  Description of Artificial Sequence: Synthetic peptide
DEAEIRTTNPVATCHYGSVSTNLQYTNQ

SEQ ID NO: 20340 - protein, 32 aa, Artificial Sequence
  Description of Artificial Sequence: Synthetic polypeptide
TEEEIRTTNPVATEQYGSVSCTNLSQRGGDNG

SEQ ID NO: 20341 - protein, 32 aa, Artificial Sequence
  Description of Artificial Sequence: Synthetic polypeptide
TEEEIRTTNPVATEQYGSVSCTNLSQRTGDNQ

SEQ ID NO: 20342 - protein, 31 aa, Artificial Sequence
  Description of Artificial Sequence: Synthetic polypeptide
DEEEIRTTNPVATEQYGSVSPINLQRGPDMS

SEQ ID NO: 20343 - protein, 31 aa, Artificial Sequence
  Description of Artificial Sequence: Synthetic polypeptide
DEEEIRTTNPVATEQYGSVSPINLQRGVETI

SEQ ID NO: 20344 - protein, 32 aa, Artificial Sequence
  Description of Artificial Sequence: Synthetic polypeptide
TEEEIRTTNPVATEQYGSVSCTNLSQRVGNPC

SEQ ID NO: 20345 - protein, 28 aa, Artificial Sequence
  Description of Artificial Sequence: Synthetic peptide
DEEIIRCTNPVATEQYGCVSTNCQFGNF

SEQ ID NO: 20346 - protein, 30 aa, Artificial Sequence
  Description of Artificial Sequence: Synthetic polypeptide
DEEEIRTTNPVATEQYGAVSTNHQPGEDRA

SEQ ID NO: 20347 - protein, 32 aa, Artificial Sequence
  Description of Artificial Sequence: Synthetic polypeptide
DEEEIRTTNPVATEQYGSVSVTNLNDRSLNGR

SEQ ID NO: 20348 - protein, 31 aa, Artificial Sequence
  Description of Artificial Sequence: Synthetic polypeptide
TEEEIRTTNPVATEQYGSVSCTNLTRVGNNG

SEQ ID NO: 20349 - protein, 29 aa, Artificial Sequence
  Description of Artificial Sequence: Synthetic peptide
DEEIIRTTNPVATEQYGCVNSTNCQGGNC

SEQ ID NO: 20350 - protein, 32 aa, Artificial Sequence
  Description of Artificial Sequence: Synthetic polypeptide
TEEEIRTTNPVATEQYGSVSCTNMLQRGGNNM

SEQ ID NO: 20351 - protein, 30 aa, Artificial Sequence
  Description of Artificial Sequence: Synthetic polypeptide
DEEEIRTTNPVATEPYGSVCHTNLTRTVNR

SEQ ID NO: 20352 - protein, 31 aa, Artificial Sequence
  Description of Artificial Sequence: Synthetic polypeptide
DEEEIRTTNPVATEQYGSVETNNLIRDENPR

SEQ ID NO: 20353 - protein, 31 aa, Artificial Sequence
  Description of Artificial Sequence: Synthetic polypeptide
DEEEIRTTNPVATEQYGSVSNMNLQFGNNGE

SEQ ID NO: 20354 - protein, 30 aa, Artificial Sequence
  Description of Artificial Sequence: Synthetic polypeptide
DEEEIRTTNPVATEQYGSVETNNQRVGVFT

SEQ ID NO: 20355 - protein, 30 aa, Artificial Sequence
  Description of Artificial Sequence: Synthetic polypeptide
DEEHIRTTNPVATEQWGSVATNNLQNGVNR

SEQ ID NO: 20356 - protein, 31 aa, Artificial Sequence
  Description of Artificial Sequence: Synthetic polypeptide
DEEEIRTTNPVATEPYGSVCPTANLIREGNR

SEQ ID NO: 20357 - protein, 32 aa, Artificial Sequence
  Description of Artificial Sequence: Synthetic polypeptide
TEEEIRTTNPVATEQYGSVSCVGNALQRGGNR

SEQ ID NO: 20358 - protein, 32 aa, Artificial Sequence
  Description of Artificial Sequence: Synthetic polypeptide
DEEEIRTTNPVATEPYGSVCSCTNLSGRTGNR

SEQ ID NO: 20359 - protein, 31 aa, Artificial Sequence
  Description of Artificial Sequence: Synthetic polypeptide
DEEEIRTTNPVATEQYGSVSPINLQRLGATI

SEQ ID NO: 20360 - protein, 31 aa, Artificial Sequence
  Description of Artificial Sequence: Synthetic polypeptide
DEEEIRTTNPVATEQYGSVSVTNLQENGILQ

SEQ ID NO: 20361 - protein, 31 aa, Artificial Sequence
  Description of Artificial Sequence: Synthetic polypeptide
DEEEIRTTNPVATEQYGSVETNMQRGNIIDE

SEQ ID NO: 20362 - protein, 31 aa, Artificial Sequence
  Description of Artificial Sequence: Synthetic polypeptide
DEEEIRTTNPVATEQYGSVSVTNLQGGLEMQ

SEQ ID NO: 20363 - protein, 32 aa, Artificial Sequence
  Description of Artificial Sequence: Synthetic polypeptide
TEEEIRTTNPVATEQYGSVSCTNLSQRDGNYP

SEQ ID NO: 20364 - protein, 28 aa, Artificial Sequence
  Description of Artificial Sequence: Synthetic peptide
DEEIIRTTNPVATEQYGCVSTNCQFGDS

SEQ ID NO: 20365 - protein, 32 aa, Artificial Sequence
  Description of Artificial Sequence: Synthetic polypeptide
DEEEIRTTNPVATEQYGSVSNTGNLQGGQGNV

SEQ ID NO: 20366 - protein, 32 aa, Artificial Sequence
  Description of Artificial Sequence: Synthetic polypeptide
TEEEIRTTNPVATEQYGSVSCTNALQRTGNNQ

SEQ ID NO: 20367 - protein, 31 aa, Artificial Sequence
  Description of Artificial Sequence: Synthetic polypeptide
TEEEIRTTNPVATEQYGSVSCTNALSQPGNS

SEQ ID NO: 20368 - protein, 32 aa, Artificial Sequence
  Description of Artificial Sequence: Synthetic polypeptide
DEEEIRTTNPVATEQYGSVSNTGLQRTLENRM

SEQ ID NO: 20369 - protein, 30 aa, Artificial Sequence
  Description of Artificial Sequence: Synthetic polypeptide
DEEEIRTTNPVATEQYGAVSTNLDQGNNEI

SEQ ID NO: 20370 - protein, 30 aa, Artificial Sequence
  Description of Artificial Sequence: Synthetic polypeptide
DEEKIRTTNPVATEQWGSVDTNNLQLGVNR

SEQ ID NO: 20371 - protein, 32 aa, Artificial Sequence
  Description of Artificial Sequence: Synthetic polypeptide
TEEEIRTTNPVATEQYGSVSCTNEQQRGTNYR

SEQ ID NO: 20372 - protein, 30 aa, Artificial Sequence
  Description of Artificial Sequence: Synthetic polypeptide
DEEEIRTTNPVATEQYGSVSPTNVQIGQDI

SEQ ID NO: 20373 - protein, 31 aa, Artificial Sequence
  Description of Artificial Sequence: Synthetic polypeptide
DEEEIRTTNPVATEQYGSVSPINLNPRLDNR

SEQ ID NO: 20374 - protein, 32 aa, Artificial Sequence
  Description of Artificial Sequence: Synthetic polypeptide
TEEEIRTTNPVATEQYGSVSCTNLQRTGGNNS

SEQ ID NO: 20375 - protein, 31 aa, Artificial Sequence
  Description of Artificial Sequence: Synthetic polypeptide
DEEEIRTTNPVATEQYGSVSVTNLMVRLNEN

SEQ ID NO: 20376 - protein, 31 aa, Artificial Sequence
  Description of Artificial Sequence: Synthetic polypeptide
DEEEIRTTNPVATEQYGSVETNLQRVPENIF

SEQ ID NO: 20377 - protein, 29 aa, Artificial Sequence
  Description of Artificial Sequence: Synthetic peptide
DEEIIRTTNPVATEQYGCVVSTNQQFGNC

SEQ ID NO: 20378 - protein, 30 aa, Artificial Sequence
  Description of Artificial Sequence: Synthetic polypeptide
DEEEIRTTNPVATEQYGSVETNLQTINEVE

SEQ ID NO: 20379 - protein, 29 aa, Artificial Sequence
  Description of Artificial Sequence: Synthetic peptide
DEEIIRTTNPVATEQYGCVSTNSQFGNEG

SEQ ID NO: 20380 - protein, 32 aa, Artificial Sequence
  Description of Artificial Sequence: Synthetic polypeptide
TEEEIRTTNPVATEQYGSVSCTNLSQGGGNRR

SEQ ID NO: 20381 - protein, 31 aa, Artificial Sequence
  Description of Artificial Sequence: Synthetic polypeptide
DEAEIRTTNPVATEQYGSTVPSTNLSQTGNQ

SEQ ID NO: 20382 - protein, 31 aa, Artificial Sequence
  Description of Artificial Sequence: Synthetic polypeptide
DEEEIRTTNPVATEQYGSVETNLQVDGLVRD

SEQ ID NO: 20383 - protein, 30 aa, Artificial Sequence
  Description of Artificial Sequence: Synthetic polypeptide
TEEEIRTTNPVATEQYGSVSCTNLSQGVNQ

SEQ ID NO: 20384 - protein, 29 aa, Artificial Sequence
  Description of Artificial Sequence: Synthetic peptide
DEEIIRTTNPVATEQYGCVSTNHQDFGNE

SEQ ID NO: 20385 - protein, 31 aa, Artificial Sequence
  Description of Artificial Sequence: Synthetic polypeptide
DEEEIRTTNPVATEQYGSVQCTNLQQGEMRA

SEQ ID NO: 20386 - protein, 29 aa, Artificial Sequence
  Description of Artificial Sequence: Synthetic peptide
DEEIIRTTNPVATEQYGCVSTNCQFNGNM

SEQ ID NO: 20387 - protein, 29 aa, Artificial Sequence
  Description of Artificial Sequence: Synthetic peptide
DEDEIRTTNPVATQQYGCVSTNLERGNPS

SEQ ID NO: 20388 - protein, 31 aa, Artificial Sequence
  Description of Artificial Sequence: Synthetic polypeptide
DEEEIRTTNPVATLQYGSVSTNLQISGSNFD

SEQ ID NO: 20389 - protein, 28 aa, Artificial Sequence
  Description of Artificial Sequence: Synthetic peptide
DEEHIRCTNPVATEQYGSVSWNQQKGNL

SEQ ID NO: 20390 - protein, 30 aa, Artificial Sequence
  Description of Artificial Sequence: Synthetic polypeptide
TEEEIRTTNPVATEQYGSVSEMNLDEFGNR

SEQ ID NO: 20391 - protein, 31 aa, Artificial Sequence
  Description of Artificial Sequence: Synthetic polypeptide
DEEEIRTTNPVATEQYGAVSSTNLQDGGNTM

SEQ ID NO: 20392 - protein, 31 aa, Artificial Sequence
  Description of Artificial Sequence: Synthetic polypeptide
DEEEIRTTNPVATEQYGSVSNMNLQSGGNQG

SEQ ID NO: 20393 - protein, 32 aa, Artificial Sequence
  Description of Artificial Sequence: Synthetic polypeptide
TEEEIRTTNPVATEQYGSVSTGNLSQRGENYQ

SEQ ID NO: 20394 - protein, 30 aa, Artificial Sequence
  Description of Artificial Sequence: Synthetic polypeptide
DEEEIRTTNPVATEQYGSVETTNDLQREDI

SEQ ID NO: 20395 - protein, 33 aa, Artificial Sequence
  Description of Artificial Sequence: Synthetic polypeptide
DEEEIRTTNPVATEQYGSVETTNDLQRGNEMRQ

SEQ ID NO: 20396 - protein, 28 aa, Artificial Sequence
  Description of Artificial Sequence: Synthetic peptide
DEEGIRTTNPVATEQYGSVSTGEIGGNT

SEQ ID NO: 20397 - protein, 28 aa, Artificial Sequence
  Description of Artificial Sequence: Synthetic peptide
YEEEIATTNPVATEQYGVVSDNLQSGNQ

SEQ ID NO: 20398 - protein, 32 aa, Artificial Sequence
  Description of Artificial Sequence: Synthetic polypeptide
TEEEIRTTNPVATEQYGSVSTMNHNQRGSNPR

SEQ ID NO: 20399 - protein, 32 aa, Artificial Sequence
  Description of Artificial Sequence: Synthetic polypeptide
DEEEIRTTNPVATEQYGSVETTNGLQRTNQRD

SEQ ID NO: 20400 - protein, 33 aa, Artificial Sequence
  Description of Artificial Sequence: Synthetic polypeptide
DEEEIRTTNPVATEQYGSVSVTNLQRSSGEERI

SEQ ID NO: 20401 - protein, 30 aa, Artificial Sequence
  Description of Artificial Sequence: Synthetic polypeptide
DEEGIRTTNPVATEQYGSVSTNLGDGGQNV

SEQ ID NO: 20402 - protein, 33 aa, Artificial Sequence
  Description of Artificial Sequence: Synthetic polypeptide
TEEEIRTTNPVATEQYGSVSTNALSQRNGGNRY

SEQ ID NO: 20403 - protein, 32 aa, Artificial Sequence
  Description of Artificial Sequence: Synthetic polypeptide
TEEEIRTTNPVATEQYGSVSTNAVSQREGNNR

SEQ ID NO: 20404 - protein, 33 aa, Artificial Sequence
  Description of Artificial Sequence: Synthetic polypeptide
DEEEIRTTNPVATEQYGSVSPTNPLQRGDNGEE

SEQ ID NO: 20405 - protein, 31 aa, Artificial Sequence
  Description of Artificial Sequence: Synthetic polypeptide
YEEEIATTNPVATEQYGSVSTNNLQKGNQRI

SEQ ID NO: 20406 - protein, 28 aa, Artificial Sequence
  Description of Artificial Sequence: Synthetic peptide
DEEGIRTTNPVATEQYGDVVTNGQGGNQ

SEQ ID NO: 20407 - protein, 31 aa, Artificial Sequence
  Description of Artificial Sequence: Synthetic polypeptide
DEEEIRTTNPVATEQYGSVSVTNLQTGQILQ

SEQ ID NO: 20408 - protein, 28 aa, Artificial Sequence
  Description of Artificial Sequence: Synthetic peptide
AEEEIRATNPCATEQYGSVSSNLMRGNT

SEQ ID NO: 20409 - protein, 29 aa, Artificial Sequence
  Description of Artificial Sequence: Synthetic peptide
YEEEIATTNPVATEQYGSVSADNLQSGNQ

SEQ ID NO: 20410 - protein, 29 aa, Artificial Sequence
  Description of Artificial Sequence: Synthetic peptide
DEEEIATTNPVATEPWGSVSTNLQQGNDQ

SEQ ID NO: 20411 - protein, 28 aa, Artificial Sequence
  Description of Artificial Sequence: Synthetic peptide
YEEEIATTNPVATEQYGEVSDNLQSGNK

SEQ ID NO: 20412 - protein, 29 aa, Artificial Sequence
  Description of Artificial Sequence: Synthetic peptide
DEEGIRTTNPVATEQYGDVSTNGQGEGNA

SEQ ID NO: 20413 - protein, 29 aa, Artificial Sequence
  Description of Artificial Sequence: Synthetic peptide
YEEEIATTNPVATEQYGSVSTVLFRGNLL

SEQ ID NO: 20414 - protein, 30 aa, Artificial Sequence
  Description of Artificial Sequence: Synthetic polypeptide
DEEGIRTTNPVATEQYGSVSTNLIDNGQNA

SEQ ID NO: 20415 - protein, 32 aa, Artificial Sequence
  Description of Artificial Sequence: Synthetic polypeptide
DEEEIRTTNPVATEQYGSVSPTNQQRDGNEEG

SEQ ID NO: 20416 - protein, 31 aa, Artificial Sequence
  Description of Artificial Sequence: Synthetic polypeptide
DEEGIRTTNPVATEQYGSVSTNLNDNGQNFR

SEQ ID NO: 20417 - protein, 31 aa, Artificial Sequence
  Description of Artificial Sequence: Synthetic polypeptide
DEEEIRTTNPVATEQYGSVSVTNLQIGAIPQ

SEQ ID NO: 20418 - protein, 30 aa, Artificial Sequence
  Description of Artificial Sequence: Synthetic polypeptide
DEEEIRTTNPVATEQYGSVETPNLILNGNQ

SEQ ID NO: 20419 - protein, 29 aa, Artificial Sequence
  Description of Artificial Sequence: Synthetic peptide
DEEGIRTTNPVATEQYGVVSTNGQFEGNI

SEQ ID NO: 20420 - protein, 29 aa, Artificial Sequence
  Description of Artificial Sequence: Synthetic peptide
DEEGIRTTNPVATEQYGVVSTNEGQFGNI

SEQ ID NO: 20421 - protein, 29 aa, Artificial Sequence
  Description of Artificial Sequence: Synthetic peptide
DEEEIRTTNPVATEQYGSVETPSLERGET

SEQ ID NO: 20422 - protein, 31 aa, Artificial Sequence
  Description of Artificial Sequence: Synthetic polypeptide
TEEEIRTTNPVATEQYGSVSINLSQNTGGNR

SEQ ID NO: 20423 - protein, 31 aa, Artificial Sequence
  Description of Artificial Sequence: Synthetic polypeptide
DEEEIRTTNPVATEQYGAVSTDNLQQGENID

SEQ ID NO: 20424 - protein, 30 aa, Artificial Sequence
  Description of Artificial Sequence: Synthetic polypeptide
DEEEIRTTNPVATEQYGSVETTGLERNNDR

SEQ ID NO: 20425 - protein, 30 aa, Artificial Sequence
  Description of Artificial Sequence: Synthetic polypeptide
YEEEIATTNPVLTEQYGDVSTNVLQRGNGR

SEQ ID NO: 20426 - protein, 31 aa, Artificial Sequence
  Description of Artificial Sequence: Synthetic polypeptide
DEEEIRTTNPVATEQYGSVSVTNLQNPSNDI

SEQ ID NO: 20427 - protein, 32 aa, Artificial Sequence
  Description of Artificial Sequence: Synthetic polypeptide
DEEEIRTTNPVATEQYGSVSNTGLQRMLENMR

SEQ ID NO: 20428 - protein, 30 aa, Artificial Sequence
  Description of Artificial Sequence: Synthetic polypeptide
DDMEIRTTNPVATEQYGSVSTNGLQQDGMR

SEQ ID NO: 20429 - protein, 30 aa, Artificial Sequence
  Description of Artificial Sequence: Synthetic polypeptide
DDMEIRTTNPVATEQYGSVSTNGLQQGSRS

SEQ ID NO: 20430 - protein, 32 aa, Artificial Sequence
  Description of Artificial Sequence: Synthetic polypeptide
DEEEIRTTNPVATEQYGSVSNMNLQQRGDNNE

SEQ ID NO: 20431 - protein, 30 aa, Artificial Sequence
  Description of Artificial Sequence: Synthetic polypeptide
DEEEIRTTNPVATEPYGSVDETNLTRGGNI

SEQ ID NO: 20432 - protein, 29 aa, Artificial Sequence
  Description of Artificial Sequence: Synthetic peptide
DEEGIRTTNPVATEQYGSVSTPEDRGNTG

SEQ ID NO: 20433 - protein, 31 aa, Artificial Sequence
  Description of Artificial Sequence: Synthetic polypeptide
DEEEIRTTNPVATEQYGSVSPTNSLQEDNEN

SEQ ID NO: 20434 - protein, 28 aa, Artificial Sequence
  Description of Artificial Sequence: Synthetic peptide
YEEEIATTNPVCTEQYGSVSDNLQSGNQ

SEQ ID NO: 20435 - protein, 31 aa, Artificial Sequence
  Description of Artificial Sequence: Synthetic polypeptide
DEEEIRTTNPVATEQYGSVQCTNLQQNENRQ

SEQ ID NO: 20436 - protein, 32 aa, Artificial Sequence
  Description of Artificial Sequence: Synthetic polypeptide
TEEEIRTTNPVATEQYGSVSTENELSTVRGNR

SEQ ID NO: 20437 - protein, 32 aa, Artificial Sequence
  Description of Artificial Sequence: Synthetic polypeptide
DEEEIRTTNPVATEQYGSVSNMNLQRGLQERG

SEQ ID NO: 20438 - protein, 30 aa, Artificial Sequence
  Description of Artificial Sequence: Synthetic polypeptide
DEEAIRTTNPAATEQYGSVSTENLERGSNA

SEQ ID NO: 20439 - protein, 30 aa, Artificial Sequence
  Description of Artificial Sequence: Synthetic polypeptide
DEEEIRTTNPVATEPYGSVNNTNLTQGGND

SEQ ID NO: 20440 - protein, 29 aa, Artificial Sequence
  Description of Artificial Sequence: Synthetic peptide
DEEEIRTTNPVATEQYGSVSPINIDRGEQ

SEQ ID NO: 20441 - protein, 32 aa, Artificial Sequence
  Description of Artificial Sequence: Synthetic polypeptide
TEEEIRTTNPVATEQYGSVSCTGNLQRGGNNP

SEQ ID NO: 20442 - protein, 31 aa, Artificial Sequence
  Description of Artificial Sequence: Synthetic polypeptide
DEEEIRTTNPVATEQYGSVETNLQRIGEELT

SEQ ID NO: 20443 - protein, 31 aa, Artificial Sequence
  Description of Artificial Sequence: Synthetic polypeptide
DEEEIRTTNPVATEQYGAVSTNLIQGGGNDE

SEQ ID NO: 20444 - protein, 30 aa, Artificial Sequence
  Description of Artificial Sequence: Synthetic polypeptide
DEEEIRTTNPVATEQYGSVETNHQSGSNVS

SEQ ID NO: 20445 - protein, 31 aa, Artificial Sequence
  Description of Artificial Sequence: Synthetic polypeptide
DEEEIRTTNPVATEPYGSVCFTNLERGGNVR

SEQ ID NO: 20446 - protein, 29 aa, Artificial Sequence
  Description of Artificial Sequence: Synthetic peptide
DEECSRTTNPIAYEQYGEVSTNLQRHGNR

SEQ ID NO: 20447 - protein, 30 aa, Artificial Sequence
  Description of Artificial Sequence: Synthetic polypeptide
DEEEIRTTNPVATEPYGSVCFTNLIATGNR

SEQ ID NO: 20448 - protein, 29 aa, Artificial Sequence
  Description of Artificial Sequence: Synthetic peptide
DEENIRTTNPVATEPYGIVTTNLQRNTNR

SEQ ID NO: 20449 - protein, 30 aa, Artificial Sequence
  Description of Artificial Sequence: Synthetic polypeptide
DEEEIRTTNPVATEQYGSVETNLEGRSEER

SEQ ID NO: 20450 - protein, 30 aa, Artificial Sequence
  Description of Artificial Sequence: Synthetic polypeptide
DEDEIRTTNPVATETYGSVSTNLQGDEGNM

SEQ ID NO: 20451 - protein, 30 aa, Artificial Sequence
  Description of Artificial Sequence: Synthetic polypeptide
DEENIRTTNPVATEIYGVVSTTNLQFGSNR

SEQ ID NO: 20452 - protein, 32 aa, Artificial Sequence
  Description of Artificial Sequence: Synthetic polypeptide
DEEEIRTTNPVATEQYGSVSNTGNLQGTGGNQ

SEQ ID NO: 20453 - protein, 29 aa, Artificial Sequence
  Description of Artificial Sequence: Synthetic peptide
DEEAIMTTNPVATECYGSVNTNTLQRGNI

SEQ ID NO: 20454 - protein, 32 aa, Artificial Sequence
  Description of Artificial Sequence: Synthetic polypeptide
DEEEIRTTNPVATEQYGSVSNTGNLQRTSNAS

SEQ ID NO: 20455 - protein, 33 aa, Artificial Sequence
  Description of Artificial Sequence: Synthetic polypeptide
DEEEIRTTNPVATEQYGSVSPTNWLEQRLSQNR

SEQ ID NO: 20456 - protein, 32 aa, Artificial Sequence
  Description of Artificial Sequence: Synthetic polypeptide
TEEEIRTTNPVATEQYGSVNTSNLMQRGSNNR

SEQ ID NO: 20457 - protein, 29 aa, Artificial Sequence
  Description of Artificial Sequence: Synthetic peptide
DEAEIRTTNPVATEQYGSVAGTGLERGNE

SEQ ID NO: 20458 - protein, 29 aa, Artificial Sequence
  Description of Artificial Sequence: Synthetic peptide
DEENIRTTNPVATEIYGQVTTNLQRGNNQ

SEQ ID NO: 20459 - protein, 30 aa, Artificial Sequence
  Description of Artificial Sequence: Synthetic polypeptide
DEENIRTTNPVATEIYGQVTTNLQRGENRG

SEQ ID NO: 20460 - protein, 29 aa, Artificial Sequence
  Description of Artificial Sequence: Synthetic peptide
DEENIRTTNPVATEIYGQVTTNLQRGDND

SEQ ID NO: 20461 - protein, 29 aa, Artificial Sequence
  Description of Artificial Sequence: Synthetic peptide
DEENIRTTNPVATEIYGQVTTNLQLGENR

SEQ ID NO: 20462 - protein, 30 aa, Artificial Sequence
  Description of Artificial Sequence: Synthetic polypeptide
DEEEIRTTNPVATEQYGSVETNLIIIDNVR

SEQ ID NO: 20463 - protein, 30 aa, Artificial Sequence
  Description of Artificial Sequence: Synthetic polypeptide
DEEEIRTTNPVATEQYGSVETNLIRDEAER

SEQ ID NO: 20464 - protein, 32 aa, Artificial Sequence
  Description of Artificial Sequence: Synthetic polypeptide
TEEEIRTTNPVATEQYGSVNTSNLTQRGENIR

SEQ ID NO: 20465 - protein, 32 aa, Artificial Sequence
  Description of Artificial Sequence: Synthetic polypeptide
TEEEIRTTNPVATEQYGSVNTSNLTQRGENKR

SEQ ID NO: 20466 - protein, 32 aa, Artificial Sequence
  Description of Artificial Sequence: Synthetic polypeptide
DEEEIRTTNPVATEQYGSVSVTNLIESFGNRV

SEQ ID NO: 20467 - protein, 30 aa, Artificial Sequence
  Description of Artificial Sequence: Synthetic polypeptide
DEEEIRTTNPVATEPYGSVCFTNEDRGGNR

SEQ ID NO: 20468 - protein, 28 aa, Artificial Sequence
  Description of Artificial Sequence: Synthetic peptide
DDETIRTTNPVATEQYGAVSTNQQRNNL

SEQ ID NO: 20469 - protein, 30 aa, Artificial Sequence
  Description of Artificial Sequence: Synthetic polypeptide
DEEEIRTTNPVATEQYGSVETNDQQRGQDE

SEQ ID NO: 20470 - protein, 28 aa, Artificial Sequence
  Description of Artificial Sequence: Synthetic peptide
DDEQIRTTNPVATEQYGQVSTNGQRVNL

SEQ ID NO: 20471 - protein, 29 aa, Artificial Sequence
  Description of Artificial Sequence: Synthetic peptide
DEENIRTTNPVATESYGQVATNLQDGSNR

SEQ ID NO: 20472 - protein, 28 aa, Artificial Sequence
  Description of Artificial Sequence: Synthetic peptide
DDESIRTTNPVATEQYGQVSTNHQRVND

SEQ ID NO: 20473 - protein, 30 aa, Artificial Sequence
  Description of Artificial Sequence: Synthetic polypeptide
DEEEIRTTNPVATEQYGAVSTNLVEVGNNG

SEQ ID NO: 20474 - protein, 32 aa, Artificial Sequence
  Description of Artificial Sequence: Synthetic polypeptide
TEEEIRTTNPVATEQYGSVISTHLSQRTVGNR

SEQ ID NO: 20475 - protein, 31 aa, Artificial Sequence
  Description of Artificial Sequence: Synthetic polypeptide
DEEEIRTTNPVATEQYGSVSVTNLERNSNQF

SEQ ID NO: 20476 - protein, 30 aa, Artificial Sequence
  Description of Artificial Sequence: Synthetic polypeptide
DEENIRTTNPVATEQYGSVSTNLSDNGQNQ

SEQ ID NO: 20477 - protein, 30 aa, Artificial Sequence
  Description of Artificial Sequence: Synthetic polypeptide
DEDEIRTTNPVATESYGSVSTNLQHQGNDS

SEQ ID NO: 20478 - protein, 29 aa, Artificial Sequence
  Description of Artificial Sequence: Synthetic peptide
TEEEIRTTNPVATEQYGSVMTALQNGEFR

SEQ ID NO: 20479 - protein, 33 aa, Artificial Sequence
  Description of Artificial Sequence: Synthetic polypeptide
DEEEIRTTNPVATEQYGSVSPIENLQRGENERY

SEQ ID NO: 20480 - protein, 31 aa, Artificial Sequence
  Description of Artificial Sequence: Synthetic polypeptide
YEEEIETTNPVATEQYGSVVMSTNLERGNFR

SEQ ID NO: 20481 - protein, 31 aa, Artificial Sequence
  Description of Artificial Sequence: Synthetic polypeptide
DEEEIRTTNPVATEQYGAVSTNLQVQGNIIQ

SEQ ID NO: 20482 - protein, 30 aa, Artificial Sequence
  Description of Artificial Sequence: Synthetic polypeptide
YEEEIETTNPVATEQYGSVSMWNLPQGGNR

SEQ ID NO: 20483 - protein, 31 aa, Artificial Sequence
  Description of Artificial Sequence: Synthetic polypeptide
DEENIRTTNPVATEQYGSVSTNLIDTNGQNR

SEQ ID NO: 20484 - protein, 30 aa, Artificial Sequence
  Description of Artificial Sequence: Synthetic polypeptide
DEENIRTTNPVATEQYGSVSTNIGDNGQNR

SEQ ID NO: 20485 - protein, 30 aa, Artificial Sequence
  Description of Artificial Sequence: Synthetic polypeptide
DEEEIRTTNPVATEQYGSVETMNLIIMNDR

SEQ ID NO: 20486 - protein, 28 aa, Artificial Sequence
  Description of Artificial Sequence: Synthetic peptide
DDETIRTTNPVATEQYGAVSTNGQRFNI

SEQ ID NO: 20487 - protein, 31 aa, Artificial Sequence
  Description of Artificial Sequence: Synthetic polypeptide
DEEEIRTTNPVATEQYGSVSPTNYVERDNER

SEQ ID NO: 20488 - protein, 32 aa, Artificial Sequence
  Description of Artificial Sequence: Synthetic polypeptide
DEEEIRTTNPVATEQYGSVSPIINLQRGNELQ

SEQ ID NO: 20489 - protein, 28 aa, Artificial Sequence
  Description of Artificial Sequence: Synthetic peptide
DEENIRTTNPVATEQYGSVEYDLDGGNR

SEQ ID NO: 20490 - protein, 29 aa, Artificial Sequence
  Description of Artificial Sequence: Synthetic peptide
YEEEICTTNPVATEQYGSTVFTDLERGNR

SEQ ID NO: 20491 - protein, 30 aa, Artificial Sequence
  Description of Artificial Sequence: Synthetic polypeptide
YEEEICTTNPDATEQYGSVSTGNLQRGNPQ

SEQ ID NO: 20492 - protein, 31 aa, Artificial Sequence
  Description of Artificial Sequence: Synthetic polypeptide
DEEEIRTTNPVATEQYGAVSTNLQQNGNENE

SEQ ID NO: 20493 - protein, 30 aa, Artificial Sequence
  Description of Artificial Sequence: Synthetic polypeptide
DEENIRTTNPVATEIYGCVATNLQRHGDNR

SEQ ID NO: 20494 - protein, 31 aa, Artificial Sequence
  Description of Artificial Sequence: Synthetic polypeptide
DEEEIRTTNPVATEQYGSVSPTNPLQLINND

SEQ ID NO: 20495 - protein, 32 aa, Artificial Sequence
  Description of Artificial Sequence: Synthetic polypeptide
TEEEIRTTNPVATEQYGSVNTSNLTQRGENVR

SEQ ID NO: 20496 - protein, 28 aa, Artificial Sequence
  Description of Artificial Sequence: Synthetic peptide
DDETIRTTNPVATEQYGKVSTNEQRVNL

SEQ ID NO: 20497 - protein, 32 aa, Artificial Sequence
  Description of Artificial Sequence: Synthetic polypeptide
TEEEIRTTNPVATEQYGSVQSCTNLQRGTNNE

SEQ ID NO: 20498 - protein, 30 aa, Artificial Sequence
  Description of Artificial Sequence: Synthetic polypeptide
DEEEIRTTNPVATEQYGAVSTNLPNDGGNG

SEQ ID NO: 20499 - protein, 31 aa, Artificial Sequence
  Description of Artificial Sequence: Synthetic polypeptide
DEEEIRTTNPVATEQYGAVSTNLIRGVDPNI

SEQ ID NO: 20500 - protein, 29 aa, Artificial Sequence
  Description of Artificial Sequence: Synthetic peptide
DEDEIRTTNPVATHQYGCVSCTNLERGNP

SEQ ID NO: 20501 - protein, 31 aa, Artificial Sequence
  Description of Artificial Sequence: Synthetic polypeptide
DEEEIRTTNPVATEQYGAVSTNLIQGNGNEF

SEQ ID NO: 20502 - protein, 32 aa, Artificial Sequence
  Description of Artificial Sequence: Synthetic polypeptide
DEEEIRTTNPVATEQYGSVMTGINLQRIGPNA

SEQ ID NO: 20503 - protein, 29 aa, Artificial Sequence
  Description of Artificial Sequence: Synthetic peptide
DEEAIRATNPVATEQYGSVSTVNEQPGNL

SEQ ID NO: 20504 - protein, 30 aa, Artificial Sequence
  Description of Artificial Sequence: Synthetic polypeptide
TEEEIRTTNPVATEQYGSVSAWNLDEDGNR

SEQ ID NO: 20505 - protein, 31 aa, Artificial Sequence
  Description of Artificial Sequence: Synthetic polypeptide
DEEEIRTTNPVATEQYGSVSVTNLIRLENDQ

SEQ ID NO: 20506 - protein, 29 aa, Artificial Sequence
  Description of Artificial Sequence: Synthetic peptide
DEEMIRTTNPVATEQYGAVSTNQQNGNGD

SEQ ID NO: 20507 - protein, 31 aa, Artificial Sequence
  Description of Artificial Sequence: Synthetic polypeptide
TEEEIRTTNPVATEQYGSVPSYTNLQRGGSP

SEQ ID NO: 20508 - protein, 30 aa, Artificial Sequence
  Description of Artificial Sequence: Synthetic polypeptide
DEEMIRTTNPVATEQWGSVATNNLQLGSNR

SEQ ID NO: 20509 - protein, 32 aa, Artificial Sequence
  Description of Artificial Sequence: Synthetic polypeptide
TEEEIRTTNPVATEQYGSVSCDGNLQRGGSNR

SEQ ID NO: 20510 - protein, 31 aa, Artificial Sequence
  Description of Artificial Sequence: Synthetic polypeptide
TEEEIRTTNPVATEQYGSVSCIGNSQRGGNR

SEQ ID NO: 20511 - protein, 31 aa, Artificial Sequence
  Description of Artificial Sequence: Synthetic polypeptide
DEEEIRTTNPVATEQYGSVSNMNLEQIGGNE

SEQ ID NO: 20512 - protein, 32 aa, Artificial Sequence
  Description of Artificial Sequence: Synthetic polypeptide
TEEEIRTTNPVATEQYGSVSCLNLSQRGGNRT

SEQ ID NO: 20513 - protein, 31 aa, Artificial Sequence
  Description of Artificial Sequence: Synthetic polypeptide
DEEEIRTTNPVATEPYGSVCFTNMLTRTGNR

SEQ ID NO: 20514 - protein, 30 aa, Artificial Sequence
  Description of Artificial Sequence: Synthetic polypeptide
DEELIRTTNPVATEQWGSVATNNLQMGVNR

SEQ ID NO: 20515 - protein, 32 aa, Artificial Sequence
  Description of Artificial Sequence: Synthetic polypeptide
TEEEIRTTNPVATEQYGSVSCNLSQRAGGNNR

SEQ ID NO: 20516 - protein, 32 aa, Artificial Sequence
  Description of Artificial Sequence: Synthetic polypeptide
TEEEIRTTNPVATEQYGSVSCQGNLQRGGNYR

SEQ ID NO: 20517 - protein, 30 aa, Artificial Sequence
  Description of Artificial Sequence: Synthetic polypeptide
DEELIRTTNPVATEQWGSVATGNLQLGVNR

SEQ ID NO: 20518 - protein, 29 aa, Artificial Sequence
  Description of Artificial Sequence: Synthetic peptide
DEEAISTTNPVATECYGSVNTNPLQRGNM

SEQ ID NO: 20519 - protein, 31 aa, Artificial Sequence
  Description of Artificial Sequence: Synthetic polypeptide
TEEEIRTTNPVATEQYGSVSCCGNLTRGGNR

SEQ ID NO: 20520 - protein, 33 aa, Artificial Sequence
  Description of Artificial Sequence: Synthetic polypeptide
TEEEIRTTNPVATEQYGSVPSYTLNLQRGGNNR

SEQ ID NO: 20521 - protein, 30 aa, Artificial Sequence
  Description of Artificial Sequence: Synthetic polypeptide
DEEEIRTTNPVATEPYGSVCFTNLTSNGNR

SEQ ID NO: 20522 - protein, 32 aa, Artificial Sequence
  Description of Artificial Sequence: Synthetic polypeptide
DEEEIRTTNPVATEQYGSVSPIMWLQREGNRM

SEQ ID NO: 20523 - protein, 31 aa, Artificial Sequence
  Description of Artificial Sequence: Synthetic polypeptide
DEEEIRTTNPVATEPYGSVCFTNLTRGFDNR

SEQ ID NO: 20524 - protein, 28 aa, Artificial Sequence
  Description of Artificial Sequence: Synthetic peptide
DDETIRTTNPVATEQYGMVSTNHQRVNL

SEQ ID NO: 20525 - protein, 28 aa, Artificial Sequence
  Description of Artificial Sequence: Synthetic peptide
DDETIRTTNPVATEQYGNVSTNMQRVNL

SEQ ID NO: 20526 - protein, 29 aa, Artificial Sequence
  Description of Artificial Sequence: Synthetic peptide
DEENIRTTNPVATEAYGQVTTNLQVGSNR

SEQ ID NO: 20527 - protein, 31 aa, Artificial Sequence
  Description of Artificial Sequence: Synthetic polypeptide
DEEEIRTTNPVATEQYGSVETNLQIRGVQQS

SEQ ID NO: 20528 - protein, 30 aa, Artificial Sequence
  Description of Artificial Sequence: Synthetic polypeptide
DEEEIRTTNPVATEPYGSVCFTNLTRGIQR

SEQ ID NO: 20529 - protein, 29 aa, Artificial Sequence
  Description of Artificial Sequence: Synthetic peptide
DEENIRTTNPVACEQYGQVSTNNNQRGNN

SEQ ID NO: 20530 - protein, 31 aa, Artificial Sequence
  Description of Artificial Sequence: Synthetic polypeptide
DEEEIRTTNPVATEPYGSVCFTNLTRQGNRS

SEQ ID NO: 20531 - protein, 29 aa, Artificial Sequence
  Description of Artificial Sequence: Synthetic peptide
DEENIRTTNPVACEQYGNVSTINTQRGNN

SEQ ID NO: 20532 - protein, 31 aa, Artificial Sequence
  Description of Artificial Sequence: Synthetic polypeptide
DEEEIRTTNPVATEQYGSVETNLQLTENERI

SEQ ID NO: 20533 - protein, 31 aa, Artificial Sequence
  Description of Artificial Sequence: Synthetic polypeptide
DEAEIRTTNPVATEQYGSVAATALQRGENRE

SEQ ID NO: 20534 - protein, 30 aa, Artificial Sequence
  Description of Artificial Sequence: Synthetic polypeptide
DEDEIRTTNPVATEYYGSVSTNLQGNGNED

SEQ ID NO: 20535 - protein, 30 aa, Artificial Sequence
  Description of Artificial Sequence: Synthetic polypeptide
DEEEIRTTNPVATEPYGSVCFTNLTRSGNM

SEQ ID NO: 20536 - protein, 32 aa, Artificial Sequence
  Description of Artificial Sequence: Synthetic polypeptide
TEEEIRTTNPVATEQYGSVPSTNFSQNRGNNR

SEQ ID NO: 20537 - protein, 30 aa, Artificial Sequence
  Description of Artificial Sequence: Synthetic polypeptide
TEEEIRTTNPVATEQYGSVPSTNHSQGGSR

SEQ ID NO: 20538 - protein, 31 aa, Artificial Sequence
  Description of Artificial Sequence: Synthetic polypeptide
DEEEIRTTNPVATEPYGSVCFTNLTRSGSNR

SEQ ID NO: 20539 - protein, 30 aa, Artificial Sequence
  Description of Artificial Sequence: Synthetic polypeptide
DEEEIRTTNPVATEQYGSVETNLQRELDEI

SEQ ID NO: 20540 - protein, 33 aa, Artificial Sequence
  Description of Artificial Sequence: Synthetic polypeptide
TEEEIRTTNPVATEQYGSVPSTNLSQERVGNRD

SEQ ID NO: 20541 - protein, 33 aa, Artificial Sequence
  Description of Artificial Sequence: Synthetic polypeptide
TEEEIRTTNPVATEQYGSVPSTNMLSQRGPNNR

SEQ ID NO: 20542 - protein, 31 aa, Artificial Sequence
  Description of Artificial Sequence: Synthetic polypeptide
DEEEIRTTNPVATEQYGSVETNLQRGETEDY

SEQ ID NO: 20543 - protein, 32 aa, Artificial Sequence
  Description of Artificial Sequence: Synthetic polypeptide
DEEEIRTTNPVATEQYGSVSVTNLIRGMNEHQ

SEQ ID NO: 20544 - protein, 30 aa, Artificial Sequence
  Description of Artificial Sequence: Synthetic polypeptide
DEEEIRTTNPVATEPYGSVCFTNLTRVGNP

SEQ ID NO: 20545 - protein, 31 aa, Artificial Sequence
  Description of Artificial Sequence: Synthetic polypeptide
DEEEIRTTNPVATEQYGAVSTNLQGGGENST

SEQ ID NO: 20546 - protein, 30 aa, Artificial Sequence
  Description of Artificial Sequence: Synthetic polypeptide
DEEEIRTTNPVATEPYGSVCFTNLTRFGDR

SEQ ID NO: 20547 - protein, 28 aa, Artificial Sequence
  Description of Artificial Sequence: Synthetic peptide
DDEQIRTTNPVATEQYGKVSTNHQRVNQ

SEQ ID NO: 20548 - protein, 31 aa, Artificial Sequence
  Description of Artificial Sequence: Synthetic polypeptide
DEEEIRTTNPVATEQYGSVSANLQHFGSNTQ

SEQ ID NO: 20549 - protein, 32 aa, Artificial Sequence
  Description of Artificial Sequence: Synthetic polypeptide
DEEEIRTTNPVATEPYGSVNTTNLSQRGGNNR

SEQ ID NO: 20550 - protein, 31 aa, Artificial Sequence
  Description of Artificial Sequence: Synthetic polypeptide
DEEEIRTTNPVATEQYGSVQCTTLQRVLENR

SEQ ID NO: 20551 - protein, 30 aa, Artificial Sequence
  Description of Artificial Sequence: Synthetic polypeptide
TEEEIRTTNPVAYEAYGSVSTNELQRGTNE

SEQ ID NO: 20552 - protein, 30 aa, Artificial Sequence
  Description of Artificial Sequence: Synthetic polypeptide
TEEEIRTTNPVAYEAYGSVSTNELSQRGNA

SEQ ID NO: 20553 - protein, 32 aa, Artificial Sequence
  Description of Artificial Sequence: Synthetic polypeptide
DEEEIRTTNPVATEQYGSVSPTNLTQRDPNTE

SEQ ID NO: 20554 - protein, 30 aa, Artificial Sequence
  Description of Artificial Sequence: Synthetic polypeptide
DEEEIVTTNPAATEQYGSVPTNLQHSGNDR

SEQ ID NO: 20555 - protein, 28 aa, Artificial Sequence
  Description of Artificial Sequence: Synthetic peptide
DEEEIVSTNPVATEQYGLVSTNWQSGNF

SEQ ID NO: 20556 - protein, 29 aa, Artificial Sequence
  Description of Artificial Sequence: Synthetic peptide
DEEEIRTTNPVATEQYGSVSPTNLTMFLN

SEQ ID NO: 20557 - protein, 30 aa, Artificial Sequence
  Description of Artificial Sequence: Synthetic polypeptide
TEEEIRTTNPVAYEAYGSVSTNVSQRGNRV

SEQ ID NO: 20558 - protein, 30 aa, Artificial Sequence
  Description of Artificial Sequence: Synthetic polypeptide
DEEEIRTTNPVATEPYGSVTLTNLTRGGNE

SEQ ID NO: 20559 - protein, 33 aa, Artificial Sequence
  Description of Artificial Sequence: Synthetic polypeptide
DEEEIRTTNPVATEQYGSVMSMTNLNQNRNGER

SEQ ID NO: 20560 - protein, 31 aa, Artificial Sequence
  Description of Artificial Sequence: Synthetic polypeptide
DEEEIRTTNPVATEQYGSVVTDWLQRGNEDM

SEQ ID NO: 20561 - protein, 30 aa, Artificial Sequence
  Description of Artificial Sequence: Synthetic polypeptide
DEEEIRTTNPVATEQYGSVSPTNLQVNDIV

SEQ ID NO: 20562 - protein, 32 aa, Artificial Sequence
  Description of Artificial Sequence: Synthetic polypeptide
DEEEITTTNPVAYEQYGSVPSTNLSQRGGNYR

SEQ ID NO: 20563 - protein, 32 aa, Artificial Sequence
  Description of Artificial Sequence: Synthetic polypeptide
DEEEIRTTNPVATEQYGSVMSITGNLQRGVLV

SEQ ID NO: 20564 - protein, 32 aa, Artificial Sequence
  Description of Artificial Sequence: Synthetic polypeptide
DEEEIRTTNPVATEQYGSVSPTNLQVGFNETQ

SEQ ID NO: 20565 - protein, 30 aa, Artificial Sequence
  Description of Artificial Sequence: Synthetic polypeptide
DEEEIRTTNPVATEQYGSVVTDLHQRGEDI

SEQ ID NO: 20566 - protein, 32 aa, Artificial Sequence
  Description of Artificial Sequence: Synthetic polypeptide
DEEEIRTTNPVATEQYGSVSPTNLQVGEEVRM

SEQ ID NO: 20567 - protein, 30 aa, Artificial Sequence
  Description of Artificial Sequence: Synthetic polypeptide
DEEEIRTTNPVATEQYGSVSPTNLQVEEQS

SEQ ID NO: 20568 - protein, 32 aa, Artificial Sequence
  Description of Artificial Sequence: Synthetic polypeptide
DEEEITTTNPVATEQYGSVSTYNQLQERMGNL

SEQ ID NO: 20569 - protein, 30 aa, Artificial Sequence
  Description of Artificial Sequence: Synthetic polypeptide
DEEEIRTTNPVATEQYGSVVTDLDQRGEDM

SEQ ID NO: 20570 - protein, 29 aa, Artificial Sequence
  Description of Artificial Sequence: Synthetic peptide
DEEEIRTTNPVATEQWGTVVSTALERGNS

SEQ ID NO: 20571 - protein, 30 aa, Artificial Sequence
  Description of Artificial Sequence: Synthetic polypeptide
DEEEIRTTNPVATEPYGSVVATNLTPGGNR

SEQ ID NO: 20572 - protein, 30 aa, Artificial Sequence
  Description of Artificial Sequence: Synthetic polypeptide
DEEEIRTTNPVATEQYGSVVTDLQSRGEDF

SEQ ID NO: 20573 - protein, 32 aa, Artificial Sequence
  Description of Artificial Sequence: Synthetic polypeptide
DEEEIRTTNPVATEQYGSVSVTTNVQEGNNDR

SEQ ID NO: 20574 - protein, 32 aa, Artificial Sequence
  Description of Artificial Sequence: Synthetic polypeptide
DEEEIRTTNPVATEQYGSVSPTNLTQRFQVNF

SEQ ID NO: 20575 - protein, 30 aa, Artificial Sequence
  Description of Artificial Sequence: Synthetic polypeptide
DDREIRTTNPVATEQYGSVSTNLLQNGSDR

SEQ ID NO: 20576 - protein, 32 aa, Artificial Sequence
  Description of Artificial Sequence: Synthetic polypeptide
DEEEIRTTNPVATEQYGSVSVTSELSTRGGNR

SEQ ID NO: 20577 - protein, 31 aa, Artificial Sequence
  Description of Artificial Sequence: Synthetic polypeptide
DEEEIRTTNPVATEQYGSVSNNIQERGDERS

SEQ ID NO: 20578 - protein, 31 aa, Artificial Sequence
  Description of Artificial Sequence: Synthetic polypeptide
DEEEIRTTNPVATEQYGSVSVTSLNQNSQNR

SEQ ID NO: 20579 - protein, 30 aa, Artificial Sequence
  Description of Artificial Sequence: Synthetic polypeptide
DEEEIRTTNPVATEQYGSVSPMLQVVANER

SEQ ID NO: 20580 - protein, 32 aa, Artificial Sequence
  Description of Artificial Sequence: Synthetic polypeptide
DEEEIRTTNPVATEQYGSVSPTNMLQRDLNIE

SEQ ID NO: 20581 - protein, 32 aa, Artificial Sequence
  Description of Artificial Sequence: Synthetic polypeptide
DEEEIRTTNPVATEQYGSVSPTNMLQRDLLRQ

SEQ ID NO: 20582 - protein, 32 aa, Artificial Sequence
  Description of Artificial Sequence: Synthetic polypeptide
DEEEIRTTNPVATEPYGSVSVTNLSQAGGNNR

SEQ ID NO: 20583 - protein, 31 aa, Artificial Sequence
  Description of Artificial Sequence: Synthetic polypeptide
DEEEIRTTNPVATEQYGSVFNTTNLNGRGTR

SEQ ID NO: 20584 - protein, 32 aa, Artificial Sequence
  Description of Artificial Sequence: Synthetic polypeptide
DEEEIRTTNPVATEPYGSVSVTNMLSQHGNNR

SEQ ID NO: 20585 - protein, 29 aa, Artificial Sequence
  Description of Artificial Sequence: Synthetic peptide
DEEEIRTTNPVATEQYGSVSPMNIDRGDV

SEQ ID NO: 20586 - protein, 31 aa, Artificial Sequence
  Description of Artificial Sequence: Synthetic polypeptide
DEEEIRTTNPVATEQYGSVSPTNLVNGEERD

SEQ ID NO: 20587 - protein, 32 aa, Artificial Sequence
  Description of Artificial Sequence: Synthetic polypeptide
DEEEIRTTNPVATEQYGSVFSDTDLGQRSQNR

SEQ ID NO: 20588 - protein, 32 aa, Artificial Sequence
  Description of Artificial Sequence: Synthetic polypeptide
DEEAIRTTNPVATEQYGSVSTNNLQRSGSNDG

SEQ ID NO: 20589 - protein, 31 aa, Artificial Sequence
  Description of Artificial Sequence: Synthetic polypeptide
DEEAIRTTNPVATEQYGSVSTNNLQGGSNDD

SEQ ID NO: 20590 - protein, 32 aa, Artificial Sequence
  Description of Artificial Sequence: Synthetic polypeptide
DEEEIRTTNPVATEQYGSVSPTNLVRNGDQRE

SEQ ID NO: 20591 - protein, 28 aa, Artificial Sequence
  Description of Artificial Sequence: Synthetic peptide
DEEEIVTTNPVATEQYGSASENIQRGGA

SEQ ID NO: 20592 - protein, 29 aa, Artificial Sequence
  Description of Artificial Sequence: Synthetic peptide
DEEEIVTTNPVATEQYGIVSTVNDQEGER

SEQ ID NO: 20593 - protein, 31 aa, Artificial Sequence
  Description of Artificial Sequence: Synthetic polypeptide
DEEAIRTTNPVATEQYGSVSTNLGDDNGQNR

SEQ ID NO: 20594 - protein, 28 aa, Artificial Sequence
  Description of Artificial Sequence: Synthetic peptide
DEAEIRTTNPVATDIYGSVNTQLQRGND

SEQ ID NO: 20595 - protein, 29 aa, Artificial Sequence
  Description of Artificial Sequence: Synthetic peptide
DEEEIRTTNPVATEQWGTVVSTSLLRGNG

SEQ ID NO: 20596 - protein, 28 aa, Artificial Sequence
  Description of Artificial Sequence: Synthetic peptide
DEAEIRTTNPVATDQYGSVNMELQRGND

SEQ ID NO: 20597 - protein, 29 aa, Artificial Sequence
  Description of Artificial Sequence: Synthetic peptide
DDREIRTTNPVATEQYGCVSTNPLQYGDR

SEQ ID NO: 20598 - protein, 30 aa, Artificial Sequence
  Description of Artificial Sequence: Synthetic polypeptide
DEEEIRTTNPVATEQYGSVVTGMLQRGEDM

SEQ ID NO: 20599 - protein, 32 aa, Artificial Sequence
  Description of Artificial Sequence: Synthetic polypeptide
DEEEITTTNPVATEQYGSVSTNQLQEREGNPL

SEQ ID NO: 20600 - protein, 32 aa, Artificial Sequence
  Description of Artificial Sequence: Synthetic polypeptide
DEEEIRTTNPVATEPYGSVVPSTILSQRGGNR

SEQ ID NO: 20601 - protein, 31 aa, Artificial Sequence
  Description of Artificial Sequence: Synthetic polypeptide
DEEEIRTTNPVATEQYGSVSPTNLQTNTNNQ

SEQ ID NO: 20602 - protein, 31 aa, Artificial Sequence
  Description of Artificial Sequence: Synthetic polypeptide
DEEEISTTNPVAYEQYGSVATNLQDRGNDRQ

SEQ ID NO: 20603 - protein, 29 aa, Artificial Sequence
  Description of Artificial Sequence: Synthetic peptide
DEEEIRTTNPVATEQWGTSVSTELLRGES

SEQ ID NO: 20604 - protein, 31 aa, Artificial Sequence
  Description of Artificial Sequence: Synthetic polypeptide
DEEEISTTNPVAYEHYGSVSCTNLSQRPGNR

SEQ ID NO: 20605 - protein, 31 aa, Artificial Sequence
  Description of Artificial Sequence: Synthetic polypeptide
DEEEIRTTNPVATEFYGSVSTNLQMENGNNT

SEQ ID NO: 20606 - protein, 29 aa, Artificial Sequence
  Description of Artificial Sequence: Synthetic peptide
DEEEIRTTNPVATEQYGSVSANDQRNTEE

SEQ ID NO: 20607 - protein, 31 aa, Artificial Sequence
  Description of Artificial Sequence: Synthetic polypeptide
TEEEIRTTNPVAYEPYGSVSTTNLSQRGNRV

SEQ ID NO: 20608 - protein, 30 aa, Artificial Sequence
  Description of Artificial Sequence: Synthetic polypeptide
DEEEIRTTNPVATEQYGSVSVTVVQMGERN

SEQ ID NO: 20609 - protein, 29 aa, Artificial Sequence
  Description of Artificial Sequence: Synthetic peptide
DEEEISTTNPVATEQYGVVSTALQNSGNQ

SEQ ID NO: 20610 - protein, 32 aa, Artificial Sequence
  Description of Artificial Sequence: Synthetic polypeptide
DEEEIRTTNPVATEQYGSVSNTENLQYGSNFF

SEQ ID NO: 20611 - protein, 31 aa, Artificial Sequence
  Description of Artificial Sequence: Synthetic polypeptide
DEEEIRTTNPVATEFYGSVSTNLDQGTGNNS

SEQ ID NO: 20612 - protein, 30 aa, Artificial Sequence
  Description of Artificial Sequence: Synthetic polypeptide
DEEEIATTNPVATEPYGSVSTNLQQGNDFF

SEQ ID NO: 20613 - protein, 31 aa, Artificial Sequence
  Description of Artificial Sequence: Synthetic polypeptide
DEEEIRTTNPVATEQYGSVSVTWLYQGSQNR

SEQ ID NO: 20614 - protein, 29 aa, Artificial Sequence
  Description of Artificial Sequence: Synthetic peptide
DEEEIRTTNPVATEQWGTSVSTDLLKGNS

SEQ ID NO: 20615 - protein, 31 aa, Artificial Sequence
  Description of Artificial Sequence: Synthetic polypeptide
DEEEIRTTNPVATEQYGSVMPTNLQRNLERD

SEQ ID NO: 20616 - protein, 30 aa, Artificial Sequence
  Description of Artificial Sequence: Synthetic polypeptide
DEEEIRTTNPVATEQYGSVMNTPLQTGNVT

SEQ ID NO: 20617 - protein, 30 aa, Artificial Sequence
  Description of Artificial Sequence: Synthetic polypeptide
DEEEISTTNPVATEQYGVSVSTNHQSFGNQ

SEQ ID NO: 20618 - protein, 29 aa, Artificial Sequence
  Description of Artificial Sequence: Synthetic peptide
DEEEIRTTNPVATEQWGTSVSIHLLRGNS

SEQ ID NO: 20619 - protein, 29 aa, Artificial Sequence
  Description of Artificial Sequence: Synthetic peptide
DEEEIRTTNPVATEQYGSVMMGLQRGEEE

SEQ ID NO: 20620 - protein, 29 aa, Artificial Sequence
  Description of Artificial Sequence: Synthetic peptide
DEEEISTTNPVATEQYGTVSTYDQFGSNR

SEQ ID NO: 20621 - protein, 28 aa, Artificial Sequence
  Description of Artificial Sequence: Synthetic peptide
DEEEIRTTNPVATEQYGSVSANDQNSEG

SEQ ID NO: 20622 - protein, 30 aa, Artificial Sequence
  Description of Artificial Sequence: Synthetic polypeptide
DEEEIRTTNPVATEQWGTSVSDTGLLRGNS

SEQ ID NO: 20623 - protein, 30 aa, Artificial Sequence
  Description of Artificial Sequence: Synthetic polypeptide
TEEEIRTTNPVAYEQWGSVFTNELQRGGNR

SEQ ID NO: 20624 - protein, 32 aa, Artificial Sequence
  Description of Artificial Sequence: Synthetic polypeptide
DEEEIRTTNPVATEQYGSVVSTVNNLQVDDNR

SEQ ID NO: 20625 - protein, 30 aa, Artificial Sequence
  Description of Artificial Sequence: Synthetic polypeptide
DEEEIATTNPVATEPYGSVSTNLQQGDERM

SEQ ID NO: 20626 - protein, 30 aa, Artificial Sequence
  Description of Artificial Sequence: Synthetic polypeptide
TEEEIRTTNPVAYEPYGSVSCTHELQRGNR

SEQ ID NO: 20627 - protein, 30 aa, Artificial Sequence
  Description of Artificial Sequence: Synthetic polypeptide
DEEEIRTTNPVATEQWGTSVSTGELNRGNS

SEQ ID NO: 20628 - protein, 29 aa, Artificial Sequence
  Description of Artificial Sequence: Synthetic peptide
DEEEIRTTNPVATEQWGTVSTDGQRGNDQ

SEQ ID NO: 20629 - protein, 29 aa, Artificial Sequence
  Description of Artificial Sequence: Synthetic peptide
DEEEIRTTNPVATEQWGTVSENLQHGNVD

SEQ ID NO: 20630 - protein, 30 aa, Artificial Sequence
  Description of Artificial Sequence: Synthetic polypeptide
DEEEIATTNPVATEPYGSVSTNGGDQNGNR

SEQ ID NO: 20631 - protein, 30 aa, Artificial Sequence
  Description of Artificial Sequence: Synthetic polypeptide
DEEEIATTNPVATEPYGSVSTNGGQNNGNR

SEQ ID NO: 20632 - protein, 30 aa, Artificial Sequence
  Description of Artificial Sequence: Synthetic polypeptide
DEEEIRTTNPVATEQWGTSVSTYLLRGNDQ

SEQ ID NO: 20633 - protein, 29 aa, Artificial Sequence
  Description of Artificial Sequence: Synthetic peptide
DEEEIRTTNPVATEQWGTSVSTYGTRGNG

SEQ ID NO: 20634 - protein, 31 aa, Artificial Sequence
  Description of Artificial Sequence: Synthetic polypeptide
DEEEIRTTNPVATEFYGSVSTNLQNGTGNND

SEQ ID NO: 20635 - protein, 32 aa, Artificial Sequence
  Description of Artificial Sequence: Synthetic polypeptide
DEEEIRTTNPVATEQYGSVSPTNLQRPVNDFV

SEQ ID NO: 20636 - protein, 31 aa, Artificial Sequence
  Description of Artificial Sequence: Synthetic polypeptide
DEEEIRTTNPVATEQYGSVSVTVLQGGIDRQ

SEQ ID NO: 20637 - protein, 30 aa, Artificial Sequence
  Description of Artificial Sequence: Synthetic polypeptide
DEEEIRTTNPVATEQWGTSVSTLLLERGNS

SEQ ID NO: 20638 - protein, 33 aa, Artificial Sequence
  Description of Artificial Sequence: Synthetic polypeptide
DEEEIRTTNPVATEQYGSVSPTNLQRPINNERI

SEQ ID NO: 20639 - protein, 32 aa, Artificial Sequence
  Description of Artificial Sequence: Synthetic polypeptide
DEEEIRTTNPVATEQYGSVSVTVLQSREGENQ

SEQ ID NO: 20640 - protein, 30 aa, Artificial Sequence
  Description of Artificial Sequence: Synthetic polypeptide
DEEEIATTNPVATEPYGSVSTNLEDHGQNR

SEQ ID NO: 20641 - protein, 29 aa, Artificial Sequence
  Description of Artificial Sequence: Synthetic peptide
DEEEIRTTNPVATEQWGTSVSTLLIDGNS

SEQ ID NO: 20642 - protein, 32 aa, Artificial Sequence
  Description of Artificial Sequence: Synthetic polypeptide
DEEEIRTTNPVATEQYGSVSPTNLQRNIENII

SEQ ID NO: 20643 - protein, 28 aa, Artificial Sequence
  Description of Artificial Sequence: Synthetic peptide
DEEEITATNPVATEVYGSVGTPLQYGNR

SEQ ID NO: 20644 - protein, 30 aa, Artificial Sequence
  Description of Artificial Sequence: Synthetic polypeptide
DEEEIRTTNPVATEQWGTSVSTHLLRGGNS

SEQ ID NO: 20645 - protein, 30 aa, Artificial Sequence
  Description of Artificial Sequence: Synthetic polypeptide
DEEEIRTTNPVATEQYGSVQDVNDQRGNQI

SEQ ID NO: 20646 - protein, 32 aa, Artificial Sequence
  Description of Artificial Sequence: Synthetic polypeptide
DEEEIATTNPVATEPYGSVSTNLQERPGENRN

SEQ ID NO: 20647 - protein, 31 aa, Artificial Sequence
  Description of Artificial Sequence: Synthetic polypeptide
DEEEIRTTNPVATEQYGSVVSTWNLERNNDE

SEQ ID NO: 20648 - protein, 32 aa, Artificial Sequence
  Description of Artificial Sequence: Synthetic polypeptide
DEEEIRTTNPVATEQYGSVSPTNLQRILNPWE

SEQ ID NO: 20649 - protein, 30 aa, Artificial Sequence
  Description of Artificial Sequence: Synthetic polypeptide
DEEEISTTNPVAYEQYGSVSTTNLQRGSQQ

SEQ ID NO: 20650 - protein, 31 aa, Artificial Sequence
  Description of Artificial Sequence: Synthetic polypeptide
DEEEISTTNPVAYEQYGSVSTNSLQERTGNL

SEQ ID NO: 20651 - protein, 31 aa, Artificial Sequence
  Description of Artificial Sequence: Synthetic polypeptide
DEEEIRTTNPVATEQYGSVSPTNMQRQDVNE

SEQ ID NO: 20652 - protein, 31 aa, Artificial Sequence
  Description of Artificial Sequence: Synthetic polypeptide
DEEEIRTTNPVATEPYGSVSTTTNLTQGGNV

SEQ ID NO: 20653 - protein, 31 aa, Artificial Sequence
  Description of Artificial Sequence: Synthetic polypeptide
TEEEIRTTNPVATESYGSVSCTNLSQSGGNR

SEQ ID NO: 20654 - protein, 30 aa, Artificial Sequence
  Description of Artificial Sequence: Synthetic polypeptide
TEEEIRTTNPVATESYGSVSCTNLSGGGNR

SEQ ID NO: 20655 - protein, 28 aa, Artificial Sequence
  Description of Artificial Sequence: Synthetic peptide
DEEEVRTTNPVATELYGSVSENDQQGND

SEQ ID NO: 20656 - protein, 31 aa, Artificial Sequence
  Description of Artificial Sequence: Synthetic polypeptide
DEEEIRTTNPVATEQYGSVETTQLQRGNEDI

SEQ ID NO: 20657 - protein, 28 aa, Artificial Sequence
  Description of Artificial Sequence: Synthetic peptide
AEEEIRATNPCATEQYGSVSENLERGNS

SEQ ID NO: 20658 - protein, 30 aa, Artificial Sequence
  Description of Artificial Sequence: Synthetic polypeptide
DEEEIRTTNPVATEQYGAVSDTNLNQGGET

SEQ ID NO: 20659 - protein, 29 aa, Artificial Sequence
  Description of Artificial Sequence: Synthetic peptide
AEEEINSTNPVAYEQYGSVSTNLQRGELR

SEQ ID NO: 20660 - protein, 31 aa, Artificial Sequence
  Description of Artificial Sequence: Synthetic polypeptide
DEEEIRTTNPVATEQYGSVSVTNPQNSGENQ

SEQ ID NO: 20661 - protein, 32 aa, Artificial Sequence
  Description of Artificial Sequence: Synthetic polypeptide
DEEEIRTTNPVATEPYGSVSCTNLQSPGGNNR

SEQ ID NO: 20662 - protein, 31 aa, Artificial Sequence
  Description of Artificial Sequence: Synthetic polypeptide
DEEEIRTTNPVATEQYGSVSPTNNQIQINER

SEQ ID NO: 20663 - protein, 31 aa, Artificial Sequence
  Description of Artificial Sequence: Synthetic polypeptide
DEEEIRTTNPVATEPYGSVSCTNLSGGTGNR

SEQ ID NO: 20664 - protein, 31 aa, Artificial Sequence
  Description of Artificial Sequence: Synthetic polypeptide
DEEEIRTTNPVATEPYGSVSCTNLSGRGGNS

SEQ ID NO: 20665 - protein, 31 aa, Artificial Sequence
  Description of Artificial Sequence: Synthetic polypeptide
DEEEIRTTNPVATEQYGSVSPTNNQRLNEPG

SEQ ID NO: 20666 - protein, 32 aa, Artificial Sequence
  Description of Artificial Sequence: Synthetic polypeptide
DEEEIRTTNPVATEPYGSVSCTNLSVRGGDNR

SEQ ID NO: 20667 - protein, 30 aa, Artificial Sequence
  Description of Artificial Sequence: Synthetic polypeptide
DEEEIRTTNPVATTQYGSVTGTNLQGGENQ

SEQ ID NO: 20668 - protein, 31 aa, Artificial Sequence
  Description of Artificial Sequence: Synthetic polypeptide
DEEEIRTTNPVATEQYGSVSNTGLGQNSTNR

SEQ ID NO: 20669 - protein, 30 aa, Artificial Sequence
  Description of Artificial Sequence: Synthetic polypeptide
TEEEIRTTNPVATEQYGSVSTNLQRNPEFY

SEQ ID NO: 20670 - protein, 31 aa, Artificial Sequence
  Description of Artificial Sequence: Synthetic polypeptide
DEEEIRTTNPVATEPYGSVSTGNHSQRPVNR

SEQ ID NO: 20671 - protein, 32 aa, Artificial Sequence
  Description of Artificial Sequence: Synthetic polypeptide
DEEEIRTTNPVATEQYGSVVTISTNLLQAGNI

SEQ ID NO: 20672 - protein, 31 aa, Artificial Sequence
  Description of Artificial Sequence: Synthetic polypeptide
TEEEIRTTNPVATEQYGSVSTNLSDSGGNRC

SEQ ID NO: 20673 - protein, 31 aa, Artificial Sequence
  Description of Artificial Sequence: Synthetic polypeptide
DEEEIRTTNPVATEQYGSVSPTNNQGNGERA

SEQ ID NO: 20674 - protein, 29 aa, Artificial Sequence
  Description of Artificial Sequence: Synthetic peptide
DEEEIRTTNPVATEQYGSVSPLLLERTER

SEQ ID NO: 20675 - protein, 30 aa, Artificial Sequence
  Description of Artificial Sequence: Synthetic polypeptide
TEEEIRTTNPVATEQYGSVSTNLSQPVNNP

SEQ ID NO: 20676 - protein, 32 aa, Artificial Sequence
  Description of Artificial Sequence: Synthetic polypeptide
DEEEIRTTNPVATEPYGSVSTGNLSQRVNVRP

SEQ ID NO: 20677 - protein, 31 aa, Artificial Sequence
  Description of Artificial Sequence: Synthetic polypeptide
DEEEIRTTNPVATEQYGAVISTNLQYNEGND

SEQ ID NO: 20678 - protein, 31 aa, Artificial Sequence
  Description of Artificial Sequence: Synthetic polypeptide
DEEEIRTTNPVATEQYGSVSNTGLQRDQEER

SEQ ID NO: 20679 - protein, 30 aa, Artificial Sequence
  Description of Artificial Sequence: Synthetic polypeptide
DEEEIRTTNPVATEQYGAVSGNLIQGIGNE

SEQ ID NO: 20680 - protein, 30 aa, Artificial Sequence
  Description of Artificial Sequence: Synthetic polypeptide
DEEEVRTTNPVATEQYGMVISTMNEQQGNR

SEQ ID NO: 20681 - protein, 28 aa, Artificial Sequence
  Description of Artificial Sequence: Synthetic peptide
DEEGIRTTNPVATEQYGCVSTNEGNGNI

SEQ ID NO: 20682 - protein, 32 aa, Artificial Sequence
  Description of Artificial Sequence: Synthetic polypeptide
TEEEIRTTNPVATEQYGSVSTNELSTRTGNER

SEQ ID NO: 20683 - protein, 28 aa, Artificial Sequence
  Description of Artificial Sequence: Synthetic peptide
YEEEIATTNPVATEQYGDVSDNLQSGNQ

SEQ ID NO: 20684 - protein, 30 aa, Artificial Sequence
  Description of Artificial Sequence: Synthetic polypeptide
DEEGIRTTNPVATEQWGSVATNNLQQGPNR

SEQ ID NO: 20685 - protein, 30 aa, Artificial Sequence
  Description of Artificial Sequence: Synthetic polypeptide
DEEGIRTTNPVATEQWGSVATNNLQLGQNR

SEQ ID NO: 20686 - protein, 30 aa, Artificial Sequence
  Description of Artificial Sequence: Synthetic polypeptide
DEEGIRTTNPVATEQWGSVATNNLQGGGNR

SEQ ID NO: 20687 - protein, 30 aa, Artificial Sequence
  Description of Artificial Sequence: Synthetic polypeptide
DEEEIRTTNPVATEQYGAVSITDNLITGNW

SEQ ID NO: 20688 - protein, 30 aa, Artificial Sequence
  Description of Artificial Sequence: Synthetic polypeptide
DEEGIRTTNPVATEPYGTVTTNLQRGGNRD

SEQ ID NO: 20689 - protein, 31 aa, Artificial Sequence
  Description of Artificial Sequence: Synthetic polypeptide
DEEEIRTTNPVATEPYGSVPFTNLTRTGNPR

SEQ ID NO: 20690 - protein, 29 aa, Artificial Sequence
  Description of Artificial Sequence: Synthetic peptide
DEEGIRTTNPVATEIYGAVTTNLQVGSNR

SEQ ID NO: 20691 - protein, 30 aa, Artificial Sequence
  Description of Artificial Sequence: Synthetic polypeptide
YEEEIATTNPLVATEQYGSVSTNLVRGERA

SEQ ID NO: 20692 - protein, 30 aa, Artificial Sequence
  Description of Artificial Sequence: Synthetic polypeptide
DEEGIRTTNPVATEAYGQVTTNLQRAGSNR

SEQ ID NO: 20693 - protein, 29 aa, Artificial Sequence
  Description of Artificial Sequence: Synthetic peptide
DEEFIRTTNPVATEQYGCVSTNNCQGGNC

SEQ ID NO: 20694 - protein, 30 aa, Artificial Sequence
  Description of Artificial Sequence: Synthetic polypeptide
DEEEIRTTNPVATEPYGSVPFTNLTSAGNR

SEQ ID NO: 20695 - protein, 28 aa, Artificial Sequence
  Description of Artificial Sequence: Synthetic peptide
DEEEVRTTNPVATFTYGSVANNLQDGNR

SEQ ID NO: 20696 - protein, 31 aa, Artificial Sequence
  Description of Artificial Sequence: Synthetic polypeptide
DEEEIRTTNPVATEPYGSVPSCTNLSTGGNR

SEQ ID NO: 20697 - protein, 32 aa, Artificial Sequence
  Description of Artificial Sequence: Synthetic polypeptide
DEEEIRTTNPVATEPYGSVPSCTNLTRGTNNR

SEQ ID NO: 20698 - protein, 31 aa, Artificial Sequence
  Description of Artificial Sequence: Synthetic polypeptide
DEEEIRTTNPVATEQYGSVSPTNNQRTENLD

SEQ ID NO: 20699 - protein, 32 aa, Artificial Sequence
  Description of Artificial Sequence: Synthetic polypeptide
DEEEIRTTNPVATEQYGSVSNTGLQRDQLNRV

SEQ ID NO: 20700 - protein, 30 aa, Artificial Sequence
  Description of Artificial Sequence: Synthetic polypeptide
TEEEIRTTNPVATEQYGSVSTNLQNGSDQI

SEQ ID NO: 20701 - protein, 33 aa, Artificial Sequence
  Description of Artificial Sequence: Synthetic polypeptide
DEEEIRTTNPVATEPYGSVSCTENLSQRGTNNR

SEQ ID NO: 20702 - protein, 33 aa, Artificial Sequence
  Description of Artificial Sequence: Synthetic polypeptide
DEEEIRTTNPVATEQYGSVSVTNPLDDRGNVRE

SEQ ID NO: 20703 - protein, 33 aa, Artificial Sequence
  Description of Artificial Sequence: Synthetic polypeptide
DEEEIRTTNPVATEPYGSVSCTNALQRTGNNRV

SEQ ID NO: 20704 - protein, 31 aa, Artificial Sequence
  Description of Artificial Sequence: Synthetic polypeptide
TEEEIRTTNPVATEQYGSVSTNMFSQSGGNR

SEQ ID NO: 20705 - protein, 32 aa, Artificial Sequence
  Description of Artificial Sequence: Synthetic polypeptide
TEEEIRTTNPVATEQYGSVSTNELSQRTGNNE

SEQ ID NO: 20706 - protein, 30 aa, Artificial Sequence
  Description of Artificial Sequence: Synthetic polypeptide
DEEEIRTTNPVATEQYGSVSPTNNQELESR

SEQ ID NO: 20707 - protein, 29 aa, Artificial Sequence
  Description of Artificial Sequence: Synthetic peptide
DDNEIRTTNPVATEQWGSVTSTLLQRGTR

SEQ ID NO: 20708 - protein, 31 aa, Artificial Sequence
  Description of Artificial Sequence: Synthetic polypeptide
TEEEIRTTNPVATEQYGSVVSTNQSQRGGNE

SEQ ID NO: 20709 - protein, 33 aa, Artificial Sequence
  Description of Artificial Sequence: Synthetic polypeptide
DEEEIRTTNPVATEQYGASVCSTNGLTRGSNRL

SEQ ID NO: 20710 - protein, 30 aa, Artificial Sequence
  Description of Artificial Sequence: Synthetic polypeptide
DEEEIRTTNPVATEPYGSVSTTNLTIGGNT

SEQ ID NO: 20711 - protein, 31 aa, Artificial Sequence
  Description of Artificial Sequence: Synthetic polypeptide
DEEEIRTTNPVATEQYGSVSANLQASGSNQS

SEQ ID NO: 20712 - protein, 33 aa, Artificial Sequence
  Description of Artificial Sequence: Synthetic polypeptide
DEEEIRTTNPVATEQYGSVSPTNNEQRGEENRM

SEQ ID NO: 20713 - protein, 31 aa, Artificial Sequence
  Description of Artificial Sequence: Synthetic polypeptide
DEEEIRTTNPVATEPYGSVSTTNLTLGGQNR

SEQ ID NO: 20714 - protein, 30 aa, Artificial Sequence
  Description of Artificial Sequence: Synthetic polypeptide
DEEEIRTTNPVATEQYGSVSPMIQRGENLN

SEQ ID NO: 20715 - protein, 31 aa, Artificial Sequence
  Description of Artificial Sequence: Synthetic polypeptide
DEEEIRTTNPVATEQYGSVSVTPLLQGRLQR

SEQ ID NO: 20716 - protein, 30 aa, Artificial Sequence
  Description of Artificial Sequence: Synthetic polypeptide
DEEEIVTTNPVATEQYGTVCSTNLVQSGNQ

SEQ ID NO: 20717 - protein, 32 aa, Artificial Sequence
  Description of Artificial Sequence: Synthetic polypeptide
DEEEIRTTNPVATEQYGSVSVTPLVQRGDEPR

SEQ ID NO: 20718 - protein, 32 aa, Artificial Sequence
  Description of Artificial Sequence: Synthetic polypeptide
TEEEIRTTNPVATEQYGSVVSTNLSQRPGTNQ

SEQ ID NO: 20719 - protein, 32 aa, Artificial Sequence
  Description of Artificial Sequence: Synthetic polypeptide
DEEEIRTTNPVATEQYGSVQCTNLQRGELNVA

SEQ ID NO: 20720 - protein, 29 aa, Artificial Sequence
  Description of Artificial Sequence: Synthetic peptide
DEEEIRTTNPVATEQYGSVSPMLQIGPAF

SEQ ID NO: 20721 - protein, 32 aa, Artificial Sequence
  Description of Artificial Sequence: Synthetic polypeptide
TEEEIRTTNPVATEQYGTVSCTNLQRGGNNRW

SEQ ID NO: 20722 - protein, 32 aa, Artificial Sequence
  Description of Artificial Sequence: Synthetic polypeptide
TEEEIRTTNPVATEQYGTVSCTNLSQRGGNER

SEQ ID NO: 20723 - protein, 33 aa, Artificial Sequence
  Description of Artificial Sequence: Synthetic polypeptide
DEEEIRTTNPVATEQYGSVSPTNNELQRGNVLQ

SEQ ID NO: 20724 - protein, 33 aa, Artificial Sequence
  Description of Artificial Sequence: Synthetic polypeptide
DEEEIRTTNPVATEQYGSVFCTPNELQRGNNRV

SEQ ID NO: 20725 - protein, 29 aa, Artificial Sequence
  Description of Artificial Sequence: Synthetic peptide
DEEEIRTTNPVAVEQYGSVNTNLQVNDIR

SEQ ID NO: 20726 - protein, 29 aa, Artificial Sequence
  Description of Artificial Sequence: Synthetic peptide
DEEEIRTTNPVATEQYGSVSPTNNELGLQ

SEQ ID NO: 20727 - protein, 31 aa, Artificial Sequence
  Description of Artificial Sequence: Synthetic polypeptide
TEEEIRTTNPVATEQYGVVSTNLSQRVGNYT

SEQ ID NO: 20728 - protein, 31 aa, Artificial Sequence
  Description of Artificial Sequence: Synthetic polypeptide
TEEEIRTTNPVATERYGSVSCTNLQRGGSNG

SEQ ID NO: 20729 - protein, 32 aa, Artificial Sequence
  Description of Artificial Sequence: Synthetic polypeptide
TEEEIRTTNPVATERYGSVSTNLSQERGGNRD

SEQ ID NO: 20730 - protein, 31 aa, Artificial Sequence
  Description of Artificial Sequence: Synthetic polypeptide
DEEEIRTTNPVATEQYGSVEVTTNLYGRGTR

SEQ ID NO: 20731 - protein, 33 aa, Artificial Sequence
  Description of Artificial Sequence: Synthetic polypeptide
TEEEIRTTNPVATEQYGSVVSTNALAQRTGNNR

SEQ ID NO: 20732 - protein, 32 aa, Artificial Sequence
  Description of Artificial Sequence: Synthetic polypeptide
TEEEIRTTNPVATEQYGSVVSTGNLSQRPGDR

SEQ ID NO: 20733 - protein, 32 aa, Artificial Sequence
  Description of Artificial Sequence: Synthetic polypeptide
DEEEIRTTNPVATEQYGSVSPTNNLDQRGVVE

SEQ ID NO: 20734 - protein, 31 aa, Artificial Sequence
  Description of Artificial Sequence: Synthetic polypeptide
TEEEIRTTNPVATEQYGSVSTPLSQSGGNRE

SEQ ID NO: 20735 - protein, 32 aa, Artificial Sequence
  Description of Artificial Sequence: Synthetic polypeptide
TEEEIRTTNPVATEQYGSVSTQNETSQRGGNR

SEQ ID NO: 20736 - protein, 32 aa, Artificial Sequence
  Description of Artificial Sequence: Synthetic polypeptide
TEEEIRTTNPVATEQYGSVSTSNEEQRGENNR

SEQ ID NO: 20737 - protein, 29 aa, Artificial Sequence
  Description of Artificial Sequence: Synthetic peptide
DEEAIRTTNPVATEQYSAEVSTNLQIGDR

SEQ ID NO: 20738 - protein, 32 aa, Artificial Sequence
  Description of Artificial Sequence: Synthetic polypeptide
TEEEIRTTNPVATEQYGSVSTSNLDQHGENDR

SEQ ID NO: 20739 - protein, 32 aa, Artificial Sequence
  Description of Artificial Sequence: Synthetic polypeptide
DEEEIRTTNPVATEQYGSVSPTNNLQRILERD

SEQ ID NO: 20740 - protein, 33 aa, Artificial Sequence
  Description of Artificial Sequence: Synthetic polypeptide
TEEEIRTTNPVATEQYGSVSTVNLNQRFGSNNR

SEQ ID NO: 20741 - protein, 31 aa, Artificial Sequence
  Description of Artificial Sequence: Synthetic polypeptide
DEEEIRTTNPVATEPYGSVSTNLQETGGNNE

SEQ ID NO: 20742 - protein, 32 aa, Artificial Sequence
  Description of Artificial Sequence: Synthetic polypeptide
DEEEIRTTNPVATEQYGSVSPTNNLQRIGLQE

SEQ ID NO: 20743 - protein, 31 aa, Artificial Sequence
  Description of Artificial Sequence: Synthetic polypeptide
DEEEIYTTNPVATEQYGSVSTNSLFQVRGED

SEQ ID NO: 20744 - protein, 33 aa, Artificial Sequence
  Description of Artificial Sequence: Synthetic polypeptide
TEEEIRTTNPVATEQYGSVSYTGNLSQRGGNYR

SEQ ID NO: 20745 - protein, 31 aa, Artificial Sequence
  Description of Artificial Sequence: Synthetic polypeptide
TEEEIRTTNPVATEQYGSVSYTNLQPGGNNA

SEQ ID NO: 20746 - protein, 32 aa, Artificial Sequence
  Description of Artificial Sequence: Synthetic polypeptide
TEEEIRTTNPVATEQYGSVSYTNLQRAGGNNS

SEQ ID NO: 20747 - protein, 32 aa, Artificial Sequence
  Description of Artificial Sequence: Synthetic polypeptide
TEEEIRTTNPVATEQYGSVSYTNLQRGGNNQW

SEQ ID NO: 20748 - protein, 32 aa, Artificial Sequence
  Description of Artificial Sequence: Synthetic polypeptide
TEEEIRTTNPVATEQYGSVSYTNLSQRGGNNE

SEQ ID NO: 20749 - protein, 32 aa, Artificial Sequence
  Description of Artificial Sequence: Synthetic polypeptide
TEEEIRTTNPVATEQYGSVSYTNLTRGGNNRP

SEQ ID NO: 20750 - protein, 32 aa, Artificial Sequence
  Description of Artificial Sequence: Synthetic polypeptide
TEEEIRTTNPVATEQYGSVSYTNMSQRGTNNR

SEQ ID NO: 20751 - protein, 29 aa, Artificial Sequence
  Description of Artificial Sequence: Synthetic peptide
TEEEIRTTNPVATEQYGSVTGTALQNGDR

SEQ ID NO: 20752 - protein, 32 aa, Artificial Sequence
  Description of Artificial Sequence: Synthetic polypeptide
DEEEIRTTNPVATEQYGSVSNNDLQRGQNDVN

SEQ ID NO: 20753 - protein, 31 aa, Artificial Sequence
  Description of Artificial Sequence: Synthetic polypeptide
DEEEIRTTNPVATEQYGSVSPLLQRPGENGL

SEQ ID NO: 20754 - protein, 31 aa, Artificial Sequence
  Description of Artificial Sequence: Synthetic polypeptide
DEEEIYTTNPVATEPYGSVCSTNLQHFGSNR

SEQ ID NO: 20755 - protein, 31 aa, Artificial Sequence
  Description of Artificial Sequence: Synthetic polypeptide
DEEEIRTTNPVATEQYGSVSPTNNLETGEQR

SEQ ID NO: 20756 - protein, 31 aa, Artificial Sequence
  Description of Artificial Sequence: Synthetic polypeptide
DEEEIRTTNPVATEQYGSVSVTNVQNSGENE

SEQ ID NO: 20757 - protein, 32 aa, Artificial Sequence
  Description of Artificial Sequence: Synthetic polypeptide
DEEEIRTTNPVATEPYGSVSTGNSSQRGGNRI

SEQ ID NO: 20758 - protein, 28 aa, Artificial Sequence
  Description of Artificial Sequence: Synthetic peptide
DEEEIRTTNPVATEQYGSVDTDLQMEEW

SEQ ID NO: 20759 - protein, 29 aa, Artificial Sequence
  Description of Artificial Sequence: Synthetic peptide
DEEEIRTTNPVATEQYGSVETMELQRNDE

SEQ ID NO: 20760 - protein, 30 aa, Artificial Sequence
  Description of Artificial Sequence: Synthetic polypeptide
DEAEIRTTNPVATEQYGSVATNAQRDGNES

SEQ ID NO: 20761 - protein, 32 aa, Artificial Sequence
  Description of Artificial Sequence: Synthetic polypeptide
DEEEIRTTNPVATEPYGQSVSTNLSTRGGNDR

SEQ ID NO: 20762 - protein, 31 aa, Artificial Sequence
  Description of Artificial Sequence: Synthetic polypeptide
DEEEIRTTNPVATETYGSVSTNLQSGGNIED

SEQ ID NO: 20763 - protein, 31 aa, Artificial Sequence
  Description of Artificial Sequence: Synthetic polypeptide
DEEEIRTTNPVATEQYGSVSNTNDEQVGNLE

SEQ ID NO: 20764 - protein, 30 aa, Artificial Sequence
  Description of Artificial Sequence: Synthetic polypeptide
DEEEIRTTNPVATEQYGSVSVTDLQRDLVE

SEQ ID NO: 20765 - protein, 31 aa, Artificial Sequence
  Description of Artificial Sequence: Synthetic polypeptide
DEEEIRTTNPVATEQYGSVSVTDLQRLLQTR

SEQ ID NO: 20766 - protein, 30 aa, Artificial Sequence
  Description of Artificial Sequence: Synthetic polypeptide
DEEEIRTTNPVATEQYGSVSVTDLQRLQEN

SEQ ID NO: 20767 - protein, 32 aa, Artificial Sequence
  Description of Artificial Sequence: Synthetic polypeptide
TEEEIRTTNPVATEQYGSHVSTNELDQTGGNR

SEQ ID NO: 20768 - protein, 30 aa, Artificial Sequence
  Description of Artificial Sequence: Synthetic polypeptide
DEEEIRTTNPVATEQYGSVEPTLLQRINED

SEQ ID NO: 20769 - protein, 32 aa, Artificial Sequence
  Description of Artificial Sequence: Synthetic polypeptide
DEEEIRTTNPVATEQYGSVEPTMGLQRGNQRQ

SEQ ID NO: 20770 - protein, 31 aa, Artificial Sequence
  Description of Artificial Sequence: Synthetic polypeptide
DEEEIRTTNPVATEQYGSVQCNTNLQLGLRE

SEQ ID NO: 20771 - protein, 29 aa, Artificial Sequence
  Description of Artificial Sequence: Synthetic peptide
TEEEIRTTNPVATEQYGSHSCTHLQRQGR

SEQ ID NO: 20772 - protein, 31 aa, Artificial Sequence
  Description of Artificial Sequence: Synthetic polypeptide
DEEEIRTTNPVATEQYGSVEPTMMLQRGVDR

SEQ ID NO: 20773 - protein, 31 aa, Artificial Sequence
  Description of Artificial Sequence: Synthetic polypeptide
DEEEIRTTNPVATEQYGSVSVTDSLQRADRD

SEQ ID NO: 20774 - protein, 32 aa, Artificial Sequence
  Description of Artificial Sequence: Synthetic polypeptide
DEEEIRTTNPVATEQYGSVSNTNDDQEGGNRD

SEQ ID NO: 20775 - protein, 28 aa, Artificial Sequence
  Description of Artificial Sequence: Synthetic peptide
AEEEIRGTNPCATEQYGSVSENLMRGNI

SEQ ID NO: 20776 - protein, 31 aa, Artificial Sequence
  Description of Artificial Sequence: Synthetic polypeptide
DEEEIRTTNPVATEQYGSVSVTEGDPQRGVR

SEQ ID NO: 20777 - protein, 31 aa, Artificial Sequence
  Description of Artificial Sequence: Synthetic polypeptide
DEEEIRTTNPVATEQYGSVEPTNGLQRGLAQ

SEQ ID NO: 20778 - protein, 31 aa, Artificial Sequence
  Description of Artificial Sequence: Synthetic polypeptide
DEEEIRTTNPVATEQYGSVEPTNGLQRGQGT

SEQ ID NO: 20779 - protein, 33 aa, Artificial Sequence
  Description of Artificial Sequence: Synthetic polypeptide
DEEEIRTTNPVATEQYGSVSVTEGLQRGENQRT

SEQ ID NO: 20780 - protein, 29 aa, Artificial Sequence
  Description of Artificial Sequence: Synthetic peptide
DEESIATTNPVATEAYGSVGTNGLQRGNL

SEQ ID NO: 20781 - protein, 31 aa, Artificial Sequence
  Description of Artificial Sequence: Synthetic polypeptide
DEEEIRTTNPVATEQYGSVSPTTLLQLGDRE

SEQ ID NO: 20782 - protein, 31 aa, Artificial Sequence
  Description of Artificial Sequence: Synthetic polypeptide
DEEEIRTTNPVATEQYGSVEPTNLDQRGPQD

SEQ ID NO: 20783 - protein, 29 aa, Artificial Sequence
  Description of Artificial Sequence: Synthetic peptide
DEEEIRTTNPVATEQYGSVSVTDSEGENR

SEQ ID NO: 20784 - protein, 31 aa, Artificial Sequence
  Description of Artificial Sequence: Synthetic polypeptide
DEEEIRTTNPVATEQYGSVSANLQTGGTNGQ

SEQ ID NO: 20785 - protein, 30 aa, Artificial Sequence
  Description of Artificial Sequence: Synthetic polypeptide
DEEEIRTTNPVATEQYGSVEPTAILQRGLT

SEQ ID NO: 20786 - protein, 30 aa, Artificial Sequence
  Description of Artificial Sequence: Synthetic polypeptide
DEEEIRTTNPVATEQYGSVEPNLERGPIRE

SEQ ID NO: 20787 - protein, 30 aa, Artificial Sequence
  Description of Artificial Sequence: Synthetic polypeptide
DEEEIRTTNPVATEQYGSVSPELNQRGDDQ

SEQ ID NO: 20788 - protein, 30 aa, Artificial Sequence
  Description of Artificial Sequence: Synthetic polypeptide
DEEEIRTTNPVATEQYGSVENTNEQVGNFD

SEQ ID NO: 20789 - protein, 31 aa, Artificial Sequence
  Description of Artificial Sequence: Synthetic polypeptide
DEEEIRTTNPVATEQYGSVSVSVNLQRNSNI

SEQ ID NO: 20790 - protein, 30 aa, Artificial Sequence
  Description of Artificial Sequence: Synthetic polypeptide
DEEEIRTTNPVATEQYGSVENTNMQAGNII

SEQ ID NO: 20791 - protein, 32 aa, Artificial Sequence
  Description of Artificial Sequence: Synthetic polypeptide
DEEEIRTTNPVATEQYGSVSPTTNLERGFTNV

SEQ ID NO: 20792 - protein, 31 aa, Artificial Sequence
  Description of Artificial Sequence: Synthetic polypeptide
DEEEIRTTNPVATEQYGSVSVSYNLQRSENI

SEQ ID NO: 20793 - protein, 31 aa, Artificial Sequence
  Description of Artificial Sequence: Synthetic polypeptide
DEEEIRTTNPVATEQYGSVVTNNDRNGNVRN

SEQ ID NO: 20794 - protein, 32 aa, Artificial Sequence
  Description of Artificial Sequence: Synthetic polypeptide
DEEEIRTTNPVATEQYGSVENTTNLQRNENRE

SEQ ID NO: 20795 - protein, 29 aa, Artificial Sequence
  Description of Artificial Sequence: Synthetic peptide
DEEEIATTNPVATEIWGSVSTNLQRGMDG

SEQ ID NO: 20796 - protein, 31 aa, Artificial Sequence
  Description of Artificial Sequence: Synthetic polypeptide
DEEEIRTTNPVATEQYGSVSVSYNLQRVNSI

SEQ ID NO: 20797 - protein, 31 aa, Artificial Sequence
  Description of Artificial Sequence: Synthetic polypeptide
DEEEIRTTNPVATEQYGSVSNTNDLGRQLER

SEQ ID NO: 20798 - protein, 29 aa, Artificial Sequence
  Description of Artificial Sequence: Synthetic peptide
DEEEIRTTNPVATEQYGSVSANYQRNEME

SEQ ID NO: 20799 - protein, 32 aa, Artificial Sequence
  Description of Artificial Sequence: Synthetic polypeptide
TEEEIRTTNPVATEQYGQSVSTANLSQRPTNR

SEQ ID NO: 20800 - protein, 31 aa, Artificial Sequence
  Description of Artificial Sequence: Synthetic polypeptide
DEESIATTNPVATEQYGESVSINLQRDGDNR

SEQ ID NO: 20801 - protein, 31 aa, Artificial Sequence
  Description of Artificial Sequence: Synthetic polypeptide
TEEEIRTTNPVATEQYGQSVSTNLQNGSNQT

SEQ ID NO: 20802 - protein, 30 aa, Artificial Sequence
  Description of Artificial Sequence: Synthetic polypeptide
DEEEIRTTNPVATEQYGSVEPMNLQRNNTE

SEQ ID NO: 20803 - protein, 30 aa, Artificial Sequence
  Description of Artificial Sequence: Synthetic polypeptide
DEEEIRTTNPVATEQYGSVSPELQRGSDDP

SEQ ID NO: 20804 - protein, 31 aa, Artificial Sequence
  Description of Artificial Sequence: Synthetic polypeptide
DEEEIRTTNPVATEPYGNSVCFTNLTRQGNR

SEQ ID NO: 20805 - protein, 31 aa, Artificial Sequence
  Description of Artificial Sequence: Synthetic polypeptide
DEEEIRTTNPVATEQYGSVSANPQERGNDQM

SEQ ID NO: 20806 - protein, 29 aa, Artificial Sequence
  Description of Artificial Sequence: Synthetic peptide
DEESIATTNPVATEMYGSVNTNTLQRGNM

SEQ ID NO: 20807 - protein, 30 aa, Artificial Sequence
  Description of Artificial Sequence: Synthetic polypeptide
DEEEIRTTNPVATEQYGSVEPNGLQRGGTM

SEQ ID NO: 20808 - protein, 28 aa, Artificial Sequence
  Description of Artificial Sequence: Synthetic peptide
DEAEIRTTNPVAAEQYGSISTNSERLNR

SEQ ID NO: 20809 - protein, 30 aa, Artificial Sequence
  Description of Artificial Sequence: Synthetic polypeptide
DEEEIRTTNPVATEQYGSVEPANLQRENQY

SEQ ID NO: 20810 - protein, 31 aa, Artificial Sequence
  Description of Artificial Sequence: Synthetic polypeptide
DEEEIRTTNPVATEQYGSVEPTNLERGVSRQ

SEQ ID NO: 20811 - protein, 28 aa, Artificial Sequence
  Description of Artificial Sequence: Synthetic peptide
DEESIACTNPVATEQYGSVSNNGQRGNL

SEQ ID NO: 20812 - protein, 28 aa, Artificial Sequence
  Description of Artificial Sequence: Synthetic peptide
YEEEIRSVNPVATEQYGVVSDNLQRGNQ

SEQ ID NO: 20813 - protein, 28 aa, Artificial Sequence
  Description of Artificial Sequence: Synthetic peptide
DEECNRTTNPIAYEQYGTVSTNLQMGNR

SEQ ID NO: 20814 - protein, 31 aa, Artificial Sequence
  Description of Artificial Sequence: Synthetic polypeptide
DEEEIRTTNPVATEQYGSVEPTWLEQRSQNR

SEQ ID NO: 20815 - protein, 32 aa, Artificial Sequence
  Description of Artificial Sequence: Synthetic polypeptide
DEEEIRTTNPVATEQYGSVSNTMNLQGESGNV

SEQ ID NO: 20816 - protein, 29 aa, Artificial Sequence
  Description of Artificial Sequence: Synthetic peptide
DEEQIRTTNPVATEQYGSVSWTDEDRGNT

SEQ ID NO: 20817 - protein, 30 aa, Artificial Sequence
  Description of Artificial Sequence: Synthetic polypeptide
DEEEIRTTNPVATEPYGSVATNLQQGNEHN

SEQ ID NO: 20818 - protein, 28 aa, Artificial Sequence
  Description of Artificial Sequence: Synthetic peptide
DEEQIRTTNPVATEQYGSVSTYELSGNQ

SEQ ID NO: 20819 - protein, 31 aa, Artificial Sequence
  Description of Artificial Sequence: Synthetic polypeptide
DEEEIRTTNPVATEQYGSVSNDNSLQGGNNE

SEQ ID NO: 20820 - protein, 29 aa, Artificial Sequence
  Description of Artificial Sequence: Synthetic peptide
DEEQIRTTNPVATEQYGSVSTVVELRGNT

SEQ ID NO: 20821 - protein, 31 aa, Artificial Sequence
  Description of Artificial Sequence: Synthetic polypeptide
DEEEIRTTNPVATEPYGSVCATNLARGGNRM

SEQ ID NO: 20822 - protein, 29 aa, Artificial Sequence
  Description of Artificial Sequence: Synthetic peptide
DEEQIRTTNPVATEQYGSVSTVSEARGNT

SEQ ID NO: 20823 - protein, 30 aa, Artificial Sequence
  Description of Artificial Sequence: Synthetic polypeptide
TEEEIRTTNPVATEQYGSTTSTNLSSPGNR

SEQ ID NO: 20824 - protein, 28 aa, Artificial Sequence
  Description of Artificial Sequence: Synthetic peptide
AEEEIRCTNPVATEQYGEASENLMRGNR

SEQ ID NO: 20825 - protein, 28 aa, Artificial Sequence
  Description of Artificial Sequence: Synthetic peptide
DEECNRTTNPTAYEQYGVVSTNLQSGNR

SEQ ID NO: 20826 - protein, 32 aa, Artificial Sequence
  Description of Artificial Sequence: Synthetic polypeptide
DEEEIRTTNPVATEQYGSVSNTMNGLQRGEFG

SEQ ID NO: 20827 - protein, 30 aa, Artificial Sequence
  Description of Artificial Sequence: Synthetic polypeptide
DEEEIRTTNPVATEPYGSVCATNLTTMGNR

SEQ ID NO: 20828 - protein, 32 aa, Artificial Sequence
  Description of Artificial Sequence: Synthetic polypeptide
TEEEIRTTNPVATEQYGSTVPSCTNLQRGNQE

SEQ ID NO: 20829 - protein, 30 aa, Artificial Sequence
  Description of Artificial Sequence: Synthetic polypeptide
DEEEIRTTNPVATEQYGSVSNELQRGLTEP

SEQ ID NO: 20830 - protein, 29 aa, Artificial Sequence
  Description of Artificial Sequence: Synthetic peptide
DEEQIRTTNPVATEQYGSVSTSPEERGNT

SEQ ID NO: 20831 - protein, 32 aa, Artificial Sequence
  Description of Artificial Sequence: Synthetic polypeptide
TEEEIRTTNPVATEQYGSTVPSDNMLSQRGNR

SEQ ID NO: 20832 - protein, 29 aa, Artificial Sequence
  Description of Artificial Sequence: Synthetic peptide
DEEQIRTTNPVATEQYGSVSTSELVRGVT

SEQ ID NO: 20833 - protein, 29 aa, Artificial Sequence
  Description of Artificial Sequence: Synthetic peptide
DEEQIRTTNPVATEQYGSVSTSEIRGGNT

SEQ ID NO: 20834 - protein, 30 aa, Artificial Sequence
  Description of Artificial Sequence: Synthetic polypeptide
DEEEIRTTNPVATEQYGSVSNENDNQTGDR

SEQ ID NO: 20835 - protein, 28 aa, Artificial Sequence
  Description of Artificial Sequence: Synthetic peptide
DEECNRTTNPTAYEQYGNVSTNLQRGNE

SEQ ID NO: 20836 - protein, 28 aa, Artificial Sequence
  Description of Artificial Sequence: Synthetic peptide
DEEQIRTTNPVATEQYGVVSTSELRGNT

SEQ ID NO: 20837 - protein, 31 aa, Artificial Sequence
  Description of Artificial Sequence: Synthetic polypeptide
DEEEIRTTNPVATEPYGSTVSTGELPQRGNA

SEQ ID NO: 20838 - protein, 31 aa, Artificial Sequence
  Description of Artificial Sequence: Synthetic polypeptide
DEEEIRTTNPVATEQYGSVQCTDLDQRGDRQ

SEQ ID NO: 20839 - protein, 31 aa, Artificial Sequence
  Description of Artificial Sequence: Synthetic polypeptide
DEEEIRTTNPVATEQYGSVSANLQRGVEEQT

SEQ ID NO: 20840 - protein, 32 aa, Artificial Sequence
  Description of Artificial Sequence: Synthetic polypeptide
DEEEIRTTNPVATEQYGSVSPTTILQRTNQRI

SEQ ID NO: 20841 - protein, 32 aa, Artificial Sequence
  Description of Artificial Sequence: Synthetic polypeptide
DEEEIRTTNPVATEPYGSSVSTTNLQPRIVNR

SEQ ID NO: 20842 - protein, 30 aa, Artificial Sequence
  Description of Artificial Sequence: Synthetic polypeptide
DEEEIRTTNPVATEQYGCASTINPLQRDNN

SEQ ID NO: 20843 - protein, 31 aa, Artificial Sequence
  Description of Artificial Sequence: Synthetic polypeptide
DEEEIRTTNPVATEQYGAYTISTNEIQRGNR

SEQ ID NO: 20844 - protein, 30 aa, Artificial Sequence
  Description of Artificial Sequence: Synthetic polypeptide
DEEEIRTTNPVATEQYGSVSPENLQQSQER

SEQ ID NO: 20845 - protein, 30 aa, Artificial Sequence
  Description of Artificial Sequence: Synthetic polypeptide
DEEEIRTTNPVATEQYGSVSVTGLQRDLVD

SEQ ID NO: 20846 - protein, 31 aa, Artificial Sequence
  Description of Artificial Sequence: Synthetic polypeptide
DEEEIRTTNPVATETYGSVSTNLVQQGGNGN

SEQ ID NO: 20847 - protein, 32 aa, Artificial Sequence
  Description of Artificial Sequence: Synthetic polypeptide
DEEEIRTTNPVATEQYGSVSPTTELQRGENEQ

SEQ ID NO: 20848 - protein, 31 aa, Artificial Sequence
  Description of Artificial Sequence: Synthetic polypeptide
DEEEIRTTNPVATETYGSVSTNLVQTGGGNE

SEQ ID NO: 20849 - protein, 31 aa, Artificial Sequence
  Description of Artificial Sequence: Synthetic polypeptide
DEEEIRTTNPVATEQYGSVSPENLQRANFNN

SEQ ID NO: 20850 - protein, 30 aa, Artificial Sequence
  Description of Artificial Sequence: Synthetic polypeptide
TEEEIRTTNPVATEQYGSTCSTHLQRVGGR

SEQ ID NO: 20851 - protein, 30 aa, Artificial Sequence
  Description of Artificial Sequence: Synthetic polypeptide
DEAEIATTNPVATEAYGSVSTNLQRGNEET

SEQ ID NO: 20852 - protein, 29 aa, Artificial Sequence
  Description of Artificial Sequence: Synthetic peptide
AEEEIRCTNPVATEQYGSASENLQRNGGR

SEQ ID NO: 20853 - protein, 28 aa, Artificial Sequence
  Description of Artificial Sequence: Synthetic peptide
AEEEIRCTNPVATEQYGSASENLMRGGR

SEQ ID NO: 20854 - protein, 31 aa, Artificial Sequence
  Description of Artificial Sequence: Synthetic polypeptide
DEEEIRTTNPVATEQYGSVSPENQDRQGNER

SEQ ID NO: 20855 - protein, 30 aa, Artificial Sequence
  Description of Artificial Sequence: Synthetic polypeptide
DEEEIRTTNPVATEQYGSVSPEQQRGENDP

SEQ ID NO: 20856 - protein, 31 aa, Artificial Sequence
  Description of Artificial Sequence: Synthetic polypeptide
TEEEIRTTNPVATEQYGSTISTHLQRPGGNR

SEQ ID NO: 20857 - protein, 32 aa, Artificial Sequence
  Description of Artificial Sequence: Synthetic polypeptide
DEEEIRTTNPVATEQYGSVQCPTNLQQGENRN

SEQ ID NO: 20858 - protein, 33 aa, Artificial Sequence
  Description of Artificial Sequence: Synthetic polypeptide
DEEEIRTTNPVATEQYGSVSNTMNLQRFGSNQD

SEQ ID NO: 20859 - protein, 30 aa, Artificial Sequence
  Description of Artificial Sequence: Synthetic polypeptide
DEEEIRTTNPVATEVYGSVCATNLARGGND

SEQ ID NO: 20860 - protein, 29 aa, Artificial Sequence
  Description of Artificial Sequence: Synthetic peptide
TEEEIRTTNPVATEQYGSTSPTVLQRQGN

SEQ ID NO: 20861 - protein, 31 aa, Artificial Sequence
  Description of Artificial Sequence: Synthetic polypeptide
DEEEIRTTNPVATEVYGSVCATNLTRGGNDR

SEQ ID NO: 20862 - protein, 29 aa, Artificial Sequence
  Description of Artificial Sequence: Synthetic peptide
DEESICTTNPVATEAYGSVNTNTLQRGND

SEQ ID NO: 20863 - protein, 31 aa, Artificial Sequence
  Description of Artificial Sequence: Synthetic polypeptide
DEEEIRTTNPVATEQYGSVSPELLQRMGDNL

SEQ ID NO: 20864 - protein, 31 aa, Artificial Sequence
  Description of Artificial Sequence: Synthetic polypeptide
DEEEIRTTNPVATEQYGSVENTGNLIGRGER

SEQ ID NO: 20865 - protein, 30 aa, Artificial Sequence
  Description of Artificial Sequence: Synthetic polypeptide
DEEEIRTTNPVATEQYGSVSVSVNLQAINI

SEQ ID NO: 20866 - protein, 31 aa, Artificial Sequence
  Description of Artificial Sequence: Synthetic polypeptide
DEEEIRTTNPVATEQYGSVSVSQNLQRVPNI

SEQ ID NO: 20867 - protein, 29 aa, Artificial Sequence
  Description of Artificial Sequence: Synthetic peptide
YEEEIRTTNPQATEQYGVVSTNLVQRGET

SEQ ID NO: 20868 - protein, 30 aa, Artificial Sequence
  Description of Artificial Sequence: Synthetic polypeptide
DEAEIATTNPVATEIYGSVSTNLQGDSGNR

SEQ ID NO: 20869 - protein, 31 aa, Artificial Sequence
  Description of Artificial Sequence: Synthetic polypeptide
DEEEIRTTNPVATEQYGCISNTELQRGSNRM

SEQ ID NO: 20870 - protein, 31 aa, Artificial Sequence
  Description of Artificial Sequence: Synthetic polypeptide
YEEEIRTTNPLATEQYGSVSTNIEQRSGNRA

SEQ ID NO: 20871 - protein, 30 aa, Artificial Sequence
  Description of Artificial Sequence: Synthetic polypeptide
DEEEIRTTNPVATEQYGSVSVSSNLQGVNG

SEQ ID NO: 20872 - protein, 29 aa, Artificial Sequence
  Description of Artificial Sequence: Synthetic peptide
DEETIATTNPVATECYGSVDTNTLQRGNM

SEQ ID NO: 20873 - protein, 29 aa, Artificial Sequence
  Description of Artificial Sequence: Synthetic peptide
DEESISTTNPVATESYGSVNTNQLQRGNM

SEQ ID NO: 20874 - protein, 29 aa, Artificial Sequence
  Description of Artificial Sequence: Synthetic peptide
DEESISTTNPVATEPYGSVNTNTLQRGNY

SEQ ID NO: 20875 - protein, 32 aa, Artificial Sequence
  Description of Artificial Sequence: Synthetic polypeptide
DEEEIRTTNPVATEQYGSVSVSTNLQAGNNNI

SEQ ID NO: 20876 - protein, 32 aa, Artificial Sequence
  Description of Artificial Sequence: Synthetic polypeptide
DEEEIRTTNPVATEQYGSVSNTNDMQHPGNRE

SEQ ID NO: 20877 - protein, 32 aa, Artificial Sequence
  Description of Artificial Sequence: Synthetic polypeptide
DEEEIRTTNPVATEQYGSVSVSTNLQGENGNI

SEQ ID NO: 20878 - protein, 29 aa, Artificial Sequence
  Description of Artificial Sequence: Synthetic peptide
DEESISTTNPVATECYGSVNTNWLQRGNA

SEQ ID NO: 20879 - protein, 31 aa, Artificial Sequence
  Description of Artificial Sequence: Synthetic polypeptide
DEEEIRTTNPVATETYGSVSTNLNQQGGGNI

SEQ ID NO: 20880 - protein, 29 aa, Artificial Sequence
  Description of Artificial Sequence: Synthetic peptide
DEESISTTNPVATECYGSVATNTLQRGNL

SEQ ID NO: 20881 - protein, 29 aa, Artificial Sequence
  Description of Artificial Sequence: Synthetic peptide
DEAEIATTNPVATEHYGVVSTNLQRDGNM

SEQ ID NO: 20882 - protein, 29 aa, Artificial Sequence
  Description of Artificial Sequence: Synthetic peptide
DEESISTTNPVATEAYGSVNTNELQRGNM

SEQ ID NO: 20883 - protein, 32 aa, Artificial Sequence
  Description of Artificial Sequence: Synthetic polypeptide
DEEEIRTTNPVATEQYGSVSVSTNLQQGNNII

SEQ ID NO: 20884 - protein, 33 aa, Artificial Sequence
  Description of Artificial Sequence: Synthetic polypeptide
DEEEIRTTNPVATEQYGSVSPTTNLQQRGNLFQ

SEQ ID NO: 20885 - protein, 31 aa, Artificial Sequence
  Description of Artificial Sequence: Synthetic polypeptide
TEEEIRTTNPVATEQYGEVSCTNLSQSGGNR

SEQ ID NO: 20886 - protein, 28 aa, Artificial Sequence
  Description of Artificial Sequence: Synthetic peptide
DEECLRTTNPTAYEQYGEVSTNLQRGNV

SEQ ID NO: 20887 - protein, 30 aa, Artificial Sequence
  Description of Artificial Sequence: Synthetic polypeptide
DEEEIRTTNPVATEQYGCFSLPNLLQRDNR

SEQ ID NO: 20888 - protein, 30 aa, Artificial Sequence
  Description of Artificial Sequence: Synthetic polypeptide
YEEEIRTTNPLATEQYGSVSTGNLQRGTPQ

SEQ ID NO: 20889 - protein, 28 aa, Artificial Sequence
  Description of Artificial Sequence: Synthetic peptide
DEAEIATTNPVATEIYGSVSTNLQGGDV

SEQ ID NO: 20890 - protein, 29 aa, Artificial Sequence
  Description of Artificial Sequence: Synthetic peptide
DEETIATTNPVATETYGSVITNTLQRGNM

SEQ ID NO: 20891 - protein, 32 aa, Artificial Sequence
  Description of Artificial Sequence: Synthetic polypeptide
DEEEIRTTNPVATEQYGSVSPTTNLQRNQVRD

SEQ ID NO: 20892 - protein, 30 aa, Artificial Sequence
  Description of Artificial Sequence: Synthetic polypeptide
DEEEIRTTNPVATEQYGSVSPTVLARENLI

SEQ ID NO: 20893 - protein, 29 aa, Artificial Sequence
  Description of Artificial Sequence: Synthetic peptide
DEAEIATTNPVATENYGTVSTNLQRGDDR

SEQ ID NO: 20894 - protein, 31 aa, Artificial Sequence
  Description of Artificial Sequence: Synthetic polypeptide
DEEEIRTTNPVATEQYGSVDTMELQCAGNDR

SEQ ID NO: 20895 - protein, 31 aa, Artificial Sequence
  Description of Artificial Sequence: Synthetic polypeptide
DEEEIRTTNPVATEQYGSVSPTVELQRDLNP

SEQ ID NO: 20896 - protein, 29 aa, Artificial Sequence
  Description of Artificial Sequence: Synthetic peptide
DEETIRATNPVATEQYGSVSNVNEQRGND

SEQ ID NO: 20897 - protein, 29 aa, Artificial Sequence
  Description of Artificial Sequence: Synthetic peptide
DEEEIRTTNPVATEQYGSVSVSPDQRMND

SEQ ID NO: 20898 - protein, 29 aa, Artificial Sequence
  Description of Artificial Sequence: Synthetic peptide
DEETIRATNPVATEQYGSVSANFQRGQNL

SEQ ID NO: 20899 - protein, 28 aa, Artificial Sequence
  Description of Artificial Sequence: Synthetic peptide
DEAEIATTNPVATENYGSVSTNLQHGDA

SEQ ID NO: 20900 - protein, 31 aa, Artificial Sequence
  Description of Artificial Sequence: Synthetic polypeptide
DEEEIRTTNPVATEQYGSVSVSPNLQERVNE

SEQ ID NO: 20901 - protein, 31 aa, Artificial Sequence
  Description of Artificial Sequence: Synthetic polypeptide
DEEEIRTTNPVATEQYGSVSVSPNLQNRVNQ

SEQ ID NO: 20902 - protein, 31 aa, Artificial Sequence
  Description of Artificial Sequence: Synthetic polypeptide
DEEEIRTTNPVATEQYGSVSNANLIQRGEVE

SEQ ID NO: 20903 - protein, 31 aa, Artificial Sequence
  Description of Artificial Sequence: Synthetic polypeptide
TEEEIRTTNPVATEQWGSVSTNMLQTGGNNR

SEQ ID NO: 20904 - protein, 32 aa, Artificial Sequence
  Description of Artificial Sequence: Synthetic polypeptide
TEEEIRTTNPVATEQWGSVSTNSLQRTGGNNR

SEQ ID NO: 20905 - protein, 30 aa, Artificial Sequence
  Description of Artificial Sequence: Synthetic polypeptide
DEEEIRTTNPVATEQYGSVSNANLNQQGLE

SEQ ID NO: 20906 - protein, 31 aa, Artificial Sequence
  Description of Artificial Sequence: Synthetic polypeptide
DEEEIRTTNPVATEQYGSVSNANLQLDGNDQ

SEQ ID NO: 20907 - protein, 32 aa, Artificial Sequence
  Description of Artificial Sequence: Synthetic polypeptide
TEEEIRTTNPVATEQWGSVVSTNALQRGGSNR

SEQ ID NO: 20908 - protein, 34 aa, Artificial Sequence
  Description of Artificial Sequence: Synthetic polypeptide
DEEEIRTTNPVATEQYGSVSPTTNMLQRGENPRI

SEQ ID NO: 20909 - protein, 32 aa, Artificial Sequence
  Description of Artificial Sequence: Synthetic polypeptide
DEEEIRTTNPVATEQYGSVSPTTNLQTGNEME

SEQ ID NO: 20910 - protein, 33 aa, Artificial Sequence
  Description of Artificial Sequence: Synthetic polypeptide
DEEEIRTTNPVATEQYGSVSNTNDMQRGGNNRN

SEQ ID NO: 20911 - protein, 29 aa, Artificial Sequence
  Description of Artificial Sequence: Synthetic peptide
DEETICTTNPVATECYGSVNTNTLQRGNM

SEQ ID NO: 20912 - protein, 32 aa, Artificial Sequence
  Description of Artificial Sequence: Synthetic polypeptide
DEEEIRTTNPVATEQYGSVSPTTNLQSGNLLQ

SEQ ID NO: 20913 - protein, 31 aa, Artificial Sequence
  Description of Artificial Sequence: Synthetic polypeptide
DEEEIRTTNPVATEQYGSVVTSLEQSGNDRN

SEQ ID NO: 20914 - protein, 30 aa, Artificial Sequence
  Description of Artificial Sequence: Synthetic polypeptide
DEEEIATTNPVATEHYGSVSTNLQMDGNNL

SEQ ID NO: 20915 - protein, 30 aa, Artificial Sequence
  Description of Artificial Sequence: Synthetic polypeptide
YEEEIRTTNPIATEQYGSVNSAPLNQRGNR

SEQ ID NO: 20916 - protein, 31 aa, Artificial Sequence
  Description of Artificial Sequence: Synthetic polypeptide
DEEEIRTTNPVATEVYGSVSSTTNLQPGNGP

SEQ ID NO: 20917 - protein, 33 aa, Artificial Sequence
  Description of Artificial Sequence: Synthetic polypeptide
DEEEIRTTNPVATEQYGSVSPTTNLQQARGVRD

SEQ ID NO: 20918 - protein, 31 aa, Artificial Sequence
  Description of Artificial Sequence: Synthetic polypeptide
DEESIRTTNPVATEQYGSVSTNLEDNGQNDR

SEQ ID NO: 20919 - protein, 30 aa, Artificial Sequence
  Description of Artificial Sequence: Synthetic polypeptide
DEEEIRTTNPVATEQYGSVEENLQRIGEDI

SEQ ID NO: 20920 - protein, 29 aa, Artificial Sequence
  Description of Artificial Sequence: Synthetic peptide
DEESIMTTNPVATECYGSVNTNWLQRGNS

SEQ ID NO: 20921 - protein, 31 aa, Artificial Sequence
  Description of Artificial Sequence: Synthetic polypeptide
DEEEIRTTNPVATEQYGCCVCSTNLFRGSNQ

SEQ ID NO: 20922 - protein, 28 aa, Artificial Sequence
  Description of Artificial Sequence: Synthetic peptide
DEEEIRTTNPVATEQYGSVSAPLEGSER

SEQ ID NO: 20923 - protein, 30 aa, Artificial Sequence
  Description of Artificial Sequence: Synthetic polypeptide
YEEEIRTTKNPVATEQYGSVSTNQQYGTTR

SEQ ID NO: 20924 - protein, 29 aa, Artificial Sequence
  Description of Artificial Sequence: Synthetic peptide
DEEEIRTTNPVATEQYGSVSNDLQRDIEA

SEQ ID NO: 20925 - protein, 30 aa, Artificial Sequence
  Description of Artificial Sequence: Synthetic polypeptide
DEEEIRTTNPVATEQYGSVEITNLQNLTNG

SEQ ID NO: 20926 - protein, 31 aa, Artificial Sequence
  Description of Artificial Sequence: Synthetic polypeptide
DEAEIRTTNPVATEQYGSVCSTNLQGSSNRI

SEQ ID NO: 20927 - protein, 29 aa, Artificial Sequence
  Description of Artificial Sequence: Synthetic peptide
DEESIMTTNPVATECYGSVCTNNLQRGNM

SEQ ID NO: 20928 - protein, 31 aa, Artificial Sequence
  Description of Artificial Sequence: Synthetic polypeptide
DEEEIRTTNPVATETYGSVSTNLQQQGIGNS

SEQ ID NO: 20929 - protein, 30 aa, Artificial Sequence
  Description of Artificial Sequence: Synthetic polypeptide
DEEEIATTNPVATEHYGSVSTNLQSGGNHD

SEQ ID NO: 20930 - protein, 29 aa, Artificial Sequence
  Description of Artificial Sequence: Synthetic peptide
DEESIKTTNPVATERYGSVNTNELQRGNM

SEQ ID NO: 20931 - protein, 31 aa, Artificial Sequence
  Description of Artificial Sequence: Synthetic polypeptide
DEEEIRTTNPVATEQYGSVSNDNLQDEGNNS

SEQ ID NO: 20932 - protein, 31 aa, Artificial Sequence
  Description of Artificial Sequence: Synthetic polypeptide
DEEEIRTTNPVATEQYGSVMTNNNLDRGEER

SEQ ID NO: 20933 - protein, 32 aa, Artificial Sequence
  Description of Artificial Sequence: Synthetic polypeptide
DEAEIRTTNPVATEQYGSVCSTNLQEAGSNRQ

SEQ ID NO: 20934 - protein, 30 aa, Artificial Sequence
  Description of Artificial Sequence: Synthetic polypeptide
DEEEIRTTNPVATEQYGCAVSTNLFRGSDQ

SEQ ID NO: 20935 - protein, 29 aa, Artificial Sequence
  Description of Artificial Sequence: Synthetic peptide
DEESICTTNPVATEPYGSVNTNMLQRGNM

SEQ ID NO: 20936 - protein, 28 aa, Artificial Sequence
  Description of Artificial Sequence: Synthetic peptide
DEAEIATTNPVATEGYGSVSTPLQNGNE

SEQ ID NO: 20937 - protein, 31 aa, Artificial Sequence
  Description of Artificial Sequence: Synthetic polypeptide
DEEEIRTTNPVATEQYGSVENTENLYGRGSR

SEQ ID NO: 20938 - protein, 29 aa, Artificial Sequence
  Description of Artificial Sequence: Synthetic peptide
DEESICTTNPVATECYGSVNTNTLQRGNQ

SEQ ID NO: 20939 - protein, 30 aa, Artificial Sequence
  Description of Artificial Sequence: Synthetic polypeptide
DEEEIRTTNPVATEQYGSVSPTTNLGPNNE

SEQ ID NO: 20940 - protein, 31 aa, Artificial Sequence
  Description of Artificial Sequence: Synthetic polypeptide
DEEEIRTTNPVATEQYGSVENTFNLSGRGTR

SEQ ID NO: 20941 - protein, 29 aa, Artificial Sequence
  Description of Artificial Sequence: Synthetic peptide
DEESIGTTNPVATEPYGSVGTNTLQRGNM

SEQ ID NO: 20942 - protein, 30 aa, Artificial Sequence
  Description of Artificial Sequence: Synthetic polypeptide
YEEEIRTTNPDVATERYGSVSTNLEGGNAR

SEQ ID NO: 20943 - protein, 28 aa, Artificial Sequence
  Description of Artificial Sequence: Synthetic peptide
DEEEIRTTNPVATEQYGSVSAPLQHSEN

SEQ ID NO: 20944 - protein, 28 aa, Artificial Sequence
  Description of Artificial Sequence: Synthetic peptide
DEEEIRTTNPVATEQYGSVSAPLQNAEE

SEQ ID NO: 20945 - protein, 32 aa, Artificial Sequence
  Description of Artificial Sequence: Synthetic polypeptide
TEEEIRTTNPVATEQYGISVSTNLQRTVGNNY

SEQ ID NO: 20946 - protein, 30 aa, Artificial Sequence
  Description of Artificial Sequence: Synthetic polypeptide
DEAEIATTNPVATEHYGSVSTNLQRDGNHL

SEQ ID NO: 20947 - protein, 32 aa, Artificial Sequence
  Description of Artificial Sequence: Synthetic polypeptide
DEEEIRTTNPVATEQYGSVPWTNLSQRDNNRC

SEQ ID NO: 20948 - protein, 29 aa, Artificial Sequence
  Description of Artificial Sequence: Synthetic peptide
DEEEIRTTNPVATEQYGSVDTPDQRENID

SEQ ID NO: 20949 - protein, 29 aa, Artificial Sequence
  Description of Artificial Sequence: Synthetic peptide
DEAEIATTNPVATEHYGSVSTNLQPDGNQ

SEQ ID NO: 20950 - protein, 31 aa, Artificial Sequence
  Description of Artificial Sequence: Synthetic polypeptide
YEEEIRTTNPGATEQYGSISTNLEQRSGNRA

SEQ ID NO: 20951 - protein, 32 aa, Artificial Sequence
  Description of Artificial Sequence: Synthetic polypeptide
DEEEIRTTNPVATEQYGCCVSTVNLQRFGSER

SEQ ID NO: 20952 - protein, 28 aa, Artificial Sequence
  Description of Artificial Sequence: Synthetic peptide
TEEEIRTTNPVATEQYGKVATALQNGAR

SEQ ID NO: 20953 - protein, 29 aa, Artificial Sequence
  Description of Artificial Sequence: Synthetic peptide
DEESIRTTNPVATEQYGCVSTNDQFGNDS

SEQ ID NO: 20954 - protein, 31 aa, Artificial Sequence
  Description of Artificial Sequence: Synthetic polypeptide
DEEEIRTTNPVATEQYGSVSVSTNLQQLQNE

SEQ ID NO: 20955 - protein, 31 aa, Artificial Sequence
  Description of Artificial Sequence: Synthetic polypeptide
DEEEIRTTNPVATEQYGSVSVSTNLQQQVNE

SEQ ID NO: 20956 - protein, 30 aa, Artificial Sequence
  Description of Artificial Sequence: Synthetic polypeptide
DEEEIATTNPVATEHYGSVSTNLQQGNEHQ

SEQ ID NO: 20957 - protein, 30 aa, Artificial Sequence
  Description of Artificial Sequence: Synthetic polypeptide
DEESIRTTNPVATEAWGSVSTYELSQRGNR

SEQ ID NO: 20958 - protein, 29 aa, Artificial Sequence
  Description of Artificial Sequence: Synthetic peptide
DEAEIATTNPVATEHYGSVSTNIQRDGNH

SEQ ID NO: 20959 - protein, 30 aa, Artificial Sequence
  Description of Artificial Sequence: Synthetic polypeptide
DEEEIRTTNPVATEQYGSVSAPNLERGEFD

SEQ ID NO: 20960 - protein, 29 aa, Artificial Sequence
  Description of Artificial Sequence: Synthetic peptide
DEAEIATTNPVATEHYGSVATNLQRDGND

SEQ ID NO: 20961 - protein, 29 aa, Artificial Sequence
  Description of Artificial Sequence: Synthetic peptide
DEESIQTTNPVATEGYGSVNTNTLQRGNM

SEQ ID NO: 20962 - protein, 31 aa, Artificial Sequence
  Description of Artificial Sequence: Synthetic polypeptide
YEEEIRTTNPEATEQYGSVNSTPLNQRGNAR

SEQ ID NO: 20963 - protein, 29 aa, Artificial Sequence
  Description of Artificial Sequence: Synthetic peptide
DEESIMTTNPVATENYGSVATNDLQRGNM

SEQ ID NO: 20964 - protein, 29 aa, Artificial Sequence
  Description of Artificial Sequence: Synthetic peptide
DEESIMTTNPVATEHYGSVNTNTLQRGNM

SEQ ID NO: 20965 - protein, 29 aa, Artificial Sequence
  Description of Artificial Sequence: Synthetic peptide
DEESIMTTNPVATEGYGSVNTNTLQRGNI

SEQ ID NO: 20966 - protein, 32 aa, Artificial Sequence
  Description of Artificial Sequence: Synthetic polypeptide
DEEEIRTTNPVATEQYGSVSPTTNLQNGNNVQ

SEQ ID NO: 20967 - protein, 29 aa, Artificial Sequence
  Description of Artificial Sequence: Synthetic peptide
DEAEIATTNPVATEHYGEVSTNLQRDGNA

SEQ ID NO: 20968 - protein, 31 aa, Artificial Sequence
  Description of Artificial Sequence: Synthetic polypeptide
YEEEIRTTNPHATEQYGSVSTNFLQRQVNDR

SEQ ID NO: 20969 - protein, 30 aa, Artificial Sequence
  Description of Artificial Sequence: Synthetic polypeptide
DEDEIRTTNPVATESYGSVSTNLQGEGNEN

SEQ ID NO: 20970 - protein, 30 aa, Artificial Sequence
  Description of Artificial Sequence: Synthetic polypeptide
DEEEIRTTNPVATEQYGSVQCTNDDRGQER

SEQ ID NO: 20971 - protein, 29 aa, Artificial Sequence
  Description of Artificial Sequence: Synthetic peptide
DEEEIRTTNPVATEQYGSVSVTLDDRGDV

SEQ ID NO: 20972 - protein, 29 aa, Artificial Sequence
  Description of Artificial Sequence: Synthetic peptide
DEEPIRTTNPVATEQYSEEVTTNLQSGNR

SEQ ID NO: 20973 - protein, 30 aa, Artificial Sequence
  Description of Artificial Sequence: Synthetic polypeptide
DEEPIRTTNPVATEQYSEEVSTNLQEGGNR

SEQ ID NO: 20974 - protein, 30 aa, Artificial Sequence
  Description of Artificial Sequence: Synthetic polypeptide
DEEPIRTTNPVATEQYSAEVSTNLQNGSNR

SEQ ID NO: 20975 - protein, 29 aa, Artificial Sequence
  Description of Artificial Sequence: Synthetic peptide
TEEEIRTTNPVATEQYGSVATALQNGSRK

SEQ ID NO: 20976 - protein, 29 aa, Artificial Sequence
  Description of Artificial Sequence: Synthetic peptide
DEAEIRTTNPVATEQYGSVATNMQVGNEE

SEQ ID NO: 20977 - protein, 31 aa, Artificial Sequence
  Description of Artificial Sequence: Synthetic polypeptide
DEEEIRTTNPVATEQYGSVSNTGTLQRMNES

SEQ ID NO: 20978 - protein, 30 aa, Artificial Sequence
  Description of Artificial Sequence: Synthetic polypeptide
YEEEIITTNPVATEQYGSVSTNNEQKGNRI

SEQ ID NO: 20979 - protein, 29 aa, Artificial Sequence
  Description of Artificial Sequence: Synthetic peptide
DEEPIRTTNPVATEQYNAEVSTNLQIGNG

SEQ ID NO: 20980 - protein, 31 aa, Artificial Sequence
  Description of Artificial Sequence: Synthetic polypeptide
DEEEIRTTNPVATEQYGSVETGLQRGNMSEG

SEQ ID NO: 20981 - protein, 28 aa, Artificial Sequence
  Description of Artificial Sequence: Synthetic peptide
TEEEIRTTNPVATEQYGSVATANQNGFR

SEQ ID NO: 20982 - protein, 30 aa, Artificial Sequence
  Description of Artificial Sequence: Synthetic polypeptide
YEEEIKTTNPVATEQYGSVSTMNLQYLNGR

SEQ ID NO: 20983 - protein, 30 aa, Artificial Sequence
  Description of Artificial Sequence: Synthetic polypeptide
DEDEIRTTNPVATERYGSVSTNLQEGGTNG

SEQ ID NO: 20984 - protein, 32 aa, Artificial Sequence
  Description of Artificial Sequence: Synthetic polypeptide
DEEEIRTTNPVATEQYGSVSNTGNLQYGSNNA

SEQ ID NO: 20985 - protein, 29 aa, Artificial Sequence
  Description of Artificial Sequence: Synthetic peptide
YEEEIHTTNPVATEQYGSVSTNGLVRVER

SEQ ID NO: 20986 - protein, 30 aa, Artificial Sequence
  Description of Artificial Sequence: Synthetic polypeptide
TEEEIRTTNPVATEQYGSVATNLSQGGNVL

SEQ ID NO: 20987 - protein, 29 aa, Artificial Sequence
  Description of Artificial Sequence: Synthetic peptide
TEEEIRTTNPVATEQYGSVATQALQNGPR

SEQ ID NO: 20988 - protein, 29 aa, Artificial Sequence
  Description of Artificial Sequence: Synthetic peptide
DEAEIRTTNPVATEQYGSVATNLTRDGDL

SEQ ID NO: 20989 - protein, 29 aa, Artificial Sequence
  Description of Artificial Sequence: Synthetic peptide
DEDEIRTTNPVATESWGSVSTNLQHGDAR

SEQ ID NO: 20990 - protein, 30 aa, Artificial Sequence
  Description of Artificial Sequence: Synthetic polypeptide
DEEEIRTTNPVATEQYGSVSNMDLQRGEDD

SEQ ID NO: 20991 - protein, 31 aa, Artificial Sequence
  Description of Artificial Sequence: Synthetic polypeptide
YEEEIHTTNPVATEQYGSVMSETNLERGNFR

SEQ ID NO: 20992 - protein, 31 aa, Artificial Sequence
  Description of Artificial Sequence: Synthetic polypeptide
DEEEIRTTNPVATEQYGSVVTNLDQERNNDQ

SEQ ID NO: 20993 - protein, 30 aa, Artificial Sequence
  Description of Artificial Sequence: Synthetic polypeptide
DEEEIRTTNPVATEQYGAVSTVNLDPEGNG

SEQ ID NO: 20994 - protein, 29 aa, Artificial Sequence
  Description of Artificial Sequence: Synthetic peptide
DEAEIRTTNPVAMEQYGSISTNLERMPNR

SEQ ID NO: 20995 - protein, 31 aa, Artificial Sequence
  Description of Artificial Sequence: Synthetic polypeptide
DEEEIRTTNPVATEQYGSVETGLQRGNNPQG

SEQ ID NO: 20996 - protein, 28 aa, Artificial Sequence
  Description of Artificial Sequence: Synthetic peptide
TEEEIRTTNPVATEQYGSVATALQNGGG

SEQ ID NO: 20997 - protein, 29 aa, Artificial Sequence
  Description of Artificial Sequence: Synthetic peptide
YEEEILTTNPDATEQYGSVSTMNIQKGNR

SEQ ID NO: 20998 - protein, 29 aa, Artificial Sequence
  Description of Artificial Sequence: Synthetic peptide
YEEEIQTTNPVATEQYGSVSKTNLVRVER

SEQ ID NO: 20999 - protein, 28 aa, Artificial Sequence
  Description of Artificial Sequence: Synthetic peptide
DEEQIATTNPVATEQYGSVSTHETRGNT

SEQ ID NO: 21000 - protein, 29 aa, Artificial Sequence
  Description of Artificial Sequence: Synthetic peptide
DEEEIRTTNPVATEQYGSVETALDRGVDQ

SEQ ID NO: 21001 - protein, 31 aa, Artificial Sequence
  Description of Artificial Sequence: Synthetic polypeptide
DEEEIRTTNPVATEQYGSVSVTNLDDLNGNQ

SEQ ID NO: 21002 - protein, 31 aa, Artificial Sequence
  Description of Artificial Sequence: Synthetic polypeptide
YEEEIQTTNPVATEQYGQSVSTNLQARGNGY

SEQ ID NO: 21003 - protein, 31 aa, Artificial Sequence
  Description of Artificial Sequence: Synthetic polypeptide
DEEEIRTTNPVATEQYGAVSTVNLQFEGGNF

SEQ ID NO: 21004 - protein, 31 aa, Artificial Sequence
  Description of Artificial Sequence: Synthetic polypeptide
DEEEIRTTNPVATEQYGSVETDLDERGENRQ

SEQ ID NO: 21005 - protein, 32 aa, Artificial Sequence
  Description of Artificial Sequence: Synthetic polypeptide
DEEEIRTTNPVATEQYGSVETDNLQRGVNEFV

SEQ ID NO: 21006 - protein, 29 aa, Artificial Sequence
  Description of Artificial Sequence: Synthetic peptide
DEEEIRTTNPVATEQYGSVETDNQRGEDM

SEQ ID NO: 21007 - protein, 31 aa, Artificial Sequence
  Description of Artificial Sequence: Synthetic polypeptide
DEEEIRTTNPVATEQYGSVETEEGLQRGNDQ

SEQ ID NO: 21008 - protein, 29 aa, Artificial Sequence
  Description of Artificial Sequence: Synthetic peptide
DEEPIRTTNPVAYEQYGEEVSTNLQHGGR

SEQ ID NO: 21009 - protein, 30 aa, Artificial Sequence
  Description of Artificial Sequence: Synthetic polypeptide
DEEEIRTTNPVATEQYGAVSTVNLPEGNDQ

SEQ ID NO: 21010 - protein, 33 aa, Artificial Sequence
  Description of Artificial Sequence: Synthetic polypeptide
DEEEIRTTNPVATEQYGSVSVTNLDQGTGNNER

SEQ ID NO: 21011 - protein, 29 aa, Artificial Sequence
  Description of Artificial Sequence: Synthetic peptide
TEEEIRTTNPVATEQYGSVATALQENGSR

SEQ ID NO: 21012 - protein, 29 aa, Artificial Sequence
  Description of Artificial Sequence: Synthetic peptide
YEEEIMTVNPVATEQYGSVSTNGERGSNR

SEQ ID NO: 21013 - protein, 29 aa, Artificial Sequence
  Description of Artificial Sequence: Synthetic peptide
TEEEIRTTNPVATEQYGSVATALQIGGFR

SEQ ID NO: 21014 - protein, 29 aa, Artificial Sequence
  Description of Artificial Sequence: Synthetic peptide
TEEEIRTTNPVATEQYGSVATALQNGDRD

SEQ ID NO: 21015 - protein, 29 aa, Artificial Sequence
  Description of Artificial Sequence: Synthetic peptide
DEEPIRTTNPVAYEQYSEEVSTNLQSGNR

SEQ ID NO: 21016 - protein, 32 aa, Artificial Sequence
  Description of Artificial Sequence: Synthetic polypeptide
DEEEIRTTNPVATEQYGSVSNTINDAQRGEDR

SEQ ID NO: 21017 - protein, 32 aa, Artificial Sequence
  Description of Artificial Sequence: Synthetic polypeptide
DEEEIRTTNPVATEQYGSVSVTNLDQSNGNDF

SEQ ID NO: 21018 - protein, 28 aa, Artificial Sequence
  Description of Artificial Sequence: Synthetic peptide
TEEEIRTTNPVATEQYGSVATALQNGFE

SEQ ID NO: 21019 - protein, 31 aa, Artificial Sequence
  Description of Artificial Sequence: Synthetic polypeptide
DEEEIRTTNPVATEQYGSVETGLQRGGIGRI

SEQ ID NO: 21020 - protein, 29 aa, Artificial Sequence
  Description of Artificial Sequence: Synthetic peptide
TEEEIRTTNPVATEQYGSVATALEQNGER

SEQ ID NO: 21021 - protein, 31 aa, Artificial Sequence
  Description of Artificial Sequence: Synthetic polypeptide
DEEEIRTTNPVATEQYGSVSNMDLQRGEQRM

SEQ ID NO: 21022 - protein, 30 aa, Artificial Sequence
  Description of Artificial Sequence: Synthetic polypeptide
DEEEIRTTNPVATEQYGAVSTTNLQTGVEE

SEQ ID NO: 21023 - protein, 31 aa, Artificial Sequence
  Description of Artificial Sequence: Synthetic polypeptide
DEEEIRTTNPVATEQYGSVETGLQRGVIPRT

SEQ ID NO: 21024 - protein, 30 aa, Artificial Sequence
  Description of Artificial Sequence: Synthetic polypeptide
DEAEIRTTNPVATEQYGSVATNLQERGDDL

SEQ ID NO: 21025 - protein, 30 aa, Artificial Sequence
  Description of Artificial Sequence: Synthetic polypeptide
DEAEIRTTNPVATEQYGSVATNLQDGMNEH

SEQ ID NO: 21026 - protein, 32 aa, Artificial Sequence
  Description of Artificial Sequence: Synthetic polypeptide
DEEEIRTTNPVATEQYGSVSNTGNLQYFGSQR

SEQ ID NO: 21027 - protein, 28 aa, Artificial Sequence
  Description of Artificial Sequence: Synthetic peptide
DEEEIRTTNPVATEQYGSVETKLANGEM

SEQ ID NO: 21028 - protein, 29 aa, Artificial Sequence
  Description of Artificial Sequence: Synthetic peptide
DEEEIRTTNPVATEQYGAVSTNTDRGDDT

SEQ ID NO: 21029 - protein, 31 aa, Artificial Sequence
  Description of Artificial Sequence: Synthetic polypeptide
DEEEIRTTNPVATEQYGSVSPIEDLQRDNER

SEQ ID NO: 21030 - protein, 30 aa, Artificial Sequence
  Description of Artificial Sequence: Synthetic polypeptide
DEEEIRTTNPVATEQYGSVETLLQRAENID

SEQ ID NO: 21031 - protein, 31 aa, Artificial Sequence
  Description of Artificial Sequence: Synthetic polypeptide
YEEEIGTTNPVATEQYWGGSVSTNLEQRGTR

SEQ ID NO: 21032 - protein, 29 aa, Artificial Sequence
  Description of Artificial Sequence: Synthetic peptide
DEAEIRTTNPVATEQYGSVATNDQRGDEL

SEQ ID NO: 21033 - protein, 32 aa, Artificial Sequence
  Description of Artificial Sequence: Synthetic polypeptide
YEEEIGTTNPVATEQYGSVVSWTNVLQGRGNR

SEQ ID NO: 21034 - protein, 30 aa, Artificial Sequence
  Description of Artificial Sequence: Synthetic polypeptide
DEEEIRTTNPVATEQYGSVETGMQERGNVF

SEQ ID NO: 21035 - protein, 29 aa, Artificial Sequence
  Description of Artificial Sequence: Synthetic peptide
DEAEIRTTNPVATEQYGSVATNDQDGNEM

SEQ ID NO: 21036 - protein, 28 aa, Artificial Sequence
  Description of Artificial Sequence: Synthetic peptide
DDENIRTTNPVATEQYGEVSTNHQRMNV

SEQ ID NO: 21037 - protein, 29 aa, Artificial Sequence
  Description of Artificial Sequence: Synthetic peptide
DEAEIRTTNPVATEQYGSVATNDDRGNDQ

SEQ ID NO: 21038 - protein, 31 aa, Artificial Sequence
  Description of Artificial Sequence: Synthetic polypeptide
DEEEIRTTNPVATEQYGSVMTNEDQEGDNIR

SEQ ID NO: 21039 - protein, 29 aa, Artificial Sequence
  Description of Artificial Sequence: Synthetic peptide
DEEEIRTTNPVATEQYGSVETLSQRGEEL

SEQ ID NO: 21040 - protein, 29 aa, Artificial Sequence
  Description of Artificial Sequence: Synthetic peptide
DEENIRTTNPVATEYYGQVTTNLQYGSNR

SEQ ID NO: 21041 - protein, 30 aa, Artificial Sequence
  Description of Artificial Sequence: Synthetic polypeptide
DEEEIRTTNPVATEQYGSVETMELQRINED

SEQ ID NO: 21042 - protein, 29 aa, Artificial Sequence
  Description of Artificial Sequence: Synthetic peptide
DEENIRTTNPVATESYGVVTTNLQPGSNR

SEQ ID NO: 21043 - protein, 30 aa, Artificial Sequence
  Description of Artificial Sequence: Synthetic polypeptide
YEEEIGTTNPVATEQYGSVSTMNLDQYLNR

SEQ ID NO: 21044 - protein, 32 aa, Artificial Sequence
  Description of Artificial Sequence: Synthetic polypeptide
DEEEIRTTNPVATEQYGSVSNTGNLQTNGNNP

SEQ ID NO: 21045 - protein, 31 aa, Artificial Sequence
  Description of Artificial Sequence: Synthetic polypeptide
DEEEIRTTNPVATEPYGSVCFTNDQNRGGNR

SEQ ID NO: 21046 - protein, 29 aa, Artificial Sequence
  Description of Artificial Sequence: Synthetic peptide
DEENIRTTNPVAYEQYGTVSTINVQRGNN

SEQ ID NO: 21047 - protein, 30 aa, Artificial Sequence
  Description of Artificial Sequence: Synthetic polypeptide
DEEEIRTTNPVATEPYGSVCFTELIRGGNR

SEQ ID NO: 21048 - protein, 32 aa, Artificial Sequence
  Description of Artificial Sequence: Synthetic polypeptide
DEEEIRTTNPVATEYYGQSVSTVNLQDRISNR

SEQ ID NO: 21049 - protein, 32 aa, Artificial Sequence
  Description of Artificial Sequence: Synthetic polypeptide
DEEEIRTTNPVATEYYGISVSTVNLQDNIGNR

SEQ ID NO: 21050 - protein, 29 aa, Artificial Sequence
  Description of Artificial Sequence: Synthetic peptide
DEAEIRTTNPVATEQYGSVATNLTAQGND

SEQ ID NO: 21051 - protein, 30 aa, Artificial Sequence
  Description of Artificial Sequence: Synthetic polypeptide
DEEEIRTTNPVATEQYGSVETGLQRINEDY

SEQ ID NO: 21052 - protein, 30 aa, Artificial Sequence
  Description of Artificial Sequence: Synthetic polypeptide
DEEEIRTTNPVATEQYGSVETGLQRIVNEM

SEQ ID NO: 21053 - protein, 30 aa, Artificial Sequence
  Description of Artificial Sequence: Synthetic polypeptide
DEEPIRTTNPVATEQYFSEVSTNQQQIGNR

SEQ ID NO: 21054 - protein, 31 aa, Artificial Sequence
  Description of Artificial Sequence: Synthetic polypeptide
DEEEIRTTNPVATEPYGSVCFTDNLTQGGNR

SEQ ID NO: 21055 - protein, 30 aa, Artificial Sequence
  Description of Artificial Sequence: Synthetic polypeptide
DEEEIRTTNPVATEQYGSVSNMDLQRQENI

SEQ ID NO: 21056 - protein, 30 aa, Artificial Sequence
  Description of Artificial Sequence: Synthetic polypeptide
DEEPIRTTNPVATEQWGSVATNNLQSGENR

SEQ ID NO: 21057 - protein, 30 aa, Artificial Sequence
  Description of Artificial Sequence: Synthetic polypeptide
DEEEIRTTNPVATEQYGSVETGLQRLEIRT

SEQ ID NO: 21058 - protein, 30 aa, Artificial Sequence
  Description of Artificial Sequence: Synthetic polypeptide
DEEPIRTTNPVATEQWGSVATNNLQMGDNR

SEQ ID NO: 21059 - protein, 30 aa, Artificial Sequence
  Description of Artificial Sequence: Synthetic polypeptide
DEEPIRTTNPVATEQWGSVATNNLQGGVNR

SEQ ID NO: 21060 - protein, 30 aa, Artificial Sequence
  Description of Artificial Sequence: Synthetic polypeptide
DEEEIRTTNPVATEQYGSVSNMNDGQGGNI

SEQ ID NO: 21061 - protein, 31 aa, Artificial Sequence
  Description of Artificial Sequence: Synthetic polypeptide
DEEEIRTTNPVATEQYGSVETGLQRQGSERE

SEQ ID NO: 21062 - protein, 29 aa, Artificial Sequence
  Description of Artificial Sequence: Synthetic peptide
DEEPIRTTNPVATENYGQVTTNLQDGSNR

SEQ ID NO: 21063 - protein, 29 aa, Artificial Sequence
  Description of Artificial Sequence: Synthetic peptide
DEEPIRTTNPVATEIYGQVTTNDQRGENR

SEQ ID NO: 21064 - protein, 30 aa, Artificial Sequence
  Description of Artificial Sequence: Synthetic polypeptide
DEAEIRTTNPVATEQYGSVATNLQRGSTQV

SEQ ID NO: 21065 - protein, 31 aa, Artificial Sequence
  Description of Artificial Sequence: Synthetic polypeptide
TEEEIRTTNPVATEQYGSVCSTNLQNGSNVS

SEQ ID NO: 21066 - protein, 31 aa, Artificial Sequence
  Description of Artificial Sequence: Synthetic polypeptide
TEEEIRTTNPVATEQYGSVCSTNLQRGSDAY

SEQ ID NO: 21067 - protein, 31 aa, Artificial Sequence
  Description of Artificial Sequence: Synthetic polypeptide
TEEEIRTTNPVATEQYGSVCSTPLQRGNEDK

SEQ ID NO: 21068 - protein, 30 aa, Artificial Sequence
  Description of Artificial Sequence: Synthetic polypeptide
DEAEIRTTNPVATEQYGSVATNLQQRGEQA

SEQ ID NO: 21069 - protein, 28 aa, Artificial Sequence
  Description of Artificial Sequence: Synthetic peptide
DDEHIRTTNPVATEQYGKVSTNHQRVNV

SEQ ID NO: 21070 - protein, 28 aa, Artificial Sequence
  Description of Artificial Sequence: Synthetic peptide
DDEHIRTTNPVATEQYGQVSTNHQRVNL

SEQ ID NO: 21071 - protein, 28 aa, Artificial Sequence
  Description of Artificial Sequence: Synthetic peptide
DDEMIRTTNPVATEQYGWVSTNHQRVNL

SEQ ID NO: 21072 - protein, 30 aa, Artificial Sequence
  Description of Artificial Sequence: Synthetic polypeptide
DEAEIRTTNPVATEQYGSVATNLQNGDNNS

SEQ ID NO: 21073 - protein, 30 aa, Artificial Sequence
  Description of Artificial Sequence: Synthetic polypeptide
DEEEIRTTNPVATEVYGTVSVSANLQPGNV

SEQ ID NO: 21074 - protein, 33 aa, Artificial Sequence
  Description of Artificial Sequence: Synthetic polypeptide
TEEEIRTTNPVATEQYGSTVSVTNLSQRTGDNR

SEQ ID NO: 21075 - protein, 31 aa, Artificial Sequence
  Description of Artificial Sequence: Synthetic polypeptide
DEEEIRTTNPVATEQYGSVSNMDLIQEGENR

SEQ ID NO: 21076 - protein, 31 aa, Artificial Sequence
  Description of Artificial Sequence: Synthetic polypeptide
DEEEIRTTNPVATEQYGSVSVTNHDRIGSNG

SEQ ID NO: 21077 - protein, 29 aa, Artificial Sequence
  Description of Artificial Sequence: Synthetic peptide
DEEQIRTTNPVATEQYGSVSTHEGERGNT

SEQ ID NO: 21078 - protein, 29 aa, Artificial Sequence
  Description of Artificial Sequence: Synthetic peptide
DEEQIRTTNPVATEQYGSVSTHEERGNTM

SEQ ID NO: 21079 - protein, 29 aa, Artificial Sequence
  Description of Artificial Sequence: Synthetic peptide
DEEQIRTTNPVATEQYGSVSTHEELRGNQ

SEQ ID NO: 21080 - protein, 31 aa, Artificial Sequence
  Description of Artificial Sequence: Synthetic polypeptide
AEEEIRATNPVATEQYGSVVSTNLQRVENTR

SEQ ID NO: 21081 - protein, 28 aa, Artificial Sequence
  Description of Artificial Sequence: Synthetic peptide
YEEEIRCTNPIATEQYGSVSENLMWGNR

SEQ ID NO: 21082 - protein, 32 aa, Artificial Sequence
  Description of Artificial Sequence: Synthetic polypeptide
DEEEIRTTNPVATEQYGSVSPTQLQRGIDNNI

SEQ ID NO: 21083 - protein, 31 aa, Artificial Sequence
  Description of Artificial Sequence: Synthetic polypeptide
DEEEIRTTNPVATEQYGSVSPGFNLQRLNIN

SEQ ID NO: 21084 - protein, 30 aa, Artificial Sequence
  Description of Artificial Sequence: Synthetic polypeptide
DEEEIRTTNPVATEQYGSVSVTMLDPRGEQ

SEQ ID NO: 21085 - protein, 29 aa, Artificial Sequence
  Description of Artificial Sequence: Synthetic peptide
AEEEIRATNPVATEQYGSVSTNLQAGEGD

SEQ ID NO: 21086 - protein, 29 aa, Artificial Sequence
  Description of Artificial Sequence: Synthetic peptide
DEEQIRTTNPVATEQYGSVSTGGEDRGNT

SEQ ID NO: 21087 - protein, 33 aa, Artificial Sequence
  Description of Artificial Sequence: Synthetic polypeptide
DEEEIRTTNPVATEQYGSVSPTQNLQRGVNVDQ

SEQ ID NO: 21088 - protein, 31 aa, Artificial Sequence
  Description of Artificial Sequence: Synthetic polypeptide
DEEEIRTTNPVATEQYGSVSNGNLGQGGGNG

SEQ ID NO: 21089 - protein, 28 aa, Artificial Sequence
  Description of Artificial Sequence: Synthetic peptide
DEEQIRTTNPVATEQYGSVSTGEGDGNT

SEQ ID NO: 21090 - protein, 32 aa, Artificial Sequence
  Description of Artificial Sequence: Synthetic polypeptide
DEEEIRTTNPVATEQYGSVSPTPNPLQPRLIR

SEQ ID NO: 21091 - protein, 29 aa, Artificial Sequence
  Description of Artificial Sequence: Synthetic peptide
DEEQIRTTNPVATEQYGSVSTEGELRGNT

SEQ ID NO: 21092 - protein, 29 aa, Artificial Sequence
  Description of Artificial Sequence: Synthetic peptide
DEEQIRTTNPVATEQYGSVSTEELRSGNQ

SEQ ID NO: 21093 - protein, 28 aa, Artificial Sequence
  Description of Artificial Sequence: Synthetic peptide
YEEEIRCTNPIATEQYGSVSENLMRGNQ

SEQ ID NO: 21094 - protein, 29 aa, Artificial Sequence
  Description of Artificial Sequence: Synthetic peptide
DEEQIRTTNPVATEQYGSVSTEEIRGGNT

SEQ ID NO: 21095 - protein, 34 aa, Artificial Sequence
  Description of Artificial Sequence: Synthetic polypeptide
DEEEIRTTNPVATEQYGSVSPTPNLQRVGEENRM

SEQ ID NO: 21096 - protein, 29 aa, Artificial Sequence
  Description of Artificial Sequence: Synthetic peptide
DEEQIRTTNPVATEQYGSVSTAELRGNET

SEQ ID NO: 21097 - protein, 29 aa, Artificial Sequence
  Description of Artificial Sequence: Synthetic peptide
DEEQIRTTNPVATEQYGSVSTAEAREGNT

SEQ ID NO: 21098 - protein, 29 aa, Artificial Sequence
  Description of Artificial Sequence: Synthetic peptide
DEEQIRTTNPVATEQYGSVSPTHEERGNT

SEQ ID NO: 21099 - protein, 30 aa, Artificial Sequence
  Description of Artificial Sequence: Synthetic polypeptide
DEEEIRTTNPVATEQYGSVSNILQRGPQIS

SEQ ID NO: 21100 - protein, 28 aa, Artificial Sequence
  Description of Artificial Sequence: Synthetic peptide
YEEEIRCTNPIATEQYGSVSENLQSGNQ

SEQ ID NO: 21101 - protein, 31 aa, Artificial Sequence
  Description of Artificial Sequence: Synthetic polypeptide
DEEEIRTTNPVATEQYGSVESIEEQRVGENR

SEQ ID NO: 21102 - protein, 29 aa, Artificial Sequence
  Description of Artificial Sequence: Synthetic peptide
DEEQIRTTNPVATEQYGSVSTHETRGENT

SEQ ID NO: 21103 - protein, 31 aa, Artificial Sequence
  Description of Artificial Sequence: Synthetic polypeptide
DEEEIRTTNPVATEQYGSVSNENLQSGGNNV

SEQ ID NO: 21104 - protein, 28 aa, Artificial Sequence
  Description of Artificial Sequence: Synthetic peptide
DEEQIRTTNPVATEQYGSVSTPEDIGNT

SEQ ID NO: 21105 - protein, 28 aa, Artificial Sequence
  Description of Artificial Sequence: Synthetic peptide
AEEEIRCTNPIATEQYGSVSNNLMEGNR

SEQ ID NO: 21106 - protein, 29 aa, Artificial Sequence
  Description of Artificial Sequence: Synthetic peptide
AEEEIRCTNPIATEQYGSVSENLMRMGNR

SEQ ID NO: 21107 - protein, 31 aa, Artificial Sequence
  Description of Artificial Sequence: Synthetic polypeptide
DEEEIRTTNPVATEQYGSVSNTMMLQRGVDQ

SEQ ID NO: 21108 - protein, 28 aa, Artificial Sequence
  Description of Artificial Sequence: Synthetic peptide
AEEEIRCTNPIATEQYGSVSENLMRGYR

SEQ ID NO: 21109 - protein, 29 aa, Artificial Sequence
  Description of Artificial Sequence: Synthetic peptide
YEEEIRQTNPVATEQYGSVSIMGLQIGNR

SEQ ID NO: 21110 - protein, 29 aa, Artificial Sequence
  Description of Artificial Sequence: Synthetic peptide
YEEEIRPTNPVATEQYGSVSTNLQHIGRN

SEQ ID NO: 21111 - protein, 29 aa, Artificial Sequence
  Description of Artificial Sequence: Synthetic peptide
YEEEIRGTNPVATEQYGSIVSTNDQRTNG

SEQ ID NO: 21112 - protein, 28 aa, Artificial Sequence
  Description of Artificial Sequence: Synthetic peptide
AEEEIRCTNPIATEQYGSVSENLMRGGR

SEQ ID NO: 21113 - protein, 29 aa, Artificial Sequence
  Description of Artificial Sequence: Synthetic peptide
DEEQIRTTNPVATEQYGSVSTNGETGGNT

SEQ ID NO: 21114 - protein, 29 aa, Artificial Sequence
  Description of Artificial Sequence: Synthetic peptide
DEEQIRTTNPVATEQYGSVSTMEARGVNT

SEQ ID NO: 21115 - protein, 29 aa, Artificial Sequence
  Description of Artificial Sequence: Synthetic peptide
YEEEIRGTNPVATEQYGSAYSTNDQRGNG

SEQ ID NO: 21116 - protein, 29 aa, Artificial Sequence
  Description of Artificial Sequence: Synthetic peptide
DEEQIRTTNPVATEQYGSVSTMDEGRGNT

SEQ ID NO: 21117 - protein, 29 aa, Artificial Sequence
  Description of Artificial Sequence: Synthetic peptide
DEEQIRTTNPVATEQYGSVSTLEQLGGNT

SEQ ID NO: 21118 - protein, 28 aa, Artificial Sequence
  Description of Artificial Sequence: Synthetic peptide
AEEEIRCTNPIATEQYGSVSENLERGNT

SEQ ID NO: 21119 - protein, 29 aa, Artificial Sequence
  Description of Artificial Sequence: Synthetic peptide
YEEEIRCTNPVCTEQYGQVSTNLQQRGNI

SEQ ID NO: 21120 - protein, 29 aa, Artificial Sequence
  Description of Artificial Sequence: Synthetic peptide
DEEQIRTTNPVATEQYGSVSTIELRDGNT

SEQ ID NO: 21121 - protein, 28 aa, Artificial Sequence
  Description of Artificial Sequence: Synthetic peptide
AEEEIRCTNPIATEQYGEVSENLQRGGR

SEQ ID NO: 21122 - protein, 28 aa, Artificial Sequence
  Description of Artificial Sequence: Synthetic peptide
DEEQIRTTNPVATEQYGSVSTHQLGGNN

SEQ ID NO: 21123 - protein, 29 aa, Artificial Sequence
  Description of Artificial Sequence: Synthetic peptide
DEEQIRTTNPVATEQYGSVSTHHTRVGNT

SEQ ID NO: 21124 - protein, 29 aa, Artificial Sequence
  Description of Artificial Sequence: Synthetic peptide
DEEQIRTTNPVATEQYGSVSTHHALRGNT

SEQ ID NO: 21125 - protein, 28 aa, Artificial Sequence
  Description of Artificial Sequence: Synthetic peptide
DEEQIRTTNPVATEQYGSVSTHGLGGNT

SEQ ID NO: 21126 - protein, 31 aa, Artificial Sequence
  Description of Artificial Sequence: Synthetic polypeptide
DEEEIRTTNPVATEQYGSVSVTMLQRGAQDD

SEQ ID NO: 21127 - protein, 30 aa, Artificial Sequence
  Description of Artificial Sequence: Synthetic polypeptide
DDEEISTTNPVATEQYGCVSTMNLQGGSNR

SEQ ID NO: 21128 - protein, 29 aa, Artificial Sequence
  Description of Artificial Sequence: Synthetic peptide
DEEQIRTTNPVATEQYGSVSETHEIRGNT

SEQ ID NO: 21129 - protein, 31 aa, Artificial Sequence
  Description of Artificial Sequence: Synthetic polypeptide
DEEEIRTTNPVATEQYGSVSVTMLQRNGILG

SEQ ID NO: 21130 - protein, 29 aa, Artificial Sequence
  Description of Artificial Sequence: Synthetic peptide
DEDEIRTTNPVATEQYGVVTVTNLQRGTS

SEQ ID NO: 21131 - protein, 28 aa, Artificial Sequence
  Description of Artificial Sequence: Synthetic peptide
DDEEISTTNPVATNQYGSVSTNPMRGNF

SEQ ID NO: 21132 - protein, 30 aa, Artificial Sequence
  Description of Artificial Sequence: Synthetic polypeptide
DEEEIRTTNPVATEQYGSVSVTNGGLRGQF

SEQ ID NO: 21133 - protein, 29 aa, Artificial Sequence
  Description of Artificial Sequence: Synthetic peptide
DDEEISTTNPVATQQYGSVSTNPIRGNRA

SEQ ID NO: 21134 - protein, 28 aa, Artificial Sequence
  Description of Artificial Sequence: Synthetic peptide
DDEEISTTNPVATTQYGSVSTNPDDGNR

SEQ ID NO: 21135 - protein, 29 aa, Artificial Sequence
  Description of Artificial Sequence: Synthetic peptide
YEEEIRATNPVATEQYGSVSTMGLQNGSR

SEQ ID NO: 21136 - protein, 28 aa, Artificial Sequence
  Description of Artificial Sequence: Synthetic peptide
DDEEISTTNPVATTQYGSVSTNPMEGNR

SEQ ID NO: 21137 - protein, 30 aa, Artificial Sequence
  Description of Artificial Sequence: Synthetic polypeptide
DEEEIRTTNPVATEQYGSVSVTNGGQAGIG

SEQ ID NO: 21138 - protein, 30 aa, Artificial Sequence
  Description of Artificial Sequence: Synthetic polypeptide
DEEQIRTTNPVATEQAGSVATNNLQLGVNR

SEQ ID NO: 21139 - protein, 30 aa, Artificial Sequence
  Description of Artificial Sequence: Synthetic polypeptide
DEEEIRTTNPVATEQYGSVSVTNGGQEGQE

SEQ ID NO: 21140 - protein, 31 aa, Artificial Sequence
  Description of Artificial Sequence: Synthetic polypeptide
TEEEIRTTNPVATEQYGSTVSTNHQNRGGNE

SEQ ID NO: 21141 - protein, 30 aa, Artificial Sequence
  Description of Artificial Sequence: Synthetic polypeptide
DEEQIRTTNPVATEPYGTVTTNLQIRGSNR

SEQ ID NO: 21142 - protein, 32 aa, Artificial Sequence
  Description of Artificial Sequence: Synthetic polypeptide
TEEEIRTTNPVATEQYGSTVSTNLQRTVGNNK

SEQ ID NO: 21143 - protein, 30 aa, Artificial Sequence
  Description of Artificial Sequence: Synthetic polypeptide
DEEQIRTTNPVATEIYGSVSTGLQLREGNP

SEQ ID NO: 21144 - protein, 30 aa, Artificial Sequence
  Description of Artificial Sequence: Synthetic polypeptide
DEEEIRTTNPVATEQYGSVSNMDLERGENE

SEQ ID NO: 21145 - protein, 28 aa, Artificial Sequence
  Description of Artificial Sequence: Synthetic peptide
DEEQIRTTNPEATEQYGCVSTNQQFGNC

SEQ ID NO: 21146 - protein, 29 aa, Artificial Sequence
  Description of Artificial Sequence: Synthetic peptide
YEEEIRATNPVATEQYGSIVSANDQRGNG

SEQ ID NO: 21147 - protein, 30 aa, Artificial Sequence
  Description of Artificial Sequence: Synthetic polypeptide
DEEEIATTNPVATEMYGSVSTNLQQGNDPM

SEQ ID NO: 21148 - protein, 33 aa, Artificial Sequence
  Description of Artificial Sequence: Synthetic polypeptide
TEEEIRTTNPVATEQYGSTVSTNLSQTRVGNRD

SEQ ID NO: 21149 - protein, 29 aa, Artificial Sequence
  Description of Artificial Sequence: Synthetic peptide
AEEEIRATNPVATEQWGSVATNDQRGNRQ

SEQ ID NO: 21150 - protein, 29 aa, Artificial Sequence
  Description of Artificial Sequence: Synthetic peptide
AEEEIRATNPVATEHYGSVSTNLQVDGNS

SEQ ID NO: 21151 - protein, 32 aa, Artificial Sequence
  Description of Artificial Sequence: Synthetic polypeptide
DEEEIRTTNPVATEQYGSVSVTNGVQTGENRQ

SEQ ID NO: 21152 - protein, 28 aa, Artificial Sequence
  Description of Artificial Sequence: Synthetic peptide
DEEQIRTTNPVATEPYGSVSTHHTRGNT

SEQ ID NO: 21153 - protein, 31 aa, Artificial Sequence
  Description of Artificial Sequence: Synthetic polypeptide
TEEEIRTTNPVATEQYGSTVSTNELTRGGSR

SEQ ID NO: 21154 - protein, 30 aa, Artificial Sequence
  Description of Artificial Sequence: Synthetic polypeptide
DDEEISTTNPVATEQYGSVSTELNQRGSNQ

SEQ ID NO: 21155 - protein, 30 aa, Artificial Sequence
  Description of Artificial Sequence: Synthetic polypeptide
DEEEIRTTNPVATEQYGSVSVTNEQDTNQQ

SEQ ID NO: 21156 - protein, 32 aa, Artificial Sequence
  Description of Artificial Sequence: Synthetic polypeptide
DEEEIRTTNPVATEQYGSVSVTMMLQRGVERQ

SEQ ID NO: 21157 - protein, 28 aa, Artificial Sequence
  Description of Artificial Sequence: Synthetic peptide
YEEEIRCTNPIATEQYGSVSENLMMGNR

SEQ ID NO: 21158 - protein, 31 aa, Artificial Sequence
  Description of Artificial Sequence: Synthetic polypeptide
DEEEIRTTNPVATEQYGSVSVTMMLQRGVQS

SEQ ID NO: 21159 - protein, 28 aa, Artificial Sequence
  Description of Artificial Sequence: Synthetic peptide
DEECSRTTNPCAYEQYGCVSTNLQGGNR

SEQ ID NO: 21160 - protein, 28 aa, Artificial Sequence
  Description of Artificial Sequence: Synthetic peptide
DEAEIATTNPVATAQYGSVSTNLANGNT

SEQ ID NO: 21161 - protein, 31 aa, Artificial Sequence
  Description of Artificial Sequence: Synthetic polypeptide
DEEEIRTTNPVATEQYGAVVSTNLQGEGGNG

SEQ ID NO: 21162 - protein, 29 aa, Artificial Sequence
  Description of Artificial Sequence: Synthetic peptide
AEEEIRATNPVATEQYGSVATNLQADNRL

SEQ ID NO: 21163 - protein, 29 aa, Artificial Sequence
  Description of Artificial Sequence: Synthetic peptide
AEEEIRATNPVATEQYGSVATNDQQGNTR

SEQ ID NO: 21164 - protein, 32 aa, Artificial Sequence
  Description of Artificial Sequence: Synthetic polypeptide
DEEEIRTTNPVATEQYGSVESTNLQQDGNNED

SEQ ID NO: 21165 - protein, 28 aa, Artificial Sequence
  Description of Artificial Sequence: Synthetic peptide
DEEQIRTTNPVATEQYGSCSTDQLRGNT

SEQ ID NO: 21166 - protein, 32 aa, Artificial Sequence
  Description of Artificial Sequence: Synthetic polypeptide
DEEEIRTTNPVATEQYGSVSPTPNLQREQNLF

SEQ ID NO: 21167 - protein, 31 aa, Artificial Sequence
  Description of Artificial Sequence: Synthetic polypeptide
TEEEIRTTNPVATEQYGSTVSTNAQQRGGNG

SEQ ID NO: 21168 - protein, 29 aa, Artificial Sequence
  Description of Artificial Sequence: Synthetic peptide
DEEQIRTTNPVATEQYGCVSTNISQFGNE

SEQ ID NO: 21169 - protein, 33 aa, Artificial Sequence
  Description of Artificial Sequence: Synthetic polypeptide
TEEEIRTTNPVATEQYGSTVSTNELPQRTGNNR

SEQ ID NO: 21170 - protein, 28 aa, Artificial Sequence
  Description of Artificial Sequence: Synthetic peptide
DEEQIRTTNPVATEQYGCVSTHEERGNQ

SEQ ID NO: 21171 - protein, 29 aa, Artificial Sequence
  Description of Artificial Sequence: Synthetic peptide
YEEEIRCTNPAATEQYGSVASENLMRGNR

SEQ ID NO: 21172 - protein, 32 aa, Artificial Sequence
  Description of Artificial Sequence: Synthetic polypeptide
DEEEIRTTNPVATEQYGSVSVTNDLQRGLGQD

SEQ ID NO: 21173 - protein, 28 aa, Artificial Sequence
  Description of Artificial Sequence: Synthetic peptide
DEEQIRTTNPVATEQYGCVSTAELRGNA

SEQ ID NO: 21174 - protein, 31 aa, Artificial Sequence
  Description of Artificial Sequence: Synthetic polypeptide
DEEEIRTTNPVATEQYGAVVSTNLFQGGNQG

SEQ ID NO: 21175 - protein, 29 aa, Artificial Sequence
  Description of Artificial Sequence: Synthetic peptide
DEEQIRTTNPVATEQYGAVSTNQQFQGNG

SEQ ID NO: 21176 - protein, 28 aa, Artificial Sequence
  Description of Artificial Sequence: Synthetic peptide
DEECSRTTNPCAYEQYGEVSTNLQGGNR

SEQ ID NO: 21177 - protein, 28 aa, Artificial Sequence
  Description of Artificial Sequence: Synthetic peptide
DEEQIRTTNPVATEQYGAVSTNQQFGEE

SEQ ID NO: 21178 - protein, 31 aa, Artificial Sequence
  Description of Artificial Sequence: Synthetic polypeptide
DEEEIRTTNPVATEQYGSVSNMDDLQRGELR

SEQ ID NO: 21179 - protein, 29 aa, Artificial Sequence
  Description of Artificial Sequence: Synthetic peptide
YEEEIRCTNPIATEQYGSVSENLMRGMNR

SEQ ID NO: 21180 - protein, 32 aa, Artificial Sequence
  Description of Artificial Sequence: Synthetic polypeptide
TEEEIRTTNPVATEQYGSVNTNNLPQRGGNYR

SEQ ID NO: 21181 - protein, 31 aa, Artificial Sequence
  Description of Artificial Sequence: Synthetic polypeptide
DEEEIRTTNPVATEQYGSVSTNDQGIGQNEV

SEQ ID NO: 21182 - protein, 32 aa, Artificial Sequence
  Description of Artificial Sequence: Synthetic polypeptide
DEEEIRTTNPVATEQYGCVSCTNLSQRGGSNL

SEQ ID NO: 21183 - protein, 32 aa, Artificial Sequence
  Description of Artificial Sequence: Synthetic polypeptide
DEEEIRTTNPVATEQYGSVSTFNLQTEGNNGN

SEQ ID NO: 21184 - protein, 30 aa, Artificial Sequence
  Description of Artificial Sequence: Synthetic polypeptide
DEEEIRTTNPVATEQYGSCSNTNLQEGSEQ

SEQ ID NO: 21185 - protein, 28 aa, Artificial Sequence
  Description of Artificial Sequence: Synthetic peptide
SEEEIRCTNPIATEQYGSVSENLMHGNR

SEQ ID NO: 21186 - protein, 32 aa, Artificial Sequence
  Description of Artificial Sequence: Synthetic polypeptide
EEEEIRTTNPVATEQYGSTVSCTNLQRGGNNT

SEQ ID NO: 21187 - protein, 33 aa, Artificial Sequence
  Description of Artificial Sequence: Synthetic polypeptide
DEEEIRTTNPVATEQYGSCSPTENDLSQRDGNR

SEQ ID NO: 21188 - protein, 32 aa, Artificial Sequence
  Description of Artificial Sequence: Synthetic polypeptide
DEEEIRTTNPVATEQYGSCSPTENLGQGIGNR

SEQ ID NO: 21189 - protein, 29 aa, Artificial Sequence
  Description of Artificial Sequence: Synthetic peptide
SEEEIRCTNPIATEQYGSVSENLMHRGNR

SEQ ID NO: 21190 - protein, 28 aa, Artificial Sequence
  Description of Artificial Sequence: Synthetic peptide
SEEEIRCTNPIATEQYGSVSENLMIGNR

SEQ ID NO: 21191 - protein, 29 aa, Artificial Sequence
  Description of Artificial Sequence: Synthetic peptide
SEEEIRCTNPIATEQYGSVSENLMIRGNR

SEQ ID NO: 21192 - protein, 28 aa, Artificial Sequence
  Description of Artificial Sequence: Synthetic peptide
SEEEIRCTNPIATEQYGSVSENLMKGNR

SEQ ID NO: 21193 - protein, 28 aa, Artificial Sequence
  Description of Artificial Sequence: Synthetic peptide
SEEEIRCTNPIATEQYGSVSENLMLGNR

SEQ ID NO: 21194 - protein, 29 aa, Artificial Sequence
  Description of Artificial Sequence: Synthetic peptide
SEEEIRCTNPIATEQYGSVSENLMLRGNR

SEQ ID NO: 21195 - protein, 30 aa, Artificial Sequence
  Description of Artificial Sequence: Synthetic polypeptide
DEEEIRTTNPVATEQYGSCSNTNLEREGDQ

SEQ ID NO: 21196 - protein, 30 aa, Artificial Sequence
  Description of Artificial Sequence: Synthetic polypeptide
DEEEIRTTNPVATEQYGSCSPTNDLQGDNI

SEQ ID NO: 21197 - protein, 29 aa, Artificial Sequence
  Description of Artificial Sequence: Synthetic peptide
SEEEIRCTNPIATEQYGSVSENLMMRGNR

SEQ ID NO: 21198 - protein, 28 aa, Artificial Sequence
  Description of Artificial Sequence: Synthetic peptide
SEEEIRCTNPIATEQYGSVSENLMNGNR

SEQ ID NO: 21199 - protein, 32 aa, Artificial Sequence
  Description of Artificial Sequence: Synthetic polypeptide
DEEEIRTTNPVATEQYGSCSPTNSLQRGLVRQ

SEQ ID NO: 21200 - protein, 29 aa, Artificial Sequence
  Description of Artificial Sequence: Synthetic peptide
AEEEIRTTNPVATEQYGSVSTTQQSEGNN

SEQ ID NO: 21201 - protein, 31 aa, Artificial Sequence
  Description of Artificial Sequence: Synthetic polypeptide
EEEEIRTTNPVATEPYGSVSTNLSTRGGNNR

SEQ ID NO: 21202 - protein, 29 aa, Artificial Sequence
  Description of Artificial Sequence: Synthetic peptide
SEEEIRCTNPIATEQYGSVSENLMNRGNR

SEQ ID NO: 21203 - protein, 28 aa, Artificial Sequence
  Description of Artificial Sequence: Synthetic peptide
SEEEIRCTNPIATEQYGSVSENLMPGNR

SEQ ID NO: 21204 - protein, 30 aa, Artificial Sequence
  Description of Artificial Sequence: Synthetic polypeptide
DEEEIRTTNPVATEQYGSCSSPNMLQRDQR

SEQ ID NO: 21205 - protein, 30 aa, Artificial Sequence
  Description of Artificial Sequence: Synthetic polypeptide
DEEEIRTTNPVATEQYGSCSSPNMLQRLNI

SEQ ID NO: 21206 - protein, 29 aa, Artificial Sequence
  Description of Artificial Sequence: Synthetic peptide
SEEEIRCTNPIATEQYGSVSENLMPRGNR

SEQ ID NO: 21207 - protein, 28 aa, Artificial Sequence
  Description of Artificial Sequence: Synthetic peptide
SEEEIRCTNPIATEQYGSVSENLMQGNR

SEQ ID NO: 21208 - protein, 28 aa, Artificial Sequence
  Description of Artificial Sequence: Synthetic peptide
EEEEIRATNPTATEQYGSVSENLMLGNR

SEQ ID NO: 21209 - protein, 28 aa, Artificial Sequence
  Description of Artificial Sequence: Synthetic peptide
SEEEIRCTNPIATEQYGSVSENLMMGNR

SEQ ID NO: 21210 - protein, 29 aa, Artificial Sequence
  Description of Artificial Sequence: Synthetic peptide
SEEEIRCTNPIATEQYGSVSENLMQPGNR

SEQ ID NO: 21211 - protein, 31 aa, Artificial Sequence
  Description of Artificial Sequence: Synthetic polypeptide
DEEEIRTTNPVATEQYGSVSTFNLSNENGNG

SEQ ID NO: 21212 - protein, 32 aa, Artificial Sequence
  Description of Artificial Sequence: Synthetic polypeptide
DEEEIRTTNPVATEQYGSCSNTENDLQRENRM

SEQ ID NO: 21213 - protein, 33 aa, Artificial Sequence
  Description of Artificial Sequence: Synthetic polypeptide
EEEEIRTTNPVATEQYGSVPSTNGLSQRTGNQR

SEQ ID NO: 21214 - protein, 29 aa, Artificial Sequence
  Description of Artificial Sequence: Synthetic peptide
SEEEIRCTNPIATEQYGSVSENLMARGNR

SEQ ID NO: 21215 - protein, 29 aa, Artificial Sequence
  Description of Artificial Sequence: Synthetic peptide
DEEEIRTTNPVATEQYGSCSLNDDRGNDG

SEQ ID NO: 21216 - protein, 28 aa, Artificial Sequence
  Description of Artificial Sequence: Synthetic peptide
SEEEIRCTNPIATEQYGSVSENLMCGNR

SEQ ID NO: 21217 - protein, 28 aa, Artificial Sequence
  Description of Artificial Sequence: Synthetic peptide
SEEEIRCTNPIATEQYGSVSENLMDGNR

SEQ ID NO: 21218 - protein, 32 aa, Artificial Sequence
  Description of Artificial Sequence: Synthetic polypeptide
EEEEIRTTNPVATEQYGSVITMNLNQRGENYR

SEQ ID NO: 21219 - protein, 29 aa, Artificial Sequence
  Description of Artificial Sequence: Synthetic peptide
SEEEIRCTNPIATEQYGSVSENLMDRGNR

SEQ ID NO: 21220 - protein, 32 aa, Artificial Sequence
  Description of Artificial Sequence: Synthetic polypeptide
DEEEIRTTNPVATEQYGSVSITNLQFGGGNTG

SEQ ID NO: 21221 - protein, 30 aa, Artificial Sequence
  Description of Artificial Sequence: Synthetic polypeptide
DEEEIRTTNPVATEQYGSCSMNLDQNGDRQ

SEQ ID NO: 21222 - protein, 32 aa, Artificial Sequence
  Description of Artificial Sequence: Synthetic polypeptide
DEEEIRTTNPVATEQYGSCSMTENGSQREGNR

SEQ ID NO: 21223 - protein, 33 aa, Artificial Sequence
  Description of Artificial Sequence: Synthetic polypeptide
DEEEIRTTNPVATEQYGSCSMTENLSQRSGNDR

SEQ ID NO: 21224 - protein, 29 aa, Artificial Sequence
  Description of Artificial Sequence: Synthetic peptide
EEEEIRTTNPVATEQYGSVETALQTGFRD

SEQ ID NO: 21225 - protein, 29 aa, Artificial Sequence
  Description of Artificial Sequence: Synthetic peptide
SEEEIRCTNPIATEQYGSVSENLMGRGNR

SEQ ID NO: 21226 - protein, 28 aa, Artificial Sequence
  Description of Artificial Sequence: Synthetic peptide
SEEEIRCTNPIATEQYGSVSENLMEGNR

SEQ ID NO: 21227 - protein, 29 aa, Artificial Sequence
  Description of Artificial Sequence: Synthetic peptide
SEEEIRCTNPIATEQYGSVSENLMERGNR

SEQ ID NO: 21228 - protein, 28 aa, Artificial Sequence
  Description of Artificial Sequence: Synthetic peptide
SEEEIRCTNPIATEQYGSVSENLMFGNR

SEQ ID NO: 21229 - protein, 30 aa, Artificial Sequence
  Description of Artificial Sequence: Synthetic polypeptide
DEEEIRTTNPVATEQYGSVSTFNQNNGNGD

SEQ ID NO: 21230 - protein, 32 aa, Artificial Sequence
  Description of Artificial Sequence: Synthetic polypeptide
DEEEIRTTNPVATEQYGSVSTNLQRDGPEITQ

SEQ ID NO: 21231 - protein, 30 aa, Artificial Sequence
  Description of Artificial Sequence: Synthetic polypeptide
DEEEIRTTNPVATEQYGSCSNINLERGNDQ

SEQ ID NO: 21232 - protein, 31 aa, Artificial Sequence
  Description of Artificial Sequence: Synthetic polypeptide
DEEEIRTTNPVATEQYGSVSTFNNQGNGQNQ

SEQ ID NO: 21233 - protein, 29 aa, Artificial Sequence
  Description of Artificial Sequence: Synthetic peptide
SEEEIRCTNPIATEQYGSVSENLMFRGNR

SEQ ID NO: 21234 - protein, 29 aa, Artificial Sequence
  Description of Artificial Sequence: Synthetic peptide
EEEEIRTTNPVATEQYGSVATLLQQGFVR

SEQ ID NO: 21235 - protein, 30 aa, Artificial Sequence
  Description of Artificial Sequence: Synthetic polypeptide
DEEEIRCTNPCATEQYGSVSSDLQQRNGNR

SEQ ID NO: 21236 - protein, 32 aa, Artificial Sequence
  Description of Artificial Sequence: Synthetic polypeptide
DEEEIRTTNPVATEQYGSVSITNLQGSGINGQ

SEQ ID NO: 21237 - protein, 28 aa, Artificial Sequence
  Description of Artificial Sequence: Synthetic peptide
DEEEIRCTNPACTEQYGSVSTNPQFGNV

SEQ ID NO: 21238 - protein, 28 aa, Artificial Sequence
  Description of Artificial Sequence: Synthetic peptide
SEEEIRCTNPIATEQYGSVSENLMGGNR

SEQ ID NO: 21239 - protein, 31 aa, Artificial Sequence
  Description of Artificial Sequence: Synthetic polypeptide
DEEEIRTTNPVATEQYGSVSTFNQNQGGGNG

SEQ ID NO: 21240 - protein, 28 aa, Artificial Sequence
  Description of Artificial Sequence: Synthetic peptide
SEEEIRCTNPIATEQYGSVSENLMAGNR

SEQ ID NO: 21241 - protein, 29 aa, Artificial Sequence
  Description of Artificial Sequence: Synthetic peptide
SEEEIRCTNPIATEQYGSVSENLMRAGNR

SEQ ID NO: 21242 - protein, 28 aa, Artificial Sequence
  Description of Artificial Sequence: Synthetic peptide
SEEEIRCTNPIATEQYGSVSENLMRANR

SEQ ID NO: 21243 - protein, 28 aa, Artificial Sequence
  Description of Artificial Sequence: Synthetic peptide
SEEEIRCTNPIATEQYGSVSENLMRGGR

SEQ ID NO: 21244 - protein, 30 aa, Artificial Sequence
  Description of Artificial Sequence: Synthetic polypeptide
EEAEIRTTNPVATEQYGSVSTNLQGGDGNQ

SEQ ID NO: 21245 - protein, 31 aa, Artificial Sequence
  Description of Artificial Sequence: Synthetic polypeptide
DEEEIRTTNPVATEQYGSVSITNLQNEGLQE

SEQ ID NO: 21246 - protein, 29 aa, Artificial Sequence
  Description of Artificial Sequence: Synthetic peptide
SEEEIRCTNPIATEQYGSVSENLMRGHNR

SEQ ID NO: 21247 - protein, 31 aa, Artificial Sequence
  Description of Artificial Sequence: Synthetic polypeptide
DEEEIRTTNPVATEQYGSVSTFNLIQGVGEP

SEQ ID NO: 21248 - protein, 28 aa, Artificial Sequence
  Description of Artificial Sequence: Synthetic peptide
SEEEIRCTNPIATEQYGSVSENLMRGHR

SEQ ID NO: 21249 - protein, 29 aa, Artificial Sequence
  Description of Artificial Sequence: Synthetic peptide
SEEEIRCTNPIATEQYGSVSENLMRGINR

SEQ ID NO: 21250 - protein, 28 aa, Artificial Sequence
  Description of Artificial Sequence: Synthetic peptide
SEEEIRCTNPIATEQYGSVSENLMRGIR

SEQ ID NO: 21251 - protein, 32 aa, Artificial Sequence
  Description of Artificial Sequence: Synthetic polypeptide
DEEEIRTTNPVATEQYGSCSTDNLQRPDINQR

SEQ ID NO: 21252 - protein, 30 aa, Artificial Sequence
  Description of Artificial Sequence: Synthetic polypeptide
DEEEIRTTNPVATEQYGSCSTDNLQYGDIQ

SEQ ID NO: 21253 - protein, 29 aa, Artificial Sequence
  Description of Artificial Sequence: Synthetic peptide
SEEEIRCTNPIATEQYGSVSENLMRGLNR

SEQ ID NO: 21254 - protein, 31 aa, Artificial Sequence
  Description of Artificial Sequence: Synthetic polypeptide
DEEEIRTTNPVATEQYGSVSTFNLIQEPNLQ

SEQ ID NO: 21255 - protein, 29 aa, Artificial Sequence
  Description of Artificial Sequence: Synthetic peptide
SEEEIRCTNPIATEQYGSVSENLMRGGNR

SEQ ID NO: 21256 - protein, 28 aa, Artificial Sequence
  Description of Artificial Sequence: Synthetic peptide
SEEEIRCTNPIATEQYGSVSENLMRGLR

SEQ ID NO: 21257 - protein, 29 aa, Artificial Sequence
  Description of Artificial Sequence: Synthetic peptide
SEEEIRCTNPIATEQYGSVSENLMRGMNR

SEQ ID NO: 21258 - protein, 32 aa, Artificial Sequence
  Description of Artificial Sequence: Synthetic polypeptide
DEEEIRTTNPVATEQYGSVSTFNLGQNGDENE

SEQ ID NO: 21259 - protein, 28 aa, Artificial Sequence
  Description of Artificial Sequence: Synthetic peptide
SEEEIRCTNPIATEQYGSVSENLMRGMR

SEQ ID NO: 21260 - protein, 28 aa, Artificial Sequence
  Description of Artificial Sequence: Synthetic peptide
SEEEIRCTNPIATEQYGSVSENLMRGNA

SEQ ID NO: 21261 - protein, 29 aa, Artificial Sequence
  Description of Artificial Sequence: Synthetic peptide
SEEEIRCTNPIATEQYGSVSENLMRGNAR

SEQ ID NO: 21262 - protein, 28 aa, Artificial Sequence
  Description of Artificial Sequence: Synthetic peptide
SEEEIRCTNPIATEQYGSVSENLMRGNC

SEQ ID NO: 21263 - protein, 28 aa, Artificial Sequence
  Description of Artificial Sequence: Synthetic peptide
SEEEIRCTNPIATEQYGSVSENLMRGND

SEQ ID NO: 21264 - protein, 32 aa, Artificial Sequence
  Description of Artificial Sequence: Synthetic polypeptide
DEEEIRTTNPVATEQYGSVSTFNLGQNEGNNM

SEQ ID NO: 21265 - protein, 29 aa, Artificial Sequence
  Description of Artificial Sequence: Synthetic peptide
DVEEIRATNPVATEQYGSVVSTNLQDGTS

SEQ ID NO: 21266 - protein, 30 aa, Artificial Sequence
  Description of Artificial Sequence: Synthetic polypeptide
DEEEIRTTNPVATEQYGSCSTGNLQTGDPQ

SEQ ID NO: 21267 - protein, 29 aa, Artificial Sequence
  Description of Artificial Sequence: Synthetic peptide
DTVEIRSTNPVATEQYGSVVSTNLQNGTR

SEQ ID NO: 21268 - protein, 29 aa, Artificial Sequence
  Description of Artificial Sequence: Synthetic peptide
SEEEIRCTNPIATEQYGSVSENLMRGNDR

SEQ ID NO: 21269 - protein, 28 aa, Artificial Sequence
  Description of Artificial Sequence: Synthetic peptide
DEEEIRTTNPVATEQYGSCSTGLQVVEE

SEQ ID NO: 21270 - protein, 32 aa, Artificial Sequence
  Description of Artificial Sequence: Synthetic polypeptide
DEEEIRTTNPVATEQYGSVSITNLQGSGNNET

SEQ ID NO: 21271 - protein, 28 aa, Artificial Sequence
  Description of Artificial Sequence: Synthetic peptide
SEEEIRCTNPIATEQYGSVSENLMRGFR

SEQ ID NO: 21272 - protein, 28 aa, Artificial Sequence
  Description of Artificial Sequence: Synthetic peptide
EEEEIACTNPVATEGYGSVSTNLQRQDR

SEQ ID NO: 21273 - protein, 29 aa, Artificial Sequence
  Description of Artificial Sequence: Synthetic peptide
DEEEIRTTNPVATEQYGSCSTANLQVDEQ

SEQ ID NO: 21274 - protein, 28 aa, Artificial Sequence
  Description of Artificial Sequence: Synthetic peptide
SEEEIRCTNPIATEQYGSVSENLMRCNR

SEQ ID NO: 21275 - protein, 29 aa, Artificial Sequence
  Description of Artificial Sequence: Synthetic peptide
SEEEIRCTNPIATEQYGSVSENLMRDGNR

SEQ ID NO: 21276 - protein, 28 aa, Artificial Sequence
  Description of Artificial Sequence: Synthetic peptide
SEEEIRCTNPIATEQYGSVSENLMRDNR

SEQ ID NO: 21277 - protein, 32 aa, Artificial Sequence
  Description of Artificial Sequence: Synthetic polypeptide
DEEEIRTTNPVATEQYGSVSTFNLQGIGNNEQ

SEQ ID NO: 21278 - protein, 29 aa, Artificial Sequence
  Description of Artificial Sequence: Synthetic peptide
SEEEIRCTNPIATEQYGSVSENLMREGNR

SEQ ID NO: 21279 - protein, 28 aa, Artificial Sequence
  Description of Artificial Sequence: Synthetic peptide
SEEEIRCTNPIATEQYGSVSENLMRENR

SEQ ID NO: 21280 - protein, 29 aa, Artificial Sequence
  Description of Artificial Sequence: Synthetic peptide
SEEEIRCTNPIATEQYGSVSENLMRFGNR

SEQ ID NO: 21281 - protein, 28 aa, Artificial Sequence
  Description of Artificial Sequence: Synthetic peptide
SEEEIRCTNPIATEQYGSVSENLMRFNR

SEQ ID NO: 21282 - protein, 29 aa, Artificial Sequence
  Description of Artificial Sequence: Synthetic peptide
EEEEIATTNPVATEQYGSVSANLQDGNEE

SEQ ID NO: 21283 - protein, 29 aa, Artificial Sequence
  Description of Artificial Sequence: Synthetic peptide
SEEEIRCTNPIATEQYGSVSENLMRGANR

SEQ ID NO: 21284 - protein, 32 aa, Artificial Sequence
  Description of Artificial Sequence: Synthetic polypeptide
DEEEIRTTNPVATEQYGSVSTFNLQGIGGQNL

SEQ ID NO: 21285 - protein, 29 aa, Artificial Sequence
  Description of Artificial Sequence: Synthetic peptide
SEEEIRCTNPIATEQYGSVSENLMRGFNR

SEQ ID NO: 21286 - protein, 29 aa, Artificial Sequence
  Description of Artificial Sequence: Synthetic peptide
DEEEIRTTNPVATEQYGSCSTDLNGENLR

SEQ ID NO: 21287 - protein, 28 aa, Artificial Sequence
  Description of Artificial Sequence: Synthetic peptide
SEEEIRCTNPIATEQYGSVSENLMRGAR

SEQ ID NO: 21288 - protein, 30 aa, Artificial Sequence
  Description of Artificial Sequence: Synthetic polypeptide
DEEEIRTTNPVATEQYGSCSTDLQNGENPQ

SEQ ID NO: 21289 - protein, 29 aa, Artificial Sequence
  Description of Artificial Sequence: Synthetic peptide
SEEEIRCTNPIATEQYGSVSENLMRGDNR

SEQ ID NO: 21290 - protein, 29 aa, Artificial Sequence
  Description of Artificial Sequence: Synthetic peptide
EEEEIATTNPVATECYGSVSTNLQQGNDN

SEQ ID NO: 21291 - protein, 31 aa, Artificial Sequence
  Description of Artificial Sequence: Synthetic polypeptide
DEEEIRTTNPVATEQYGSVSTFNLQDGEQEG

SEQ ID NO: 21292 - protein, 31 aa, Artificial Sequence
  Description of Artificial Sequence: Synthetic polypeptide
DEEEIRTTNPVATEQYGSCSTDLQNQGENIR

SEQ ID NO: 21293 - protein, 30 aa, Artificial Sequence
  Description of Artificial Sequence: Synthetic polypeptide
DEEEIRTTNPVATEQYGSCSTDLQPGENVQ

SEQ ID NO: 21294 - protein, 30 aa, Artificial Sequence
  Description of Artificial Sequence: Synthetic polypeptide
DEEEIRTTNPVATEQYGSCSTDLQPGNIDA

SEQ ID NO: 21295 - protein, 31 aa, Artificial Sequence
  Description of Artificial Sequence: Synthetic polypeptide
DEEEIRTTNPVATEQYGSCSTDLQRTGEHQR

SEQ ID NO: 21296 - protein, 28 aa, Artificial Sequence
  Description of Artificial Sequence: Synthetic peptide
SEEEIRCTNPIATEQYGSVSENLMRGDR

SEQ ID NO: 21297 - protein, 29 aa, Artificial Sequence
  Description of Artificial Sequence: Synthetic peptide
SEEEIRCTNPIATEQYGSVSENLMRGENR

SEQ ID NO: 21298 - protein, 28 aa, Artificial Sequence
  Description of Artificial Sequence: Synthetic peptide
SEEEIRCTNPIATEQYGSVSENLMRGER

SEQ ID NO: 21299 - protein, 32 aa, Artificial Sequence
  Description of Artificial Sequence: Synthetic polypeptide
DEEEIRTTNPVATEQYGSVSTNLQRFGGMVVQ

SEQ ID NO: 21300 - protein, 28 aa, Artificial Sequence
  Description of Artificial Sequence: Synthetic peptide
SEEEIRCTNPIATEQYGSVSENLMRGNE

SEQ ID NO: 21301 - protein, 30 aa, Artificial Sequence
  Description of Artificial Sequence: Synthetic polypeptide
EEEEIRTTNPVATEQYGSVSAHNLAEFGNR

SEQ ID NO: 21302 - protein, 28 aa, Artificial Sequence
  Description of Artificial Sequence: Synthetic peptide
SEEEIRCTNPIATEQYGSVSENLLRGNY

SEQ ID NO: 21303 - protein, 32 aa, Artificial Sequence
  Description of Artificial Sequence: Synthetic polypeptide
DEEEIRTTNPVATEQYGSVSTGIQRGNNNVRN

SEQ ID NO: 21304 - protein, 29 aa, Artificial Sequence
  Description of Artificial Sequence: Synthetic peptide
AEEEIVTTNPVATEQYGNVSVTTLQGGNR

SEQ ID NO: 21305 - protein, 31 aa, Artificial Sequence
  Description of Artificial Sequence: Synthetic polypeptide
EEEEIRTTNPVATEQYGSVSTNLSQVGNNTV

SEQ ID NO: 21306 - protein, 30 aa, Artificial Sequence
  Description of Artificial Sequence: Synthetic polypeptide
DEEEIRTTNPVATEQYGSVSTGHQSGNDFQ

SEQ ID NO: 21307 - protein, 31 aa, Artificial Sequence
  Description of Artificial Sequence: Synthetic polypeptide
DEEEIRTTNPVATEQYGSVSITNLDMGENGQ

SEQ ID NO: 21308 - protein, 30 aa, Artificial Sequence
  Description of Artificial Sequence: Synthetic polypeptide
EEEEIRTTNPVATEQYGSVSTNLQVVLFND

SEQ ID NO: 21309 - protein, 28 aa, Artificial Sequence
  Description of Artificial Sequence: Synthetic peptide
SEEEIRCTNPIATEQYGSVSENITRGNR

SEQ ID NO: 21310 - protein, 31 aa, Artificial Sequence
  Description of Artificial Sequence: Synthetic polypeptide
EEEEIRTTNPVATEQYGSVSTNLQRNANEYA

SEQ ID NO: 21311 - protein, 28 aa, Artificial Sequence
  Description of Artificial Sequence: Synthetic peptide
SEEEIRCTNPIATEQYGSVSENKMRGNR

SEQ ID NO: 21312 - protein, 29 aa, Artificial Sequence
  Description of Artificial Sequence: Synthetic peptide
SEEEIRCTNPIATEQYGSVSENLAMRGNR

SEQ ID NO: 21313 - protein, 28 aa, Artificial Sequence
  Description of Artificial Sequence: Synthetic peptide
SEEEIRCTNPIATEQYGSVSENLARGNG

SEQ ID NO: 21314 - protein, 29 aa, Artificial Sequence
  Description of Artificial Sequence: Synthetic peptide
SEEEIRCTNPIATEQYGSVSENLARGNRH

SEQ ID NO: 21315 - protein, 31 aa, Artificial Sequence
  Description of Artificial Sequence: Synthetic polypeptide
AEEEIRTTNPVATEQYGSVSTTTNLQQGNIA

SEQ ID NO: 21316 - protein, 28 aa, Artificial Sequence
  Description of Artificial Sequence: Synthetic peptide
SEEEIRCTNPIATEQYGSVSENLARQNR

SEQ ID NO: 21317 - protein, 31 aa, Artificial Sequence
  Description of Artificial Sequence: Synthetic polypeptide
EEEEIRTTNPVATEQYGSVSTNLQQRGAIQD

SEQ ID NO: 21318 - protein, 29 aa, Artificial Sequence
  Description of Artificial Sequence: Synthetic peptide
DEEEIRCTNPIATEQYGSVSEENLMRGNH

SEQ ID NO: 21319 - protein, 30 aa, Artificial Sequence
  Description of Artificial Sequence: Synthetic polypeptide
DEEEIRCTNPIATEQYGSVSEEDLQMRGNR

SEQ ID NO: 21320 - protein, 32 aa, Artificial Sequence
  Description of Artificial Sequence: Synthetic polypeptide
DEEEIRTTNPVATEQYGSVSTNLQQIGTNEFT

SEQ ID NO: 21321 - protein, 29 aa, Artificial Sequence
  Description of Artificial Sequence: Synthetic peptide
SEEEIRCTNPIATEQYGSVSENLDARGNR

SEQ ID NO: 21322 - protein, 32 aa, Artificial Sequence
  Description of Artificial Sequence: Synthetic polypeptide
DEEEIRTTNPVATEQYGSVSTGEPQERGSNRG

SEQ ID NO: 21323 - protein, 31 aa, Artificial Sequence
  Description of Artificial Sequence: Synthetic polypeptide
DEEEIRTTNPVATEQYGCVSNTNHQRGSERF

SEQ ID NO: 21324 - protein, 30 aa, Artificial Sequence
  Description of Artificial Sequence: Synthetic polypeptide
DEEEIRTTNPVATEQYGSVSTNLQQIVPAE

SEQ ID NO: 21325 - protein, 29 aa, Artificial Sequence
  Description of Artificial Sequence: Synthetic peptide
SEEEIRCTNPIATEQYGSVSENLDMRGNR

SEQ ID NO: 21326 - protein, 31 aa, Artificial Sequence
  Description of Artificial Sequence: Synthetic polypeptide
DEEEIRTTNPVATEQYGSVSTGELQSFGNPQ

SEQ ID NO: 21327 - protein, 28 aa, Artificial Sequence
  Description of Artificial Sequence: Synthetic peptide
AEEGIRTTNPVATEQYGSVATNLDMLNR

SEQ ID NO: 21328 - protein, 29 aa, Artificial Sequence
  Description of Artificial Sequence: Synthetic peptide
SEEEIRCTNPIATEQYGSVSENLDRGNFR

SEQ ID NO: 21329 - protein, 31 aa, Artificial Sequence
  Description of Artificial Sequence: Synthetic polypeptide
EEEEIRTTNPVATEQYGSVSTNLQQTGNLTV

SEQ ID NO: 21330 - protein, 28 aa, Artificial Sequence
  Description of Artificial Sequence: Synthetic peptide
AEEGISTTNPVATEQYGSVSSNHQRGNS

SEQ ID NO: 21331 - protein, 28 aa, Artificial Sequence
  Description of Artificial Sequence: Synthetic peptide
SEEEIRCTNPIATEQYGSVSENIMRGNR

SEQ ID NO: 21332 - protein, 29 aa, Artificial Sequence
  Description of Artificial Sequence: Synthetic peptide
DEEEIRCTNPIATEQYGSVSENEMNRGNR

SEQ ID NO: 21333 - protein, 30 aa, Artificial Sequence
  Description of Artificial Sequence: Synthetic polypeptide
EEEEIRTTNPVATEQYGSVSTTNLVPGNPP

SEQ ID NO: 21334 - protein, 31 aa, Artificial Sequence
  Description of Artificial Sequence: Synthetic polypeptide
DEEEIRTTNPVATEQYGSVSTGLEVQRMVRI

SEQ ID NO: 21335 - protein, 31 aa, Artificial Sequence
  Description of Artificial Sequence: Synthetic polypeptide
DEEEIRCTNPIATEQYGSVSENLPQREGENR

SEQ ID NO: 21336 - protein, 30 aa, Artificial Sequence
  Description of Artificial Sequence: Synthetic polypeptide
DEEEIRCTNPIATEQYGSVSENLPMREGNR

SEQ ID NO: 21337 - protein, 28 aa, Artificial Sequence
  Description of Artificial Sequence: Synthetic peptide
DEEEIRTTNPEATYQYGVVPTDLQRGNF

SEQ ID NO: 21338 - protein, 29 aa, Artificial Sequence
  Description of Artificial Sequence: Synthetic peptide
EEEEIRTTNPVATEQYGSVSTTLGTGNNT

SEQ ID NO: 21339 - protein, 31 aa, Artificial Sequence
  Description of Artificial Sequence: Synthetic polypeptide
DEEEIRTTNPVATEQYGSVSTGLEQRQMVRI

SEQ ID NO: 21340 - protein, 28 aa, Artificial Sequence
  Description of Artificial Sequence: Synthetic peptide
SEEEIRCTNPIATEQYGSVSENGMRGNR

SEQ ID NO: 21341 - protein, 32 aa, Artificial Sequence
  Description of Artificial Sequence: Synthetic polypeptide
DEEEIRTTNPVATEQYGCVSNTNLGQWFGNRE

SEQ ID NO: 21342 - protein, 28 aa, Artificial Sequence
  Description of Artificial Sequence: Synthetic peptide
SEEEIRCTNPIATEQYGSVSENGNRGNR

SEQ ID NO: 21343 - protein, 32 aa, Artificial Sequence
  Description of Artificial Sequence: Synthetic polypeptide
EEEEIRTTNPVATEQYGSVSTSNLVQRGENAQ

SEQ ID NO: 21344 - protein, 29 aa, Artificial Sequence
  Description of Artificial Sequence: Synthetic peptide
SEEEIRCTNPIATEQYGSVSENHLMRGNR

SEQ ID NO: 21345 - protein, 31 aa, Artificial Sequence
  Description of Artificial Sequence: Synthetic polypeptide
DEEEIRTTNPVATEQYGSVSITNLDFNGGNV

SEQ ID NO: 21346 - protein, 28 aa, Artificial Sequence
  Description of Artificial Sequence: Synthetic peptide
SEEEIRCTNPIATEQYGSVSENHMRGNR

SEQ ID NO: 21347 - protein, 29 aa, Artificial Sequence
  Description of Artificial Sequence: Synthetic peptide
DEEEIRCTNPIATEQYGSVSENLMNRENR

SEQ ID NO: 21348 - protein, 28 aa, Artificial Sequence
  Description of Artificial Sequence: Synthetic peptide
DEEEIRCTNPIATEQYGSVSENLMHGER

SEQ ID NO: 21349 - protein, 32 aa, Artificial Sequence
  Description of Artificial Sequence: Synthetic polypeptide
EEEEIRTTNPVATEQYGSVSTSHLVQRGENER

SEQ ID NO: 21350 - protein, 29 aa, Artificial Sequence
  Description of Artificial Sequence: Synthetic peptide
DEEEIRCTNPIATEQYGSVSENLMHEGNR

SEQ ID NO: 21351 - protein, 31 aa, Artificial Sequence
  Description of Artificial Sequence: Synthetic polypeptide
DEEEIRTTNPVATEQYGSVSTGLEQQRMERE

SEQ ID NO: 21352 - protein, 31 aa, Artificial Sequence
  Description of Artificial Sequence: Synthetic polypeptide
EEEEIRTTNPVATEQYGSVSTPNLVRVGNNE

SEQ ID NO: 21353 - protein, 33 aa, Artificial Sequence
  Description of Artificial Sequence: Synthetic polypeptide
DEEEIRTTNPVATEQYGCVSNTNLGQRSGSNRG

SEQ ID NO: 21354 - protein, 31 aa, Artificial Sequence
  Description of Artificial Sequence: Synthetic polypeptide
EEEEIRTTNPVATEQYGSVSTPNLQRLNVGG

SEQ ID NO: 21355 - protein, 30 aa, Artificial Sequence
  Description of Artificial Sequence: Synthetic polypeptide
DEEEIRTTNPVATEQYGCVSNTNLANGSNA

SEQ ID NO: 21356 - protein, 31 aa, Artificial Sequence
  Description of Artificial Sequence: Synthetic polypeptide
EEEEIRTTNPVATEQYGSVSTPNLQIGNLDG

SEQ ID NO: 21357 - protein, 30 aa, Artificial Sequence
  Description of Artificial Sequence: Synthetic polypeptide
EEEEIRTTNPVATEQYGSVSTPNLNSGIRL

SEQ ID NO: 21358 - protein, 32 aa, Artificial Sequence
  Description of Artificial Sequence: Synthetic polypeptide
DEEEIRTTNPVATEQYGSVSTNLQQGQGGNDT

SEQ ID NO: 21359 - protein, 29 aa, Artificial Sequence
  Description of Artificial Sequence: Synthetic peptide
SEEEIRCTNPIATEQYGSVSENILMRGNR

SEQ ID NO: 21360 - protein, 31 aa, Artificial Sequence
  Description of Artificial Sequence: Synthetic polypeptide
EEEEIRTTNPVATEQYGSVSCTNLQSGGNNE

SEQ ID NO: 21361 - protein, 29 aa, Artificial Sequence
  Description of Artificial Sequence: Synthetic peptide
SEEEIRCTNPIATEQYGSVSENLDRGNRM

SEQ ID NO: 21362 - protein, 30 aa, Artificial Sequence
  Description of Artificial Sequence: Synthetic polypeptide
DEEEIRTTNPVATEQYGCVSNTNHQRFTNI

SEQ ID NO: 21363 - protein, 28 aa, Artificial Sequence
  Description of Artificial Sequence: Synthetic peptide
SEEEIRCTNPIATEQYGSVSENLGSGNR

SEQ ID NO: 21364 - protein, 30 aa, Artificial Sequence
  Description of Artificial Sequence: Synthetic polypeptide
DEEEIRTTNPVATEQYGSCSINLDQNRGDP

SEQ ID NO: 21365 - protein, 29 aa, Artificial Sequence
  Description of Artificial Sequence: Synthetic peptide
SEEEIRCTNPIATEQYGSVSENLHMRGNR

SEQ ID NO: 21366 - protein, 29 aa, Artificial Sequence
  Description of Artificial Sequence: Synthetic peptide
SEEEIRCTNPIATEQYGSVSENLHRGNQR

SEQ ID NO: 21367 - protein, 30 aa, Artificial Sequence
  Description of Artificial Sequence: Synthetic polypeptide
DEEEIRTTNPVATEQYGSCSITNLERDDGR

SEQ ID NO: 21368 - protein, 28 aa, Artificial Sequence
  Description of Artificial Sequence: Synthetic peptide
DEEEIRCTNPIATEQWGSVSENLMRGNA

SEQ ID NO: 21369 - protein, 28 aa, Artificial Sequence
  Description of Artificial Sequence: Synthetic peptide
SEEEIRCTNPIATEQYGSVSENLHRPNR

SEQ ID NO: 21370 - protein, 28 aa, Artificial Sequence
  Description of Artificial Sequence: Synthetic peptide
SEEEIRCTNPIATEQYGSVSENLIAGNR

SEQ ID NO: 21371 - protein, 31 aa, Artificial Sequence
  Description of Artificial Sequence: Synthetic polypeptide
EEEEIRTTNPVATEQYGSVSPTNLQDGNNVD

SEQ ID NO: 21372 - protein, 28 aa, Artificial Sequence
  Description of Artificial Sequence: Synthetic peptide
SEEEIRCTNPIATEQYGSVSENLIDGNR

SEQ ID NO: 21373 - protein, 29 aa, Artificial Sequence
  Description of Artificial Sequence: Synthetic peptide
SEEEIRCTNPIATEQYGSVSENLIMRGNR

SEQ ID NO: 21374 - protein, 29 aa, Artificial Sequence
  Description of Artificial Sequence: Synthetic peptide
SEEEIRCTNPIATEQYGSVSENLIRGNNR

SEQ ID NO: 21375 - protein, 29 aa, Artificial Sequence
  Description of Artificial Sequence: Synthetic peptide
SEEEIRCTNPIATEQYGSVSENLGRGNSR

SEQ ID NO: 21376 - protein, 30 aa, Artificial Sequence
  Description of Artificial Sequence: Synthetic polypeptide
DEEEIRTTNPVATEQYGSCSLGNMLQPDNR

SEQ ID NO: 21377 - protein, 28 aa, Artificial Sequence
  Description of Artificial Sequence: Synthetic peptide
SEEEIRCTNPIATEQYGSVSENLIRGNS

SEQ ID NO: 21378 - protein, 32 aa, Artificial Sequence
  Description of Artificial Sequence: Synthetic polypeptide
DEEEIRTTNPVATEQYGSVSTNLQQVTGINGG

SEQ ID NO: 21379 - protein, 32 aa, Artificial Sequence
  Description of Artificial Sequence: Synthetic polypeptide
DEEEIRTTNPVATEQYGSVSTNLQQVVNVNTR

SEQ ID NO: 21380 - protein, 28 aa, Artificial Sequence
  Description of Artificial Sequence: Synthetic peptide
SEEEIRCTNPIATEQYGSVSENLIRGNY

SEQ ID NO: 21381 - protein, 28 aa, Artificial Sequence
  Description of Artificial Sequence: Synthetic peptide
SEEEIRCTNPIATEQYGSVSENLIRGTR

SEQ ID NO: 21382 - protein, 29 aa, Artificial Sequence
  Description of Artificial Sequence: Synthetic peptide
SEEEIRCTNPIATEQYGSVSENLKARGNR

SEQ ID NO: 21383 - protein, 29 aa, Artificial Sequence
  Description of Artificial Sequence: Synthetic peptide
SEEEIRCTNPIATEQYGSVSENLKRGNMR

SEQ ID NO: 21384 - protein, 32 aa, Artificial Sequence
  Description of Artificial Sequence: Synthetic polypeptide
EEEEIRTTNPVATEQYGSVSITNLQVGLFNRN

SEQ ID NO: 21385 - protein, 32 aa, Artificial Sequence
  Description of Artificial Sequence: Synthetic polypeptide
DEEEIRTTNPVATEQYGSVSITNLNQANIGNQ

SEQ ID NO: 21386 - protein, 29 aa, Artificial Sequence
  Description of Artificial Sequence: Synthetic peptide
SEEEIRCTNPIATEQYGSVSENLLMRGNR

SEQ ID NO: 21387 - protein, 28 aa, Artificial Sequence
  Description of Artificial Sequence: Synthetic peptide
DEEEIRCTNPIATECYGSVSENLMRGNG

SEQ ID NO: 21388 - protein, 28 aa, Artificial Sequence
  Description of Artificial Sequence: Synthetic peptide
DEEEIRCTNPIATECYGSVSENLMPGNR

SEQ ID NO: 21389 - protein, 30 aa, Artificial Sequence
  Description of Artificial Sequence: Synthetic polypeptide
DEEEIRTTNPVATEQYGSCSLIDMLQRDNR

SEQ ID NO: 21390 - protein, 28 aa, Artificial Sequence
  Description of Artificial Sequence: Synthetic peptide
AEENICTTNPVATEQYGSVSMNSQRGNN

SEQ ID NO: 21391 - protein, 31 aa, Artificial Sequence
  Description of Artificial Sequence: Synthetic polypeptide
DEEEIRTTNPVATEQYGSVSTGALQERGSDA

SEQ ID NO: 21392 - protein, 31 aa, Artificial Sequence
  Description of Artificial Sequence: Synthetic polypeptide
DEEEIRTTNPVATEQYGSVSTGALQFGSNQP

SEQ ID NO: 21393 - protein, 31 aa, Artificial Sequence
  Description of Artificial Sequence: Synthetic polypeptide
DEEEIRTTNPVATEQYGSVSTNLQQMNENTF

SEQ ID NO: 21394 - protein, 29 aa, Artificial Sequence
  Description of Artificial Sequence: Synthetic peptide
SEEEIRCTNPIATEQYGSVSENLDRGNRR

SEQ ID NO: 21395 - protein, 28 aa, Artificial Sequence
  Description of Artificial Sequence: Synthetic peptide
SEEEIRCTNPIATEQYGSVSENLDRGPR

SEQ ID NO: 21396 - protein, 31 aa, Artificial Sequence
  Description of Artificial Sequence: Synthetic polypeptide
EEEEIRTTNPVATEQYGSVSTNLQERNNIQV

SEQ ID NO: 21397 - protein, 28 aa, Artificial Sequence
  Description of Artificial Sequence: Synthetic peptide
SEEEIRCTNPIATEQYGSVSENLDRGTR

SEQ ID NO: 21398 - protein, 31 aa, Artificial Sequence
  Description of Artificial Sequence: Synthetic polypeptide
DEEEIRTTNPVATEQYGSVSTGELQRFMSDR

SEQ ID NO: 21399 - protein, 31 aa, Artificial Sequence
  Description of Artificial Sequence: Synthetic polypeptide
DEEEIRTTNPVATEQYGSVSITNLGVRGELQ

SEQ ID NO: 21400 - protein, 30 aa, Artificial Sequence
  Description of Artificial Sequence: Synthetic polypeptide
EEEEIRTTNPVATEQYGSVSTNLQANANVY

SEQ ID NO: 21401 - protein, 32 aa, Artificial Sequence
  Description of Artificial Sequence: Synthetic polypeptide
DEEEIRTTNPVATEQYGSCSDTDNDVQRGDNR

SEQ ID NO: 21402 - protein, 31 aa, Artificial Sequence
  Description of Artificial Sequence: Synthetic polypeptide
DEEEIRTTNPVATEQYGSCSDTWLPQRSENR

SEQ ID NO: 21403 - protein, 30 aa, Artificial Sequence
  Description of Artificial Sequence: Synthetic polypeptide
DEEEIRTTNPVATEQYGSVSTNLQQNELSV

SEQ ID NO: 21404 - protein, 29 aa, Artificial Sequence
  Description of Artificial Sequence: Synthetic peptide
SEEEIRCTNPIATEQYGSVSENLEMRGNR

SEQ ID NO: 21405 - protein, 31 aa, Artificial Sequence
  Description of Artificial Sequence: Synthetic polypeptide
DEEEIRTTNPVATEQYGSYSLPNMEQRGDNR

SEQ ID NO: 21406 - protein, 31 aa, Artificial Sequence
  Description of Artificial Sequence: Synthetic polypeptide
EEEEIRTTNPVATEQYGSVSTNLETRGINPL

SEQ ID NO: 21407 - protein, 28 aa, Artificial Sequence
  Description of Artificial Sequence: Synthetic peptide
AEEQICTTNPVATEQYGSVSSNSQRGNQ

SEQ ID NO: 21408 - protein, 28 aa, Artificial Sequence
  Description of Artificial Sequence: Synthetic peptide
SEEEIRCTNPIATEQYGSVSENLERGNN

SEQ ID NO: 21409 - protein, 30 aa, Artificial Sequence
  Description of Artificial Sequence: Synthetic polypeptide
DEEEIRCTNPIATEQYGSVSAENLMRGNDR

SEQ ID NO: 21410 - protein, 31 aa, Artificial Sequence
  Description of Artificial Sequence: Synthetic polypeptide
DEEEIRTTNPVATEQYGSVSTNLQQNNGIEG

SEQ ID NO: 21411 - protein, 31 aa, Artificial Sequence
  Description of Artificial Sequence: Synthetic polypeptide
DEEEIRTTNPVATEQYGSVSGNLQEDGENAG

SEQ ID NO: 21412 - protein, 29 aa, Artificial Sequence
  Description of Artificial Sequence: Synthetic peptide
DEEEIRCTNPIATEQYGSVAEENLMRGNR

SEQ ID NO: 21413 - protein, 29 aa, Artificial Sequence
  Description of Artificial Sequence: Synthetic peptide
SEEEIRCTNPIATEQYGSVSENLFMRGNR

SEQ ID NO: 21414 - protein, 29 aa, Artificial Sequence
  Description of Artificial Sequence: Synthetic peptide
SEEEIRCTNPIATEQYGSVSENLGMRGNR

SEQ ID NO: 21415 - protein, 30 aa, Artificial Sequence
  Description of Artificial Sequence: Synthetic polypeptide
EEEEIRTTNPVATEQYGSVSTNIQRNPNFY

SEQ ID NO: 21416 - protein, 31 aa, Artificial Sequence
  Description of Artificial Sequence: Synthetic polypeptide
DEEEIRTTNPVATEQYGSVSITNLNGNGGNA

SEQ ID NO: 21417 - protein, 31 aa, Artificial Sequence
  Description of Artificial Sequence: Synthetic polypeptide
EEEEIRTTNPVATEQYGSVSTNDLQRNANFE

SEQ ID NO: 21418 - protein, 29 aa, Artificial Sequence
  Description of Artificial Sequence: Synthetic peptide
SEEEIRCTNPIATEQYGSVSENLGRDGNR

SEQ ID NO: 21419 - protein, 28 aa, Artificial Sequence
  Description of Artificial Sequence: Synthetic peptide
SEEEIRCTNPIATEQYGSVSENLERGNL

SEQ ID NO: 21420 - protein, 31 aa, Artificial Sequence
  Description of Artificial Sequence: Synthetic polypeptide
DEEEIRTTNPVATEQYGSVSTFNLGQGTNQE

SEQ ID NO: 21421 - protein, 29 aa, Artificial Sequence
  Description of Artificial Sequence: Synthetic peptide
SEEEIRCTNPIATEQYGSVSENLMRGNER

SEQ ID NO: 21422 - protein, 28 aa, Artificial Sequence
  Description of Artificial Sequence: Synthetic peptide
SEEEIRCTNPIATEQYGSVSENLMRGNF

SEQ ID NO: 21423 - protein, 29 aa, Artificial Sequence
  Description of Artificial Sequence: Synthetic peptide
DEEEIRTTNPVATEQYGSCSTNLDRLVDD

SEQ ID NO: 21424 - protein, 28 aa, Artificial Sequence
  Description of Artificial Sequence: Synthetic peptide
SEEEIRCTNPIATEQYGSVSENLMRWNR

SEQ ID NO: 21425 - protein, 29 aa, Artificial Sequence
  Description of Artificial Sequence: Synthetic peptide
SEEEIRCTNPIATEQYGSVSENLMRYGNR

SEQ ID NO: 21426 - protein, 28 aa, Artificial Sequence
  Description of Artificial Sequence: Synthetic peptide
SEEEIRCTNPIATEQYGSVSENLMRYNR

SEQ ID NO: 21427 - protein, 29 aa, Artificial Sequence
  Description of Artificial Sequence: Synthetic peptide
DTEEIRTTNPQATEMYGSVSFNLQREENR

SEQ ID NO: 21428 - protein, 29 aa, Artificial Sequence
  Description of Artificial Sequence: Synthetic peptide
DEEEIRTTNPFATEQYGSVSYNIVTRGND

SEQ ID NO: 21429 - protein, 28 aa, Artificial Sequence
  Description of Artificial Sequence: Synthetic peptide
DTEEIRTTNPQATEHYGSVSSNLQRNNI

SEQ ID NO: 21430 - protein, 28 aa, Artificial Sequence
  Description of Artificial Sequence: Synthetic peptide
SEEEIRCTNPIATEQYGSVSENLMSGNR

SEQ ID NO: 21431 - protein, 29 aa, Artificial Sequence
  Description of Artificial Sequence: Synthetic peptide
SEEEIRCTNPIATEQYGSVSENLMSRGNR

SEQ ID NO: 21432 - protein, 28 aa, Artificial Sequence
  Description of Artificial Sequence: Synthetic peptide
SEEEIRCTNPIATEQYGSVSENLMTGNR

SEQ ID NO: 21433 - protein, 29 aa, Artificial Sequence
  Description of Artificial Sequence: Synthetic peptide
SEEEIRCTNPIATEQYGSVSENLMTRGNR

SEQ ID NO: 21434 - protein, 28 aa, Artificial Sequence
  Description of Artificial Sequence: Synthetic peptide
SEEEIRCTNPIATEQYGSVSENLMVGNR

SEQ ID NO: 21435 - protein, 30 aa, Artificial Sequence
  Description of Artificial Sequence: Synthetic polypeptide
DTEEIRTTNPTATEHYGSTVSCNLQREGNR

SEQ ID NO: 21436 - protein, 29 aa, Artificial Sequence
  Description of Artificial Sequence: Synthetic peptide
SEEEIRCTNPIATEQYGSVSENLMVRGNR

SEQ ID NO: 21437 - protein, 29 aa, Artificial Sequence
  Description of Artificial Sequence: Synthetic peptide
SEEEIRCTNPIATEQYGSVSENLMWRGNR

SEQ ID NO: 21438 - protein, 28 aa, Artificial Sequence
  Description of Artificial Sequence: Synthetic peptide
SEEEIRCTNPIATEQYGSVSENLMYGNR

SEQ ID NO: 21439 - protein, 30 aa, Artificial Sequence
  Description of Artificial Sequence: Synthetic polypeptide
DEEEIRTTNPVATEQYGSCSTNLNDRDDGR

SEQ ID NO: 21440 - protein, 29 aa, Artificial Sequence
  Description of Artificial Sequence: Synthetic peptide
DTEEIRTTNPQATEHYGSVSEWNLQRVNR

SEQ ID NO: 21441 - protein, 28 aa, Artificial Sequence
  Description of Artificial Sequence: Synthetic peptide
DTEEIRTTNPQATEGYGSVSWNLQRNNQ

SEQ ID NO: 21442 - protein, 29 aa, Artificial Sequence
  Description of Artificial Sequence: Synthetic peptide
DTEEIRTTNPLATEHYGSVSFNLSQRENR

SEQ ID NO: 21443 - protein, 29 aa, Artificial Sequence
  Description of Artificial Sequence: Synthetic peptide
SEEEIRCTNPIATEQYGSVSENLMYRGNR

SEQ ID NO: 21444 - protein, 29 aa, Artificial Sequence
  Description of Artificial Sequence: Synthetic peptide
DTEEIRTTNPIATEHYGSVSMNLQREDNR

SEQ ID NO: 21445 - protein, 30 aa, Artificial Sequence
  Description of Artificial Sequence: Synthetic polypeptide
DTEEIRTTNPIATEHYGSVSCNLQREGNNR

SEQ ID NO: 21446 - protein, 29 aa, Artificial Sequence
  Description of Artificial Sequence: Synthetic peptide
SEEEIRCTNPIATEQYGSVSENLNMRGNR

SEQ ID NO: 21447 - protein, 28 aa, Artificial Sequence
  Description of Artificial Sequence: Synthetic peptide
DTEEIRTTNPGATGHYGSVSFNLQRENR

SEQ ID NO: 21448 - protein, 30 aa, Artificial Sequence
  Description of Artificial Sequence: Synthetic polypeptide
DEEEIRTTNPVATEQYGSVSTETQAGSNLY

SEQ ID NO: 21449 - protein, 28 aa, Artificial Sequence
  Description of Artificial Sequence: Synthetic peptide
SEEEIRCTNPIATEQYGSVSENLMWGNR

SEQ ID NO: 21450 - protein, 30 aa, Artificial Sequence
  Description of Artificial Sequence: Synthetic polypeptide
DEEEIRTTNPVATEQYGSVSTESLQAMDSR

SEQ ID NO: 21451 - protein, 29 aa, Artificial Sequence
  Description of Artificial Sequence: Synthetic peptide
DTEEIRTTNPTATEHYGSVSCCNLQRENR

SEQ ID NO: 21452 - protein, 28 aa, Artificial Sequence
  Description of Artificial Sequence: Synthetic peptide
SEEEIRCTNPIATEQYGSVSENLMRVNR

SEQ ID NO: 21453 - protein, 30 aa, Artificial Sequence
  Description of Artificial Sequence: Synthetic polypeptide
AEEEIRTTNPVATEQYGSVSTTNQQSGNTL

SEQ ID NO: 21454 - protein, 28 aa, Artificial Sequence
  Description of Artificial Sequence: Synthetic peptide
SEEEIRCTNPIATEQYGSVSENLMRLNR

SEQ ID NO: 21455 - protein, 29 aa, Artificial Sequence
  Description of Artificial Sequence: Synthetic peptide
SEEEIRCTNPIATEQYGSVSENLMRMGNR

SEQ ID NO: 21456 - protein, 29 aa, Artificial Sequence
  Description of Artificial Sequence: Synthetic peptide
DEEEIRTTNPFATEQYGSVSYNIERSGND

SEQ ID NO: 21457 - protein, 28 aa, Artificial Sequence
  Description of Artificial Sequence: Synthetic peptide
SEEEIRCTNPIATEQYGSVSENLMRMNR

SEQ ID NO: 21458 - protein, 29 aa, Artificial Sequence
  Description of Artificial Sequence: Synthetic peptide
DTEEIRTTNPVATEQWGSVTSTQLQRGTN

SEQ ID NO: 21459 - protein, 29 aa, Artificial Sequence
  Description of Artificial Sequence: Synthetic peptide
SEEEIRCTNPIATEQYGSVSENLMRNGNR

SEQ ID NO: 21460 - protein, 29 aa, Artificial Sequence
  Description of Artificial Sequence: Synthetic peptide
DTEEIRTTNPVATEQWGSVTSTLLQRGVD

SEQ ID NO: 21461 - protein, 28 aa, Artificial Sequence
  Description of Artificial Sequence: Synthetic peptide
SEEEIRCTNPIATEQYGSVSENLMRNNR

SEQ ID NO: 21462 - protein, 29 aa, Artificial Sequence
  Description of Artificial Sequence: Synthetic peptide
DTEEIRTTNPVATEQWGSVTSTLLQMGIR

SEQ ID NO: 21463 - protein, 29 aa, Artificial Sequence
  Description of Artificial Sequence: Synthetic peptide
SEEEIRCTNPIATEQYGSVSENLMRPGNR

SEQ ID NO: 21464 - protein, 28 aa, Artificial Sequence
  Description of Artificial Sequence: Synthetic peptide
SEEEIRCTNPIATEQYGSVSENLMRPNR

SEQ ID NO: 21465 - protein, 28 aa, Artificial Sequence
  Description of Artificial Sequence: Synthetic peptide
DTEEIRTTNPTATEHYGSVSGNLQGENR

SEQ ID NO: 21466 - protein, 29 aa, Artificial Sequence
  Description of Artificial Sequence: Synthetic peptide
SEEEIRCTNPIATEQYGSVSENLMRQGNR

SEQ ID NO: 21467 - protein, 28 aa, Artificial Sequence
  Description of Artificial Sequence: Synthetic peptide
SEEEIRCTNPIATEQYGSVSENLMRQNR

SEQ ID NO: 21468 - protein, 29 aa, Artificial Sequence
  Description of Artificial Sequence: Synthetic peptide
DTEEIRTTNPVATEQWGSVTSTDLQPGPR

SEQ ID NO: 21469 - protein, 29 aa, Artificial Sequence
  Description of Artificial Sequence: Synthetic peptide
DTEEIRTTNPVATEQWGSVTSGLLQRGTR

SEQ ID NO: 21470 - protein, 30 aa, Artificial Sequence
  Description of Artificial Sequence: Synthetic polypeptide
DTEEIRTTNPVATEQWGSVSSTLLQRGTDR

SEQ ID NO: 21471 - protein, 32 aa, Artificial Sequence
  Description of Artificial Sequence: Synthetic polypeptide
DEEEIRTTNPVATEQYGSVSITNLQRFMVLGN

SEQ ID NO: 21472 - protein, 29 aa, Artificial Sequence
  Description of Artificial Sequence: Synthetic peptide
DEEEIRTTNPVATEQYGSCSTNLDMRDDD

SEQ ID NO: 21473 - protein, 29 aa, Artificial Sequence
  Description of Artificial Sequence: Synthetic peptide
SEEEIRCTNPIATEQYGSVSENLMRSGNR

SEQ ID NO: 21474 - protein, 28 aa, Artificial Sequence
  Description of Artificial Sequence: Synthetic peptide
SEEEIRCTNPIATEQYGSVSENLMRSNR

SEQ ID NO: 21475 - protein, 31 aa, Artificial Sequence
  Description of Artificial Sequence: Synthetic polypeptide
DECEIATTNPVATEQYGSVVSTGNLQDGNHR

SEQ ID NO: 21476 - protein, 29 aa, Artificial Sequence
  Description of Artificial Sequence: Synthetic peptide
SEEEIRCTNPIATEQYGSVSENLMRTGNR

SEQ ID NO: 21477 - protein, 28 aa, Artificial Sequence
  Description of Artificial Sequence: Synthetic peptide
SEEEIRCTNPIATEQYGSVSENLMRTNR

SEQ ID NO: 21478 - protein, 29 aa, Artificial Sequence
  Description of Artificial Sequence: Synthetic peptide
SEEEIRCTNPIATEQYGSVSENLMRVGNR

SEQ ID NO: 21479 - protein, 29 aa, Artificial Sequence
  Description of Artificial Sequence: Synthetic peptide
DTEEIRTTNPVATEQWGSVTSTLLERGTR

SEQ ID NO: 21480 - protein, 29 aa, Artificial Sequence
  Description of Artificial Sequence: Synthetic peptide
DEEEIRTTNPFATEQYGSVSYNIERGSND

SEQ ID NO: 21481 - protein, 30 aa, Artificial Sequence
  Description of Artificial Sequence: Synthetic polypeptide
DECEIATTNPVATEQYGSVSTNLQGDVGNA

SEQ ID NO: 21482 - protein, 30 aa, Artificial Sequence
  Description of Artificial Sequence: Synthetic polypeptide
DEEEIRTTNPVATEQYGSVSGLLDRGNDQQ

SEQ ID NO: 21483 - protein, 30 aa, Artificial Sequence
  Description of Artificial Sequence: Synthetic polypeptide
DEEEIRTTNPVATEQYGSCSTNLQEMGSEE

SEQ ID NO: 21484 - protein, 29 aa, Artificial Sequence
  Description of Artificial Sequence: Synthetic peptide
SEEEIRCTNPIATEQYGSVSENLRRGVNR

SEQ ID NO: 21485 - protein, 29 aa, Artificial Sequence
  Description of Artificial Sequence: Synthetic peptide
SEEEIRCTNPIATEQYGSVSENLSMRGNR

SEQ ID NO: 21486 - protein, 29 aa, Artificial Sequence
  Description of Artificial Sequence: Synthetic peptide
DTEEIRTTNPCATEAYGSVSVNLQAGENR

SEQ ID NO: 21487 - protein, 28 aa, Artificial Sequence
  Description of Artificial Sequence: Synthetic peptide
SEEEIRCTNPIATEQYGSVSENLSTGNR

SEQ ID NO: 21488 - protein, 29 aa, Artificial Sequence
  Description of Artificial Sequence: Synthetic peptide
DEEEIRTTNPVATEQYGSVSTEPNQRDSD

SEQ ID NO: 21489 - protein, 29 aa, Artificial Sequence
  Description of Artificial Sequence: Synthetic peptide
SEEEIRCTNPIATEQYGSVSENLTMRGNR

SEQ ID NO: 21490 - protein, 29 aa, Artificial Sequence
  Description of Artificial Sequence: Synthetic peptide
SEEEIRCTNPIATEQYGSVSENLTRAGNR

SEQ ID NO: 21491 - protein, 30 aa, Artificial Sequence
  Description of Artificial Sequence: Synthetic polypeptide
DEEEIRATNPVATEQYGTVSYTNLSQGVNR

SEQ ID NO: 21492 - protein, 29 aa, Artificial Sequence
  Description of Artificial Sequence: Synthetic peptide
SEEEIRCTNPIATEQYGSVSENLVARGNR

SEQ ID NO: 21493 - protein, 29 aa, Artificial Sequence
  Description of Artificial Sequence: Synthetic peptide
SEEEIRCTNPIATEQYGSVSENLVERGNR

SEQ ID NO: 21494 - protein, 31 aa, Artificial Sequence
  Description of Artificial Sequence: Synthetic polypeptide
DEEEIRATNPVATEQYGTVSMTNLNQGGSNR

SEQ ID NO: 21495 - protein, 28 aa, Artificial Sequence
  Description of Artificial Sequence: Synthetic peptide
DTEEIRTTNPCATEGYGSVSANLQRDNN

SEQ ID NO: 21496 - protein, 30 aa, Artificial Sequence
  Description of Artificial Sequence: Synthetic polypeptide
SEEEIRCTNPIATEQYGSVSENLVMQRGNR

SEQ ID NO: 21497 - protein, 29 aa, Artificial Sequence
  Description of Artificial Sequence: Synthetic peptide
DTEEIRTTNPAATEHYGSVSFNLQRENRM

SEQ ID NO: 21498 - protein, 29 aa, Artificial Sequence
  Description of Artificial Sequence: Synthetic peptide
SEEEIRCTNPIATEQYGSVSENLVRGENR

SEQ ID NO: 21499 - protein, 29 aa, Artificial Sequence
  Description of Artificial Sequence: Synthetic peptide
DTEEIRSTNPVAYEQYGSTVSTNLQNGSR

SEQ ID NO: 21500 - protein, 31 aa, Artificial Sequence
  Description of Artificial Sequence: Synthetic polypeptide
DEEEIRATNPVATEQYGTVSMTMNLEQGGNR

SEQ ID NO: 21501 - protein, 30 aa, Artificial Sequence
  Description of Artificial Sequence: Synthetic polypeptide
DECEIATTNPVATEQYGNVSTNLQGDGNSR

SEQ ID NO: 21502 - protein, 28 aa, Artificial Sequence
  Description of Artificial Sequence: Synthetic peptide
SEEEIRCTNPIATEQYGSVSENLVRGNI

SEQ ID NO: 21503 - protein, 31 aa, Artificial Sequence
  Description of Artificial Sequence: Synthetic polypeptide
DEEEIRTTNPVATEQYGSVSTEPLESGGSNR

SEQ ID NO: 21504 - protein, 29 aa, Artificial Sequence
  Description of Artificial Sequence: Synthetic peptide
DTEEIRSTNPVATEQYGSVVSTNLQNGED

SEQ ID NO: 21505 - protein, 30 aa, Artificial Sequence
  Description of Artificial Sequence: Synthetic polypeptide
DTEEIRSTNPVATEQYGSVVSTNELQNGSR

SEQ ID NO: 21506 - protein, 32 aa, Artificial Sequence
  Description of Artificial Sequence: Synthetic polypeptide
DEEEIRTTNPVATEQYGSVSTEPLERSGSNRA

SEQ ID NO: 21507 - protein, 31 aa, Artificial Sequence
  Description of Artificial Sequence: Synthetic polypeptide
DTEEIRSTNPVATEQYGSVSTNLQQREGEQR

SEQ ID NO: 21508 - protein, 29 aa, Artificial Sequence
  Description of Artificial Sequence: Synthetic peptide
SEEEIRCTNPIATEQYGSVSENLYRAGNR

SEQ ID NO: 21509 - protein, 29 aa, Artificial Sequence
  Description of Artificial Sequence: Synthetic peptide
SEEEIRCTNPIATEQYGSVSENLVMRGNR

SEQ ID NO: 21510 - protein, 28 aa, Artificial Sequence
  Description of Artificial Sequence: Synthetic peptide
DTEEIRTTNPDATEHYGSVSFNLERVNR

SEQ ID NO: 21511 - protein, 29 aa, Artificial Sequence
  Description of Artificial Sequence: Synthetic peptide
DTEEIRTTNPCATEGYGSVSANLQRPNER

SEQ ID NO: 21512 - protein, 31 aa, Artificial Sequence
  Description of Artificial Sequence: Synthetic polypeptide
DEEEIRTTNPVATEQYGSCSTNLQEGDNGEP

SEQ ID NO: 21513 - protein, 30 aa, Artificial Sequence
  Description of Artificial Sequence: Synthetic polypeptide
DEEEIRTTNPVATEQYGSVSGFNDQTGGNI

SEQ ID NO: 21514 - protein, 30 aa, Artificial Sequence
  Description of Artificial Sequence: Synthetic polypeptide
DEEEIRATNPVATEQYGVVSTTNLLQAGNF

SEQ ID NO: 21515 - protein, 30 aa, Artificial Sequence
  Description of Artificial Sequence: Synthetic polypeptide
AEEEIRTTNPVATEQYGSVSTTNQQQIGNN

SEQ ID NO: 21516 - protein, 28 aa, Artificial Sequence
  Description of Artificial Sequence: Synthetic peptide
DEEEIRTTNPFATEQYWSVSPNLEREND

SEQ ID NO: 21517 - protein, 28 aa, Artificial Sequence
  Description of Artificial Sequence: Synthetic peptide
DTEEIRTTNPCATEWYGSVSVNLQRENA

SEQ ID NO: 21518 - protein, 30 aa, Artificial Sequence
  Description of Artificial Sequence: Synthetic polypeptide
DEEEIRATNPVATEQYGVVSNTNLNQGGNV

SEQ ID NO: 21519 - protein, 28 aa, Artificial Sequence
  Description of Artificial Sequence: Synthetic peptide
DTEEIRTTNPCATESYGSVSVPLQRENR

SEQ ID NO: 21520 - protein, 30 aa, Artificial Sequence
  Description of Artificial Sequence: Synthetic polypeptide
AEEEIRTTNPVATEQYGSVSTTNQQQGNSE

SEQ ID NO: 21521 - protein, 29 aa, Artificial Sequence
  Description of Artificial Sequence: Synthetic peptide
DTEEIRTTNPCATESYGSVSIGNLQRENR

SEQ ID NO: 21522 - protein, 29 aa, Artificial Sequence
  Description of Artificial Sequence: Synthetic peptide
DTEEIRTTNPCATEPYGSVSANLQRENRL

SEQ ID NO: 21523 - protein, 29 aa, Artificial Sequence
  Description of Artificial Sequence: Synthetic peptide
SEEEIRCTNPIATEQYGSVSENLNRGNRA

SEQ ID NO: 21524 - protein, 28 aa, Artificial Sequence
  Description of Artificial Sequence: Synthetic peptide
SEEEIRCTNPIATEQYGSVSENLNRGNV

SEQ ID NO: 21525 - protein, 29 aa, Artificial Sequence
  Description of Artificial Sequence: Synthetic peptide
DEEEIRATNPVATEQYGVVATNLQRPENG

SEQ ID NO: 21526 - protein, 29 aa, Artificial Sequence
  Description of Artificial Sequence: Synthetic peptide
DTEEIRTTNPCATEIYGSVSVNLQRTENR

SEQ ID NO: 21527 - protein, 28 aa, Artificial Sequence
  Description of Artificial Sequence: Synthetic peptide
DTEEIRTTNPCATEHYGSVSVNLQRNNQ

SEQ ID NO: 21528 - protein, 29 aa, Artificial Sequence
  Description of Artificial Sequence: Synthetic peptide
DTEEIRTTNPCATEHYGSVSNNLQRENTR

SEQ ID NO: 21529 - protein, 30 aa, Artificial Sequence
  Description of Artificial Sequence: Synthetic polypeptide
DEEEIRATNPVATEQYGVVSMTNLFQGGNA

SEQ ID NO: 21530 - protein, 29 aa, Artificial Sequence
  Description of Artificial Sequence: Synthetic peptide
SEEEIRCTNPIATEQYGSVSENLPMRGNR

SEQ ID NO: 21531 - protein, 28 aa, Artificial Sequence
  Description of Artificial Sequence: Synthetic peptide
DTEEIRTTNPCATEHYGSVSFELQRENR

SEQ ID NO: 21532 - protein, 30 aa, Artificial Sequence
  Description of Artificial Sequence: Synthetic polypeptide
DEEEIRTTNPVATEQYGSVSGDLQRIGLAN

SEQ ID NO: 21533 - protein, 30 aa, Artificial Sequence
  Description of Artificial Sequence: Synthetic polypeptide
DTEEIRTTNPCATEHYGSVSCNLQRGEANR

SEQ ID NO: 21534 - protein, 29 aa, Artificial Sequence
  Description of Artificial Sequence: Synthetic peptide
SEEEIRCTNPIATEQYGSVSENLPRDGNR

SEQ ID NO: 21535 - protein, 28 aa, Artificial Sequence
  Description of Artificial Sequence: Synthetic peptide
DTEEIRTTNPCATEHYGSVSASLQRENR

SEQ ID NO: 21536 - protein, 29 aa, Artificial Sequence
  Description of Artificial Sequence: Synthetic peptide
SEEEIRCTNPIATEQYGSVSENLQMRGNH

SEQ ID NO: 21537 - protein, 29 aa, Artificial Sequence
  Description of Artificial Sequence: Synthetic peptide
SEEEIRCTNPIATEQYGSVSENLQQRGNH

SEQ ID NO: 21538 - protein, 29 aa, Artificial Sequence
  Description of Artificial Sequence: Synthetic peptide
DEEEIRTTNPVATEQYGSCSTNLQEESEG

SEQ ID NO: 21539 - protein, 30 aa, Artificial Sequence
  Description of Artificial Sequence: Synthetic polypeptide
DEEEIRATNPVATEQYGVVSMTNLFQGGNV

SEQ ID NO: 21540 - protein, 29 aa, Artificial Sequence
  Description of Artificial Sequence: Synthetic peptide
SEEEIRCTNPIATEQYGSVSENLMRLGNR

SEQ ID NO: 21541 - protein, 30 aa, Artificial Sequence
  Description of Artificial Sequence: Synthetic polypeptide
AEEEIRTTNPVATEQYGSVSTTNSEQGNLR

SEQ ID NO: 21542 - protein, 28 aa, Artificial Sequence
  Description of Artificial Sequence: Synthetic peptide
SEEEIRCTNPIATEQYGSVSENLMRINR

SEQ ID NO: 21543 - protein, 31 aa, Artificial Sequence
  Description of Artificial Sequence: Synthetic polypeptide
DEEEIRTTNPVATEQYGSVSITNLQQLIVNG

SEQ ID NO: 21544 - protein, 28 aa, Artificial Sequence
  Description of Artificial Sequence: Synthetic peptide
SEEEIRCTNPIATEQYGSVSENLMRGNQ

SEQ ID NO: 21545 - protein, 30 aa, Artificial Sequence
  Description of Artificial Sequence: Synthetic polypeptide
DEEEIRTTNPVATEQYGSCSTMLQRNGTQM

SEQ ID NO: 21546 - protein, 30 aa, Artificial Sequence
  Description of Artificial Sequence: Synthetic polypeptide
DTEEIRYTNPVATEQYGYSAVSTNLQNGTR

SEQ ID NO: 21547 - protein, 29 aa, Artificial Sequence
  Description of Artificial Sequence: Synthetic peptide
SEEEIRCTNPIATEQYGSVSENLMRGNQR

SEQ ID NO: 21548 - protein, 29 aa, Artificial Sequence
  Description of Artificial Sequence: Synthetic peptide
SEEEIRCTNPIATEQYGSVSENLMRGNRA

SEQ ID NO: 21549 - protein, 30 aa, Artificial Sequence
  Description of Artificial Sequence: Synthetic polypeptide
DTEEIRYTNPVATEQYGSYVSTNLQNGDTR

SEQ ID NO: 21550 - protein, 29 aa, Artificial Sequence
  Description of Artificial Sequence: Synthetic peptide
DTEEIRYTNPVATEQYGSVVSTNLVNGTR

SEQ ID NO: 21551 - protein, 29 aa, Artificial Sequence
  Description of Artificial Sequence: Synthetic peptide
SEEEIRCTNPIATEQYGSVSENLMRGNRD

SEQ ID NO: 21552 - protein, 30 aa, Artificial Sequence
  Description of Artificial Sequence: Synthetic polypeptide
DTEEIRYTNPVATEQYGSQVSTNLQNGTTR

SEQ ID NO: 21553 - protein, 30 aa, Artificial Sequence
  Description of Artificial Sequence: Synthetic polypeptide
DTEEIRYTNPVATEQYGSNVSTNLQNGTRI

SEQ ID NO: 21554 - protein, 29 aa, Artificial Sequence
  Description of Artificial Sequence: Synthetic peptide
SEEEIRCTNPIATEQYGSVSENLMRGNRE

SEQ ID NO: 21555 - protein, 29 aa, Artificial Sequence
  Description of Artificial Sequence: Synthetic peptide
SEEEIRCTNPIATEQYGSVSENLMRGNPR

SEQ ID NO: 21556 - protein, 29 aa, Artificial Sequence
  Description of Artificial Sequence: Synthetic peptide
SEEEIRCTNPIATEQYGSVSENLMRGNRF

SEQ ID NO: 21557 - protein, 29 aa, Artificial Sequence
  Description of Artificial Sequence: Synthetic peptide
SEEEIRCTNPIATEQYGSVSENLMRGNRG

SEQ ID NO: 21558 - protein, 29 aa, Artificial Sequence
  Description of Artificial Sequence: Synthetic peptide
SEEEIRCTNPIATEQYGSVSENLMRGNRH

SEQ ID NO: 21559 - protein, 29 aa, Artificial Sequence
  Description of Artificial Sequence: Synthetic peptide
SEEEIRCTNPIATEQYGSVSENLMRGNRI

SEQ ID NO: 21560 - protein, 29 aa, Artificial Sequence
  Description of Artificial Sequence: Synthetic peptide
SEEEIRCTNPIATEQYGSVSENLMRGNRL

SEQ ID NO: 21561 - protein, 29 aa, Artificial Sequence
  Description of Artificial Sequence: Synthetic peptide
SEEEIRCTNPIATEQYGSVSENLMRGNRM

SEQ ID NO: 21562 - protein, 29 aa, Artificial Sequence
  Description of Artificial Sequence: Synthetic peptide
AEEEIRTTNPVATEQYGSVSTTNVEAGNG

SEQ ID NO: 21563 - protein, 29 aa, Artificial Sequence
  Description of Artificial Sequence: Synthetic peptide
SEEEIRCTNPIATEQYGSVSENLMRGNRN

SEQ ID NO: 21564 - protein, 29 aa, Artificial Sequence
  Description of Artificial Sequence: Synthetic peptide
SEEEIRCTNPIATEQYGSVSENLMRGNRP

SEQ ID NO: 21565 - protein, 29 aa, Artificial Sequence
  Description of Artificial Sequence: Synthetic peptide
SEEEIRCTNPIATEQYGSVSENLMRGNRQ

SEQ ID NO: 21566 - protein, 29 aa, Artificial Sequence
  Description of Artificial Sequence: Synthetic peptide
SEEEIRCTNPIATEQYGSVSENLMRGNRS

SEQ ID NO: 21567 - protein, 29 aa, Artificial Sequence
  Description of Artificial Sequence: Synthetic peptide
SEEEIRCTNPIATEQYGSVSENLMRGNRT

SEQ ID NO: 21568 - protein, 30 aa, Artificial Sequence
  Description of Artificial Sequence: Synthetic polypeptide
DEEEIRATNPVATEQYGVVSVTNLFQGGNA

SEQ ID NO: 21569 - protein, 30 aa, Artificial Sequence
  Description of Artificial Sequence: Synthetic polypeptide
DTEEIRYTNPVATEQYGSMVSETNLQNGTR

SEQ ID NO: 21570 - protein, 29 aa, Artificial Sequence
  Description of Artificial Sequence: Synthetic peptide
SEEEIRCTNPIATEQYGSVSENLMRGNRV

SEQ ID NO: 21571 - protein, 28 aa, Artificial Sequence
  Description of Artificial Sequence: Synthetic peptide
SEEEIRCTNPIATEQYGSVSENLMRGNP

SEQ ID NO: 21572 - protein, 28 aa, Artificial Sequence
  Description of Artificial Sequence: Synthetic peptide
SEEEIRCTNPIATEQYGSVSENLMRGNN

SEQ ID NO: 21573 - protein, 31 aa, Artificial Sequence
  Description of Artificial Sequence: Synthetic polypeptide
DEEEIRTTNPVATEQYGSVSTFNLGQGINEA

SEQ ID NO: 21574 - protein, 29 aa, Artificial Sequence
  Description of Artificial Sequence: Synthetic peptide
SEEEIRCTNPIATEQYGSVSENLMRGNFR

SEQ ID NO: 21575 - protein, 28 aa, Artificial Sequence
  Description of Artificial Sequence: Synthetic peptide
SEEEIRCTNPIATEQYGSVSENLMRGNG

SEQ ID NO: 21576 - protein, 29 aa, Artificial Sequence
  Description of Artificial Sequence: Synthetic peptide
DEEEIRTTNPFATEQYGSVSVNIIRGNDD

SEQ ID NO: 21577 - protein, 30 aa, Artificial Sequence
  Description of Artificial Sequence: Synthetic polypeptide
DEEEIRTTNPFATEQYGSVSVTNLQDPGDN

SEQ ID NO: 21578 - protein, 29 aa, Artificial Sequence
  Description of Artificial Sequence: Synthetic peptide
SEEEIRCTNPIATEQYGSVSENLMRGNGR

SEQ ID NO: 21579 - protein, 28 aa, Artificial Sequence
  Description of Artificial Sequence: Synthetic peptide
SEEEIRCTNPIATEQYGSVSENLMRGNH

SEQ ID NO: 21580 - protein, 29 aa, Artificial Sequence
  Description of Artificial Sequence: Synthetic peptide
SEEEIRCTNPIATEQYGSVSENLMRGNHR

SEQ ID NO: 21581 - protein, 31 aa, Artificial Sequence
  Description of Artificial Sequence: Synthetic polypeptide
DEEEIRTTNPVATEQYGSVSTFNLFNSGNQG

SEQ ID NO: 21582 - protein, 28 aa, Artificial Sequence
  Description of Artificial Sequence: Synthetic peptide
SEEEIRCTNPIATEQYGSVSENLMRGNI

SEQ ID NO: 21583 - protein, 29 aa, Artificial Sequence
  Description of Artificial Sequence: Synthetic peptide
SEEEIRCTNPIATEQYGSVSENLMRGNIR

SEQ ID NO: 21584 - protein, 28 aa, Artificial Sequence
  Description of Artificial Sequence: Synthetic peptide
SEEEIRCTNPIATEQYGSVSENLMRGNK

SEQ ID NO: 21585 - protein, 29 aa, Artificial Sequence
  Description of Artificial Sequence: Synthetic peptide
SEEEIRCTNPIATEQYGSVSENLMRGNNR

SEQ ID NO: 21586 - protein, 28 aa, Artificial Sequence
  Description of Artificial Sequence: Synthetic peptide
SEEEIRCTNPIATEQYGSVSENLMRGNL

SEQ ID NO: 21587 - protein, 29 aa, Artificial Sequence
  Description of Artificial Sequence: Synthetic peptide
DTQEIRTTNPVATEQYGSVSTNVLQNGMG

SEQ ID NO: 21588 - protein, 29 aa, Artificial Sequence
  Description of Artificial Sequence: Synthetic peptide
DTQEIRTTNPVATEQYGSVSTNVLQLGSD

SEQ ID NO: 21589 - protein, 29 aa, Artificial Sequence
  Description of Artificial Sequence: Synthetic peptide
DTQEIRTTNPVATEQYGSVSTNDLQLGMT

SEQ ID NO: 21590 - protein, 29 aa, Artificial Sequence
  Description of Artificial Sequence: Synthetic peptide
DEEEIRTTNPFATEQYGSVSYANYFRGND

SEQ ID NO: 21591 - protein, 28 aa, Artificial Sequence
  Description of Artificial Sequence: Synthetic peptide
DTNEIRTTNPVATEQYGCCSTDLQMGNR

SEQ ID NO: 21592 - protein, 29 aa, Artificial Sequence
  Description of Artificial Sequence: Synthetic peptide
SEEEIRCTNPIATEQYGSVSENLMRGNLR

SEQ ID NO: 21593 - protein, 29 aa, Artificial Sequence
  Description of Artificial Sequence: Synthetic peptide
AEEEIRTTNPVATEQYGSVSTTQLGGGNM

SEQ ID NO: 21594 - protein, 29 aa, Artificial Sequence
  Description of Artificial Sequence: Synthetic peptide
DTGEIRTTNPVATEQYGSVSTNVLQLGTS

SEQ ID NO: 21595 - protein, 28 aa, Artificial Sequence
  Description of Artificial Sequence: Synthetic peptide
SEEEIRCTNPIATEQYGSVSENLMRGNM

SEQ ID NO: 21596 - protein, 29 aa, Artificial Sequence
  Description of Artificial Sequence: Synthetic peptide
DEEEIRTTNPVATEQYGSCSTMLDAGEFR

SEQ ID NO: 21597 - protein, 28 aa, Artificial Sequence
  Description of Artificial Sequence: Synthetic peptide
DTETIRTTNPVATEQYGTVSTNGQRVNL

SEQ ID NO: 21598 - protein, 29 aa, Artificial Sequence
  Description of Artificial Sequence: Synthetic peptide
SEEEIRCTNPIATEQYGSVSENLMRGNMR

SEQ ID NO: 21599 - protein, 28 aa, Artificial Sequence
  Description of Artificial Sequence: Synthetic peptide
DTSEIRTTNPVATEQYGCCSTVLQAGNR

SEQ ID NO: 21600 - protein, 30 aa, Artificial Sequence
  Description of Artificial Sequence: Synthetic polypeptide
DEEEIRTTNPVATEQYGSCSTNDLQGFVND

SEQ ID NO: 21601 - protein, 29 aa, Artificial Sequence
  Description of Artificial Sequence: Synthetic peptide
SEEEIRCTNPIATEQYGSVSENLMRGNRW

SEQ ID NO: 21602 - protein, 29 aa, Artificial Sequence
  Description of Artificial Sequence: Synthetic peptide
SEEEIRCTNPIATEQYGSVSENLMRGNRY

SEQ ID NO: 21603 - protein, 29 aa, Artificial Sequence
  Description of Artificial Sequence: Synthetic peptide
SEEEIRCTNPIATEQYGSVSENLMRGQNR

SEQ ID NO: 21604 - protein, 28 aa, Artificial Sequence
  Description of Artificial Sequence: Synthetic peptide
SEEEIRCTNPIATEQYGSVSENLMRGQR

SEQ ID NO: 21605 - protein, 30 aa, Artificial Sequence
  Description of Artificial Sequence: Synthetic polypeptide
DEEEIRTTNPVATEQYGSCSTNDQTNNTRT

SEQ ID NO: 21606 - protein, 31 aa, Artificial Sequence
  Description of Artificial Sequence: Synthetic polypeptide
DEEEIRTTNPVATEQYGSCSTNDQVRDNQRD

SEQ ID NO: 21607 - protein, 29 aa, Artificial Sequence
  Description of Artificial Sequence: Synthetic peptide
SEEEIRCTNPIATEQYGSVSENLMRGSNR

SEQ ID NO: 21608 - protein, 30 aa, Artificial Sequence
  Description of Artificial Sequence: Synthetic polypeptide
DTEEIRTTNPVATTQYGSVSTNNVQNGNNR

SEQ ID NO: 21609 - protein, 31 aa, Artificial Sequence
  Description of Artificial Sequence: Synthetic polypeptide
AEEEIRTTNPVATEQYGSVSTTNTLQGGNNP

SEQ ID NO: 21610 - protein, 28 aa, Artificial Sequence
  Description of Artificial Sequence: Synthetic peptide
SEEEIRCTNPIATEQYGSVSENLMRGSR

SEQ ID NO: 21611 - protein, 30 aa, Artificial Sequence
  Description of Artificial Sequence: Synthetic polypeptide
DTEEIRTTNPVATTQYGSVSTNGDQNGNQR

SEQ ID NO: 21612 - protein, 29 aa, Artificial Sequence
  Description of Artificial Sequence: Synthetic peptide
SEEEIRCTNPIATEQYGSVSENLMRGTNR

SEQ ID NO: 21613 - protein, 30 aa, Artificial Sequence
  Description of Artificial Sequence: Synthetic polypeptide
DTEEIRTTNPVATQQYGSVSTNGTQNGNVR

SEQ ID NO: 21614 - protein, 30 aa, Artificial Sequence
  Description of Artificial Sequence: Synthetic polypeptide
DTEEIRTTNPVATNQYGSVSTNGVQNGNFR

SEQ ID NO: 21615 - protein, 32 aa, Artificial Sequence
  Description of Artificial Sequence: Synthetic polypeptide
DEEEIRTTNPVATEQYGSVSTFNLEQAGTNNA

SEQ ID NO: 21616 - protein, 30 aa, Artificial Sequence
  Description of Artificial Sequence: Synthetic polypeptide
DTEEIRTTNPVATMQYGSVSTNGNQNGNNR

SEQ ID NO: 21617 - protein, 28 aa, Artificial Sequence
  Description of Artificial Sequence: Synthetic peptide
SEEEIRCTNPIATEQYGSVSENLMRGTR

SEQ ID NO: 21618 - protein, 29 aa, Artificial Sequence
  Description of Artificial Sequence: Synthetic peptide
SEEEIRCTNPIATEQYGSVSENLMRGVNR

SEQ ID NO: 21619 - protein, 28 aa, Artificial Sequence
  Description of Artificial Sequence: Synthetic peptide
SEEEIRCTNPIATEQYGSVSENLMRGVR

SEQ ID NO: 21620 - protein, 32 aa, Artificial Sequence
  Description of Artificial Sequence: Synthetic polypeptide
DEEEIRTTNPVATEQYGSVSTFNLDQTEGGNI

SEQ ID NO: 21621 - protein, 28 aa, Artificial Sequence
  Description of Artificial Sequence: Synthetic peptide
SEEEIRCTNPIATEQYGSVSENLMRGYR

SEQ ID NO: 21622 - protein, 30 aa, Artificial Sequence
  Description of Artificial Sequence: Synthetic polypeptide
AEEEIRTTNPVATEQYGSVSTTNSQQTGNL

SEQ ID NO: 21623 - protein, 29 aa, Artificial Sequence
  Description of Artificial Sequence: Synthetic peptide
SEEEIRCTNPIATEQYGSVSENLMRHGNR

SEQ ID NO: 21624 - protein, 28 aa, Artificial Sequence
  Description of Artificial Sequence: Synthetic peptide
SEEEIRCTNPIATEQYGSVSENLMRHNR

SEQ ID NO: 21625 - protein, 31 aa, Artificial Sequence
  Description of Artificial Sequence: Synthetic polypeptide
DTEEIRTTNPVATEQYGSVSTNLDQGSGNNT

SEQ ID NO: 21626 - protein, 29 aa, Artificial Sequence
  Description of Artificial Sequence: Synthetic peptide
SEEEIRCTNPIATEQYGSVSENLMRIGNR

SEQ ID NO: 21627 - protein, 32 aa, Artificial Sequence
  Description of Artificial Sequence: Synthetic polypeptide
DEECIRTTNPVATEHYGSVPSCTNLSQRGGNR

SEQ ID NO: 21628 - protein, 29 aa, Artificial Sequence
  Description of Artificial Sequence: Synthetic peptide
DEEEIRTTNPVATEQYGSCSTNEQMTDRF

SEQ ID NO: 21629 - protein, 30 aa, Artificial Sequence
  Description of Artificial Sequence: Synthetic polypeptide
DTEEIRTTNPVATHQYGSVSTNGDQNGNER

SEQ ID NO: 21630 - protein, 31 aa, Artificial Sequence
  Description of Artificial Sequence: Synthetic polypeptide
DEEEIRTTNPVATEQYGSCSTNDQRNQNGRT

SEQ ID NO: 21631 - protein, 30 aa, Artificial Sequence
  Description of Artificial Sequence: Synthetic polypeptide
DEEEIRTTNPVATEQYGSCSTNDQRNQERP

SEQ ID NO: 21632 - protein, 28 aa, Artificial Sequence
  Description of Artificial Sequence: Synthetic peptide
SEEEIRCTNPIATEQYGSVSENLMRGPR

SEQ ID NO: 21633 - protein, 30 aa, Artificial Sequence
  Description of Artificial Sequence: Synthetic polypeptide
DTEEIRYTNPVATEQYGSFVSTNLEQNGTR

SEQ ID NO: 21634 - protein, 29 aa, Artificial Sequence
  Description of Artificial Sequence: Synthetic peptide
DEEEIRTTNPFATEQYGSVSYINIGRGND

SEQ ID NO: 21635 - protein, 28 aa, Artificial Sequence
  Description of Artificial Sequence: Synthetic peptide
SEEEIRCTNPIATEQYGSVSENLMRGNS

SEQ ID NO: 21636 - protein, 29 aa, Artificial Sequence
  Description of Artificial Sequence: Synthetic peptide
SEEEIRCTNPIATEQYGSVSENLMRGNSR

SEQ ID NO: 21637 - protein, 31 aa, Artificial Sequence
  Description of Artificial Sequence: Synthetic polypeptide
DTEEIRYTNPVATEQYGMSCVSTNLQNGNTR

SEQ ID NO: 21638 - protein, 28 aa, Artificial Sequence
  Description of Artificial Sequence: Synthetic peptide
SEEEIRCTNPIATEQYGSVSENLMRGNT

SEQ ID NO: 21639 - protein, 29 aa, Artificial Sequence
  Description of Artificial Sequence: Synthetic peptide
DTEEIRYTNPVATEFYGSFVSTNLQNGTR

SEQ ID NO: 21640 - protein, 30 aa, Artificial Sequence
  Description of Artificial Sequence: Synthetic polypeptide
DEEEIRTTNPVATEQYGSCSTNDQAGDNFD

SEQ ID NO: 21641 - protein, 30 aa, Artificial Sequence
  Description of Artificial Sequence: Synthetic polypeptide
DEEEIRTTNPVATEQYGSCSTNDQDEGNQE

SEQ ID NO: 21642 - protein, 29 aa, Artificial Sequence
  Description of Artificial Sequence: Synthetic peptide
DEEEIRTTNPVATEQYGSCSTNDQGETER

SEQ ID NO: 21643 - protein, 29 aa, Artificial Sequence
  Description of Artificial Sequence: Synthetic peptide
SEEEIRCTNPIATEQYGSVSENLMRGNTR

SEQ ID NO: 21644 - protein, 28 aa, Artificial Sequence
  Description of Artificial Sequence: Synthetic peptide
SEEEIRCTNPIATEQYGSVSENLMRGNV

SEQ ID NO: 21645 - protein, 28 aa, Artificial Sequence
  Description of Artificial Sequence: Synthetic peptide
DTEEIRTTNPYATEHYGSVSFNLQRENN

SEQ ID NO: 21646 - protein, 29 aa, Artificial Sequence
  Description of Artificial Sequence: Synthetic peptide
SEEEIRCTNPIATEQYGSVSENLMRGNVR

SEQ ID NO: 21647 - protein, 28 aa, Artificial Sequence
  Description of Artificial Sequence: Synthetic peptide
SEEEIRCTNPIATEQYGSVSENLMRGNW

SEQ ID NO: 21648 - protein, 28 aa, Artificial Sequence
  Description of Artificial Sequence: Synthetic peptide
DTEEIRTTNPVGTEQWGVVSTNLQRGIG

SEQ ID NO: 21649 - protein, 29 aa, Artificial Sequence
  Description of Artificial Sequence: Synthetic peptide
DTEEIRTTNPVGTEQWGTVSTNLQRGVIR

SEQ ID NO: 21650 - protein, 29 aa, Artificial Sequence
  Description of Artificial Sequence: Synthetic peptide
SEEEIRCTNPIATEQYGSVSENLMRGNWR

SEQ ID NO: 21651 - protein, 28 aa, Artificial Sequence
  Description of Artificial Sequence: Synthetic peptide
SEEEIRCTNPIATEQYGSVSENLMRGNY

SEQ ID NO: 21652 - protein, 32 aa, Artificial Sequence
  Description of Artificial Sequence: Synthetic polypeptide
DEEEIRTTNPVATEQYGSCSTNDQPRGENSRQ

SEQ ID NO: 21653 - protein, 29 aa, Artificial Sequence
  Description of Artificial Sequence: Synthetic peptide
SEEEIRCTNPIATEQYGSVSENLMRGNYR

SEQ ID NO: 21654 - protein, 28 aa, Artificial Sequence
  Description of Artificial Sequence: Synthetic peptide
DTEEIRTTNPVGTEQWGMVSTNLQRGVD

SEQ ID NO: 21655 - protein, 28 aa, Artificial Sequence
  Description of Artificial Sequence: Synthetic peptide
DTEEIRTTNPVGTEQWGGVSTNLQRGEI

SEQ ID NO: 21656 - protein, 30 aa, Artificial Sequence
  Description of Artificial Sequence: Synthetic polypeptide
DEEEIRTTNPVATEQYGSCSTNDQRNEVRY

SEQ ID NO: 21657 - protein, 29 aa, Artificial Sequence
  Description of Artificial Sequence: Synthetic peptide
SEEEIRCTNPIATEQYGSVSENLMRGPNR

SEQ ID NO: 21658 - protein, 30 aa, Artificial Sequence
  Description of Artificial Sequence: Synthetic polypeptide
DEEEIRTTNPVATEQYGSCSTNDQRNNVFE

SEQ ID NO: 21659 - protein, 28 aa, Artificial Sequence
  Description of Artificial Sequence: Synthetic peptide
DTEEIRTTNPVAYLQYGSVSTNDQPGTR

SEQ ID NO: 21660 - protein, 29 aa, Artificial Sequence
  Description of Artificial Sequence: Synthetic peptide
SEEEIRCTNPIATEQYGSVSENGLMRGNR

SEQ ID NO: 21661 - protein, 28 aa, Artificial Sequence
  Description of Artificial Sequence: Synthetic peptide
DEEEIRCTNPIATEQYGSVSENWMPGNR

SEQ ID NO: 21662 - protein, 28 aa, Artificial Sequence
  Description of Artificial Sequence: Synthetic peptide
SEEEIRCTNPIATEQYGSVSENFMRGNR

SEQ ID NO: 21663 - protein, 28 aa, Artificial Sequence
  Description of Artificial Sequence: Synthetic peptide
DEEEIRTTNPEATVQYGCVPTELQRGNF

SEQ ID NO: 21664 - protein, 28 aa, Artificial Sequence
  Description of Artificial Sequence: Synthetic peptide
SEEEIRCTNPIATEQYGFVSENLMRGNR

SEQ ID NO: 21665 - protein, 30 aa, Artificial Sequence
  Description of Artificial Sequence: Synthetic polypeptide
FEEEIRTTNPVATESYGSVSETNLARGMQR

SEQ ID NO: 21666 - protein, 28 aa, Artificial Sequence
  Description of Artificial Sequence: Synthetic peptide
SEEEIRCTNPIATEQYGGVSENLMRGNR

SEQ ID NO: 21667 - protein, 32 aa, Artificial Sequence
  Description of Artificial Sequence: Synthetic polypeptide
DEEEIRTTNPVATEQYGSVSTGPLQNRGNSMG

SEQ ID NO: 21668 - protein, 28 aa, Artificial Sequence
  Description of Artificial Sequence: Synthetic peptide
SEEEIRCTNPIATEQYGHVSENLMRGNR

SEQ ID NO: 21669 - protein, 28 aa, Artificial Sequence
  Description of Artificial Sequence: Synthetic peptide
SEEEIRCTNPIATEQYGIVSCNLMRGNR

SEQ ID NO: 21670 - protein, 32 aa, Artificial Sequence
  Description of Artificial Sequence: Synthetic polypeptide
DEEEIRTTNPVATEQYGSVSTGPLQNRGNESE

SEQ ID NO: 21671 - protein, 31 aa, Artificial Sequence
  Description of Artificial Sequence: Synthetic polypeptide
DEEEIRTTNPVATEQYGSVSTNLQHFQSNFA

SEQ ID NO: 21672 - protein, 31 aa, Artificial Sequence
  Description of Artificial Sequence: Synthetic polypeptide
DEEEIRTTNPVATEQYGSVSTGPLQHRDTDR

SEQ ID NO: 21673 - protein, 32 aa, Artificial Sequence
  Description of Artificial Sequence: Synthetic polypeptide
DEEEIRCTNPVATEQYGSVCSTPNLQGSGNRP

SEQ ID NO: 21674 - protein, 28 aa, Artificial Sequence
  Description of Artificial Sequence: Synthetic peptide
SEEEIRCTNPIATEQYGIVSENLMRGNR

SEQ ID NO: 21675 - protein, 28 aa, Artificial Sequence
  Description of Artificial Sequence: Synthetic peptide
SEEEIRCTNPIATEQYGIVSENLYRGNR

SEQ ID NO: 21676 - protein, 28 aa, Artificial Sequence
  Description of Artificial Sequence: Synthetic peptide
SEEEIRCTNPIATEQYGEVSENLQRGGR

SEQ ID NO: 21677 - protein, 31 aa, Artificial Sequence
  Description of Artificial Sequence: Synthetic polypeptide
DEEEIRCTNPVATEQYGSVCSTGNLQHGNQL

SEQ ID NO: 21678 - protein, 31 aa, Artificial Sequence
  Description of Artificial Sequence: Synthetic polypeptide
DEEEIRTTNPVATEQYGSVSTGNTQRGSVQF

SEQ ID NO: 21679 - protein, 30 aa, Artificial Sequence
  Description of Artificial Sequence: Synthetic polypeptide
DEEEIRTTNPVATEQYGSASLMNMVQRDNR

SEQ ID NO: 21680 - protein, 30 aa, Artificial Sequence
  Description of Artificial Sequence: Synthetic polypeptide
DEEEIRCTNPVATEQYGSVCSEGLMREGNR

SEQ ID NO: 21681 - protein, 28 aa, Artificial Sequence
  Description of Artificial Sequence: Synthetic peptide
SEEEIRCTNPIATEQYGKVSENLMRGNR

SEQ ID NO: 21682 - protein, 28 aa, Artificial Sequence
  Description of Artificial Sequence: Synthetic peptide
SEEEIRCTNPIATEQYGLVSENLMRGNR

SEQ ID NO: 21683 - protein, 29 aa, Artificial Sequence
  Description of Artificial Sequence: Synthetic peptide
FEEEIRTTNPVATEQYGSVSVTNLQVVEE

SEQ ID NO: 21684 - protein, 30 aa, Artificial Sequence
  Description of Artificial Sequence: Synthetic polypeptide
DEEEIRTTNPVATEQYGSASLPNMLQKDNR

SEQ ID NO: 21685 - protein, 29 aa, Artificial Sequence
  Description of Artificial Sequence: Synthetic peptide
SEEEIRCTNPIATEQYGMSVSENLDRGNR

SEQ ID NO: 21686 - protein, 32 aa, Artificial Sequence
  Description of Artificial Sequence: Synthetic polypeptide
DEEEIRTTNPVATEQYGSVSITMLQEGGDNRN

SEQ ID NO: 21687 - protein, 28 aa, Artificial Sequence
  Description of Artificial Sequence: Synthetic peptide
SEEEIRCTNPIATEQYGMVSENLMRGNR

SEQ ID NO: 21688 - protein, 32 aa, Artificial Sequence
  Description of Artificial Sequence: Synthetic polypeptide
DEEEIRTTNPVATEQYGSVSTGNNQNSGSNRF

SEQ ID NO: 21689 - protein, 31 aa, Artificial Sequence
  Description of Artificial Sequence: Synthetic polypeptide
FEEEIRTTNPVATEQYGSVSTVNLQETGNVN

SEQ ID NO: 21690 - protein, 31 aa, Artificial Sequence
  Description of Artificial Sequence: Synthetic polypeptide
DEEEIRCTNPVATEQYGSVCSTENEQRGSND

SEQ ID NO: 21691 - protein, 29 aa, Artificial Sequence
  Description of Artificial Sequence: Synthetic peptide
SEEEIRCTNPIATEQYGNSVSENLSRGNR

SEQ ID NO: 21692 - protein, 28 aa, Artificial Sequence
  Description of Artificial Sequence: Synthetic peptide
SEEEIRCTNPIATEQYGEVSENLMRGNR

SEQ ID NO: 21693 - protein, 31 aa, Artificial Sequence
  Description of Artificial Sequence: Synthetic polypeptide
DEEEIRTTNPVATEQYGSVSITILQRMQERD

SEQ ID NO: 21694 - protein, 29 aa, Artificial Sequence
  Description of Artificial Sequence: Synthetic peptide
SEEEIRCTNPIATEQYGCSVSENLMRGNR

SEQ ID NO: 21695 - protein, 30 aa, Artificial Sequence
  Description of Artificial Sequence: Synthetic polypeptide
FNEEIRTTNPVATEQYGVVSTNLQDGVNDR

SEQ ID NO: 21696 - protein, 32 aa, Artificial Sequence
  Description of Artificial Sequence: Synthetic polypeptide
DEEEIRTTNPVATEQYGSVSTHLSQRGGNNEH

SEQ ID NO: 21697 - protein, 28 aa, Artificial Sequence
  Description of Artificial Sequence: Synthetic peptide
DEDEIATTNPVAYEPYGSVATNLQRGNT

SEQ ID NO: 21698 - protein, 28 aa, Artificial Sequence
  Description of Artificial Sequence: Synthetic peptide
SEEEIRCTNPIATEQYGCVSENLMRGNR

SEQ ID NO: 21699 - protein, 31 aa, Artificial Sequence
  Description of Artificial Sequence: Synthetic polypeptide
DEEEIRTTNPVATEQYGSVSTHLGQDTSGER

SEQ ID NO: 21700 - protein, 28 aa, Artificial Sequence
  Description of Artificial Sequence: Synthetic peptide
DEEEIRTTNPEATEQYGSVPTPLVRGKE

SEQ ID NO: 21701 - protein, 28 aa, Artificial Sequence
  Description of Artificial Sequence: Synthetic peptide
DEEEIRTTNPEATEQYGSVPTQLARGTE

SEQ ID NO: 21702 - protein, 30 aa, Artificial Sequence
  Description of Artificial Sequence: Synthetic polypeptide
DEEEIRTTNPVATEQYGSVSTHIQRSGEMQ

SEQ ID NO: 21703 - protein, 30 aa, Artificial Sequence
  Description of Artificial Sequence: Synthetic polypeptide
DEEEIRCTNPVATEQYGSVSCNEPMREGNR

SEQ ID NO: 21704 - protein, 28 aa, Artificial Sequence
  Description of Artificial Sequence: Synthetic peptide
AEEEIRTTNPVAYEEYGKTSINLQRGNR

SEQ ID NO: 21705 - protein, 31 aa, Artificial Sequence
  Description of Artificial Sequence: Synthetic polypeptide
DEEEIRTTNPVATEQYGSVSTGYLQGSGNQN

SEQ ID NO: 21706 - protein, 28 aa, Artificial Sequence
  Description of Artificial Sequence: Synthetic peptide
SEEEIRCTNPIATEQYGEVSANLMRGNR

SEQ ID NO: 21707 - protein, 32 aa, Artificial Sequence
  Description of Artificial Sequence: Synthetic polypeptide
DEEEIRTTNPVATEQYGSVSITGNLQRGVLIN

SEQ ID NO: 21708 - protein, 31 aa, Artificial Sequence
  Description of Artificial Sequence: Synthetic polypeptide
DEEEIRTTNPVATEQYGSVSTNLQGRIVEES

SEQ ID NO: 21709 - protein, 29 aa, Artificial Sequence
  Description of Artificial Sequence: Synthetic peptide
DEEEIRTTNPVATEQYGSASANLQGGVEN

SEQ ID NO: 21710 - protein, 32 aa, Artificial Sequence
  Description of Artificial Sequence: Synthetic polypeptide
DEEEIRTTNPVATEQYGSVSITGNLQRGVVPE

SEQ ID NO: 21711 - protein, 28 aa, Artificial Sequence
  Description of Artificial Sequence: Synthetic peptide
FEEGITTTNPVATEQYGSVSLNSQRGNS

SEQ ID NO: 21712 - protein, 31 aa, Artificial Sequence
  Description of Artificial Sequence: Synthetic polypeptide
DEEEIRTTNPVATEQYGSVSTGVLDRGEQRE

SEQ ID NO: 21713 - protein, 28 aa, Artificial Sequence
  Description of Artificial Sequence: Synthetic peptide
SEEEIRCTNPIATEQYGDVSENLMRGNR

SEQ ID NO: 21714 - protein, 32 aa, Artificial Sequence
  Description of Artificial Sequence: Synthetic polypeptide
DEEEIRTTNPVATEQYGSVSTNLQGSGNNGQE

SEQ ID NO: 21715 - protein, 31 aa, Artificial Sequence
  Description of Artificial Sequence: Synthetic polypeptide
DEEEIRTTNPVATEQYGSVSTNLQGTQANAT

SEQ ID NO: 21716 - protein, 28 aa, Artificial Sequence
  Description of Artificial Sequence: Synthetic peptide
DEEEIRTTNPEATEQYGSVPTWLARGAM

SEQ ID NO: 21717 - protein, 30 aa, Artificial Sequence
  Description of Artificial Sequence: Synthetic polypeptide
FEEEIRTVNPVATEQYGSVSFSNLQRFGNG

SEQ ID NO: 21718 - protein, 29 aa, Artificial Sequence
  Description of Artificial Sequence: Synthetic peptide
SEEEIRCTNPIATEQYGESVSENLMRGNR

SEQ ID NO: 21719 - protein, 28 aa, Artificial Sequence
  Description of Artificial Sequence: Synthetic peptide
DEEEIRTTNPEATEQYGSVPTWLARGSG

SEQ ID NO: 21720 - protein, 29 aa, Artificial Sequence
  Description of Artificial Sequence: Synthetic peptide
DEEEIRTTNPVATEQYGSAQTTGLQRENL

SEQ ID NO: 21721 - protein, 28 aa, Artificial Sequence
  Description of Artificial Sequence: Synthetic peptide
SEEEIRCTNPIATEQYGAVSENLMRGNR

SEQ ID NO: 21722 - protein, 32 aa, Artificial Sequence
  Description of Artificial Sequence: Synthetic polypeptide
DEEEIRTTNPVATEQYGSVSTGNNLTQIGNNF

SEQ ID NO: 21723 - protein, 31 aa, Artificial Sequence
  Description of Artificial Sequence: Synthetic polypeptide
DEEEIRCTNPVATEQYGSVATNLQRDNPNGR

SEQ ID NO: 21724 - protein, 32 aa, Artificial Sequence
  Description of Artificial Sequence: Synthetic polypeptide
DEEEIRTTNPVATEQYGSVSTGNLQSNEGSNE

SEQ ID NO: 21725 - protein, 29 aa, Artificial Sequence
  Description of Artificial Sequence: Synthetic peptide
SEEEIRCTNPIATEQYGSAVSENLMRGNR

SEQ ID NO: 21726 - protein, 32 aa, Artificial Sequence
  Description of Artificial Sequence: Synthetic polypeptide
DEEEIRTTNPVATEQYGSVSTGNLQSIGSNEG

SEQ ID NO: 21727 - protein, 28 aa, Artificial Sequence
  Description of Artificial Sequence: Synthetic peptide
SEEEIRCTNPIATEQYGSCSENLMRGNR

SEQ ID NO: 21728 - protein, 32 aa, Artificial Sequence
  Description of Artificial Sequence: Synthetic polypeptide
DEEEIRTTNPVATEQYGSVSTGNLQSIGMNNF

SEQ ID NO: 21729 - protein, 29 aa, Artificial Sequence
  Description of Artificial Sequence: Synthetic peptide
SEEEIRCTNPIATEQYGSCVSENLMRGNR

SEQ ID NO: 21730 - protein, 32 aa, Artificial Sequence
  Description of Artificial Sequence: Synthetic polypeptide
DEEEIRTTNPVATEQYGSVSTGNLQSFGNNQP

SEQ ID NO: 21731 - protein, 32 aa, Artificial Sequence
  Description of Artificial Sequence: Synthetic polypeptide
DEEEIRTTNPVATEQYGSVSTGNLQRSNNNQS

SEQ ID NO: 21732 - protein, 28 aa, Artificial Sequence
  Description of Artificial Sequence: Synthetic peptide
SEEEIRCTNPIATEQYGSFSENLMRGNR

SEQ ID NO: 21733 - protein, 28 aa, Artificial Sequence
  Description of Artificial Sequence: Synthetic peptide
SEEEIRCTNPIATEQYGSISENLMRGNR

SEQ ID NO: 21734 - protein, 29 aa, Artificial Sequence
  Description of Artificial Sequence: Synthetic peptide
SEEEIRCTNPIATEQYGSIVSENLMRGNR

SEQ ID NO: 21735 - protein, 28 aa, Artificial Sequence
  Description of Artificial Sequence: Synthetic peptide
SEEEIRCTNPIATEQYGSLSENLMRGNR

SEQ ID NO: 21736 - protein, 29 aa, Artificial Sequence
  Description of Artificial Sequence: Synthetic peptide
AEEEIRTTNPVATEQYGSVSTTVQELGNG

SEQ ID NO: 21737 - protein, 31 aa, Artificial Sequence
  Description of Artificial Sequence: Synthetic polypeptide
FEEEIRTTNPVATEQYGSVSTPNLQRVADRN

SEQ ID NO: 21738 - protein, 31 aa, Artificial Sequence
  Description of Artificial Sequence: Synthetic polypeptide
DEEEIRTTNPVATEQYGSVSTNLQITDEERA

SEQ ID NO: 21739 - protein, 31 aa, Artificial Sequence
  Description of Artificial Sequence: Synthetic polypeptide
DEEEIRTTNPVATEQYGSVSTGNLQRFMSET

SEQ ID NO: 21740 - protein, 32 aa, Artificial Sequence
  Description of Artificial Sequence: Synthetic polypeptide
FEEEIRTTNPVATEQYGSVSTPNGLDQRGNEP

SEQ ID NO: 21741 - protein, 29 aa, Artificial Sequence
  Description of Artificial Sequence: Synthetic peptide
SEEEIRCTNPIATEQYGSMVSENLMRGNR

SEQ ID NO: 21742 - protein, 32 aa, Artificial Sequence
  Description of Artificial Sequence: Synthetic polypeptide
DEEEIRTTNPVATEQYGSVSTGNLQQVVGNFN

SEQ ID NO: 21743 - protein, 30 aa, Artificial Sequence
  Description of Artificial Sequence: Synthetic polypeptide
FEEEIRTTNPVATEQYGSVSTNSTQVGNIQ

SEQ ID NO: 21744 - protein, 32 aa, Artificial Sequence
  Description of Artificial Sequence: Synthetic polypeptide
DEEEIRTTNPVATEQYGSVSTGNLQQVEGNNQ

SEQ ID NO: 21745 - protein, 32 aa, Artificial Sequence
  Description of Artificial Sequence: Synthetic polypeptide
DEEEIRTTNPVATEQYGSVSTNLQLDGENVQQ

SEQ ID NO: 21746 - protein, 29 aa, Artificial Sequence
  Description of Artificial Sequence: Synthetic peptide
SEEEIRCTNPIATEQYGSSVSENLMRGNR

SEQ ID NO: 21747 - protein, 32 aa, Artificial Sequence
  Description of Artificial Sequence: Synthetic polypeptide
DEEEIRTTNPVATEQYGSVSTGNLQQIGQNEL

SEQ ID NO: 21748 - protein, 31 aa, Artificial Sequence
  Description of Artificial Sequence: Synthetic polypeptide
FEEEIRTTNPVATEQYGSVSTNLSEQVGNID

SEQ ID NO: 21749 - protein, 31 aa, Artificial Sequence
  Description of Artificial Sequence: Synthetic polypeptide
FEEEIRTTNPVATEQYGSVSTNLQVGGNINQ

SEQ ID NO: 21750 - protein, 29 aa, Artificial Sequence
  Description of Artificial Sequence: Synthetic peptide
SEEEIRCTNPIATEQYGSLVSENLMRGNR

SEQ ID NO: 21751 - protein, 28 aa, Artificial Sequence
  Description of Artificial Sequence: Synthetic peptide
DEEEIRTTNPEATEQYGSVPTWLDRGEE

SEQ ID NO: 21752 - protein, 33 aa, Artificial Sequence
  Description of Artificial Sequence: Synthetic polypeptide
FEEEIRTTNPVATEQYGSVSTSNLIQQRGENYR

SEQ ID NO: 21753 - protein, 32 aa, Artificial Sequence
  Description of Artificial Sequence: Synthetic polypeptide
DEEEIRTTNPVATEQYGSVSTGNLQTEGGNGQ

SEQ ID NO: 21754 - protein, 28 aa, Artificial Sequence
  Description of Artificial Sequence: Synthetic peptide
SEEEIRCTNPIATEQYGNVSENLMRGNR

SEQ ID NO: 21755 - protein, 31 aa, Artificial Sequence
  Description of Artificial Sequence: Synthetic polypeptide
DEEEIRTTNPVATEQYGSVSITMLQQGEQND

SEQ ID NO: 21756 - protein, 31 aa, Artificial Sequence
  Description of Artificial Sequence: Synthetic polypeptide
DEEEIRTTNPVATEQYGSVSTGNNAQNGNNM

SEQ ID NO: 21757 - protein, 28 aa, Artificial Sequence
  Description of Artificial Sequence: Synthetic peptide
AEEEIRTVNPVATEQYGSVSTGLQRNQE

SEQ ID NO: 21758 - protein, 32 aa, Artificial Sequence
  Description of Artificial Sequence: Synthetic polypeptide
DEEEIRTTNPVATEQYGSVSTNLQHQGENIGQ

SEQ ID NO: 21759 - protein, 29 aa, Artificial Sequence
  Description of Artificial Sequence: Synthetic peptide
SEEEIRCTNPIATEQYGQSVSENLMRGNR

SEQ ID NO: 21760 - protein, 31 aa, Artificial Sequence
  Description of Artificial Sequence: Synthetic polypeptide
FEEEIRTTNPVATEQYGSVSTTNLQQGNVGE

SEQ ID NO: 21761 - protein, 28 aa, Artificial Sequence
  Description of Artificial Sequence: Synthetic peptide
SEEEIRCTNPIATEQYGQVSENLMRGNR

SEQ ID NO: 21762 - protein, 31 aa, Artificial Sequence
  Description of Artificial Sequence: Synthetic polypeptide
DEEEIRCTNPVATEQYGSVATNLQNDGNERP

SEQ ID NO: 21763 - protein, 31 aa, Artificial Sequence
  Description of Artificial Sequence: Synthetic polypeptide
DEEEIRTTNPVATEQYGSVSITMLQRQIERD

SEQ ID NO: 21764 - protein, 28 aa, Artificial Sequence
  Description of Artificial Sequence: Synthetic peptide
DEEEIRTTNPEATEQYGSVPTWLGRGSE

SEQ ID NO: 21765 - protein, 32 aa, Artificial Sequence
  Description of Artificial Sequence: Synthetic polypeptide
DEEEIRTTNPVATEQYGSVSTGNLTQGGGNII

SEQ ID NO: 21766 - protein, 33 aa, Artificial Sequence
  Description of Artificial Sequence: Synthetic polypeptide
FEEEIRTTNPVATEQYGSVSTSNQLIQRGENER

SEQ ID NO: 21767 - protein, 28 aa, Artificial Sequence
  Description of Artificial Sequence: Synthetic peptide
SEEEIRCTNPIATEQYGSAPENLQRGNR

SEQ ID NO: 21768 - protein, 30 aa, Artificial Sequence
  Description of Artificial Sequence: Synthetic polypeptide
DEEEIRCTNPVATEQYGSVATNLQHDGNEA

SEQ ID NO: 21769 - protein, 28 aa, Artificial Sequence
  Description of Artificial Sequence: Synthetic peptide
SEEEIRCTNPIATEQYGSASENCQRGNR

SEQ ID NO: 21770 - protein, 30 aa, Artificial Sequence
  Description of Artificial Sequence: Synthetic polypeptide
DEEEIRCTNPVATEQYGSVATNLQERGDSA

SEQ ID NO: 21771 - protein, 32 aa, Artificial Sequence
  Description of Artificial Sequence: Synthetic polypeptide
DEEEIRTTNPVATEQYGSVSTGNLTQGEGNNF

SEQ ID NO: 21772 - protein, 31 aa, Artificial Sequence
  Description of Artificial Sequence: Synthetic polypeptide
DEEEIRTTNPVATEQYGSVSTGNLTGGSNGT

SEQ ID NO: 21773 - protein, 29 aa, Artificial Sequence
  Description of Artificial Sequence: Synthetic peptide
DEEEIRCTNPVATEQYGSVATNLQDGEMQ

SEQ ID NO: 21774 - protein, 28 aa, Artificial Sequence
  Description of Artificial Sequence: Synthetic peptide
DEEEIRCTNPVATEQYGSVATNLERPTQ

SEQ ID NO: 21775 - protein, 29 aa, Artificial Sequence
  Description of Artificial Sequence: Synthetic peptide
DEEEIRCTNPVATEQYGSVATNDLQGMNA

SEQ ID NO: 21776 - protein, 31 aa, Artificial Sequence
  Description of Artificial Sequence: Synthetic polypeptide
DEEEIRCTNPVATEQYGSVATNDDQDRGTNR

SEQ ID NO: 21777 - protein, 28 aa, Artificial Sequence
  Description of Artificial Sequence: Synthetic peptide
SEEEIRCTNPIATEQYGSASENLMRGNR

SEQ ID NO: 21778 - protein, 30 aa, Artificial Sequence
  Description of Artificial Sequence: Synthetic polypeptide
DEEEIRTTNPVATEQYGSASLPNMLQRDQR

SEQ ID NO: 21779 - protein, 30 aa, Artificial Sequence
  Description of Artificial Sequence: Synthetic polypeptide
DEEEIRCTNPVATEQYGSCSTNLTSGMNRQ

SEQ ID NO: 21780 - protein, 28 aa, Artificial Sequence
  Description of Artificial Sequence: Synthetic peptide
SEEEIRCTNPIATEQYGSASDNLMRGNR

SEQ ID NO: 21781 - protein, 28 aa, Artificial Sequence
  Description of Artificial Sequence: Synthetic peptide
AEEEIRTTNPVATEYYGSVITNAQAGNG

SEQ ID NO: 21782 - protein, 28 aa, Artificial Sequence
  Description of Artificial Sequence: Synthetic peptide
DEECIRTTNPVATEQWGCVSTNTQHGNA

SEQ ID NO: 21783 - protein, 28 aa, Artificial Sequence
  Description of Artificial Sequence: Synthetic peptide
FSEEIRTTNPVATHQYGSVSTTLERGNF

SEQ ID NO: 21784 - protein, 30 aa, Artificial Sequence
  Description of Artificial Sequence: Synthetic polypeptide
HEEEIRTTNPVATEQYGSVSTNLQRNHHFY

SEQ ID NO: 21785 - protein, 29 aa, Artificial Sequence
  Description of Artificial Sequence: Synthetic peptide
DEEEIRTTNPVATEQYGSVSTLLEMIGDT

SEQ ID NO: 21786 - protein, 28 aa, Artificial Sequence
  Description of Artificial Sequence: Synthetic peptide
SEEEIRCTNPIASEQYGSVSENLMRGNR

SEQ ID NO: 21787 - protein, 29 aa, Artificial Sequence
  Description of Artificial Sequence: Synthetic peptide
DEEEIRTTNPVATEQYGSVSTLLEENFER

SEQ ID NO: 21788 - protein, 29 aa, Artificial Sequence
  Description of Artificial Sequence: Synthetic peptide
AEEEIRTTNPVATESYGSVSTVNLGNGNT

SEQ ID NO: 21789 - protein, 28 aa, Artificial Sequence
  Description of Artificial Sequence: Synthetic peptide
SEEEIRCTNPIATAQYGSVSENLMRGNR

SEQ ID NO: 21790 - protein, 30 aa, Artificial Sequence
  Description of Artificial Sequence: Synthetic polypeptide
DEECIRTTNPVATEQWGSVATNNLQDGMNR

SEQ ID NO: 21791 - protein, 28 aa, Artificial Sequence
  Description of Artificial Sequence: Synthetic peptide
SEEEIRCTNPIATCQYGSVSENLCRGNR

SEQ ID NO: 21792 - protein, 28 aa, Artificial Sequence
  Description of Artificial Sequence: Synthetic peptide
SEEEIRCTNPIATCQYGSVSENLMRGNR

SEQ ID NO: 21793 - protein, 32 aa, Artificial Sequence
  Description of Artificial Sequence: Synthetic polypeptide
DEEEIRTTNPVATEQYGSVSTLLDQRNGNEED

SEQ ID NO: 21794 - protein, 30 aa, Artificial Sequence
  Description of Artificial Sequence: Synthetic polypeptide
DEEEIRTTNPVATEQYGSVSTLLDHGEQRE

SEQ ID NO: 21795 - protein, 28 aa, Artificial Sequence
  Description of Artificial Sequence: Synthetic peptide
SEEEIRCTNPIATDQYGSVSENLMRGNR

SEQ ID NO: 21796 - protein, 30 aa, Artificial Sequence
  Description of Artificial Sequence: Synthetic polypeptide
AEEEIRTTNPVATESYGSVSTTNLQSGNNL

SEQ ID NO: 21797 - protein, 28 aa, Artificial Sequence
  Description of Artificial Sequence: Synthetic peptide
SEEEIRCTNPIATEAYGSVSENLMRGNR

SEQ ID NO: 21798 - protein, 31 aa, Artificial Sequence
  Description of Artificial Sequence: Synthetic polypeptide
HEEEIRTTNPVATEQYGSVSTNLQRDQANDQ

SEQ ID NO: 21799 - protein, 30 aa, Artificial Sequence
  Description of Artificial Sequence: Synthetic polypeptide
HEEEIRTTNPVATEQYGSVSTNLQGNANES

SEQ ID NO: 21800 - protein, 30 aa, Artificial Sequence
  Description of Artificial Sequence: Synthetic polypeptide
DEEEIRTTNPVATEQYGCVSTATQRGSNIS

SEQ ID NO: 21801 - protein, 30 aa, Artificial Sequence
  Description of Artificial Sequence: Synthetic polypeptide
HEEEIRTTNPVATEQYGSVSTNLQENTNFV

SEQ ID NO: 21802 - protein, 30 aa, Artificial Sequence
  Description of Artificial Sequence: Synthetic polypeptide
DEEEIRTTNPVATEQYGCVSTALQNGSNVS

SEQ ID NO: 21803 - protein, 28 aa, Artificial Sequence
  Description of Artificial Sequence: Synthetic peptide
SEEEIRCTNPIATECYGSVSCNEQRGNR

SEQ ID NO: 21804 - protein, 28 aa, Artificial Sequence
  Description of Artificial Sequence: Synthetic peptide
SEEEIRCTNPIATECYGSVSENEQRGNR

SEQ ID NO: 21805 - protein, 31 aa, Artificial Sequence
  Description of Artificial Sequence: Synthetic polypeptide
HEEEIRTTNPVATEQYGSVSTGLQRNGNFQE

SEQ ID NO: 21806 - protein, 29 aa, Artificial Sequence
  Description of Artificial Sequence: Synthetic peptide
DEEEIRTTNPVATEQYGSVSTLDVQEGEF

SEQ ID NO: 21807 - protein, 31 aa, Artificial Sequence
  Description of Artificial Sequence: Synthetic polypeptide
AEEEIRTTNPVATEQYGSVSTVNGLQNGGNN

SEQ ID NO: 21808 - protein, 31 aa, Artificial Sequence
  Description of Artificial Sequence: Synthetic polypeptide
DEEEIRTTNPVATEQYGSVSTNLQGEFNNNP

SEQ ID NO: 21809 - protein, 31 aa, Artificial Sequence
  Description of Artificial Sequence: Synthetic polypeptide
DEEEIRTTNPVATEQYGSVSTNLQGEIGQGD

SEQ ID NO: 21810 - protein, 31 aa, Artificial Sequence
  Description of Artificial Sequence: Synthetic polypeptide
HEEEIRTTNPVATEQYGSVSTNLQREDANEH

SEQ ID NO: 21811 - protein, 32 aa, Artificial Sequence
  Description of Artificial Sequence: Synthetic polypeptide
DEEEIRTTNPVATEQYGSVSTLDLQNRNGDQR

SEQ ID NO: 21812 - protein, 31 aa, Artificial Sequence
  Description of Artificial Sequence: Synthetic polypeptide
DEEEIRTTNPVATEQYGSVSTLLENDGDNLR

SEQ ID NO: 21813 - protein, 30 aa, Artificial Sequence
  Description of Artificial Sequence: Synthetic polypeptide
AEEEIRTTNPVATESYGSVSTTNLNRGDER

SEQ ID NO: 21814 - protein, 28 aa, Artificial Sequence
  Description of Artificial Sequence: Synthetic peptide
SEEEIRCTNPIAHEQYGSVSENLMRGNR

SEQ ID NO: 21815 - protein, 28 aa, Artificial Sequence
  Description of Artificial Sequence: Synthetic peptide
SEEEIRCTNPIAHEQYGSVSGNLMRGNR

SEQ ID NO: 21816 - protein, 31 aa, Artificial Sequence
  Description of Artificial Sequence: Synthetic polypeptide
DEEEIRTTNPVATEQYGSVSTNLQFSNSNFE

SEQ ID NO: 21817 - protein, 31 aa, Artificial Sequence
  Description of Artificial Sequence: Synthetic polypeptide
AEEEIRTTNPVATEQYGSVSTVNLGQIGGNT

SEQ ID NO: 21818 - protein, 32 aa, Artificial Sequence
  Description of Artificial Sequence: Synthetic polypeptide
DEEEIRTTNPVATEQYGSVSTNLQFTGGNNED

SEQ ID NO: 21819 - protein, 30 aa, Artificial Sequence
  Description of Artificial Sequence: Synthetic polypeptide
DEECIRTTNPVATEQWGSVATNNLQNGMNR

SEQ ID NO: 21820 - protein, 29 aa, Artificial Sequence
  Description of Artificial Sequence: Synthetic peptide
AEEEIRTTNPVATESYGSVSTNDEQGGNG

SEQ ID NO: 21821 - protein, 29 aa, Artificial Sequence
  Description of Artificial Sequence: Synthetic peptide
AEEEIRTTNPVATESYGSVSTNLLMGNEH

SEQ ID NO: 21822 - protein, 30 aa, Artificial Sequence
  Description of Artificial Sequence: Synthetic polypeptide
AEEEIRTTNPVATESYGSVSTNLQGTGNND

SEQ ID NO: 21823 - protein, 28 aa, Artificial Sequence
  Description of Artificial Sequence: Synthetic peptide
SEEEIRCTNPIAMEQYGSVSENLMRGNR

SEQ ID NO: 21824 - protein, 29 aa, Artificial Sequence
  Description of Artificial Sequence: Synthetic peptide
DEEEIRTTNPVATEQYGSVSTLLERNQSQ

SEQ ID NO: 21825 - protein, 29 aa, Artificial Sequence
  Description of Artificial Sequence: Synthetic peptide
AEEEIRTTNPVATESYGSVSTNLQNINEG

SEQ ID NO: 21826 - protein, 30 aa, Artificial Sequence
  Description of Artificial Sequence: Synthetic polypeptide
AEEEIRTTNPVATEQYGSVSTVNLDNNGNG

SEQ ID NO: 21827 - protein, 30 aa, Artificial Sequence
  Description of Artificial Sequence: Synthetic polypeptide
AEEEIRTTNPVATESYGSVSTNLQQAGNED

SEQ ID NO: 21828 - protein, 29 aa, Artificial Sequence
  Description of Artificial Sequence: Synthetic peptide
DEEEIRTTNPVATEQYGCVSTDLQGEVNH

SEQ ID NO: 21829 - protein, 29 aa, Artificial Sequence
  Description of Artificial Sequence: Synthetic peptide
AEEEIRTTNPVATESYGSVSTNLQTNQNG

SEQ ID NO: 21830 - protein, 30 aa, Artificial Sequence
  Description of Artificial Sequence: Synthetic polypeptide
AEEEIRTTNPVATESYGSVSTNLQTTGNNG

SEQ ID NO: 21831 - protein, 30 aa, Artificial Sequence
  Description of Artificial Sequence: Synthetic polypeptide
AEEEIRTTNPVATESYGSVSTNLQVGVNGI

SEQ ID NO: 21832 - protein, 30 aa, Artificial Sequence
  Description of Artificial Sequence: Synthetic polypeptide
AEEEIRTTNPVATESYGSVSTNLQVTGGNG

SEQ ID NO: 21833 - protein, 31 aa, Artificial Sequence
  Description of Artificial Sequence: Synthetic polypeptide
DEEEIRTTNPVATEQYGSVSTNLQFTGSDQA

SEQ ID NO: 21834 - protein, 30 aa, Artificial Sequence
  Description of Artificial Sequence: Synthetic polypeptide
DEEEIRTTNPVATEQYGCVSTDLQEIGDRQ

SEQ ID NO: 21835 - protein, 30 aa, Artificial Sequence
  Description of Artificial Sequence: Synthetic polypeptide
HEEEIRTTNPVATEQYGSVSTNLQRNSDFQ

SEQ ID NO: 21836 - protein, 29 aa, Artificial Sequence
  Description of Artificial Sequence: Synthetic peptide
AEEEIRTTNPVATESYGSVSTNNQAGNQG

SEQ ID NO: 21837 - protein, 32 aa, Artificial Sequence
  Description of Artificial Sequence: Synthetic polypeptide
DEEEIRTTNPVATEQYGSVSTLLEQRGNNVEE

SEQ ID NO: 21838 - protein, 30 aa, Artificial Sequence
  Description of Artificial Sequence: Synthetic polypeptide
DEEEIRTTNPVATEQYGSVSTLLENSNQER

SEQ ID NO: 21839 - protein, 30 aa, Artificial Sequence
  Description of Artificial Sequence: Synthetic polypeptide
AEEEIRTTNPVATEQYGSVSTVNLEDNGNM

SEQ ID NO: 21840 - protein, 30 aa, Artificial Sequence
  Description of Artificial Sequence: Synthetic polypeptide
AEEEIRTTNPVATESYGSVSTNLQQGDNGN

SEQ ID NO: 21841 - protein, 31 aa, Artificial Sequence
  Description of Artificial Sequence: Synthetic polypeptide
DEEEIRTTNPVATEQYGSVSTLDLDQNGNNM

SEQ ID NO: 21842 - protein, 28 aa, Artificial Sequence
  Description of Artificial Sequence: Synthetic peptide
SEEEIRCTNPIATECYGSVSENLMRGNR

SEQ ID NO: 21843 - protein, 32 aa, Artificial Sequence
  Description of Artificial Sequence: Synthetic polypeptide
DEEEIRTTNPVATEQYGSVSTNLQGFEGNQLN

SEQ ID NO: 21844 - protein, 28 aa, Artificial Sequence
  Description of Artificial Sequence: Synthetic peptide
GEEEIRTVNPVATEWYGTVSTNLQRGQS

SEQ ID NO: 21845 - protein, 29 aa, Artificial Sequence
  Description of Artificial Sequence: Synthetic peptide
AEEEIRTTNPVATEQYGSVSTVLQEGIQM

SEQ ID NO: 21846 - protein, 30 aa, Artificial Sequence
  Description of Artificial Sequence: Synthetic polypeptide
AEEEIRTTNPVATEQYGSVSTVLQAINGNT

SEQ ID NO: 21847 - protein, 30 aa, Artificial Sequence
  Description of Artificial Sequence: Synthetic polypeptide
AEEEIRTTNPVATEQYGSVSTVLQAGGINT

SEQ ID NO: 21848 - protein, 28 aa, Artificial Sequence
  Description of Artificial Sequence: Synthetic peptide
SEEEIRCTNPIATEPYGSVSENLMRGNR

SEQ ID NO: 21849 - protein, 30 aa, Artificial Sequence
  Description of Artificial Sequence: Synthetic polypeptide
AEEEIRTTNPVATEQYGSVSTVLNQIGGNI

SEQ ID NO: 21850 - protein, 30 aa, Artificial Sequence
  Description of Artificial Sequence: Synthetic polypeptide
AEEEIRTTNPVATEQYGSVSTVLGQIGGNT

SEQ ID NO: 21851 - protein, 29 aa, Artificial Sequence
  Description of Artificial Sequence: Synthetic peptide
SEEEIRCTNPIATEPYGSVSENLQQRGNR

SEQ ID NO: 21852 - protein, 29 aa, Artificial Sequence
  Description of Artificial Sequence: Synthetic peptide
AEEEIRTTNPVATESYGVVSSVNLQRGER

SEQ ID NO: 21853 - protein, 31 aa, Artificial Sequence
  Description of Artificial Sequence: Synthetic polypeptide
DEEEIRTTNPVATEQYGSVSTILVQERGIVD

SEQ ID NO: 21854 - protein, 31 aa, Artificial Sequence
  Description of Artificial Sequence: Synthetic polypeptide
DEEEIRTTNPVATEQYGSVSTILQRVDNFQD

SEQ ID NO: 21855 - protein, 28 aa, Artificial Sequence
  Description of Artificial Sequence: Synthetic peptide
GEEEIRCTNPIATEQYGSVSENLMEGNR

SEQ ID NO: 21856 - protein, 28 aa, Artificial Sequence
  Description of Artificial Sequence: Synthetic peptide
GEEEISCTNPIATEQYGSVSENLMRGNR

SEQ ID NO: 21857 - protein, 28 aa, Artificial Sequence
  Description of Artificial Sequence: Synthetic peptide
GEEEINATNPVATEQYGAVSTNVQRGQR

SEQ ID NO: 21858 - protein, 29 aa, Artificial Sequence
  Description of Artificial Sequence: Synthetic peptide
DEEEIRCTNPVATEQYGSVSEILMRAENR

SEQ ID NO: 21859 - protein, 31 aa, Artificial Sequence
  Description of Artificial Sequence: Synthetic polypeptide
DEEEIRTTNPVATEQYGCVSTAEQRFGSNRS

SEQ ID NO: 21860 - protein, 30 aa, Artificial Sequence
  Description of Artificial Sequence: Synthetic polypeptide
AEEEIRTTNPVATETYGSVSTNALQNLGNL

SEQ ID NO: 21861 - protein, 30 aa, Artificial Sequence
  Description of Artificial Sequence: Synthetic polypeptide
DEEEIRTTNPVATEQYGSVSTILQANGDEK

SEQ ID NO: 21862 - protein, 30 aa, Artificial Sequence
  Description of Artificial Sequence: Synthetic polypeptide
DEEEIRTTNPVATEQYGSVSTILDQPNNTP

SEQ ID NO: 21863 - protein, 28 aa, Artificial Sequence
  Description of Artificial Sequence: Synthetic peptide
SEEEIRCTNPIATEQWGSVSENLMRGNR

SEQ ID NO: 21864 - protein, 29 aa, Artificial Sequence
  Description of Artificial Sequence: Synthetic peptide
DEEEIRTTNPVATEQYGSVSTIGQTGEQS

SEQ ID NO: 21865 - protein, 28 aa, Artificial Sequence
  Description of Artificial Sequence: Synthetic peptide
AEEEIRTTNPVATEVYGCYSNNLQMGNR

SEQ ID NO: 21866 - protein, 29 aa, Artificial Sequence
  Description of Artificial Sequence: Synthetic peptide
DEEEIRTTNPVATEQYGCVSSNVDRGEDR

SEQ ID NO: 21867 - protein, 31 aa, Artificial Sequence
  Description of Artificial Sequence: Synthetic polypeptide
DEEEIRTTNPVATEQYGSVSTIEDLQEGDNE

SEQ ID NO: 21868 - protein, 28 aa, Artificial Sequence
  Description of Artificial Sequence: Synthetic peptide
SEEEIRCTNPIATEQWGSVSENLQRGNG

SEQ ID NO: 21869 - protein, 29 aa, Artificial Sequence
  Description of Artificial Sequence: Synthetic peptide
SEEEIRCTNPIATEQYGASVSENLMRGNR

SEQ ID NO: 21870 - protein, 28 aa, Artificial Sequence
  Description of Artificial Sequence: Synthetic peptide
SEEEIRCTNPIATEQFGSVSENLMRGNR

SEQ ID NO: 21871 - protein, 29 aa, Artificial Sequence
  Description of Artificial Sequence: Synthetic peptide
GEEEISSTNPVASEQYGSVSTNLQERGNW

SEQ ID NO: 21872 - protein, 29 aa, Artificial Sequence
  Description of Artificial Sequence: Synthetic peptide
AEEEIRTTNPVATEQYGSVSTVLQIGGVT

SEQ ID NO: 21873 - protein, 30 aa, Artificial Sequence
  Description of Artificial Sequence: Synthetic polypeptide
AEEEIRTTNPVATEQYGSVSTVLQIIGGNV

SEQ ID NO: 21874 - protein, 32 aa, Artificial Sequence
  Description of Artificial Sequence: Synthetic polypeptide
HEEEIRTTNPVATEQYGSVNTPNLPQRGENYR

SEQ ID NO: 21875 - protein, 30 aa, Artificial Sequence
  Description of Artificial Sequence: Synthetic polypeptide
DEEEIRTTNPVATEQYGSVSITGLQRILQD

SEQ ID NO: 21876 - protein, 28 aa, Artificial Sequence
  Description of Artificial Sequence: Synthetic peptide
SEEEIRCTNPIATEEYGSVSENLMRGNR

SEQ ID NO: 21877 - protein, 28 aa, Artificial Sequence
  Description of Artificial Sequence: Synthetic peptide
SEEEIRCTNPIATEFYGSVSENLMRGNR

SEQ ID NO: 21878 - protein, 30 aa, Artificial Sequence
  Description of Artificial Sequence: Synthetic polypeptide
AEEEIRTTNPVATEQYGSVSTVNEQEGNNE

SEQ ID NO: 21879 - protein, 31 aa, Artificial Sequence
  Description of Artificial Sequence: Synthetic polypeptide
AEEEIRTTNPVATEQYGSVSTVNEEQGVGNR

SEQ ID NO: 21880 - protein, 28 aa, Artificial Sequence
  Description of Artificial Sequence: Synthetic peptide
SEEEIRCTNPIATEGYGSVSENLMRGNR

SEQ ID NO: 21881 - protein, 29 aa, Artificial Sequence
  Description of Artificial Sequence: Synthetic peptide
HEEEIRCTNPIATEQYGSVSENLMRGNRA

SEQ ID NO: 21882 - protein, 29 aa, Artificial Sequence
  Description of Artificial Sequence: Synthetic peptide
HEEEIRCTNPIATEQYGSVSENLMRGNLR

SEQ ID NO: 21883 - protein, 28 aa, Artificial Sequence
  Description of Artificial Sequence: Synthetic peptide
HEEEIRCTNPIATEQYGSVSEKLMRGNR

SEQ ID NO: 21884 - protein, 28 aa, Artificial Sequence
  Description of Artificial Sequence: Synthetic peptide
SEEEIRCTNPIATEHYGSVSENLMRGNR

SEQ ID NO: 21885 - protein, 31 aa, Artificial Sequence
  Description of Artificial Sequence: Synthetic polypeptide
DEEEIRTTNPVATEQYGSVSTNLQGGGMEYD

SEQ ID NO: 21886 - protein, 28 aa, Artificial Sequence
  Description of Artificial Sequence: Synthetic peptide
SEEEIRCTNPIATEHYGSVSGNLMRGNR

SEQ ID NO: 21887 - protein, 28 aa, Artificial Sequence
  Description of Artificial Sequence: Synthetic peptide
SEEEIRCTNPIATEIYGSVSENLMRGNR

SEQ ID NO: 21888 - protein, 28 aa, Artificial Sequence
  Description of Artificial Sequence: Synthetic peptide
DEEEIRTTNPEATEQYGSVATTLARGKE

SEQ ID NO: 21889 - protein, 28 aa, Artificial Sequence
  Description of Artificial Sequence: Synthetic peptide
SEEEIRCTNPIATEKYGSVSENLMRGNR

SEQ ID NO: 21890 - protein, 28 aa, Artificial Sequence
  Description of Artificial Sequence: Synthetic peptide
SEEEIRCTNPIATEMYGSVSENLMRGNR

SEQ ID NO: 21891 - protein, 28 aa, Artificial Sequence
  Description of Artificial Sequence: Synthetic peptide
SEEEIRCTNPIATENYGSVSENLMRGNR

SEQ ID NO: 21892 - protein, 29 aa, Artificial Sequence
  Description of Artificial Sequence: Synthetic peptide
GSEEIRTTNPVATDQYGSVSTELQVRGNE

SEQ ID NO: 21893 - protein, 30 aa, Artificial Sequence
  Description of Artificial Sequence: Synthetic polypeptide
DEEEIRTTNPVATEQYGCVSTALQEGGSER

SEQ ID NO: 21894 - protein, 32 aa, Artificial Sequence
  Description of Artificial Sequence: Synthetic polypeptide
DEEEIRTTNPVATEQYGSVSTINLQRGFAGTG

SEQ ID NO: 21895 - protein, 31 aa, Artificial Sequence
  Description of Artificial Sequence: Synthetic polypeptide
DEEEIRTTNPVATEQYGCVSTALNQRGSNLS

SEQ ID NO: 21896 - protein, 32 aa, Artificial Sequence
  Description of Artificial Sequence: Synthetic polypeptide
DEEEIRTTNPVATEQYGSVSTINLQEPGGNDT

SEQ ID NO: 21897 - protein, 31 aa, Artificial Sequence
  Description of Artificial Sequence: Synthetic polypeptide
DEEEIRCTNPVATEQYGSVSEINLPMRGENR

SEQ ID NO: 21898 - protein, 29 aa, Artificial Sequence
  Description of Artificial Sequence: Synthetic peptide
AEEEIRTTNPVATEQYGSVSTVLQQEGAT

SEQ ID NO: 21899 - protein, 29 aa, Artificial Sequence
  Description of Artificial Sequence: Synthetic peptide
GEGEIRTTNPVATEQYGCVYWNLQRGNRE

SEQ ID NO: 21900 - protein, 29 aa, Artificial Sequence
  Description of Artificial Sequence: Synthetic peptide
AEEEIRTTNPVATEQYGSVSTVLQIVTNA

SEQ ID NO: 21901 - protein, 31 aa, Artificial Sequence
  Description of Artificial Sequence: Synthetic polypeptide
FEEEIRTTNPVATEQYGSVSTNLQSGGENID

SEQ ID NO: 21902 - protein, 30 aa, Artificial Sequence
  Description of Artificial Sequence: Synthetic polypeptide
DTEEIRSTNPVATEQYGSVSTNLQQGNGQT

SEQ ID NO: 21903 - protein, 32 aa, Artificial Sequence
  Description of Artificial Sequence: Synthetic polypeptide
DEEEIRTTNPVATEQYGSVSTGNLQQGVNEGD

SEQ ID NO: 21904 - protein, 28 aa, Artificial Sequence
  Description of Artificial Sequence: Synthetic peptide
SEEEIRCTNPIATEQYGSTSENLMRGNR

SEQ ID NO: 21905 - protein, 31 aa, Artificial Sequence
  Description of Artificial Sequence: Synthetic polypeptide
DEEEIRTTNPVATEQYGSVSTNLQNTQGEIE

SEQ ID NO: 21906 - protein, 31 aa, Artificial Sequence
  Description of Artificial Sequence: Synthetic polypeptide
DEEEIRTTNPVATEQYGSVSGNLQEDGNNES

SEQ ID NO: 21907 - protein, 28 aa, Artificial Sequence
  Description of Artificial Sequence: Synthetic peptide
DEEEIRTTNPEATRQYGCVFTDLQRGNF

SEQ ID NO: 21908 - protein, 28 aa, Artificial Sequence
  Description of Artificial Sequence: Synthetic peptide
SEEEIRCTNPIATEQYGSVSEELMRGNR

SEQ ID NO: 21909 - protein, 29 aa, Artificial Sequence
  Description of Artificial Sequence: Synthetic peptide
DEEEIRTTNPVATEQYGSCITINLQVDNQ

SEQ ID NO: 21910 - protein, 28 aa, Artificial Sequence
  Description of Artificial Sequence: Synthetic peptide
FEEEIRCTNPIATEQYGSVSENLMRGVR

SEQ ID NO: 21911 - protein, 29 aa, Artificial Sequence
  Description of Artificial Sequence: Synthetic peptide
SEEEIRCTNPIATEQYGSVSEENLMRGNR

SEQ ID NO: 21912 - protein, 28 aa, Artificial Sequence
  Description of Artificial Sequence: Synthetic peptide
FEEEIRCTNPIATEQYGSVSENLMRGNQ

SEQ ID NO: 21913 - protein, 28 aa, Artificial Sequence
  Description of Artificial Sequence: Synthetic peptide
FEEEIRCTNPIATEQYGSVSENGERGNR

SEQ ID NO: 21914 - protein, 29 aa, Artificial Sequence
  Description of Artificial Sequence: Synthetic peptide
FEEEIRCTNPIATEQYGSVSEINLMRGNR

SEQ ID NO: 21915 - protein, 29 aa, Artificial Sequence
  Description of Artificial Sequence: Synthetic peptide
FEEEIMTTNPVATEQYGNVSVTSLQQGNR

SEQ ID NO: 21916 - protein, 31 aa, Artificial Sequence
  Description of Artificial Sequence: Synthetic polypeptide
DEEEIRTTNPVATEQYGSVSTGLQSGNNEDF

SEQ ID NO: 21917 - protein, 28 aa, Artificial Sequence
  Description of Artificial Sequence: Synthetic peptide
DEEEIRTTNPVATEQYGSCITDPQRGEQ

SEQ ID NO: 21918 - protein, 28 aa, Artificial Sequence
  Description of Artificial Sequence: Synthetic peptide
DEEEIRTTNPVATEQYGSCITNLMRVDE

SEQ ID NO: 21919 - protein, 28 aa, Artificial Sequence
  Description of Artificial Sequence: Synthetic peptide
DEEEIRTTNPVATEQYGSCITNPDRGEN

SEQ ID NO: 21920 - protein, 28 aa, Artificial Sequence
  Description of Artificial Sequence: Synthetic peptide
SEEEIRCTNPIATEQYGSVSEFLMRGNR

SEQ ID NO: 21921 - protein, 30 aa, Artificial Sequence
  Description of Artificial Sequence: Synthetic polypeptide
DECEICTTNPMATEQYGSVPTNLQDRGNGR

SEQ ID NO: 21922 - protein, 29 aa, Artificial Sequence
  Description of Artificial Sequence: Synthetic peptide
SEEEIRCTNPIATEQYGSVSEFNLMRGNR

SEQ ID NO: 21923 - protein, 31 aa, Artificial Sequence
  Description of Artificial Sequence: Synthetic polypeptide
DEEEIRTTNPVATEQYGSVSTNLQPGGMEQD

SEQ ID NO: 21924 - protein, 28 aa, Artificial Sequence
  Description of Artificial Sequence: Synthetic peptide
SEEEIRCTNPIATEQYGSVSEGLMRGNR

SEQ ID NO: 21925 - protein, 31 aa, Artificial Sequence
  Description of Artificial Sequence: Synthetic polypeptide
DEEEIRTTNPVATEQYGSVSTGLQRVDDFRG

SEQ ID NO: 21926 - protein, 28 aa, Artificial Sequence
  Description of Artificial Sequence: Synthetic peptide
EQEEIRTTNPVATEQWGTVSTNLQEGNE

SEQ ID NO: 21927 - protein, 29 aa, Artificial Sequence
  Description of Artificial Sequence: Synthetic peptide
SEEEIRCTNPIATEQYGSVSEGNLMRGNR

SEQ ID NO: 21928 - protein, 28 aa, Artificial Sequence
  Description of Artificial Sequence: Synthetic peptide
SEEEIRCTNPIATEQYGSVSEHLMRGNR

SEQ ID NO: 21929 - protein, 32 aa, Artificial Sequence
  Description of Artificial Sequence: Synthetic polypeptide
DEEEIRTTNPVATEQYGSVSTNLQPGVHIERV

SEQ ID NO: 21930 - protein, 30 aa, Artificial Sequence
  Description of Artificial Sequence: Synthetic polypeptide
ENEEIRTTNPVATEQYGVVSTNLQDNGNNR

SEQ ID NO: 21931 - protein, 28 aa, Artificial Sequence
  Description of Artificial Sequence: Synthetic peptide
FEDEIRTTNPVATEQYGETSTNLQRGGS

SEQ ID NO: 21932 - protein, 32 aa, Artificial Sequence
  Description of Artificial Sequence: Synthetic polypeptide
DEEEIRTTNPVATEQYGSCNSTNALQEPGNQR

SEQ ID NO: 21933 - protein, 29 aa, Artificial Sequence
  Description of Artificial Sequence: Synthetic peptide
DEEEIRCTNPVATEQWGSVSENLMNRGNA

SEQ ID NO: 21934 - protein, 28 aa, Artificial Sequence
  Description of Artificial Sequence: Synthetic peptide
SEEEIRCTNPIATEQYGSVSEDLMRGNR

SEQ ID NO: 21935 - protein, 30 aa, Artificial Sequence
  Description of Artificial Sequence: Synthetic polypeptide
DEEEIRTTNPVATEQYGSCATNLQDGMNED

SEQ ID NO: 21936 - protein, 29 aa, Artificial Sequence
  Description of Artificial Sequence: Synthetic peptide
DEECIRTTNPVATEIYGQVTTNLQRGSNQ

SEQ ID NO: 21937 - protein, 28 aa, Artificial Sequence
  Description of Artificial Sequence: Synthetic peptide
FEEEIRTTNPVATEQYGSVATAMQNGFR

SEQ ID NO: 21938 - protein, 28 aa, Artificial Sequence
  Description of Artificial Sequence: Synthetic peptide
FEEEIRTTNPVATEQYGSVATALQNGFQ

SEQ ID NO: 21939 - protein, 29 aa, Artificial Sequence
  Description of Artificial Sequence: Synthetic peptide
DEECIRTTNPVATEIYGQVTTNLQDGNDR

SEQ ID NO: 21940 - protein, 29 aa, Artificial Sequence
  Description of Artificial Sequence: Synthetic peptide
FEEEIRTTNPVATEQYGSVATALQGMGFR

SEQ ID NO: 21941 - protein, 29 aa, Artificial Sequence
  Description of Artificial Sequence: Synthetic peptide
SEEEIRCTNPIATEQYGSVSDENLMRGNR

SEQ ID NO: 21942 - protein, 29 aa, Artificial Sequence
  Description of Artificial Sequence: Synthetic peptide
DEECIRTTNPVATEIYGQVTTNLPRGSNR

SEQ ID NO: 21943 - protein, 28 aa, Artificial Sequence
  Description of Artificial Sequence: Synthetic peptide
SEEEIRCTNPIATEQYGSVSDNLARGNQ

SEQ ID NO: 21944 - protein, 29 aa, Artificial Sequence
  Description of Artificial Sequence: Synthetic peptide
SEEEIRCTNPIATEQYGSVSDNLMRGENR

SEQ ID NO: 21945 - protein, 28 aa, Artificial Sequence
  Description of Artificial Sequence: Synthetic peptide
SEEEIRCTNPIATEQYGSVSDNLMRGIR

SEQ ID NO: 21946 - protein, 29 aa, Artificial Sequence
  Description of Artificial Sequence: Synthetic peptide
SEEEIRCTNPIATEQYGSVSDNLMRGNAR

SEQ ID NO: 21947 - protein, 29 aa, Artificial Sequence
  Description of Artificial Sequence: Synthetic peptide
SEEEIRCTNPIATEQYGSVSEDNLMRGNR

SEQ ID NO: 21948 - protein, 28 aa, Artificial Sequence
  Description of Artificial Sequence: Synthetic peptide
SEEEIRCTNPIATEQYGSVSDNLMRMNR

SEQ ID NO: 21949 - protein, 28 aa, Artificial Sequence
  Description of Artificial Sequence: Synthetic peptide
SEEEIRCTNPIATEQYGSVSEALMRGNR

SEQ ID NO: 21950 - protein, 29 aa, Artificial Sequence
  Description of Artificial Sequence: Synthetic peptide
SEEEIRCTNPIATEQYGSVSEANLERGNR

SEQ ID NO: 21951 - protein, 30 aa, Artificial Sequence
  Description of Artificial Sequence: Synthetic polypeptide
DEEEIRTTNPVATEQYGSCGLPNGLQRDNR

SEQ ID NO: 21952 - protein, 29 aa, Artificial Sequence
  Description of Artificial Sequence: Synthetic peptide
SEEEIRCTNPIATEQYGSVSEANLMRGNR

SEQ ID NO: 21953 - protein, 32 aa, Artificial Sequence
  Description of Artificial Sequence: Synthetic polypeptide
DEEEIRTTNPVATEQYGSVSTGLSQRGQEDNI

SEQ ID NO: 21954 - protein, 28 aa, Artificial Sequence
  Description of Artificial Sequence: Synthetic peptide
SEEEIRCTNPIATEQYGSVSECLMRGNR

SEQ ID NO: 21955 - protein, 30 aa, Artificial Sequence
  Description of Artificial Sequence: Synthetic polypeptide
FEEEIRTTNPVATEQYGCVSTNHQRNSNRD

SEQ ID NO: 21956 - protein, 30 aa, Artificial Sequence
  Description of Artificial Sequence: Synthetic polypeptide
FEEEIRTTNPVATEQYGCVSTNHQRGSNTQ

SEQ ID NO: 21957 - protein, 29 aa, Artificial Sequence
  Description of Artificial Sequence: Synthetic peptide
SEEEIRCTNPIATEQYGSVSECNLMRGNR

SEQ ID NO: 21958 - protein, 30 aa, Artificial Sequence
  Description of Artificial Sequence: Synthetic polypeptide
FEEEIRTTNPVATEQYGAVSTNLQRIPERQ

SEQ ID NO: 21959 - protein, 28 aa, Artificial Sequence
  Description of Artificial Sequence: Synthetic peptide
DEEEIRCTNPVATEQWGSVSENLMRENA

SEQ ID NO: 21960 - protein, 30 aa, Artificial Sequence
  Description of Artificial Sequence: Synthetic polypeptide
DEEEIRTTNPVATEQYGSVSTGLQVSPNPD

SEQ ID NO: 21961 - protein, 30 aa, Artificial Sequence
  Description of Artificial Sequence: Synthetic polypeptide
FEEEIRTTNPVATEQYGNVSTNLQQGGNTA

SEQ ID NO: 21962 - protein, 31 aa, Artificial Sequence
  Description of Artificial Sequence: Synthetic polypeptide
DEEEIRTTNPVATEQYGSVSITNEQRQNMLD

SEQ ID NO: 21963 - protein, 29 aa, Artificial Sequence
  Description of Artificial Sequence: Synthetic peptide
SEEEIRCTNPIATEQYGSVSEHNLMRGNR

SEQ ID NO: 21964 - protein, 32 aa, Artificial Sequence
  Description of Artificial Sequence: Synthetic polypeptide
DEEEIRTTNPVATEQYGSVSTNLQPIEGNIIT

SEQ ID NO: 21965 - protein, 32 aa, Artificial Sequence
  Description of Artificial Sequence: Synthetic polypeptide
DEEEIRTTNPVATEQYGSVSTNLQQAFGNNQD

SEQ ID NO: 21966 - protein, 29 aa, Artificial Sequence
  Description of Artificial Sequence: Synthetic peptide
SEEEIRCTNPIATEQYGSVSENCLMRGNR

SEQ ID NO: 21967 - protein, 29 aa, Artificial Sequence
  Description of Artificial Sequence: Synthetic peptide
DEEEIRCTNPIATEQYGTVSENLVMRGNR

SEQ ID NO: 21968 - protein, 31 aa, Artificial Sequence
  Description of Artificial Sequence: Synthetic polypeptide
DEEEIRTTNPVATEQYGSVSTNLQQDFNLMQ

SEQ ID NO: 21969 - protein, 29 aa, Artificial Sequence
  Description of Artificial Sequence: Synthetic peptide
DEEEIRCTNPIATEQYGTVSENLVERGNR

SEQ ID NO: 21970 - protein, 29 aa, Artificial Sequence
  Description of Artificial Sequence: Synthetic peptide
SEEEIRCTNPIATEQYGSVSENCLPRGNR

SEQ ID NO: 21971 - protein, 32 aa, Artificial Sequence
  Description of Artificial Sequence: Synthetic polypeptide
EEEEIRTTNPVATEQYGSVYPTPNLQRMGNER

SEQ ID NO: 21972 - protein, 28 aa, Artificial Sequence
  Description of Artificial Sequence: Synthetic peptide
SEEEIRCTNPIATEQYGSVSENCMRGNR

SEQ ID NO: 21973 - protein, 30 aa, Artificial Sequence
  Description of Artificial Sequence: Synthetic polypeptide
DEEEIRTTNPVATEQYGSVSTNLQQDVLTE

SEQ ID NO: 21974 - protein, 28 aa, Artificial Sequence
  Description of Artificial Sequence: Synthetic peptide
SEEEIRCTNPIATEQYGSVSENCNRGNR

SEQ ID NO: 21975 - protein, 29 aa, Artificial Sequence
  Description of Artificial Sequence: Synthetic peptide
DEEEIRTTNPVATEQYGSCSANLQEGSEH

SEQ ID NO: 21976 - protein, 29 aa, Artificial Sequence
  Description of Artificial Sequence: Synthetic peptide
EEEEIRTTNPVATEQYGSVVTALQNGEFR

SEQ ID NO: 21977 - protein, 28 aa, Artificial Sequence
  Description of Artificial Sequence: Synthetic peptide
SEEEIRCTNPIATEQYGSVSENCGRGNR

SEQ ID NO: 21978 - protein, 29 aa, Artificial Sequence
  Description of Artificial Sequence: Synthetic peptide
DEEEIRCTNPIATEQYGSVSTNLEDHGER

SEQ ID NO: 21979 - protein, 31 aa, Artificial Sequence
  Description of Artificial Sequence: Synthetic polypeptide
DEEEIRCTNPIATEQYGSVSTEPNLNRNGNR

SEQ ID NO: 21980 - protein, 29 aa, Artificial Sequence
  Description of Artificial Sequence: Synthetic peptide
SEEEIRCTNPIATEQYGSVSENDLMRGNR

SEQ ID NO: 21981 - protein, 29 aa, Artificial Sequence
  Description of Artificial Sequence: Synthetic peptide
SEEEIRCTNPIATEQYGSVSENDLVRGNR

SEQ ID NO: 21982 - protein, 28 aa, Artificial Sequence
  Description of Artificial Sequence: Synthetic peptide
SEEEIRCTNPIATEQYGSVSENDMRGNR

SEQ ID NO: 21983 - protein, 29 aa, Artificial Sequence
  Description of Artificial Sequence: Synthetic peptide
SEEEIRCTNPIATEQYGSVSENELMRGNR

SEQ ID NO: 21984 - protein, 32 aa, Artificial Sequence
  Description of Artificial Sequence: Synthetic polypeptide
DEEEIRTTNPVATEQYGSCSCPNMLSQRDGNR

SEQ ID NO: 21985 - protein, 30 aa, Artificial Sequence
  Description of Artificial Sequence: Synthetic polypeptide
DEEEIRTTNPVATEQYGSCSCTNLDNDNDR

SEQ ID NO: 21986 - protein, 31 aa, Artificial Sequence
  Description of Artificial Sequence: Synthetic polypeptide
EEEEIRTTNPVATEQYGSVSVTNLQTGNNEI

SEQ ID NO: 21987 - protein, 28 aa, Artificial Sequence
  Description of Artificial Sequence: Synthetic peptide
SEEEIRCTNPIATEQYGSVSENEMRGNR

SEQ ID NO: 21988 - protein, 30 aa, Artificial Sequence
  Description of Artificial Sequence: Synthetic polypeptide
EEEEIRTTNPVATEQYGSVSVTELQRGLQG

SEQ ID NO: 21989 - protein, 29 aa, Artificial Sequence
  Description of Artificial Sequence: Synthetic peptide
DEEEIRTTNPVATEQYGSCSDNNNQDGDR

SEQ ID NO: 21990 - protein, 29 aa, Artificial Sequence
  Description of Artificial Sequence: Synthetic peptide
SEEEIRCTNPIATEQYGSVSENFLMRGNR

SEQ ID NO: 21991 - protein, 28 aa, Artificial Sequence
  Description of Artificial Sequence: Synthetic peptide
SEEEIRCTNPIATEQYGSVSENDIRGNR

SEQ ID NO: 21992 - protein, 30 aa, Artificial Sequence
  Description of Artificial Sequence: Synthetic polypeptide
DEEEIRTTNPVATEQYGSCNSTNLERDDIR

SEQ ID NO: 21993 - protein, 31 aa, Artificial Sequence
  Description of Artificial Sequence: Synthetic polypeptide
DEEEIRTTNPVATEQYGSVSTNLQPTGTGGQ

SEQ ID NO: 21994 - protein, 30 aa, Artificial Sequence
  Description of Artificial Sequence: Synthetic polypeptide
EEEEISTTNPVATEQYGSVSMNLPQGIGNR

SEQ ID NO: 21995 - protein, 29 aa, Artificial Sequence
  Description of Artificial Sequence: Synthetic peptide
SEEEIRCTNPIATEQYGSVSEHNLYRGNR

SEQ ID NO: 21996 - protein, 28 aa, Artificial Sequence
  Description of Artificial Sequence: Synthetic peptide
SEEEIRCTNPIATEQYGSVSEILMRGNR

SEQ ID NO: 21997 - protein, 31 aa, Artificial Sequence
  Description of Artificial Sequence: Synthetic polypeptide
DEEEIRTTNPVATEQYGCVSNTNLQRGSQAF

SEQ ID NO: 21998 - protein, 29 aa, Artificial Sequence
  Description of Artificial Sequence: Synthetic peptide
DEEEIRTTNPVATEQYGSCNSTVDQMGER

SEQ ID NO: 21999 - protein, 29 aa, Artificial Sequence
  Description of Artificial Sequence: Synthetic peptide
SEEEIRCTNPIATEQYGSVSEINLMRGNR

SEQ ID NO: 22000 - protein, 30 aa, Artificial Sequence
  Description of Artificial Sequence: Synthetic polypeptide
EETEIRTTNPVATEQYGSVSTALERMGNRD

SEQ ID NO: 22001 - protein, 32 aa, Artificial Sequence
  Description of Artificial Sequence: Synthetic polypeptide
DEEEIRTTNPVATEQYGSVSTNLQPMTGTNMN

SEQ ID NO: 22002 - protein, 30 aa, Artificial Sequence
  Description of Artificial Sequence: Synthetic polypeptide
DEEEIRTTNPVATEQYGSCNSTVDQRGVER

SEQ ID NO: 22003 - protein, 28 aa, Artificial Sequence
  Description of Artificial Sequence: Synthetic peptide
SEEEIRCTNPIATEQYGSVSEKLMRGNR

SEQ ID NO: 22004 - protein, 28 aa, Artificial Sequence
  Description of Artificial Sequence: Synthetic peptide
SEEEIRCTNPIATEQYGSVSELLMRGNR

SEQ ID NO: 22005 - protein, 31 aa, Artificial Sequence
  Description of Artificial Sequence: Synthetic polypeptide
DEEEIRTTNPVATEQYGSVSTGLQRGLTDVD

SEQ ID NO: 22006 - protein, 30 aa, Artificial Sequence
  Description of Artificial Sequence: Synthetic polypeptide
DEEEIRTTNPVATEQYGSVSTNLQPPMVVF

SEQ ID NO: 22007 - protein, 31 aa, Artificial Sequence
  Description of Artificial Sequence: Synthetic polypeptide
DEEEIRTTNPVATEQYGSVSTGLQEGGGNGT

SEQ ID NO: 22008 - protein, 29 aa, Artificial Sequence
  Description of Artificial Sequence: Synthetic peptide
SEEEIRCTNPIATEQYGSVSELNLMRGNR

SEQ ID NO: 22009 - protein, 31 aa, Artificial Sequence
  Description of Artificial Sequence: Synthetic polypeptide
DEEEIRTTNPVATEQYGSCSAGDNLQRDNER

SEQ ID NO: 22010 - protein, 31 aa, Artificial Sequence
  Description of Artificial Sequence: Synthetic polypeptide
DEEEIRTTNPVATEQYGSVSTGLQRFGSTQV

SEQ ID NO: 22011 - protein, 28 aa, Artificial Sequence
  Description of Artificial Sequence: Synthetic peptide
EEEGICTTNPVATEQYGSVSMNSQRGNV

SEQ ID NO: 22012 - protein, 31 aa, Artificial Sequence
  Description of Artificial Sequence: Synthetic polypeptide
DEEEIRTTNPVATEQYGSVSTGLQRDGVGEA

SEQ ID NO: 22013 - protein, 29 aa, Artificial Sequence
  Description of Artificial Sequence: Synthetic peptide
DEEEIRTTNPVATEQYGSVSTGLQNQLED

SEQ ID NO: 22014 - protein, 31 aa, Artificial Sequence
  Description of Artificial Sequence: Synthetic polypeptide
DEEEIRTTNPVATEQYGSCSAGNALQRDNDR

SEQ ID NO: 22015 - protein, 31 aa, Artificial Sequence
  Description of Artificial Sequence: Synthetic polypeptide
DEEEIRTTNPVATEQYGSCSAGNDDQRGNRE

SEQ ID NO: 22016 - protein, 29 aa, Artificial Sequence
  Description of Artificial Sequence: Synthetic peptide
SEEEIRCTNPIATEQYGSVSEMNLMRGNR

SEQ ID NO: 22017 - protein, 29 aa, Artificial Sequence
  Description of Artificial Sequence: Synthetic peptide
DEEEIRCTNPIATEQYGTVSMENLMRGNR

SEQ ID NO: 22018 - protein, 29 aa, Artificial Sequence
  Description of Artificial Sequence: Synthetic peptide
SEEEIRCTNPIATEQYGSVSENALMRGNR

SEQ ID NO: 22019 - protein, 31 aa, Artificial Sequence
  Description of Artificial Sequence: Synthetic polypeptide
DEEEIRTTNPVATEQYGSVSTGLQGQGNIGQ

SEQ ID NO: 22020 - protein, 28 aa, Artificial Sequence
  Description of Artificial Sequence: Synthetic peptide
SEEEIRCTNPIATEQYGSVSENAMRGNR

SEQ ID NO: 22021 - protein, 28 aa, Artificial Sequence
  Description of Artificial Sequence: Synthetic peptide
SEEEIRCTNPIATEQYGSVSEMLMRGNR

SEQ ID NO: 22022 - protein, 30 aa, Artificial Sequence
  Description of Artificial Sequence: Synthetic polypeptide
DEEEIRTTNPVATEQYGSCATNDQNQGNRD

SEQ ID NO: 22023 - protein, 29 aa, Artificial Sequence
  Description of Artificial Sequence: Synthetic peptide
DEEEIRTTNPVATEQYGSCATNDQDGNDF

SEQ ID NO: 22024 - protein, 28 aa, Artificial Sequence
  Description of Artificial Sequence: Synthetic peptide
SEEEIRCTNPIATEQYGSVSCNLMSGNR

SEQ ID NO: 22025 - protein, 32 aa, Artificial Sequence
  Description of Artificial Sequence: Synthetic polypeptide
AEEEIRTTNPVATEQYGSVSTTVNLQQESGNR

SEQ ID NO: 22026 - protein, 31 aa, Artificial Sequence
  Description of Artificial Sequence: Synthetic polypeptide
AEEEIRTTNPVATEQYGSVSTTVNLQNVGNG

SEQ ID NO: 22027 - protein, 28 aa, Artificial Sequence
  Description of Artificial Sequence: Synthetic peptide
SEEEIRCTNPIATEQYGSVGENLMRGNR

SEQ ID NO: 22028 - protein, 32 aa, Artificial Sequence
  Description of Artificial Sequence: Synthetic polypeptide
DEEEIRTTNPVATEQYGSVSTGNLNQTGENSG

SEQ ID NO: 22029 - protein, 31 aa, Artificial Sequence
  Description of Artificial Sequence: Synthetic polypeptide
DEEEIRCTNPVATEQYGCVSMTNSLFQGGNR

SEQ ID NO: 22030 - protein, 31 aa, Artificial Sequence
  Description of Artificial Sequence: Synthetic polypeptide
FEEEIRTTNPVATEQYGSVSTLNLNQEIGNG

SEQ ID NO: 22031 - protein, 29 aa, Artificial Sequence
  Description of Artificial Sequence: Synthetic peptide
SEEEIRCTNPIATEQYGSVGSENLMRGNR

SEQ ID NO: 22032 - protein, 29 aa, Artificial Sequence
  Description of Artificial Sequence: Synthetic peptide
SEEEIRCTNPIATEQYGSVGSQNLMRGNR

SEQ ID NO: 22033 - protein, 29 aa, Artificial Sequence
  Description of Artificial Sequence: Synthetic peptide
SEEEIRCTNPIATEQYGSVGSSNLMRGNR

SEQ ID NO: 22034 - protein, 28 aa, Artificial Sequence
  Description of Artificial Sequence: Synthetic peptide
SEEEIRCTNPIATEQYGSVHENLDRGNR

SEQ ID NO: 22035 - protein, 31 aa, Artificial Sequence
  Description of Artificial Sequence: Synthetic polypeptide
FEEEIRTTNPVATEQYGSVSTGNLQNGNEFE

SEQ ID NO: 22036 - protein, 28 aa, Artificial Sequence
  Description of Artificial Sequence: Synthetic peptide
SEEEIRCTNPIATEQYGSVHENLMRGNR

SEQ ID NO: 22037 - protein, 32 aa, Artificial Sequence
  Description of Artificial Sequence: Synthetic polypeptide
DEEEIRTTNPVATEQYGSVSTGNLQEIGNEDQ

SEQ ID NO: 22038 - protein, 31 aa, Artificial Sequence
  Description of Artificial Sequence: Synthetic polypeptide
DEEEIRTTNPVATEQYGSVSTGNLNQGQNGN

SEQ ID NO: 22039 - protein, 29 aa, Artificial Sequence
  Description of Artificial Sequence: Synthetic peptide
SEEEIRCTNPIATEQYGSVHSENLMRGNR

SEQ ID NO: 22040 - protein, 28 aa, Artificial Sequence
  Description of Artificial Sequence: Synthetic peptide
SEEEIRCTNPIATEQYGSVIENLMRGNR

SEQ ID NO: 22041 - protein, 32 aa, Artificial Sequence
  Description of Artificial Sequence: Synthetic polypeptide
DEEEIRTTNPVATEQYGSVSTGNLNQGQEGNQ

SEQ ID NO: 22042 - protein, 31 aa, Artificial Sequence
  Description of Artificial Sequence: Synthetic polypeptide
DEEEIRTTNPVATEQYGSVSTGNLNNFGGNV

SEQ ID NO: 22043 - protein, 29 aa, Artificial Sequence
  Description of Artificial Sequence: Synthetic peptide
SEEEIRCTNPIATEQYGSVISENLMRGNR

SEQ ID NO: 22044 - protein, 31 aa, Artificial Sequence
  Description of Artificial Sequence: Synthetic polypeptide
FEEEIRTTNPVATEQYGSVSTDNLEQGGNEF

SEQ ID NO: 22045 - protein, 32 aa, Artificial Sequence
  Description of Artificial Sequence: Synthetic polypeptide
DEEEIRTTNPVATEQYGSVSTNLQMNGGENIP

SEQ ID NO: 22046 - protein, 31 aa, Artificial Sequence
  Description of Artificial Sequence: Synthetic polypeptide
DEEEIRTTNPVATEQYGSVSTGNLIDGGNTQ

SEQ ID NO: 22047 - protein, 29 aa, Artificial Sequence
  Description of Artificial Sequence: Synthetic peptide
SEEEIRCTNPIATEQYGSVLSENLMRGNR

SEQ ID NO: 22048 - protein, 28 aa, Artificial Sequence
  Description of Artificial Sequence: Synthetic peptide
DEEEIRTTNPEATLQYGQVPTDLQRGNH

SEQ ID NO: 22049 - protein, 28 aa, Artificial Sequence
  Description of Artificial Sequence: Synthetic peptide
SEEEIRCTNPIATEQYGSVMENLMRGNR

SEQ ID NO: 22050 - protein, 32 aa, Artificial Sequence
  Description of Artificial Sequence: Synthetic polypeptide
DEEEIRTTNPVATEQYGSVSTGNLGRFGSNAP

SEQ ID NO: 22051 - protein, 31 aa, Artificial Sequence
  Description of Artificial Sequence: Synthetic polypeptide
DEEEIRTTNPVATEQYGSASTNLQQRGPDSN

SEQ ID NO: 22052 - protein, 29 aa, Artificial Sequence
  Description of Artificial Sequence: Synthetic peptide
SEEEIRCTNPIATEQYGSVMSENLMRGNR

SEQ ID NO: 22053 - protein, 29 aa, Artificial Sequence
  Description of Artificial Sequence: Synthetic peptide
DEEEIRCTNPVATEQYGDVSENEMNRGNR

SEQ ID NO: 22054 - protein, 29 aa, Artificial Sequence
  Description of Artificial Sequence: Synthetic peptide
SEEEIRCTNPIATEQYGSVFSENLMRGNR

SEQ ID NO: 22055 - protein, 32 aa, Artificial Sequence
  Description of Artificial Sequence: Synthetic polypeptide
DEEEIRTTNPVATEQYGSVSTGNLQQGTGNGP

SEQ ID NO: 22056 - protein, 29 aa, Artificial Sequence
  Description of Artificial Sequence: Synthetic peptide
SEEEIRCTNPIATEQYGSTVSENLMRGNR

SEQ ID NO: 22057 - protein, 32 aa, Artificial Sequence
  Description of Artificial Sequence: Synthetic polypeptide
DEEEIRTTNPVATEQYGSVSTGNLQQEGINTM

SEQ ID NO: 22058 - protein, 31 aa, Artificial Sequence
  Description of Artificial Sequence: Synthetic polypeptide
FEEEIRTTNPVATEQYGSVSTNLQQGNGNEG

SEQ ID NO: 22059 - protein, 31 aa, Artificial Sequence
  Description of Artificial Sequence: Synthetic polypeptide
FEEEIRTTNPVATEQYGSVSTNLQQGGGNQG

SEQ ID NO: 22060 - protein, 28 aa, Artificial Sequence
  Description of Artificial Sequence: Synthetic peptide
SEEEIRCTNPIATEQYGSVAENLMRGNR

SEQ ID NO: 22061 - protein, 31 aa, Artificial Sequence
  Description of Artificial Sequence: Synthetic polypeptide
FEEEIRTTNPVATEQYGSVSTNLQMVGNEQQ

SEQ ID NO: 22062 - protein, 31 aa, Artificial Sequence
  Description of Artificial Sequence: Synthetic polypeptide
DEEEIRTTNPVATEQYGSVSTGNLQNFNNLN

SEQ ID NO: 22063 - protein, 30 aa, Artificial Sequence
  Description of Artificial Sequence: Synthetic polypeptide
FEEEIRTTNPVATEQYGSVSTNLQENANFY

SEQ ID NO: 22064 - protein, 29 aa, Artificial Sequence
  Description of Artificial Sequence: Synthetic peptide
SEEEIRCTNPIATEQYGSVASENLHRGNR

SEQ ID NO: 22065 - protein, 29 aa, Artificial Sequence
  Description of Artificial Sequence: Synthetic peptide
SEEEIRCTNPIATEQYGSVASENLMRGNR

SEQ ID NO: 22066 - protein, 31 aa, Artificial Sequence
  Description of Artificial Sequence: Synthetic polypeptide
FEEEIRTTNPVATEQYGSVSTNLDQVGNVNE

SEQ ID NO: 22067 - protein, 32 aa, Artificial Sequence
  Description of Artificial Sequence: Synthetic polypeptide
DEEEIRTTNPVATEQYGSVSTNLQMEMGTNVE

SEQ ID NO: 22068 - protein, 28 aa, Artificial Sequence
  Description of Artificial Sequence: Synthetic peptide
SEEEIRCTNPIATEQYGSVCENLMRGNR

SEQ ID NO: 22069 - protein, 29 aa, Artificial Sequence
  Description of Artificial Sequence: Synthetic peptide
SEEEIRCTNPIATEQYGSVCSENLPRGNR

SEQ ID NO: 22070 - protein, 29 aa, Artificial Sequence
  Description of Artificial Sequence: Synthetic peptide
SEEEIRCTNPIATEQYGSVCSENLTRGNR

SEQ ID NO: 22071 - protein, 32 aa, Artificial Sequence
  Description of Artificial Sequence: Synthetic polypeptide
DEEEIRTTNPVATEQYGSVSTNLQLNDGNENE

SEQ ID NO: 22072 - protein, 32 aa, Artificial Sequence
  Description of Artificial Sequence: Synthetic polypeptide
DEEEIRTTNPVATEQYGSVSTNLQLNIGNFTE

SEQ ID NO: 22073 - protein, 31 aa, Artificial Sequence
  Description of Artificial Sequence: Synthetic polypeptide
DEEEIRTTNPVATEQYGSVSTGNLQGEGIDM

SEQ ID NO: 22074 - protein, 30 aa, Artificial Sequence
  Description of Artificial Sequence: Synthetic polypeptide
DEEEIRCTNPVATEQYGFVSMTNLFQGGNA

SEQ ID NO: 22075 - protein, 32 aa, Artificial Sequence
  Description of Artificial Sequence: Synthetic polypeptide
DEEEIRTTNPVATEQYGSVSTGNLQGEGFNED

SEQ ID NO: 22076 - protein, 28 aa, Artificial Sequence
  Description of Artificial Sequence: Synthetic peptide
DEEEIRTTNPEATEQYGSVTTWLARGQE

SEQ ID NO: 22077 - protein, 28 aa, Artificial Sequence
  Description of Artificial Sequence: Synthetic peptide
DEEEIRTTNPEATEQYGSVVTWLGRGKE

SEQ ID NO: 22078 - protein, 29 aa, Artificial Sequence
  Description of Artificial Sequence: Synthetic peptide
DEEEIRTTNPVATEQYGSASTNDQDPEER

SEQ ID NO: 22079 - protein, 28 aa, Artificial Sequence
  Description of Artificial Sequence: Synthetic peptide
SEEEIRCTNPIATEQYGSVFENLMRGNR

SEQ ID NO: 22080 - protein, 32 aa, Artificial Sequence
  Description of Artificial Sequence: Synthetic polypeptide
DEEEIRTTNPVATEQYGSVSTNLQMDEGNNED

SEQ ID NO: 22081 - protein, 29 aa, Artificial Sequence
  Description of Artificial Sequence: Synthetic peptide
SEEEIRCTNPIATEQYGSVCSENLMRGNR

SEQ ID NO: 22082 - protein, 28 aa, Artificial Sequence
  Description of Artificial Sequence: Synthetic peptide
SEEEIRCTNPIATEQYGSVNENLMRGNR

SEQ ID NO: 22083 - protein, 32 aa, Artificial Sequence
  Description of Artificial Sequence: Synthetic polypeptide
DEEEIRTTNPVATEQYGSVSTGNLGQFEGNAE

SEQ ID NO: 22084 - protein, 29 aa, Artificial Sequence
  Description of Artificial Sequence: Synthetic peptide
SEEEIRCTNPIATEQYGSVNSENLARGNR

SEQ ID NO: 22085 - protein, 30 aa, Artificial Sequence
  Description of Artificial Sequence: Synthetic polypeptide
FEEEIRTTNPVATEQYGSVQTNGQRPGENE

SEQ ID NO: 22086 - protein, 31 aa, Artificial Sequence
  Description of Artificial Sequence: Synthetic polypeptide
DEEEIRTTNPVATEQYGSAVSTLHQRGSDER

SEQ ID NO: 22087 - protein, 29 aa, Artificial Sequence
  Description of Artificial Sequence: Synthetic peptide
SEEEIRCTNPIATEQYGSVSAENLMRGNR

SEQ ID NO: 22088 - protein, 32 aa, Artificial Sequence
  Description of Artificial Sequence: Synthetic polypeptide
FEEEIRTTNPVATEQYGSVNTQNLSQRGGNYR

SEQ ID NO: 22089 - protein, 32 aa, Artificial Sequence
  Description of Artificial Sequence: Synthetic polypeptide
FEEEIRTTNPVATEQYGSVNTNNLQQRGENYR

SEQ ID NO: 22090 - protein, 29 aa, Artificial Sequence
  Description of Artificial Sequence: Synthetic peptide
DECEICTTNPVATEQYGSVSTNLGGYGNT

SEQ ID NO: 22091 - protein, 28 aa, Artificial Sequence
  Description of Artificial Sequence: Synthetic peptide
SEEEIRCTNPIATEQYGSVSAMLMRGNR

SEQ ID NO: 22092 - protein, 28 aa, Artificial Sequence
  Description of Artificial Sequence: Synthetic peptide
SEEEIRCTNPIATEQYGSVSANLMRGER

SEQ ID NO: 22093 - protein, 30 aa, Artificial Sequence
  Description of Artificial Sequence: Synthetic polypeptide
DEEEIRTTNPVATEQYGSVSTGNGEGGNEG

SEQ ID NO: 22094 - protein, 31 aa, Artificial Sequence
  Description of Artificial Sequence: Synthetic polypeptide
DEEEIRTTNPVATEQYGSVSTNLQNFISNDY

SEQ ID NO: 22095 - protein, 28 aa, Artificial Sequence
  Description of Artificial Sequence: Synthetic peptide
SEEEIRCTNPIATEQYGSVSANLMRGNY

SEQ ID NO: 22096 - protein, 29 aa, Artificial Sequence
  Description of Artificial Sequence: Synthetic peptide
SEEEIRCTNPIATEQYGSVSANLMRIGNR

SEQ ID NO: 22097 - protein, 29 aa, Artificial Sequence
  Description of Artificial Sequence: Synthetic peptide
DECEICTTNPVATEQYGSVSTNLMSGNTD

SEQ ID NO: 22098 - protein, 32 aa, Artificial Sequence
  Description of Artificial Sequence: Synthetic polypeptide
DEEEIRTTNPVATEQYGSVSTGNGDQRGGNEM

SEQ ID NO: 22099 - protein, 30 aa, Artificial Sequence
  Description of Artificial Sequence: Synthetic polypeptide
DEEEIRTTNPVATEQYGCVSNTYDQNGNRS

SEQ ID NO: 22100 - protein, 31 aa, Artificial Sequence
  Description of Artificial Sequence: Synthetic polypeptide
DEEEIRTTNPVATEQYGCVSNTPLQRDSNRA

SEQ ID NO: 22101 - protein, 29 aa, Artificial Sequence
  Description of Artificial Sequence: Synthetic peptide
SEEEIRCTNPIATEQYGSVSCENLMRGNR

SEQ ID NO: 22102 - protein, 33 aa, Artificial Sequence
  Description of Artificial Sequence: Synthetic polypeptide
DEEEIRTTNPVATEQYGSVSITNDLQRLGSNVV

SEQ ID NO: 22103 - protein, 31 aa, Artificial Sequence
  Description of Artificial Sequence: Synthetic polypeptide
DEEEIRTTNPVATEQYGSAWSLGNDLQRDNR

SEQ ID NO: 22104 - protein, 31 aa, Artificial Sequence
  Description of Artificial Sequence: Synthetic polypeptide
DEEEIRTTNPVATEQYGSVSTNLQNIGDVFD

SEQ ID NO: 22105 - protein, 32 aa, Artificial Sequence
  Description of Artificial Sequence: Synthetic polypeptide
DEEEIRTTNPVATEQYGSVSTGNALSQEGGNG

SEQ ID NO: 22106 - protein, 31 aa, Artificial Sequence
  Description of Artificial Sequence: Synthetic polypeptide
FEEEIRTTNPVATEQYGSVGSTNLQRNVNQA

SEQ ID NO: 22107 - protein, 28 aa, Artificial Sequence
  Description of Artificial Sequence: Synthetic peptide
SEEEIRCTNPIATEQYGSVSCNEMRGNR

SEQ ID NO: 22108 - protein, 31 aa, Artificial Sequence
  Description of Artificial Sequence: Synthetic polypeptide
FEEEIRTTNPVATEQYGSVGSTNLQNNGENT

SEQ ID NO: 22109 - protein, 28 aa, Artificial Sequence
  Description of Artificial Sequence: Synthetic peptide
SEEEIRCTNPIATEQYGSVSCNLMRGNG

SEQ ID NO: 22110 - protein, 29 aa, Artificial Sequence
  Description of Artificial Sequence: Synthetic peptide
SEEEIRCTNPIATEQYGSVSCNLMRPGNR

SEQ ID NO: 22111 - protein, 29 aa, Artificial Sequence
  Description of Artificial Sequence: Synthetic peptide
SEEEIRCTNPIATEQYGSVSATDLMRGNR

SEQ ID NO: 22112 - protein, 29 aa, Artificial Sequence
  Description of Artificial Sequence: Synthetic peptide
DECEICTTNPVATEQYGSVSTNLMTGNDT

SEQ ID NO: 22113 - protein, 30 aa, Artificial Sequence
  Description of Artificial Sequence: Synthetic polypeptide
FEEEIRTTNPVATEQYGSVSEYLQRGNGQN

SEQ ID NO: 22114 - protein, 32 aa, Artificial Sequence
  Description of Artificial Sequence: Synthetic polypeptide
DEEEIRTTNPVATEQYGSAVSMTNLQRFQSND

SEQ ID NO: 22115 - protein, 29 aa, Artificial Sequence
  Description of Artificial Sequence: Synthetic peptide
SEEEIRCTNPIATEQYGSVNSENLKRGNR

SEQ ID NO: 22116 - protein, 29 aa, Artificial Sequence
  Description of Artificial Sequence: Synthetic peptide
SEEEIRCTNPIATEQYGSVNSENLMRGNR

SEQ ID NO: 22117 - protein, 32 aa, Artificial Sequence
  Description of Artificial Sequence: Synthetic polypeptide
DEEEIRTTNPVATEQYGSAVCGTNLQRFMSNR

SEQ ID NO: 22118 - protein, 29 aa, Artificial Sequence
  Description of Artificial Sequence: Synthetic peptide
DEECIRTTNPVATEQFGTSVSTYLLRGNF

SEQ ID NO: 22119 - protein, 32 aa, Artificial Sequence
  Description of Artificial Sequence: Synthetic polypeptide
DEEEIRTTNPVATEQYGSVSTGNLDQEVGNNQ

SEQ ID NO: 22120 - protein, 29 aa, Artificial Sequence
  Description of Artificial Sequence: Synthetic peptide
DECEICTTNPVATEQYGSVSTQNLMNGNT

SEQ ID NO: 22121 - protein, 28 aa, Artificial Sequence
  Description of Artificial Sequence: Synthetic peptide
SEEEIRCTNPIATEQYGSVPENLMRGNR

SEQ ID NO: 22122 - protein, 31 aa, Artificial Sequence
  Description of Artificial Sequence: Synthetic polypeptide
FEEEIRTTNPVATEQYGSVSPTNNEQLGNRI

SEQ ID NO: 22123 - protein, 31 aa, Artificial Sequence
  Description of Artificial Sequence: Synthetic polypeptide
FEEEIRTTNPVATEQYGSVSPTNLQQGNQVE

SEQ ID NO: 22124 - protein, 31 aa, Artificial Sequence
  Description of Artificial Sequence: Synthetic polypeptide
FEEEIRTTNPVATEQYGSVSPTNLQERENSN

SEQ ID NO: 22125 - protein, 32 aa, Artificial Sequence
  Description of Artificial Sequence: Synthetic polypeptide
DEEEIRTTNPVATEQYGSAVCSTNHQNGGNRA

SEQ ID NO: 22126 - protein, 29 aa, Artificial Sequence
  Description of Artificial Sequence: Synthetic peptide
SEEEIRCTNPIATEQYGSVPSENLMRGNR

SEQ ID NO: 22127 - protein, 31 aa, Artificial Sequence
  Description of Artificial Sequence: Synthetic polypeptide
DEEEIRTTNPVATEQYGSVSTGNHQRGGEQD

SEQ ID NO: 22128 - protein, 31 aa, Artificial Sequence
  Description of Artificial Sequence: Synthetic polypeptide
FEEEIRTTNPVATEQYGSVSPANLQRGETER

SEQ ID NO: 22129 - protein, 31 aa, Artificial Sequence
  Description of Artificial Sequence: Synthetic polypeptide
DEEEIRTTNPVATEQYGSAVCSTNLQNTSER

SEQ ID NO: 22130 - protein, 30 aa, Artificial Sequence
  Description of Artificial Sequence: Synthetic polypeptide
DEEEIRCTNPVATEQYGCVCSTNLQYGNQE

SEQ ID NO: 22131 - protein, 32 aa, Artificial Sequence
  Description of Artificial Sequence: Synthetic polypeptide
DEEEIRTTNPVATEQYGSAVGTENLQNFGSNR

SEQ ID NO: 22132 - protein, 28 aa, Artificial Sequence
  Description of Artificial Sequence: Synthetic peptide
SEEEIRCTNPIATEQYGSVQENLMRGNR

SEQ ID NO: 22133 - protein, 31 aa, Artificial Sequence
  Description of Artificial Sequence: Synthetic polypeptide
DEEEIRTTNPVATEQYGSVSTGNHQFPSNRF

SEQ ID NO: 22134 - protein, 32 aa, Artificial Sequence
  Description of Artificial Sequence: Synthetic polypeptide
DEEEIRTTNPVATEQYGSAVPTNLQRNEENRD

SEQ ID NO: 22135 - protein, 31 aa, Artificial Sequence
  Description of Artificial Sequence: Synthetic polypeptide
FEEEIRTTNPVATEQYGSVSITNLQRNANFD

SEQ ID NO: 22136 - protein, 31 aa, Artificial Sequence
  Description of Artificial Sequence: Synthetic polypeptide
DEEEIRTTNPVATEQYGSVSGNLQGADGTRF

SEQ ID NO: 22137 - protein, 29 aa, Artificial Sequence
  Description of Artificial Sequence: Synthetic peptide
SEEEIRCTNPIATEQYGSVQSENLMRGNR

SEQ ID NO: 22138 - protein, 31 aa, Artificial Sequence
  Description of Artificial Sequence: Synthetic polypeptide
DEEEIRTTNPVATEQYGSVSTGNGQNGGNIF

SEQ ID NO: 22139 - protein, 29 aa, Artificial Sequence
  Description of Artificial Sequence: Synthetic peptide
DEEEIRTTNPVATEQYGCVSPSPDQRGDR

SEQ ID NO: 22140 - protein, 29 aa, Artificial Sequence
  Description of Artificial Sequence: Synthetic peptide
SEEEIRCTNPIATEQYGSVQSENLTRGNR

SEQ ID NO: 22141 - protein, 31 aa, Artificial Sequence
  Description of Artificial Sequence: Synthetic polypeptide
DEEEIRTTNPVATEQYGSVSTGNGNQGEGNG

SEQ ID NO: 22142 - protein, 32 aa, Artificial Sequence
  Description of Artificial Sequence: Synthetic polypeptide
DEEEIRTTNPVATEQYGSVSTGNLQQGVDGNN

SEQ ID NO: 22143 - protein, 30 aa, Artificial Sequence
  Description of Artificial Sequence: Synthetic polypeptide
DEEEIRCTNPVATEQYGSVSSTALMMRGNV

SEQ ID NO: 22144 - protein, 30 aa, Artificial Sequence
  Description of Artificial Sequence: Synthetic polypeptide
DTEEIRSTNPVATEQYGSVSTNLQPREGQG

SEQ ID NO: 22145 - protein, 29 aa, Artificial Sequence
  Description of Artificial Sequence: Synthetic peptide
SEEEIRCTNPIATEQYGSVSENMLMRGNR

SEQ ID NO: 22146 - protein, 30 aa, Artificial Sequence
  Description of Artificial Sequence: Synthetic polypeptide
SEEEIRCTNPVATEQYGSVSTPNLMMRGNV

SEQ ID NO: 22147 - protein, 30 aa, Artificial Sequence
  Description of Artificial Sequence: Synthetic polypeptide
DEEEIRATNPVATEQYGMVSMTNLFQGQNR

SEQ ID NO: 22148 - protein, 32 aa, Artificial Sequence
  Description of Artificial Sequence: Synthetic polypeptide
SEEEIRCTNPVATEQYGSVSTSNLEQRGENDR

SEQ ID NO: 22149 - protein, 31 aa, Artificial Sequence
  Description of Artificial Sequence: Synthetic polypeptide
DEEEIRTTNPVATEQYGSVSTDPQGGAGNRR

SEQ ID NO: 22150 - protein, 29 aa, Artificial Sequence
  Description of Artificial Sequence: Synthetic peptide
DMEEIRTTNPVATEQWGSVTSTELQRGTQ

SEQ ID NO: 22151 - protein, 29 aa, Artificial Sequence
  Description of Artificial Sequence: Synthetic peptide
DEEEIRTTNPIATEQYGSVSSEALNRGNV

SEQ ID NO: 22152 - protein, 29 aa, Artificial Sequence
  Description of Artificial Sequence: Synthetic peptide
DMEEIRTTNPVATEQWGCVTSTLLQRGDR

SEQ ID NO: 22153 - protein, 31 aa, Artificial Sequence
  Description of Artificial Sequence: Synthetic polypeptide
DEEEIRTTNPVATEQYGSFVSTNLDGDRGEN

SEQ ID NO: 22154 - protein, 30 aa, Artificial Sequence
  Description of Artificial Sequence: Synthetic polypeptide
DMEEIRSTNPVATEQYGSVSWNLQTRNGQR

SEQ ID NO: 22155 - protein, 31 aa, Artificial Sequence
  Description of Artificial Sequence: Synthetic polypeptide
DEEEIRTTNPVATEQYGSFVSTNLQEGDLMS

SEQ ID NO: 22156 - protein, 29 aa, Artificial Sequence
  Description of Artificial Sequence: Synthetic peptide
SEEEIRCTNPVATESYGSVATNLQEGNRE

SEQ ID NO: 22157 - protein, 30 aa, Artificial Sequence
  Description of Artificial Sequence: Synthetic polypeptide
DMEEIRSTNPVATEQYGSVSTNLETRFGQR

SEQ ID NO: 22158 - protein, 31 aa, Artificial Sequence
  Description of Artificial Sequence: Synthetic polypeptide
DEEEIRTTNPVATEQYGSVSITSLLQAGDNQ

SEQ ID NO: 22159 - protein, 31 aa, Artificial Sequence
  Description of Artificial Sequence: Synthetic polypeptide
DEEEIRTTNPVATEQYGSVSTDPLQQMGQNE

SEQ ID NO: 22160 - protein, 28 aa, Artificial Sequence
  Description of Artificial Sequence: Synthetic peptide
SEEEIRCTNPVCTEQYGVVSENLMRGNR

SEQ ID NO: 22161 - protein, 28 aa, Artificial Sequence
  Description of Artificial Sequence: Synthetic peptide
DEECIRTTNPCATEQYGCVSTNGQFGNE

SEQ ID NO: 22162 - protein, 28 aa, Artificial Sequence
  Description of Artificial Sequence: Synthetic peptide
SEEEIRCTNPVGTEQYGVVASNLQRGNR

SEQ ID NO: 22163 - protein, 29 aa, Artificial Sequence
  Description of Artificial Sequence: Synthetic peptide
DMEEIRSTNPVATEQYGSSSWTNMQRGNE

SEQ ID NO: 22164 - protein, 31 aa, Artificial Sequence
  Description of Artificial Sequence: Synthetic polypeptide
DEEEIRTTNPVATEQYGCVDSTEDHQRGSNR

SEQ ID NO: 22165 - protein, 28 aa, Artificial Sequence
  Description of Artificial Sequence: Synthetic peptide
DMEEIRSTNPVATEQYGSSSTNVQRGSN

SEQ ID NO: 22166 - protein, 30 aa, Artificial Sequence
  Description of Artificial Sequence: Synthetic polypeptide
DEEEIRATNPVATEQYGFVSSTNLFQGGNL

SEQ ID NO: 22167 - protein, 31 aa, Artificial Sequence
  Description of Artificial Sequence: Synthetic polypeptide
DEEEIRTTNPVATEQYGSVSTDNVIQGGGND

SEQ ID NO: 22168 - protein, 28 aa, Artificial Sequence
  Description of Artificial Sequence: Synthetic peptide
DMEEIRSTNPVATEQYGSSSTNHQYGNF

SEQ ID NO: 22169 - protein, 28 aa, Artificial Sequence
  Description of Artificial Sequence: Synthetic peptide
DMEEIRSTNPVATEQYGSSSTNHQDGNN

SEQ ID NO: 22170 - protein, 31 aa, Artificial Sequence
  Description of Artificial Sequence: Synthetic polypeptide
AEEEIRTTNPVATEQYGSVSTTNNLQSGNNE

SEQ ID NO: 22171 - protein, 29 aa, Artificial Sequence
  Description of Artificial Sequence: Synthetic peptide
DMEEIRSTNPVATEQYGSCSTNNMQRGNN

SEQ ID NO: 22172 - protein, 30 aa, Artificial Sequence
  Description of Artificial Sequence: Synthetic polypeptide
DEEEIRATNPVATEQYGFVSYTNDHQGGNR

SEQ ID NO: 22173 - protein, 29 aa, Artificial Sequence
  Description of Artificial Sequence: Synthetic peptide
DMEEIRSTNPVATEQYGSCSTNDQREGNN

SEQ ID NO: 22174 - protein, 30 aa, Artificial Sequence
  Description of Artificial Sequence: Synthetic polypeptide
SEEEIRCTNPVATEQYGSVSTNLQERTNED

SEQ ID NO: 22175 - protein, 29 aa, Artificial Sequence
  Description of Artificial Sequence: Synthetic peptide
SEEEIRCTNPVATEQYGSVSTDLEREGNL

SEQ ID NO: 22176 - protein, 31 aa, Artificial Sequence
  Description of Artificial Sequence: Synthetic polypeptide
DEEEIRATNPVATEQYGNVSPTNLFQVGNRN

SEQ ID NO: 22177 - protein, 29 aa, Artificial Sequence
  Description of Artificial Sequence: Synthetic peptide
SEEEIRCTNPVATEQYGSVSENIMRVGNR

SEQ ID NO: 22178 - protein, 29 aa, Artificial Sequence
  Description of Artificial Sequence: Synthetic peptide
DNEEISTTNPVATDQYGSVSTNPVRGENR

SEQ ID NO: 22179 - protein, 29 aa, Artificial Sequence
  Description of Artificial Sequence: Synthetic peptide
DNEEISTTNPVATDQYGSVSTNPMRMGNR

SEQ ID NO: 22180 - protein, 28 aa, Artificial Sequence
  Description of Artificial Sequence: Synthetic peptide
SEEEIRCTNPVATEQYGSVSENLMAGDR

SEQ ID NO: 22181 - protein, 29 aa, Artificial Sequence
  Description of Artificial Sequence: Synthetic peptide
DNEEISTTNPVATCQYGSVCSTNPMRGNR

SEQ ID NO: 22182 - protein, 29 aa, Artificial Sequence
  Description of Artificial Sequence: Synthetic peptide
DNEEIRYTNPVATEQYGVGVSTNLQNGQR

SEQ ID NO: 22183 - protein, 29 aa, Artificial Sequence
  Description of Artificial Sequence: Synthetic peptide
DEEEIRTTNPVATEQYGSVSTDQQDENND

SEQ ID NO: 22184 - protein, 29 aa, Artificial Sequence
  Description of Artificial Sequence: Synthetic peptide
SEEEIRCTNPVATEQYGSVSENLPMRGNG

SEQ ID NO: 22185 - protein, 30 aa, Artificial Sequence
  Description of Artificial Sequence: Synthetic polypeptide
SEEEIRCTNPVATEQYGSVSENLVEREGNR

SEQ ID NO: 22186 - protein, 29 aa, Artificial Sequence
  Description of Artificial Sequence: Synthetic peptide
SEEEIRCTNPVATEQYGSVSENLVMRGND

SEQ ID NO: 22187 - protein, 29 aa, Artificial Sequence
  Description of Artificial Sequence: Synthetic peptide
SEEEIRCTNPVATEQYGSVSENPMREGNR

SEQ ID NO: 22188 - protein, 29 aa, Artificial Sequence
  Description of Artificial Sequence: Synthetic peptide
SEEEIRCTNPVATEQYGSVSTDLMREGNL

SEQ ID NO: 22189 - protein, 28 aa, Artificial Sequence
  Description of Artificial Sequence: Synthetic peptide
SEEEIRCTNPVATEQYGSVSETLMHGNR

SEQ ID NO: 22190 - protein, 30 aa, Artificial Sequence
  Description of Artificial Sequence: Synthetic polypeptide
DEEEIRTTNPVATEQYGSVSTDQGNDGNSR

SEQ ID NO: 22191 - protein, 30 aa, Artificial Sequence
  Description of Artificial Sequence: Synthetic polypeptide
DNEEIRSTNPVATEQYGSVSTNEQREGDPR

SEQ ID NO: 22192 - protein, 30 aa, Artificial Sequence
  Description of Artificial Sequence: Synthetic polypeptide
SEEEIRCTNPVATEQYGSVSSTALMMRGNR

SEQ ID NO: 22193 - protein, 31 aa, Artificial Sequence
  Description of Artificial Sequence: Synthetic polypeptide
SEEEIRCTNPVATEQYGSVSSTENLMRGMNR

SEQ ID NO: 22194 - protein, 31 aa, Artificial Sequence
  Description of Artificial Sequence: Synthetic polypeptide
DNEEIGTTNPVATEQYGSVSTNMLQERMGNE

SEQ ID NO: 22195 - protein, 28 aa, Artificial Sequence
  Description of Artificial Sequence: Synthetic peptide
DNEEICTTNPVATTQYGSVSTNPGDGNR

SEQ ID NO: 22196 - protein, 30 aa, Artificial Sequence
  Description of Artificial Sequence: Synthetic polypeptide
DEEEIRATNPVATEQYGNVSDTNLQQGGER

SEQ ID NO: 22197 - protein, 28 aa, Artificial Sequence
  Description of Artificial Sequence: Synthetic peptide
DNEEIATTNPVATTQYGSVSTNPMRGNT

SEQ ID NO: 22198 - protein, 28 aa, Artificial Sequence
  Description of Artificial Sequence: Synthetic peptide
DNEEIATTNPVATDQYGSVSTNDMQGNR

SEQ ID NO: 22199 - protein, 29 aa, Artificial Sequence
  Description of Artificial Sequence: Synthetic peptide
DNEEIATTNPVATAQYGSVSTNPDRGQNR

SEQ ID NO: 22200 - protein, 31 aa, Artificial Sequence
  Description of Artificial Sequence: Synthetic polypeptide
DEEEIRATNPVATEQYGNVSATNLQQTGNQR

SEQ ID NO: 22201 - protein, 28 aa, Artificial Sequence
  Description of Artificial Sequence: Synthetic peptide
DNAEISTTNPVATGQYGSVSTNPMRGNR

SEQ ID NO: 22202 - protein, 31 aa, Artificial Sequence
  Description of Artificial Sequence: Synthetic polypeptide
DEEEIRATNPVATEQYGNVSMTMNLTQQGNR

SEQ ID NO: 22203 - protein, 29 aa, Artificial Sequence
  Description of Artificial Sequence: Synthetic peptide
DNEEISTTNPVATNQYGSVSTENPMRGNR

SEQ ID NO: 22204 - protein, 30 aa, Artificial Sequence
  Description of Artificial Sequence: Synthetic polypeptide
DEEEIRATNPVATEQYGFVSPTPLFQGGNR

SEQ ID NO: 22205 - protein, 28 aa, Artificial Sequence
  Description of Artificial Sequence: Synthetic peptide
DEEEIRTTNPIATEQYGSVSTDLMHGEL

SEQ ID NO: 22206 - protein, 31 aa, Artificial Sequence
  Description of Artificial Sequence: Synthetic polypeptide
DEEEIRATNPVATEQYGEVYSVTNLFQGGNR

SEQ ID NO: 22207 - protein, 30 aa, Artificial Sequence
  Description of Artificial Sequence: Synthetic polypeptide
DGEEIRTTNPVATEQWGSVTSTGLQRDGTR

SEQ ID NO: 22208 - protein, 29 aa, Artificial Sequence
  Description of Artificial Sequence: Synthetic peptide
DGEEIRTTNPVATEQWGSVTSTDLQHGTR

SEQ ID NO: 22209 - protein, 30 aa, Artificial Sequence
  Description of Artificial Sequence: Synthetic polypeptide
DEEEIRTTNPVATEQYGSVSTNLSDANGTS

SEQ ID NO: 22210 - protein, 31 aa, Artificial Sequence
  Description of Artificial Sequence: Synthetic polypeptide
DEEEIRATNPVATEQYGEVSMTNLPQGGNMR

SEQ ID NO: 22211 - protein, 31 aa, Artificial Sequence
  Description of Artificial Sequence: Synthetic polypeptide
DEEEIRTTNPVATEQYGSVSTNLSDRDNEDI

SEQ ID NO: 22212 - protein, 32 aa, Artificial Sequence
  Description of Artificial Sequence: Synthetic polypeptide
DEEEIRTTNPIATEQYGSVSTTPNLPMRNGNR

SEQ ID NO: 22213 - protein, 32 aa, Artificial Sequence
  Description of Artificial Sequence: Synthetic polypeptide
DEEEIRTTNPVATEQYGSVSTNLSDRTGGNEN

SEQ ID NO: 22214 - protein, 30 aa, Artificial Sequence
  Description of Artificial Sequence: Synthetic polypeptide
DEEEIRATNPVATEQYGEVSMTNEQQGGNR

SEQ ID NO: 22215 - protein, 31 aa, Artificial Sequence
  Description of Artificial Sequence: Synthetic polypeptide
DEEEIRATNPVATEQYGEVSCTNMLSQGGNR

SEQ ID NO: 22216 - protein, 31 aa, Artificial Sequence
  Description of Artificial Sequence: Synthetic polypeptide
AEEEIRTTNPVATEQYGSVSTTNNLQQGENL

SEQ ID NO: 22217 - protein, 31 aa, Artificial Sequence
  Description of Artificial Sequence: Synthetic polypeptide
DEEEIRTTNPVATEQYGSFVSTNLQNNEERD

SEQ ID NO: 22218 - protein, 30 aa, Artificial Sequence
  Description of Artificial Sequence: Synthetic polypeptide
DEEEIRTTNPVATEQYGSVSTDNQMIIGNG

SEQ ID NO: 22219 - protein, 32 aa, Artificial Sequence
  Description of Artificial Sequence: Synthetic polypeptide
AEEEIRTTNPVATEQYGSVSTTNNLQQGENIR

SEQ ID NO: 22220 - protein, 29 aa, Artificial Sequence
  Description of Artificial Sequence: Synthetic peptide
DEEEIRTTNPIATEQYGSVSYNDIDRGND

SEQ ID NO: 22221 - protein, 29 aa, Artificial Sequence
  Description of Artificial Sequence: Synthetic peptide
DGEEIRTTNPVATEGWGSVNSTLLQRGTR

SEQ ID NO: 22222 - protein, 29 aa, Artificial Sequence
  Description of Artificial Sequence: Synthetic peptide
DEEEIRTTNPIATEQYGSVSYNEHREGND

SEQ ID NO: 22223 - protein, 28 aa, Artificial Sequence
  Description of Artificial Sequence: Synthetic peptide
SEEEIRSTNPVATEGYGSVSETLMRGNR

SEQ ID NO: 22224 - protein, 28 aa, Artificial Sequence
  Description of Artificial Sequence: Synthetic peptide
SEEEIRSTNPVATEQYGSMSETLQHGNR

SEQ ID NO: 22225 - protein, 28 aa, Artificial Sequence
  Description of Artificial Sequence: Synthetic peptide
DEEEIRTTNPIATEQYGSVSYNIFNGND

SEQ ID NO: 22226 - protein, 29 aa, Artificial Sequence
  Description of Artificial Sequence: Synthetic peptide
SEEEIRSTNPVATEQYGSVSENLMSRGQR

SEQ ID NO: 22227 - protein, 29 aa, Artificial Sequence
  Description of Artificial Sequence: Synthetic peptide
DGEEIATTNPVATEQWGSVTSTELQRGTR

SEQ ID NO: 22228 - protein, 31 aa, Artificial Sequence
  Description of Artificial Sequence: Synthetic polypeptide
DEEEIRTTNPVATEQYGSFVSTTNLQPTNPD

SEQ ID NO: 22229 - protein, 29 aa, Artificial Sequence
  Description of Artificial Sequence: Synthetic peptide
DEEEIRTTNPIATEQYGSVSYNIGDRGND

SEQ ID NO: 22230 - protein, 28 aa, Artificial Sequence
  Description of Artificial Sequence: Synthetic peptide
SEEEIRSTNPVATEQYGVVASTLQHGNR

SEQ ID NO: 22231 - protein, 29 aa, Artificial Sequence
  Description of Artificial Sequence: Synthetic peptide
DEYVIRTTNPVATEQYGMVETNEQVRGNR

SEQ ID NO: 22232 - protein, 29 aa, Artificial Sequence
  Description of Artificial Sequence: Synthetic peptide
DGEEIRTTNPVATEQWGAVTSTVLQRGTR

SEQ ID NO: 22233 - protein, 29 aa, Artificial Sequence
  Description of Artificial Sequence: Synthetic peptide
DEECIRTTNPCATEQYFEEVSTNLQIGNR

SEQ ID NO: 22234 - protein, 30 aa, Artificial Sequence
  Description of Artificial Sequence: Synthetic polypeptide
DGEEIRTTNPVATEQWGSVTSTLLQRGFER

SEQ ID NO: 22235 - protein, 28 aa, Artificial Sequence
  Description of Artificial Sequence: Synthetic peptide
SEEEIRSTNPIATEQYGVVSENLQRGNQ

SEQ ID NO: 22236 - protein, 28 aa, Artificial Sequence
  Description of Artificial Sequence: Synthetic peptide
SEEEIRGTNPCATEQYGSVSENLPMGNR

SEQ ID NO: 22237 - protein, 29 aa, Artificial Sequence
  Description of Artificial Sequence: Synthetic peptide
SEEEIRGTNPCATEQYGSVSNNLMRGNDR

SEQ ID NO: 22238 - protein, 28 aa, Artificial Sequence
  Description of Artificial Sequence: Synthetic peptide
SEEEIRGTNPIATEQYGSVSENLMRGNV

SEQ ID NO: 22239 - protein, 28 aa, Artificial Sequence
  Description of Artificial Sequence: Synthetic peptide
SEEEIRGTNPIATEYYGSVSENLMRGNR

SEQ ID NO: 22240 - protein, 28 aa, Artificial Sequence
  Description of Artificial Sequence: Synthetic peptide
SEEEIRPTNPCATEQYGIVSCNLQRGTR

SEQ ID NO: 22241 - protein, 28 aa, Artificial Sequence
  Description of Artificial Sequence: Synthetic peptide
SEEEIRPTNPCATEQYGVVDTNLQRGNA

SEQ ID NO: 22242 - protein, 28 aa, Artificial Sequence
  Description of Artificial Sequence: Synthetic peptide
DMEEIATTNPVATAQYGSVSTNPDRGND

SEQ ID NO: 22243 - protein, 28 aa, Artificial Sequence
  Description of Artificial Sequence: Synthetic peptide
SEEEIRPTNPIASEQYGSVSENLQRGTR

SEQ ID NO: 22244 - protein, 28 aa, Artificial Sequence
  Description of Artificial Sequence: Synthetic peptide
SEEEIRPTNPIATEEYGSVSENLMRGNR

SEQ ID NO: 22245 - protein, 29 aa, Artificial Sequence
  Description of Artificial Sequence: Synthetic peptide
SEEEIRPTNPIATEQYGSVSENYLMRGNR

SEQ ID NO: 22246 - protein, 28 aa, Artificial Sequence
  Description of Artificial Sequence: Synthetic peptide
SEEEIRSTNPCATEQYGSVSENLMRGIR

SEQ ID NO: 22247 - protein, 28 aa, Artificial Sequence
  Description of Artificial Sequence: Synthetic peptide
SEEEIRSTNPCATEQYGSVSVNLMRGNT

SEQ ID NO: 22248 - protein, 30 aa, Artificial Sequence
  Description of Artificial Sequence: Synthetic polypeptide
DGEEIRTTNPVATEQWGSVTSTLLQRGQRP

SEQ ID NO: 22249 - protein, 28 aa, Artificial Sequence
  Description of Artificial Sequence: Synthetic peptide
SEEEIRSTNPIATEQYGNVSENLMRGNR

SEQ ID NO: 22250 - protein, 28 aa, Artificial Sequence
  Description of Artificial Sequence: Synthetic peptide
SEEEIRSTNPIATEQYGNVSNNLMRGNR

SEQ ID NO: 22251 - protein, 29 aa, Artificial Sequence
  Description of Artificial Sequence: Synthetic peptide
DGEEISTTNPVATEQWGSVTSTLLQRGTR

SEQ ID NO: 22252 - protein, 31 aa, Artificial Sequence
  Description of Artificial Sequence: Synthetic polypeptide
DEEEIRATNPVATEQYGFVSITNLFQGGNRG

SEQ ID NO: 22253 - protein, 31 aa, Artificial Sequence
  Description of Artificial Sequence: Synthetic polypeptide
DEEEIRATNPVATEQYGFVSETNLFQGGNRG

SEQ ID NO: 22254 - protein, 28 aa, Artificial Sequence
  Description of Artificial Sequence: Synthetic peptide
SEEEIRSTNPIATEQYGSVSENLMMGNR

SEQ ID NO: 22255 - protein, 28 aa, Artificial Sequence
  Description of Artificial Sequence: Synthetic peptide
SEEEIRSTNPIATEQYGSVSENLMPGNR

SEQ ID NO: 22256 - protein, 31 aa, Artificial Sequence
  Description of Artificial Sequence: Synthetic polypeptide
DEEEIRTTNPVATEQYGSVSITVLQRFGEFD

SEQ ID NO: 22257 - protein, 28 aa, Artificial Sequence
  Description of Artificial Sequence: Synthetic peptide
SEEEIRSTNPIATEQYGSVSENLMSGNR

SEQ ID NO: 22258 - protein, 29 aa, Artificial Sequence
  Description of Artificial Sequence: Synthetic peptide
SEEEIRSTNPIATEQYGSVSENLMSRGNR

SEQ ID NO: 22259 - protein, 28 aa, Artificial Sequence
  Description of Artificial Sequence: Synthetic peptide
SEEEIRSTNPIATEQYGSVSNNLMRGQR

SEQ ID NO: 22260 - protein, 28 aa, Artificial Sequence
  Description of Artificial Sequence: Synthetic peptide
SEEEIRSTNPIATEQYGVVSDNLQRGNQ

SEQ ID NO: 22261 - protein, 28 aa, Artificial Sequence
  Description of Artificial Sequence: Synthetic peptide
SEEEIRSTNPIATEQYGVVSENLMRGNR

SEQ ID NO: 22262 - protein, 31 aa, Artificial Sequence
  Description of Artificial Sequence: Synthetic polypeptide
DEEEIRATNPVATEQYGFVSMTNLDQGGNRE

SEQ ID NO: 22263 - protein, 31 aa, Artificial Sequence
  Description of Artificial Sequence: Synthetic polypeptide
DEEEIRTTNPVATEQYGSFVSTYNLQEIDNY

SEQ ID NO: 22264 - protein, 29 aa, Artificial Sequence
  Description of Artificial Sequence: Synthetic peptide
SEEEIRCTNPVATEQYGSVSENGMMRGNR

SEQ ID NO: 22265 - protein, 28 aa, Artificial Sequence
  Description of Artificial Sequence: Synthetic peptide
DNEEISTTNPVATTQYGSVSTNGVNGNR

SEQ ID NO: 22266 - protein, 30 aa, Artificial Sequence
  Description of Artificial Sequence: Synthetic polypeptide
DEEEIRATNPVATEQYGSVATNLQERNNGS

SEQ ID NO: 22267 - protein, 29 aa, Artificial Sequence
  Description of Artificial Sequence: Synthetic peptide
DEEEIRATNPVATEQYGSVATNLQERNDF

SEQ ID NO: 22268 - protein, 30 aa, Artificial Sequence
  Description of Artificial Sequence: Synthetic polypeptide
DQEEIRTTNPVATAQYGSVSTNAVQNGNNR

SEQ ID NO: 22269 - protein, 29 aa, Artificial Sequence
  Description of Artificial Sequence: Synthetic peptide
DEEEIRTTNPIATEQYGSISMNLQQNGNH

SEQ ID NO: 22270 - protein, 30 aa, Artificial Sequence
  Description of Artificial Sequence: Synthetic polypeptide
DQEEIRSTNPVATEQYGSVSTNPQARSGQR

SEQ ID NO: 22271 - protein, 29 aa, Artificial Sequence
  Description of Artificial Sequence: Synthetic peptide
DEEEIRTTNPVATEQYGSVSTDWIQNGEE

SEQ ID NO: 22272 - protein, 31 aa, Artificial Sequence
  Description of Artificial Sequence: Synthetic polypeptide
DQEEIRSTNPVATEQYGSVSTNLQARTGGQR

SEQ ID NO: 22273 - protein, 31 aa, Artificial Sequence
  Description of Artificial Sequence: Synthetic polypeptide
DEEEIRTTNPVATEQYGSVSITNTLQVLTNG

SEQ ID NO: 22274 - protein, 30 aa, Artificial Sequence
  Description of Artificial Sequence: Synthetic polypeptide
DEEEIRTTNPVATEQYGSVSFTVLSNGDDR

SEQ ID NO: 22275 - protein, 30 aa, Artificial Sequence
  Description of Artificial Sequence: Synthetic polypeptide
DEEEIRATNPVATEQYGSVATNLQEGGNSQ

SEQ ID NO: 22276 - protein, 28 aa, Artificial Sequence
  Description of Artificial Sequence: Synthetic peptide
SEEEIRCTNPTATEQYGSVSENAMRGNR

SEQ ID NO: 22277 - protein, 28 aa, Artificial Sequence
  Description of Artificial Sequence: Synthetic peptide
SEEEIRCTNPTATEQYGSVSENIMRGNR

SEQ ID NO: 22278 - protein, 32 aa, Artificial Sequence
  Description of Artificial Sequence: Synthetic polypeptide
DEEEIRTTNPVATEQYGSVSTNLQTLGGNDIG

SEQ ID NO: 22279 - protein, 30 aa, Artificial Sequence
  Description of Artificial Sequence: Synthetic polypeptide
DEEEIRTTNPIATEQYGSVATNLQMRKELR

SEQ ID NO: 22280 - protein, 28 aa, Artificial Sequence
  Description of Artificial Sequence: Synthetic peptide
SEEEIRCTNPTATEQYGSVSENLMRGHR

SEQ ID NO: 22281 - protein, 30 aa, Artificial Sequence
  Description of Artificial Sequence: Synthetic polypeptide
DEEEIRATNPVATEQYGSVATNLQDGNNNN

SEQ ID NO: 22282 - protein, 29 aa, Artificial Sequence
  Description of Artificial Sequence: Synthetic peptide
DEEEIRATNPVATEQYGSVATNLQDGEFP

SEQ ID NO: 22283 - protein, 31 aa, Artificial Sequence
  Description of Artificial Sequence: Synthetic polypeptide
DEEEIRTTNPVATEQYGSVSTNLQTQGLEFE

SEQ ID NO: 22284 - protein, 28 aa, Artificial Sequence
  Description of Artificial Sequence: Synthetic peptide
DQEDIRTTNPVATEQYGCVSTNDQRVNL

SEQ ID NO: 22285 - protein, 28 aa, Artificial Sequence
  Description of Artificial Sequence: Synthetic peptide
DEEEIRTTNPIATEQYGSVATVLARGDE

SEQ ID NO: 22286 - protein, 28 aa, Artificial Sequence
  Description of Artificial Sequence: Synthetic peptide
DEEEIRATNPVATEQYGSVATNLERTDL

SEQ ID NO: 22287 - protein, 28 aa, Artificial Sequence
  Description of Artificial Sequence: Synthetic peptide
SEEEIRCTNPTATEQYGSVSENLMVGNR

SEQ ID NO: 22288 - protein, 31 aa, Artificial Sequence
  Description of Artificial Sequence: Synthetic polypeptide
DEEEIRTTNPVATEQYGSVSTNLQTVAQNAE

SEQ ID NO: 22289 - protein, 30 aa, Artificial Sequence
  Description of Artificial Sequence: Synthetic polypeptide
SEEEIRCTNPTATEQYGSVSENLQMRGNER

SEQ ID NO: 22290 - protein, 29 aa, Artificial Sequence
  Description of Artificial Sequence: Synthetic peptide
DEEEIRATNPVATEQYGSVATNLERGQDE

SEQ ID NO: 22291 - protein, 32 aa, Artificial Sequence
  Description of Artificial Sequence: Synthetic polypeptide
DEEEIRTTNPVATEQYGSVSTNLQTVMGDNDI

SEQ ID NO: 22292 - protein, 30 aa, Artificial Sequence
  Description of Artificial Sequence: Synthetic polypeptide
DEEEIRATNPVATEQYGSVATNLQEAGNPQ

SEQ ID NO: 22293 - protein, 28 aa, Artificial Sequence
  Description of Artificial Sequence: Synthetic peptide
SEEEIRCTNPTATEQYGSVSENLTRGNT

SEQ ID NO: 22294 - protein, 30 aa, Artificial Sequence
  Description of Artificial Sequence: Synthetic polypeptide
DEEEIRTTNPVATEQYGCVGSNLQEGGSNR

SEQ ID NO: 22295 - protein, 30 aa, Artificial Sequence
  Description of Artificial Sequence: Synthetic polypeptide
DEEEIRATNPVATEQYGSVATNLQERSNDA

SEQ ID NO: 22296 - protein, 29 aa, Artificial Sequence
  Description of Artificial Sequence: Synthetic peptide
SEEEIRCTNPLATEQYGSVSENELMRGNR

SEQ ID NO: 22297 - protein, 28 aa, Artificial Sequence
  Description of Artificial Sequence: Synthetic peptide
SEEEIRCTNPLATEQYGSVSSNLMYGNR

SEQ ID NO: 22298 - protein, 29 aa, Artificial Sequence
  Description of Artificial Sequence: Synthetic peptide
SEEEIRCTNPLATEQYGSVYSENLMRGNR

SEQ ID NO: 22299 - protein, 30 aa, Artificial Sequence
  Description of Artificial Sequence: Synthetic polypeptide
DEEEIRTTNPVATEQYGSVSTNLQTEVPQE

SEQ ID NO: 22300 - protein, 29 aa, Artificial Sequence
  Description of Artificial Sequence: Synthetic peptide
SEEEIRCTNPMATEQYGSVSENLMRGNRL

SEQ ID NO: 22301 - protein, 32 aa, Artificial Sequence
  Description of Artificial Sequence: Synthetic polypeptide
DQEEIRTTNPVATEQYGSVSCTNLSQRTVDNR

SEQ ID NO: 22302 - protein, 32 aa, Artificial Sequence
  Description of Artificial Sequence: Synthetic polypeptide
DQEEIRTTNPVATEQYGSVCSTNLEQRGSNDE

SEQ ID NO: 22303 - protein, 29 aa, Artificial Sequence
  Description of Artificial Sequence: Synthetic peptide
SEEEIRCTNPQATEQYGSVSENLMRGNSR

SEQ ID NO: 22304 - protein, 29 aa, Artificial Sequence
  Description of Artificial Sequence: Synthetic peptide
SEEEIRCTNPQATEQYGSVSENLMRGNTR

SEQ ID NO: 22305 - protein, 28 aa, Artificial Sequence
  Description of Artificial Sequence: Synthetic peptide
SEEEIRCTNPSATEQYGAVSENLMRGNR

SEQ ID NO: 22306 - protein, 29 aa, Artificial Sequence
  Description of Artificial Sequence: Synthetic peptide
SEEEIRCTNPSATEQYGSVSENLMRGLNR

SEQ ID NO: 22307 - protein, 31 aa, Artificial Sequence
  Description of Artificial Sequence: Synthetic polypeptide
DEEEIRATNPVATEQYGSVATNLTRDGNDRL

SEQ ID NO: 22308 - protein, 30 aa, Artificial Sequence
  Description of Artificial Sequence: Synthetic polypeptide
DEEEIRTTNPVATEQYGSVSTNLQTHELEE

SEQ ID NO: 22309 - protein, 31 aa, Artificial Sequence
  Description of Artificial Sequence: Synthetic polypeptide
DQEEIRTTNPVATEQYGCVCSTNLQRGSNLE

SEQ ID NO: 22310 - protein, 31 aa, Artificial Sequence
  Description of Artificial Sequence: Synthetic polypeptide
DQEEIRTTNPVATEQYGCVCSTGNLQQGNRP

SEQ ID NO: 22311 - protein, 31 aa, Artificial Sequence
  Description of Artificial Sequence: Synthetic polypeptide
DQEEIRTTNPVATEQYGCVCSTELQRFGNRS

SEQ ID NO: 22312 - protein, 30 aa, Artificial Sequence
  Description of Artificial Sequence: Synthetic polypeptide
DQEEIRTTNPVATEQWGSVTSVTLLQRGTR

SEQ ID NO: 22313 - protein, 29 aa, Artificial Sequence
  Description of Artificial Sequence: Synthetic peptide
DQEEIRTTNPVATEQWGSVTSTGLQRGTL

SEQ ID NO: 22314 - protein, 30 aa, Artificial Sequence
  Description of Artificial Sequence: Synthetic polypeptide
DQEEIRTTNPVATEQWGSVPSTLLAQRGTR

SEQ ID NO: 22315 - protein, 28 aa, Artificial Sequence
  Description of Artificial Sequence: Synthetic peptide
SEEEIRCTNPSATEQYGSVSENNMRGNR

SEQ ID NO: 22316 - protein, 30 aa, Artificial Sequence
  Description of Artificial Sequence: Synthetic polypeptide
DQEEIRTTNPVATDQYGSVSTNGVQEGNSR

SEQ ID NO: 22317 - protein, 30 aa, Artificial Sequence
  Description of Artificial Sequence: Synthetic polypeptide
DQEEIRTTNPVATDQYGSVSTNGIQNGNER

SEQ ID NO: 22318 - protein, 30 aa, Artificial Sequence
  Description of Artificial Sequence: Synthetic polypeptide
DEEEIRATNPVATEQYGSVATNLQPDGNEN

SEQ ID NO: 22319 - protein, 30 aa, Artificial Sequence
  Description of Artificial Sequence: Synthetic polypeptide
DQEEIRTTNPVATDQYGSVSTNGDQAGNNR

SEQ ID NO: 22320 - protein, 29 aa, Artificial Sequence
  Description of Artificial Sequence: Synthetic peptide
SEEEIRCTNPSATEQYGSVSSENLMRGNR

SEQ ID NO: 22321 - protein, 30 aa, Artificial Sequence
  Description of Artificial Sequence: Synthetic polypeptide
DEEEIRTTNPVATEQYGCVGTEEHQRGSNR

SEQ ID NO: 22322 - protein, 31 aa, Artificial Sequence
  Description of Artificial Sequence: Synthetic polypeptide
DEEEIRATNPVATEQYGSVATNLQVGDNTRS

SEQ ID NO: 22323 - protein, 30 aa, Artificial Sequence
  Description of Artificial Sequence: Synthetic polypeptide
SEEEIRCTNPVATEQYGSVSEINLPMRGNR

SEQ ID NO: 22324 - protein, 28 aa, Artificial Sequence
  Description of Artificial Sequence: Synthetic peptide
DQAEIRTTNPVATEQYGECSTWLQHGNR

SEQ ID NO: 22325 - protein, 30 aa, Artificial Sequence
  Description of Artificial Sequence: Synthetic polypeptide
SEEEIRCTNPVATEAYGSVSTNLQDGNDRM

SEQ ID NO: 22326 - protein, 29 aa, Artificial Sequence
  Description of Artificial Sequence: Synthetic peptide
DEEEIRATNPVATEQYGSVAANLQEPGNQ

SEQ ID NO: 22327 - protein, 28 aa, Artificial Sequence
  Description of Artificial Sequence: Synthetic peptide
DEEEIRATNPVATEQYGSVAANLQDGGE

SEQ ID NO: 22328 - protein, 28 aa, Artificial Sequence
  Description of Artificial Sequence: Synthetic peptide
SEEEIRCTNPVATEQWGSVSENLMRGDR

SEQ ID NO: 22329 - protein, 32 aa, Artificial Sequence
  Description of Artificial Sequence: Synthetic polypeptide
DEEEIRTTNPVATEQYGSVSITPNLQRQGVLE

SEQ ID NO: 22330 - protein, 31 aa, Artificial Sequence
  Description of Artificial Sequence: Synthetic polypeptide
DEEEIRTTNPIATEQYGSVSCNEPQDREGNR

SEQ ID NO: 22331 - protein, 32 aa, Artificial Sequence
  Description of Artificial Sequence: Synthetic polypeptide
DEEEIRTTNPVATEQYGSVSTDTIQPRGGNRQ

SEQ ID NO: 22332 - protein, 28 aa, Artificial Sequence
  Description of Artificial Sequence: Synthetic peptide
SEEEIRCTNPVATEQYGEASENLMRGNR

SEQ ID NO: 22333 - protein, 30 aa, Artificial Sequence
  Description of Artificial Sequence: Synthetic polypeptide
DEEEIRTTNPVATEQYGSVSITPNMDRLNE

SEQ ID NO: 22334 - protein, 29 aa, Artificial Sequence
  Description of Artificial Sequence: Synthetic peptide
DEEEIRTTNPIATEQYGSVSEAGMRGNPR

SEQ ID NO: 22335 - protein, 28 aa, Artificial Sequence
  Description of Artificial Sequence: Synthetic peptide
SEEEIRCTNPVATEQYGSAPENCQRGNR

SEQ ID NO: 22336 - protein, 28 aa, Artificial Sequence
  Description of Artificial Sequence: Synthetic peptide
SEEEIRCTNPVATEQYGSMSETLQHGNR

SEQ ID NO: 22337 - protein, 29 aa, Artificial Sequence
  Description of Artificial Sequence: Synthetic peptide
DEEEIRTTNPIATEQYGSVSEAGNRGNPR

SEQ ID NO: 22338 - protein, 28 aa, Artificial Sequence
  Description of Artificial Sequence: Synthetic peptide
DQAEIRTTNPVATEQYGCASTVLQAGNR

SEQ ID NO: 22339 - protein, 28 aa, Artificial Sequence
  Description of Artificial Sequence: Synthetic peptide
DNEEISTTNPVATWQYGSVSTNIVRNNR

SEQ ID NO: 22340 - protein, 29 aa, Artificial Sequence
  Description of Artificial Sequence: Synthetic peptide
DNEEISTTNPVATTQYGSVSTTNIERGNR

SEQ ID NO: 22341 - protein, 29 aa, Artificial Sequence
  Description of Artificial Sequence: Synthetic peptide
SEEEIRCTNPVATEQYGSVATNLQRMNEH

SEQ ID NO: 22342 - protein, 31 aa, Artificial Sequence
  Description of Artificial Sequence: Synthetic polypeptide
DEEEIRTTNPVATEQYGSVSTDQVLQESGNG

SEQ ID NO: 22343 - protein, 31 aa, Artificial Sequence
  Description of Artificial Sequence: Synthetic polypeptide
DEEEIRTTNPVATEQYGSVSTNLQVTEEGEG

SEQ ID NO: 22344 - protein, 28 aa, Artificial Sequence
  Description of Artificial Sequence: Synthetic peptide
SEEEIRCTNPVATEQYGSVSCNEMRGNG

SEQ ID NO: 22345 - protein, 29 aa, Artificial Sequence
  Description of Artificial Sequence: Synthetic peptide
DNEEISTTNPVATTQYGSVSTNPDRGNDR

SEQ ID NO: 22346 - protein, 28 aa, Artificial Sequence
  Description of Artificial Sequence: Synthetic peptide
DNEEISTTNPVATTQYGSVSTNNSNGNR

SEQ ID NO: 22347 - protein, 29 aa, Artificial Sequence
  Description of Artificial Sequence: Synthetic peptide
SEEEIRCTNPVATEQYGSVSCNEQDRGNG

SEQ ID NO: 22348 - protein, 30 aa, Artificial Sequence
  Description of Artificial Sequence: Synthetic polypeptide
DEEEIRATNPVATEQYGQVSMTNLSQGGER

SEQ ID NO: 22349 - protein, 28 aa, Artificial Sequence
  Description of Artificial Sequence: Synthetic peptide
DEEEIRTTNPIATEQYGSVSEDLERGEL

SEQ ID NO: 22350 - protein, 29 aa, Artificial Sequence
  Description of Artificial Sequence: Synthetic peptide
SEEEIRCTNPVATEQYGSVSEILMNRGNR

SEQ ID NO: 22351 - protein, 30 aa, Artificial Sequence
  Description of Artificial Sequence: Synthetic polypeptide
DEEEIRATNPVATEQYGNVSVTNLEQGGNT

SEQ ID NO: 22352 - protein, 30 aa, Artificial Sequence
  Description of Artificial Sequence: Synthetic polypeptide
SEEEIRCTNPVATEQYGSVATNLQIDGNER

SEQ ID NO: 22353 - protein, 28 aa, Artificial Sequence
  Description of Artificial Sequence: Synthetic peptide
DEEEIRTTNPIATEQYGSVATWLARGEF

SEQ ID NO: 22354 - protein, 31 aa, Artificial Sequence
  Description of Artificial Sequence: Synthetic polypeptide
DEEEIRTTNPVATEQYGSVSITNWDQINGNS

SEQ ID NO: 22355 - protein, 28 aa, Artificial Sequence
  Description of Artificial Sequence: Synthetic peptide
DEEEIRTTNPIATEQYGSVPTWLNRGKE

SEQ ID NO: 22356 - protein, 31 aa, Artificial Sequence
  Description of Artificial Sequence: Synthetic polypeptide
DEEEIRTTNPVATEQYGCVDSTNLTRGSNQI

SEQ ID NO: 22357 - protein, 30 aa, Artificial Sequence
  Description of Artificial Sequence: Synthetic polypeptide
DEEEIRATNPVATEQYGSVATNLEDGGNRQ

SEQ ID NO: 22358 - protein, 30 aa, Artificial Sequence
  Description of Artificial Sequence: Synthetic polypeptide
DEEEIRATNPVATEQYGSVATNLDRPNPRP

SEQ ID NO: 22359 - protein, 28 aa, Artificial Sequence
  Description of Artificial Sequence: Synthetic peptide
SEEEIRCTNPVATECYGSVSENEMRGNR

SEQ ID NO: 22360 - protein, 30 aa, Artificial Sequence
  Description of Artificial Sequence: Synthetic polypeptide
DEEEIRATNPVATEQYGSVATNLDRGNPEM

SEQ ID NO: 22361 - protein, 29 aa, Artificial Sequence
  Description of Artificial Sequence: Synthetic peptide
SEEEIRCTNPVATECYGSVSENEQRGENR

SEQ ID NO: 22362 - protein, 28 aa, Artificial Sequence
  Description of Artificial Sequence: Synthetic peptide
SEEEIRCTNPVATECYGSVSENLMRENR

SEQ ID NO: 22363 - protein, 29 aa, Artificial Sequence
  Description of Artificial Sequence: Synthetic peptide
DEEEIRATNPVATEQYGSVATNGQESGNQ

SEQ ID NO: 22364 - protein, 28 aa, Artificial Sequence
  Description of Artificial Sequence: Synthetic peptide
SEEEIRCTNPVATEGYGSVSETLMRGNR

SEQ ID NO: 22365 - protein, 29 aa, Artificial Sequence
  Description of Artificial Sequence: Synthetic peptide
SEEEIRCTNPVATEHYGVVSTNLQRGNDY

SEQ ID NO: 22366 - protein, 30 aa, Artificial Sequence
  Description of Artificial Sequence: Synthetic polypeptide
DEEEIRATNPVATEQYGSVATNDQRDNDRV

SEQ ID NO: 22367 - protein, 29 aa, Artificial Sequence
  Description of Artificial Sequence: Synthetic peptide
DEEEIRATNPVATEQYGSVATNDQGGNQG

SEQ ID NO: 22368 - protein, 31 aa, Artificial Sequence
  Description of Artificial Sequence: Synthetic polypeptide
DEEEIRTTNPVATEQYGSFSSLPNMLQRDNR

SEQ ID NO: 22369 - protein, 28 aa, Artificial Sequence
  Description of Artificial Sequence: Synthetic peptide
DEEEIRTTNPIATEQYGSVCYNIERGND

SEQ ID NO: 22370 - protein, 30 aa, Artificial Sequence
  Description of Artificial Sequence: Synthetic polypeptide
DEEEIRATNPVATEQYGSVATNDDRGNERL

SEQ ID NO: 22371 - protein, 29 aa, Artificial Sequence
  Description of Artificial Sequence: Synthetic peptide
DEEEIRATNPVATEQYGSVATNAQGGNDQ

SEQ ID NO: 22372 - protein, 32 aa, Artificial Sequence
  Description of Artificial Sequence: Synthetic polypeptide
DEEEIRTTNPVATEQYGSVSTDTLQNYGSNIR

SEQ ID NO: 22373 - protein, 31 aa, Artificial Sequence
  Description of Artificial Sequence: Synthetic polypeptide
DEEEIRATNPVATEQYGSVATGNLQEGNERS

SEQ ID NO: 22374 - protein, 30 aa, Artificial Sequence
  Description of Artificial Sequence: Synthetic polypeptide
DEEEIRTTNPIATEQYGSVIATNLQGGNHA

SEQ ID NO: 22375 - protein, 32 aa, Artificial Sequence
  Description of Artificial Sequence: Synthetic polypeptide
DEEEIRTTNPVATEQYGSVSTNLQVIGLNIGQ

SEQ ID NO: 22376 - protein, 28 aa, Artificial Sequence
  Description of Artificial Sequence: Synthetic peptide
SEEEIRCTNPVATEQWGDVSENLMRGNR

SEQ ID NO: 22377 - protein, 29 aa, Artificial Sequence
  Description of Artificial Sequence: Synthetic peptide
DEEEIRATNPVATEQYGSVATDLQQGNEP

SEQ ID NO: 22378 - protein, 32 aa, Artificial Sequence
  Description of Artificial Sequence: Synthetic polypeptide
DEEEIRTTNPVATEQYGSVSTNLQVMGFNIEQ

SEQ ID NO: 22379 - protein, 29 aa, Artificial Sequence
  Description of Artificial Sequence: Synthetic peptide
DEDEIATTNPVAYEQYGSVSTNLQGGNVD

SEQ ID NO: 22380 - protein, 30 aa, Artificial Sequence
  Description of Artificial Sequence: Synthetic polypeptide
DEEEIRTTNPVATEQYGSVSTNLQVMTEVL

SEQ ID NO: 22381 - protein, 31 aa, Artificial Sequence
  Description of Artificial Sequence: Synthetic polypeptide
DEEEIRTTNPVATEQYGSVSTNLQVMTNEIL

SEQ ID NO: 22382 - protein, 29 aa, Artificial Sequence
  Description of Artificial Sequence: Synthetic peptide
SEEEIRCTNPVATEPYGSISMNLQQRGNR

SEQ ID NO: 22383 - protein, 28 aa, Artificial Sequence
  Description of Artificial Sequence: Synthetic peptide
DEYVIATTNPVATEQYGQVETNEQRGNR

SEQ ID NO: 22384 - protein, 31 aa, Artificial Sequence
  Description of Artificial Sequence: Synthetic polypeptide
DEEEIRTTNPVATEQYGSVSTNLSGNGEENE

SEQ ID NO: 22385 - protein, 29 aa, Artificial Sequence
  Description of Artificial Sequence: Synthetic peptide
DEYEIYTTNPVATEQYGSVSTNLNDGNTD

SEQ ID NO: 22386 - protein, 31 aa, Artificial Sequence
  Description of Artificial Sequence: Synthetic polypeptide
DEVEIRTTNPVATEQYGSVSTNLQQIGTNED

SEQ ID NO: 22387 - protein, 31 aa, Artificial Sequence
  Description of Artificial Sequence: Synthetic polypeptide
DEEEIRTTNPVATEQYGSISLPNMLDRVGNR

SEQ ID NO: 22388 - protein, 31 aa, Artificial Sequence
  Description of Artificial Sequence: Synthetic polypeptide
DEVEIRTTNPVATEQYGSVSTNLQPGGDNGT

SEQ ID NO: 22389 - protein, 31 aa, Artificial Sequence
  Description of Artificial Sequence: Synthetic polypeptide
AEEEIRTTNPVATEQYGSVSTTNLQQTGGIR

SEQ ID NO: 22390 - protein, 28 aa, Artificial Sequence
  Description of Artificial Sequence: Synthetic peptide
DEECIRCTNPVATEQYGVVSWNDQRGNL

SEQ ID NO: 22391 - protein, 32 aa, Artificial Sequence
  Description of Artificial Sequence: Synthetic polypeptide
DEEEIRTTNPVATEQYGSVSTDNLFQVEGNQI

SEQ ID NO: 22392 - protein, 30 aa, Artificial Sequence
  Description of Artificial Sequence: Synthetic polypeptide
DEVEIRTTNPVATEQYGSVSTNLQNFGDQS

SEQ ID NO: 22393 - protein, 31 aa, Artificial Sequence
  Description of Artificial Sequence: Synthetic polypeptide
DEVEIRTTNPVATEQYGSVSTNLQMNGDNGQ

SEQ ID NO: 22394 - protein, 31 aa, Artificial Sequence
  Description of Artificial Sequence: Synthetic polypeptide
DEEEIRTTNPVATEQYGSVSTDNLDQRQMMV

SEQ ID NO: 22395 - protein, 28 aa, Artificial Sequence
  Description of Artificial Sequence: Synthetic peptide
DEEEIRTTNPLATEQYGSVSYNIFRGSD

SEQ ID NO: 22396 - protein, 31 aa, Artificial Sequence
  Description of Artificial Sequence: Synthetic polypeptide
DEVEIRTTNPVATEQYGSVSTNLQMGGDNQK

SEQ ID NO: 22397 - protein, 31 aa, Artificial Sequence
  Description of Artificial Sequence: Synthetic polypeptide
DEVEIRTTNPVATEQYGSVSTNLQMGGDNEI

SEQ ID NO: 22398 - protein, 31 aa, Artificial Sequence
  Description of Artificial Sequence: Synthetic polypeptide
DEVEIRTTNPVATEQYGSVSTNLQQMGDNGD

SEQ ID NO: 22399 - protein, 31 aa, Artificial Sequence
  Description of Artificial Sequence: Synthetic polypeptide
DEVEIRTTNPVATEQYGSVSTNLQLGEGNED

SEQ ID NO: 22400 - protein, 28 aa, Artificial Sequence
  Description of Artificial Sequence: Synthetic peptide
DEEEIRTTNPLATERYGSVATNHGRGNA

SEQ ID NO: 22401 - protein, 30 aa, Artificial Sequence
  Description of Artificial Sequence: Synthetic polypeptide
DEEEIRTTNPVATEQYGSISLPNMLQRDNL

SEQ ID NO: 22402 - protein, 29 aa, Artificial Sequence
  Description of Artificial Sequence: Synthetic peptide
SEEEIRTTNPVATECWGSVSENEQRGENR

SEQ ID NO: 22403 - protein, 31 aa, Artificial Sequence
  Description of Artificial Sequence: Synthetic polypeptide
DEEEIRTTNPVATEQYGSVSTDNLDPGNNIQ

SEQ ID NO: 22404 - protein, 31 aa, Artificial Sequence
  Description of Artificial Sequence: Synthetic polypeptide
DEEEIRTTNPVATEQYGSVSTDNIQGEGNNS

SEQ ID NO: 22405 - protein, 28 aa, Artificial Sequence
  Description of Artificial Sequence: Synthetic peptide
AENEIACTNPVATEQYGEVSENLQRGNR

SEQ ID NO: 22406 - protein, 30 aa, Artificial Sequence
  Description of Artificial Sequence: Synthetic polypeptide
DEDEIGTTNPVATEQYGSVATNLERGNDRD

SEQ ID NO: 22407 - protein, 30 aa, Artificial Sequence
  Description of Artificial Sequence: Synthetic polypeptide
DEDEIGTTNPVAYEQYGSVSTNLQQRGNED

SEQ ID NO: 22408 - protein, 31 aa, Artificial Sequence
  Description of Artificial Sequence: Synthetic polypeptide
DEVEIRTTNPVATEQYGSVSTNLQIGGGNDA

SEQ ID NO: 22409 - protein, 28 aa, Artificial Sequence
  Description of Artificial Sequence: Synthetic peptide
AENEIACTNPVATEQYGEVSTNLQRGGR

SEQ ID NO: 22410 - protein, 30 aa, Artificial Sequence
  Description of Artificial Sequence: Synthetic polypeptide
DEVEIRTTNPVATEQYGSVSTNLQHQDGES

SEQ ID NO: 22411 - protein, 30 aa, Artificial Sequence
  Description of Artificial Sequence: Synthetic polypeptide
DEVEIRTTNPVATEQYGSVSTNLQHFGEQP

SEQ ID NO: 22412 - protein, 31 aa, Artificial Sequence
  Description of Artificial Sequence: Synthetic polypeptide
DEEEIRTTNPVATEQYGSVSTDNLDQQYDER

SEQ ID NO: 22413 - protein, 32 aa, Artificial Sequence
  Description of Artificial Sequence: Synthetic polypeptide
DEEEIRTTNPVATEQYGCVCSTYMLNQRGSNR

SEQ ID NO: 22414 - protein, 31 aa, Artificial Sequence
  Description of Artificial Sequence: Synthetic polypeptide
AEEEIRTTNPVATEQYGSVSTTNLQSQGNDT

SEQ ID NO: 22415 - protein, 31 aa, Artificial Sequence
  Description of Artificial Sequence: Synthetic polypeptide
SEEEIRTTNPVATEAYGSVSNTNLQGRGDQR

SEQ ID NO: 22416 - protein, 29 aa, Artificial Sequence
  Description of Artificial Sequence: Synthetic peptide
DEEEIRTTNPVATEQYGSVSTNLTNISDD

SEQ ID NO: 22417 - protein, 32 aa, Artificial Sequence
  Description of Artificial Sequence: Synthetic polypeptide
DEEEIRTTNPVATEQYGSVSTDNLQEGNGNFQ

SEQ ID NO: 22418 - protein, 31 aa, Artificial Sequence
  Description of Artificial Sequence: Synthetic polypeptide
DEEEIRTTNPVATEQYGSVSTNLTQEGPLAP

SEQ ID NO: 22419 - protein, 32 aa, Artificial Sequence
  Description of Artificial Sequence: Synthetic polypeptide
DEEEIRTTNPVATEQYGSVSTNLTQGFGSNQG

SEQ ID NO: 22420 - protein, 32 aa, Artificial Sequence
  Description of Artificial Sequence: Synthetic polypeptide
DEEEIRTTNPVATEQYGSISCLGNMLQRVGNR

SEQ ID NO: 22421 - protein, 31 aa, Artificial Sequence
  Description of Artificial Sequence: Synthetic polypeptide
AEEEIRTTNPVATEQYGSVSTTNLQYGANET

SEQ ID NO: 22422 - protein, 30 aa, Artificial Sequence
  Description of Artificial Sequence: Synthetic polypeptide
DEVEIRTTNPVATEQYGSVSTPDGQDGGNR

SEQ ID NO: 22423 - protein, 32 aa, Artificial Sequence
  Description of Artificial Sequence: Synthetic polypeptide
DEEEIRTTNPVATEQYGSVSTNLTQGQGGNND

SEQ ID NO: 22424 - protein, 30 aa, Artificial Sequence
  Description of Artificial Sequence: Synthetic polypeptide
DEVEIRTTNPVATEQYGSVSTNQGGQDGNY

SEQ ID NO: 22425 - protein, 30 aa, Artificial Sequence
  Description of Artificial Sequence: Synthetic polypeptide
DEVEIRTTNPVATEQYGSVSTNPQQGGNEK

SEQ ID NO: 22426 - protein, 32 aa, Artificial Sequence
  Description of Artificial Sequence: Synthetic polypeptide
DEEEIRTTNPVATEQYGSVSTNLTQPPGNEGD

SEQ ID NO: 22427 - protein, 30 aa, Artificial Sequence
  Description of Artificial Sequence: Synthetic polypeptide
AEEEIRTTNPVATEQYGSVSTTNLQVNGTE

SEQ ID NO: 22428 - protein, 31 aa, Artificial Sequence
  Description of Artificial Sequence: Synthetic polypeptide
AEEEIRTTNPVATEQYGSVSTTNLQTEGNEE

SEQ ID NO: 22429 - protein, 32 aa, Artificial Sequence
  Description of Artificial Sequence: Synthetic polypeptide
DEEEIRTTNPVATEQYGSVSTDNLQEEGGNNQ

SEQ ID NO: 22430 - protein, 31 aa, Artificial Sequence
  Description of Artificial Sequence: Synthetic polypeptide
AEEEIRTTNPVATEQYGSVSTTNLQVIGNNN

SEQ ID NO: 22431 - protein, 32 aa, Artificial Sequence
  Description of Artificial Sequence: Synthetic polypeptide
DEEEIRTTNPVATEQYGSVSTDNLQAGGGNDT

SEQ ID NO: 22432 - protein, 30 aa, Artificial Sequence
  Description of Artificial Sequence: Synthetic polypeptide
DEEEIRTTNPVATEQYGSVSTDNLPQSVEI

SEQ ID NO: 22433 - protein, 30 aa, Artificial Sequence
  Description of Artificial Sequence: Synthetic polypeptide
DEVEIRTTNPVATEQYGSVSTNNDQEGNDE

SEQ ID NO: 22434 - protein, 30 aa, Artificial Sequence
  Description of Artificial Sequence: Synthetic polypeptide
AEEEIRTTNPVATEQYGSVSTTNLQTQGVT

SEQ ID NO: 22435 - protein, 32 aa, Artificial Sequence
  Description of Artificial Sequence: Synthetic polypeptide
DEEEIRTTNPVATEQYGSVSTDNLGQNQGNEQ

SEQ ID NO: 22436 - protein, 31 aa, Artificial Sequence
  Description of Artificial Sequence: Synthetic polypeptide
DEEEIRTTNPVATEQYGSVSTNLTQTSMPRA

SEQ ID NO: 22437 - protein, 31 aa, Artificial Sequence
  Description of Artificial Sequence: Synthetic polypeptide
AEEEIRTTNPVATEQYGSVSTTNLQTIGNVS

SEQ ID NO: 22438 - protein, 30 aa, Artificial Sequence
  Description of Artificial Sequence: Synthetic polypeptide
AEEEIRTTNPVATEQYGSVSTTNLQTIGEL

SEQ ID NO: 22439 - protein, 31 aa, Artificial Sequence
  Description of Artificial Sequence: Synthetic polypeptide
DEVEIRTTNPVATEQYGSVSTNLQSGGGNTQ

SEQ ID NO: 22440 - protein, 31 aa, Artificial Sequence
  Description of Artificial Sequence: Synthetic polypeptide
DEVEIRTTNPVATEQYGSVSTNLQSDGGNID

SEQ ID NO: 22441 - protein, 32 aa, Artificial Sequence
  Description of Artificial Sequence: Synthetic polypeptide
DEVEIRTTNPVATEQYGSVSTNLQRSGSNPGP

SEQ ID NO: 22442 - protein, 32 aa, Artificial Sequence
  Description of Artificial Sequence: Synthetic polypeptide
DEEEIRTTNPVATEQYGSVSTDNLQEEGGNES

SEQ ID NO: 22443 - protein, 32 aa, Artificial Sequence
  Description of Artificial Sequence: Synthetic polypeptide
DEEEIRTTNPVATEQYGSVSTDNLQEIGNNDS

SEQ ID NO: 22444 - protein, 30 aa, Artificial Sequence
  Description of Artificial Sequence: Synthetic polypeptide
SEEEIRTTNPVATECYGSVSTTNLQFGTQR

SEQ ID NO: 22445 - protein, 31 aa, Artificial Sequence
  Description of Artificial Sequence: Synthetic polypeptide
DEVEIRTTNPVATEQYGSVSTNLQGGTGNEQ

SEQ ID NO: 22446 - protein, 32 aa, Artificial Sequence
  Description of Artificial Sequence: Synthetic polypeptide
DEEEIRTTNPVATEQYGCVCSTTNELQFGSNR

SEQ ID NO: 22447 - protein, 30 aa, Artificial Sequence
  Description of Artificial Sequence: Synthetic polypeptide
DEVEIRTTNPVATEQYGSVSTNGEQNGNMD

SEQ ID NO: 22448 - protein, 29 aa, Artificial Sequence
  Description of Artificial Sequence: Synthetic peptide
DEECIRCTNPVATEQYGSVSWNIEQRGNL

SEQ ID NO: 22449 - protein, 31 aa, Artificial Sequence
  Description of Artificial Sequence: Synthetic polypeptide
AEEEIRTTNPVATEQYGSVSTTNLQQNQNER

SEQ ID NO: 22450 - protein, 32 aa, Artificial Sequence
  Description of Artificial Sequence: Synthetic polypeptide
DEVEIRTTNPVATEQYGSVSTNGDQERGGDNR

SEQ ID NO: 22451 - protein, 31 aa, Artificial Sequence
  Description of Artificial Sequence: Synthetic polypeptide
DEEEIRTTNPVATEQYGSVSTDNGLERFNDA

SEQ ID NO: 22452 - protein, 30 aa, Artificial Sequence
  Description of Artificial Sequence: Synthetic polypeptide
DEVEIRTTNPVATEQYGSVSTNEQGEHGND

SEQ ID NO: 22453 - protein, 31 aa, Artificial Sequence
  Description of Artificial Sequence: Synthetic polypeptide
DEEEIRTTNPVATEQYGSVSTNLVQEPNNTI

SEQ ID NO: 22454 - protein, 28 aa, Artificial Sequence
  Description of Artificial Sequence: Synthetic peptide
DEECIRCTNPVATEQYGSVSWNFQRGSG

SEQ ID NO: 22455 - protein, 30 aa, Artificial Sequence
  Description of Artificial Sequence: Synthetic polypeptide
AEEEIRTTNPVATEQYGSVSTTNLQQNGLG

SEQ ID NO: 22456 - protein, 30 aa, Artificial Sequence
  Description of Artificial Sequence: Synthetic polypeptide
AEEEIRTTNPVATEQYGSVSTTNLQQNENL

SEQ ID NO: 22457 - protein, 29 aa, Artificial Sequence
  Description of Artificial Sequence: Synthetic peptide
DEEEIRATNPTATEQYGGVSEMNLQQGNR

SEQ ID NO: 22458 - protein, 30 aa, Artificial Sequence
  Description of Artificial Sequence: Synthetic polypeptide
DEVEIRTTNPVATEQYGSVSTNGGQENGNK

SEQ ID NO: 22459 - protein, 28 aa, Artificial Sequence
  Description of Artificial Sequence: Synthetic peptide
SEEEIRTTNPVATEGYGCTSINLQRDNR

SEQ ID NO: 22460 - protein, 30 aa, Artificial Sequence
  Description of Artificial Sequence: Synthetic polypeptide
DEEEIRTTNPVATEQYGSISPTPNLLRGEE

SEQ ID NO: 22461 - protein, 28 aa, Artificial Sequence
  Description of Artificial Sequence: Synthetic peptide
DEEEIRTTNPMATEEYGSVATNHGRGNP

SEQ ID NO: 22462 - protein, 29 aa, Artificial Sequence
  Description of Artificial Sequence: Synthetic peptide
DEECIRCTNPVATEQYGSVSWNEQRNGNL

SEQ ID NO: 22463 - protein, 31 aa, Artificial Sequence
  Description of Artificial Sequence: Synthetic polypeptide
AEEEIRTTNPVATEQYGSVSTTNLQQIGNQE

SEQ ID NO: 22464 - protein, 29 aa, Artificial Sequence
  Description of Artificial Sequence: Synthetic peptide
DEEEIRTTNPMATEGYGSCSTNLSARGNT

SEQ ID NO: 22465 - protein, 28 aa, Artificial Sequence
  Description of Artificial Sequence: Synthetic peptide
DEEEIRTTNPMATEIYGSVCTNMGRGNA

SEQ ID NO: 22466 - protein, 28 aa, Artificial Sequence
  Description of Artificial Sequence: Synthetic peptide
DEEEIRTTNPMATEMYGSVATNDGRGNA

SEQ ID NO: 22467 - protein, 28 aa, Artificial Sequence
  Description of Artificial Sequence: Synthetic peptide
DEECIRCTNPVATEQYGSVSWNEQKGNA

SEQ ID NO: 22468 - protein, 30 aa, Artificial Sequence
  Description of Artificial Sequence: Synthetic polypeptide
DEVEIRTTNPVATEQYGSVSTGGQEGNGNR

SEQ ID NO: 22469 - protein, 30 aa, Artificial Sequence
  Description of Artificial Sequence: Synthetic polypeptide
DEVEIRTTNPVATEQYGSVSTGGNGQDGNV

SEQ ID NO: 22470 - protein, 32 aa, Artificial Sequence
  Description of Artificial Sequence: Synthetic polypeptide
DEEEIRTTNPVATEQYGSVSTDNELQGEMNER

SEQ ID NO: 22471 - protein, 31 aa, Artificial Sequence
  Description of Artificial Sequence: Synthetic polypeptide
DEEEIRTTNPVATEQYGSVSTDNDTQEMGNV

SEQ ID NO: 22472 - protein, 31 aa, Artificial Sequence
  Description of Artificial Sequence: Synthetic polypeptide
DEEEIRTTNPVATEQYGSVSTNLVQGVNNGN

SEQ ID NO: 22473 - protein, 29 aa, Artificial Sequence
  Description of Artificial Sequence: Synthetic peptide
DEECIRCTNPVATEQYGSVSWNVQRGGNQ

SEQ ID NO: 22474 - protein, 30 aa, Artificial Sequence
  Description of Artificial Sequence: Synthetic polypeptide
DEVEIRTTNPVATEQYGSVSTNGGQNGNNM

SEQ ID NO: 22475 - protein, 30 aa, Artificial Sequence
  Description of Artificial Sequence: Synthetic polypeptide
DEVEIRTTNPVATEQYGSVSTNGQGQNGNE

SEQ ID NO: 22476 - protein, 31 aa, Artificial Sequence
  Description of Artificial Sequence: Synthetic polypeptide
DEVEIRTTNPVATEQYGSVSTNLQGEGDNEK

SEQ ID NO: 22477 - protein, 29 aa, Artificial Sequence
  Description of Artificial Sequence: Synthetic peptide
DEECIRCTNPVATEQYGSVSWNTMQRGNL

SEQ ID NO: 22478 - protein, 30 aa, Artificial Sequence
  Description of Artificial Sequence: Synthetic polypeptide
DEVEIRTTNPVATEQYGSVSTNLQGDGEGA

SEQ ID NO: 22479 - protein, 31 aa, Artificial Sequence
  Description of Artificial Sequence: Synthetic polypeptide
DEVEIRTTNPVATEQYGSVSTNLQFNVGNMN

SEQ ID NO: 22480 - protein, 29 aa, Artificial Sequence
  Description of Artificial Sequence: Synthetic peptide
SEEEIRTTNPVATEEYGCWSINLQRGNQR

SEQ ID NO: 22481 - protein, 31 aa, Artificial Sequence
  Description of Artificial Sequence: Synthetic polypeptide
DEVEIRTTNPVATEQYGSVSTNLQFGDGNSK

SEQ ID NO: 22482 - protein, 30 aa, Artificial Sequence
  Description of Artificial Sequence: Synthetic polypeptide
SEEEIRTTNPVATEEYGSVSNTNLVRGDQR

SEQ ID NO: 22483 - protein, 30 aa, Artificial Sequence
  Description of Artificial Sequence: Synthetic polypeptide
SEEEIRTTNPVATEEYGSVSTDLQVGSNNR

SEQ ID NO: 22484 - protein, 31 aa, Artificial Sequence
  Description of Artificial Sequence: Synthetic polypeptide
DEVEIRTTNPVATEQYGSVSTNLQDGNGNVQ

SEQ ID NO: 22485 - protein, 31 aa, Artificial Sequence
  Description of Artificial Sequence: Synthetic polypeptide
DEVEIRTTNPVATEQYGSVSTNLQDGGGNAM

SEQ ID NO: 22486 - protein, 29 aa, Artificial Sequence
  Description of Artificial Sequence: Synthetic peptide
DEEEIRATNPVATEHYGSVSTNLQIDGDN

SEQ ID NO: 22487 - protein, 30 aa, Artificial Sequence
  Description of Artificial Sequence: Synthetic polypeptide
DEDEIRATNPVATEQYGSVSTNLQNGNDDS

SEQ ID NO: 22488 - protein, 31 aa, Artificial Sequence
  Description of Artificial Sequence: Synthetic polypeptide
DEEEIRTTNPVATEQYGSVSTNLVGVGNNEE

SEQ ID NO: 22489 - protein, 32 aa, Artificial Sequence
  Description of Artificial Sequence: Synthetic polypeptide
DEVEIRTTNPVATEQYGSVSTNLQDDNGNNTR

SEQ ID NO: 22490 - protein, 31 aa, Artificial Sequence
  Description of Artificial Sequence: Synthetic polypeptide
DEVEIRTTNPVATEQYGSVSTNLNQNGGNND

SEQ ID NO: 22491 - protein, 31 aa, Artificial Sequence
  Description of Artificial Sequence: Synthetic polypeptide
DEVEIRTTNPVATEQYGSVSTNLNGDGNDGR

SEQ ID NO: 22492 - protein, 28 aa, Artificial Sequence
  Description of Artificial Sequence: Synthetic peptide
DEDEIRATNPVAYEQYGSVATNLTRGDR

SEQ ID NO: 22493 - protein, 31 aa, Artificial Sequence
  Description of Artificial Sequence: Synthetic polypeptide
AEEEIRTTNPVATEQYGSVSTTNLQQQGNQG

SEQ ID NO: 22494 - protein, 28 aa, Artificial Sequence
  Description of Artificial Sequence: Synthetic peptide
DEECIRCTNPVATEQYGSVSWNNQRNNL

SEQ ID NO: 22495 - protein, 30 aa, Artificial Sequence
  Description of Artificial Sequence: Synthetic polypeptide
DEEEIRTTNPVATEQYGSISMNLQQQNGNH

SEQ ID NO: 22496 - protein, 31 aa, Artificial Sequence
  Description of Artificial Sequence: Synthetic polypeptide
DEVEIRTTNPVATEQYGSVSTNLEQNGNNDD

SEQ ID NO: 22497 - protein, 28 aa, Artificial Sequence
  Description of Artificial Sequence: Synthetic peptide
DEECIRCTNPVATEQYGSVSWNIQGGNQ

SEQ ID NO: 22498 - protein, 31 aa, Artificial Sequence
  Description of Artificial Sequence: Synthetic polypeptide
DEVEIRTTNPVATEQYGSVSTNLDGEDGNNR

SEQ ID NO: 22499 - protein, 29 aa, Artificial Sequence
  Description of Artificial Sequence: Synthetic peptide
SEEEIRTTNPVATEEYGSVSTNLNEGGNC

SEQ ID NO: 22500 - protein, 32 aa, Artificial Sequence
  Description of Artificial Sequence: Synthetic polypeptide
DEEEIRTTNPVATEQYGSISMTENLSQREGVR

SEQ ID NO: 22501 - protein, 30 aa, Artificial Sequence
  Description of Artificial Sequence: Synthetic polypeptide
DEEEIRATNPVATEAYGQVSVTNLSQGGNR

SEQ ID NO: 22502 - protein, 32 aa, Artificial Sequence
  Description of Artificial Sequence: Synthetic polypeptide
DEEEIRTTNPVATEQYGCVCSTVLNQRSGSNR

SEQ ID NO: 22503 - protein, 31 aa, Artificial Sequence
  Description of Artificial Sequence: Synthetic polypeptide
DEEEIRTTNPVATEQYGSVSTNLTMEQGQNL

SEQ ID NO: 22504 - protein, 32 aa, Artificial Sequence
  Description of Artificial Sequence: Synthetic polypeptide
DEEEIRTTNPVATEQYGSICSTNNLQRGSERF

SEQ ID NO: 22505 - protein, 33 aa, Artificial Sequence
  Description of Artificial Sequence: Synthetic polypeptide
DEEEIRTTNPVATEQYGSICSMTENLSQRIGNR

(The sequence listing continues in the following parts.)

What is claimed is:

1. A viral capsid polypeptide having a Levenshtein distance to SEQ ID NO: 2 of at least 2 and bearing a mutation relative to SEQ ID NO: 2 (WT AAV2) in a region corresponding to amino acids 561-588, wherein the mutation comprises an amino acid substitution at amino acid 587.

2. The viral capsid polypeptide of claim 1, which has a Levenshtein distance to SEQ ID NO: 2 of between 3 and 12.

3. The viral capsid polypeptide of claim 1, wherein the region corresponding to amino acids 561-588 comprises SEQ ID NO: 187, 246, 259, 978, 1730, 1767, 1983, 2049, 2072, 2100, or 2352.

4. The viral capsid polypeptide of claim 3, wherein the region corresponding to amino acids 561-588 comprises SEQ ID NO: 187.

5. The viral capsid polypeptide of claim 1, which has at least 98% sequence identity to SEQ ID NO: 2.

6. The viral capsid polypeptide of claim 1, wherein the region corresponding to amino acids 561-588 comprises a sequence selected from SEQ ID NO: 4-211,872 having an amino acid substitution at amino acid 587.

7. The viral capsid polypeptide of claim 6, which is an AAV capsid polypeptide.

8. The viral capsid polypeptide of claim 7, wherein the AAV capsid polypeptide is an AAV2 capsid polypeptide.

9. An AAV VP1 capsid polypeptide having a Levenshtein distance to SEQ ID NO: 2 of at least 2 and bearing a mutation in the region corresponding to amino acids 561-588 of SEQ ID NO: 2, wherein the mutation comprises an amino acid substitution at amino acid 587.

10. The AAV VP1 capsid polypeptide of claim 9, wherein the region corresponding to amino acids 561-588 of SEQ ID NO: 2 comprises a sequence selected from SEQ ID NO: 4-211,872 having an amino acid substitution at amino acid 587.

11. The AAV VP1 capsid polypeptide of claim 10, which is an AAV2 capsid polypeptide.

12. A viral capsid polypeptide comprising a region corresponding to the amino acid sequence of SEQ ID NO: 3 comprising a mutation relative to SEQ ID NO: 3, wherein the region comprises an amino acid substitution at position 587 corresponding to SEQ ID NO: 2 and is selected from SEQ ID NO: 4-211,872.

13. An engineered AAV vector having at least one capsid polypeptide comprising a capsid polypeptide of claim 1.

14. A method for delivering a payload, the method comprising contacting a cell with an engineered AAV vector of claim 13.

15. A method for administering a payload, the method comprising administering to a subject an engineered AAV vector of claim 13.

16. The method of claim 15, wherein the payload is selected from the group consisting of: a nucleic acid, a polypeptide, an inhibitory RNA, an antibody or antibody reagent, an oligonucleotide, and a miRNA.

17. A nucleic acid encoding the capsid polypeptide of claim 1.

18. A viral particle comprising a capsid polypeptide of claim 1.

19. A method for delivering a payload, the method comprising contacting a cell with a viral particle of claim 18.

20. A method for administering a payload, the method comprising administering to a subject a viral particle of claim 18.

21. The method of claim 20, wherein the payload is selected from the group consisting of: a nucleic acid, a polypeptide, an inhibitory RNA, an antibody or antibody reagent, an oligonucleotide, and a miRNA.

\* \* \* \* \*